(12) United States Patent
Deng et al.

(10) Patent No.: US 10,570,408 B2
(45) Date of Patent: Feb. 25, 2020

(54) TRANSGENIC PLANTS WITH ENHANCED AGRONOMIC TRAITS

(71) Applicant: Monsanto Technology LLC, St. Louis, MO (US)

(72) Inventors: Molian Deng, Grover, MO (US); Zhidong Xie, Maryland Heights, MO (US)

(73) Assignee: Monsanto Technology LLC, St. Louis, MO (US)

( * ) Notice: Subject to any disclaimer, the term of this patent is extended or adjusted under 35 U.S.C. 154(b) by 0 days.

(21) Appl. No.: 15/732,622

(22) Filed: Dec. 5, 2017

(65) Prior Publication Data

US 2018/0245095 A1    Aug. 30, 2018

Related U.S. Application Data

(63) Continuation of application No. 14/998,728, filed on Feb. 8, 2016, now abandoned, which is a continuation of application No. 13/815,411, filed on Feb. 27, 2013, now abandoned, which is a continuation of application No. 12/218,251, filed on Jul. 10, 2008, now abandoned.

(60) Provisional application No. 60/958,909, filed on Jul. 10, 2007.

(51) Int. Cl.
*C12N 15/82* (2006.01)
*A01H 1/02* (2006.01)
*C12Q 1/6895* (2018.01)

(52) U.S. Cl.
CPC ........... *C12N 15/8261* (2013.01); *A01H 1/02* (2013.01); *C12N 15/8241* (2013.01); *C12Q 1/6895* (2013.01); *C12Q 2600/13* (2013.01); *Y02A 40/146* (2018.01)

(58) Field of Classification Search
None
See application file for complete search history.

(56) References Cited

U.S. PATENT DOCUMENTS

| | | | |
|---|---|---|---|
| 7,033,806 B2 * | 4/2006 | Lagarias | C12N 9/001 435/189 |
| 2003/0204874 A1 | 10/2003 | Kim et al. | |
| 2003/0233670 A1 | 12/2003 | Edgerton et al. | |
| 2004/0034888 A1 | 2/2004 | Liu et al. | |
| 2006/0236419 A1 | 10/2006 | La Rosa et al. | |
| 2007/0277269 A1 | 11/2007 | Alexandrov et al. | |
| 2011/0265221 A1 | 10/2011 | Abad et al. | |
| 2013/0283461 A1 | 10/2013 | Abad et al. | |
| 2016/0230183 A1 | 8/2016 | Abad et al. | |

FOREIGN PATENT DOCUMENTS

| | | |
|---|---|---|
| JP | 2003-310071 | 11/2003 |
| WO | WO-0250289 A1 | 6/2002 |
| WO | WO-2006076423 A2 | 7/2006 |
| WO | WO-2008070179 A2 | 6/2008 |
| WO | WO-2009009142 A3 | 1/2009 |

OTHER PUBLICATIONS

Whisstock J.C. et al. Prediction of protein function from protein sequence and structure. Q Rev Biophys. Aug. 2003;36(3):307-40. Review. (Year: 2003).*
Hill M.A. et al. Functional analysis of conserved histidines in ADP-glucose pyrophosphorylase from *Escherichia coli*. Biochem Biophys Res Commun. Mar. 17, 1998;244(2):573-7. (Year: 1998).*
Rhoads D.M. et al. Regulation of the cyanide-resistant alternative oxidase of plant mitochondria. Identification of the cysteine residue involved in alpha-keto acid stimulation and intersubunit disulfide bond formation. J Biol Chem. Nov. 1998 (Year: 1998).*
"Alignment of SEQ ID No. 397 and four disclosed homologs", (Apr. 2, 2012), 1 pg.
"U.S. Appl. No. 12/218,251, Final Office Action dated Aug. 2, 2012", 19 pgs.
"U.S. Appl. No. 12/218,251, Non Final Office Action dated Dec. 1, 2011", 13 pgs.
"U.S. Appl. No. 12/218,251, Preliminary Amendment dated May 13, 2010", 9 pgs.
"U.S. Appl. No. 12/218,251, Response filed Apr. 2, 2012 to Non Final Office Action dated Dec. 1, 2011", 14 pgs.
"U.S. Appl. No. 12/218,251, Response filed Sep. 8, 2011 to Restriction Requirement dated Aug. 8, 2011", 10 pgs.
"U.S. Appl. No. 12/218,251, Restriction Requirement dated Aug. 8, 2011", 12 pgs.
"U.S. Appl. No. 12/218,251, Supplemental Preliminary Amendment dated Jun. 10, 2011", 20 pgs.
"U.S. Appl. No. 13/815,411, Final Office Action dated Nov. 6, 2015", 28 pgs.
"U.S. Appl. No. 13/815,411, Non Final Office Action dated Mar. 27, 2015", 25 pgs.
"U.S. Appl. No. 13/815,411, Preliminary Amendment filed Feb. 27, 2013", 9 pgs.

(Continued)

*Primary Examiner* — Cynthia E Collins

(74) *Attorney, Agent, or Firm* — Schwegman Lundberg & Woessner, P.A.

(57) ABSTRACT

This invention provides recombinant DNA constructs, transgenic plant nuclei and cells with such recombinant DNA construct for expression of proteins that are useful for imparting enhanced agronomic trait(s) to transgenic crop plants. This invention also provides transgenic plants and progeny seed comprising the transgenic plant cells where the plants are selected for having an enhanced trait selected from the group of traits consisting of enhanced water use efficiency, enhanced cold tolerance, increased yield, enhanced nitrogen use efficiency, enhanced seed protein and enhanced seed oil. Also disclosed are methods for manufacturing transgenic seed and plants with enhanced traits.

10 Claims, 7 Drawing Sheets

Specification includes a Sequence Listing.

(56) References Cited

OTHER PUBLICATIONS

"U.S. Appl. No. 13/815,411, Response filed Jul. 27, 2015 to Non Final Office Action dated Mar. 27, 2015", 10 pgs.
"U.S. Appl. No. 13/815,411, Response filed Dec. 9, 2014 to Restriction Requirement dated Oct. 10, 2014", 10 pgs.
"U.S. Appl. No. 13/815,411, Restriction Requirement dated Oct. 10, 2014", 12 pgs.
"U.S. Appl. No. 13/815,411, Supplemental Preliminary Amendment filed Jun. 21, 2013", 4 pgs.
"U.S. Appl. No. 14/998,728, Non Final Office Action dated Sep. 5, 2017", 29 pgs.
"U.S. Appl. No. 14/998,728, Response filed Aug. 22, 2017 to Restriction Requirment dated Jun. 22, 2017", 9 pgs.
"U.S. Appl. No. 14/998,728, Restriction Requirement dated Jun. 22, 2017", 12 pgs.
"European Application Serial No. 08780144.5, Extended European Search Report dated Dec. 23, 2010", 8 pgs.
"European Application Serial No. 11174743.2, Extended European Search Report dated Mar. 14, 2012", 8 Pgs.
"European Application Serial No. 11174743.2, Partial European Search Report dated Nov. 17, 2011", 5 pgs.
"European Application Serial. No. 12186820.2, European Search Report dated Jun. 21, 2013", 8 pgs.
"European Application Serial No. 12186820.2, Examination Notification Art. 94(3) dated Apr. 7, 2014", 4 pgs.
"European Application Serial No. 12186820.2, Examination Notification Art. 94(3) dated Oct. 29, 2014", 5 pgs.
"European Application Serial No. 12186820.2, Office Action dated Oct. 17, 2012", 1 pg.
"European Application Serial No. 12186820.2, Partial European Search Report dated Feb. 21, 2013", 5 pgs.
"European Application Serial No. 12186820.2, Response Dec. 18, 2012 to Office Action dated Oct. 17, 2012", 5 pgs.
"European Application Serial No. 12186820.2, Response filed Aug. 18, 2014 to Examination Notification Art. 94(3) dated Apr. 7, 2014", 3 pgs.
"European Application Serial No. 12794105.2, Response filed Jan. 24, 2014 to Extended European Search Report dated Jun. 21, 2013", 8 pgs.
"GenBank: AAQ81632.1", (Oct. 5, 2004).
"International Application Serial No. PCT/US2008/008557, International Search Report dated Feb. 6, 2009", 3 pgs.
"International Application Serial No. PCT/US2008/008557, Written Opinion dated Feb. 6, 2009", 5 pgs.
"Phytochromobilin synthase [*Zea mays*]", NCBI, GenBank, Sequence Accession No. AAT66259.1, (Sep. 17, 2004), 1 pg.
Bouche, N., et al., "*Arabidopsis* gene knockout: phenotypes wanted", Curr Opin Plant Biol., 4(2), (2001), 111-117.
Chen, S. L., et al., "Identification of genes subject to positive selection in uropathogenic strains of *Escherichia coli*: A comparative genomics approach", Proc. Natl. Acad. Sci. USA, 103(15), (Apr. 2006), 5977-5982.
Devi, S. R., et al., "A Novel High-Throughput Genetic Screen for Stress-Responsive Mutants of *Arabidopsis thaliana* Reveals New Loci Involving Stress Responses", The Plant Journal, 47(4), (2006), 652-663.
Falcon-Perez, et al., "Functional domain analysis of the yeast ABC transporter Ycf1 p by site-directed mutagenesis", J Biol Chem. 274(33), (Aug. 13, 1999), 23584-23590.
Fu, Yan, et al., "Types and Frequencies of Sequencing Errors in Methyl-Filtered and High C0t Maize Genome Survey Sequences", Plant Physiology, vol. 135, (Aug. 2004), pp. 2040-2045.
Gelhaye, E., et al., "The thioredoxin h system of higher plants", Plant Physiol Biochem, 42(4), (Apr. 2004), 265-271.
Greene, E. A., et al., "Spectrum of Chemically Induced Mutations From a Large-Scale Reverse-Genetic Screen in *Arabidopsis*", Genetics, 164, (Jun. 2003), 731-740.
Hill, Margaret A, et al., "Functional Analysis of Conserved Histidines in ADP-Glucose Pyrophosphorylase from *Escherichia coli*", Biochem Biophys Res Commun., 244(2), (Mar. 17, 1998), 573-577.

Israelsson, et al., "Cloning and overproduction of gibberellin 3-oxidase in hybrid aspen trees", Effects on gibberellin homeostasis and development. Plant Physiol. 135(1), 221-30.
Lamberg, A., et al., "Site-directed mutagenesis of the alpha subunit of human prolyl 4-hydroxylase. Identification of three histidine residues critical for catalytic activity", J Biol Chem. 270(17), (Apr. 28, 1995), 9926-9931.
Lu, C., et al., "A High-Throughput Screen for Genes from Castor that Boost Hydroxy Fatty Acid Accumulation in Seed Oils of Transgenic *Arabidoopsis*", The Plant Journal, 45(5),, (2006), 847-856.
Matsushita, Akane, et al., "AGF1, an AT-Hook Protein, Is Necessary for the Negative Feedback of AtGA3ox1 Encoding GA 3-Oxidase", Plant Physiology, American Society of Plant Biologists, v. 143, Mar. 2007, www.plantphysiol.org., 1152-1162.
McDowall, K. J., et al., "The ams-1 and rne-3071 Temperature-Sensitive Mutations in the ams Gene Are in Close Proximity to Each Other and Cause Substitutions within a Domain That Resembles a Product of the *Escherichia coli* mre Locus", Journal of Bacteriology, 175(13), (Jul. 1993), 4245-4249.
Renard, Michelle, et al., "Identification and Characterization of Thioredoxin h Isoforms Differentially Expressed in Germinating Seeds of the Model Legume Medicago truncatula", Plant Physiology, vol. 155, (Mar. 2011), 1113-1126.
Rhoads, David M, et al., "Regulation of the Cyanide-resistant Alternative Oxidase of Plant Mitochondria", Identification of the cysteine residue involved in alpha-keto acid stimulation and intersubunit disulfide bond formation. J. Biol. Chem., 273(46), (Nov. 13, 1998), 30750-30756.
Sahrawy, M., et al., "Intron position as an evolutionary marker of thioredoxins and thioredoxin domains", J Mol Evol, 42(4), (Apr. 1996), 422-431.
Skandalis, A., et al., "Enzymatic Properties of Rat DNA Polymerase Beta Mutants Obtained by Randomized Mutagenesis", Nucleic Acids Res., 29(11), (2001), 2418-2426.
Stoop, A. A., et al., "High-Density Mutagenesis by Combined DNA Shuffling and Phage Display to Assign Essential Amino Acid Residues in Protein-Protein Interactions: Application to Study Structure-Function of Plasminogen Activation Inhibitor 1 (PAI-1)", J. Mol. Biol., 301(5), (2000), 1135-47.
Takahashi, Y., et al., "A High-Throughput Screen of Cell-Death-Inducing Factors in Nicotiana Benthamiana Identifies a Novel MAPKK that Mediates INF1-induced Cell Death Signaling and non-Host Resistance to Pseudomonas Cichorii", The Plant Journall, 9(6), (2007), 1030-1040.
Wen, Tsui-Jung, et al., "Analyses of Mutants of Three Genes That Influence Root Hair Development in *Zea mays* (Gramineae) Suggest That Root Hairs are Dispensable", American Journal of Botany, vol. 81, No. 7, (Jul. 1994), pp. 833-842.
Whisstock, J C, et al., "Prediction of protein function from protein sequence and structure", Q Rev Biophys. 36(3), (2003), 307-340.
Yeh, T. C., et al., "A Dual Role for the Kinase-like Domain of the Tyrosine Kinase Tyk2 in Interferon-alpha Signaling", Proc Natl Acad Sci., USA, 97(16), (2000), 8991-8996.
Kohchi, Takayuki, et al., "The *Arabidopsis* HY2 Gene Encodes Phytochromobilin Synthase, a Ferredoxin-Dependent Biliverdin Reductase", The Plant Cell, vol. 13, (Feb. 2001), 425-436.
Sawers, Ruairidh J.H., et al., "Elongated mesocotyl1, a Phytochrome-Deficient Mutant of Maize", Plant Physiology, vol. 130, (Sep. 2002), 155-163.
Sawers, Ruairidh J.H., et al., "The Elm1 (ZmHy2) Gene of Maize Encodes a Phytochromobilin Synthase", Plant Physiology, vol. 136, (Sep. 2004), 2771-2781.
U.S. Appl. No. 12/218,251, filed Jul. 10, 2008, Thioredoxin Expressing Transgenic Plants With Enhanced Agronomic Traits.
U.S. Appl. No. 13/815,411, filed Feb. 27, 2013, Transgenic Plants With Enhanced Agronomic Traits.
U.S. Appl. No. 14/998,728, filed Feb. 8, 2016, Transgenic Plants With Enhanced Agronomic Traits.

* cited by examiner

```
SEQ ID NO: homolog SEQ ID NOs
4210       ----------------------------------------------------------------
4213       ----------------------------------------------------------------
23796      ------------------------------MASNIMQRCNVFMSERVKLHAAMLALQFGYAGFHIVS
5323       ------------------------------MSP-----------VPERTKLHIAMAVFQTGYAGNHVIM
9197       ----------------------------------MVHGRLCNRDGWILTAMVVTEFSNVGVNTLV
22010      ----------------------------------MVHGRLCNRDGWILTAMVVTEFSNVGVNTLV
2187       ----------------------------------------------------------------
26922      ----------------------------MAGAVSLWRREAVFLTAMLAGETSIVGLSTLF
12208      ----------------------------MAGAVSLWRREAVFLTAMLAGETSIVGLSTLF
27336      ----------------------------MAGAVSLWRREAVFLTAMLAGETSIVGLSTLF
19871      -------------------------MPIMAGTASPWRREAVFLTAMLVVETSVVGISTLF
11517      ----------------------------------------------------------------
8202       -------------------------MPIMAGTASPWRREAVFLTAMLVVETSVVGISTLF
6010       ----------------------------------------------------------------
16802      ----------------------------MARTVSLWRREAVFLTAMLATETGVVGISTLF
301        ----------------------------------------------------------------
2040       -------------------------------MTRKYFQREVLPVTALVIMECANVGLNTLF
6920       ----------------------------------------------------------------
5087       ----------------------MKKEMI---------EEVVIVGGLVMVQFVYAGNSLLM
5965       MEGLLSYRSNVLRNIMREREKDRKKMLISEIFSENEDEEVVIIGGLVMVQFVYAGNSLLM
3372       -----------------------------MAAVAMADGGGKKPYVVAVAIQAINTGTFVVS
consensus  -----------------------------xxxxxxxxxxxxxxxxxxxxxxxxxxxxxxx
30526

----------------------------------------------------------------
----------------------------------------------------------------
RAALNMGVSKVVFPVYRNILALMLIGPCAYFLEKKERPALTLSFLIQFFLLALCGITGQS
RFALNLGVSKLIFPLYRNIIALSVLAPSAFFLEKKERPRMTTSLLIQFFLLGLVGITLNQ
KAATSKGLSPFVVLVYSYTFGSLLLLPLTFFSFRSRSLPPLTFSILCNMGILGLIASAFQ
KAATSKGLSPFVVLVYSYTFGSLLLLPLTFFSFR--------------------SAFQ
------------------------------------------------------MYV
KVATSKGLNIYPFLSYSYLLASLLLLPSLFFTN----------SASILSKIGLLGFLGSMYV
KVATSKGLNIYPFLSYSYLLASLLLLPSLFFTNRSRSLPPLSASILSKIGLLGFLGSMYV
KVATSKGLNIYPFLSYSYLLASLLLLPSLFFTNRSRSLPPLSASILSKIGLLGFLGSMYV
KFATSKGLNIYPFLGYSYLLASLLLLPSLFFTNRSSSLPPLSVSILSKIGLLGFLGSMYV
------------------------------------------------------MYV
KFATSKGLNIYPFLGYSYLLASLLLLPSLFFTNRSSSLPPLSVSILSKIGLLGFLGSMYV
------------------------------------------------------MYV
KVATSKGLNLYAFLGYSYLLASLLLLPSLFFTDRSRSLPPLSLSILSKIGLLGLLGSMYV
----------------------------------------------------------------
KAATLQGMGFHVFIVYSYGLAALLLLPSLFFSYRSRTLPPMNFSILYKVVLLGLIGCCSN
----------------------------------------------------------------
SYLMSLGLGPFTIVIFSTFATFLILSPFAILFERKQWPKELSARLIGKLVLISFAGVTLF
SYLMSLSLGPLTIVIFSTFATFLILSPFAILFERKQWPDELSPRLIGKLVLISFAGVTLF
KAAFDSGMYTYIFVFYRLAAATALLVPIALINCACRRSQSTTSTPAQAMSCRLLFKLFLC
xxxxxxxxxxxxxxxxxxxxxxxxxxxxxxxxxxxxxxxxxxxxxxxxxxxxxxxxxxxx ----------------------------------------------------------------
----------------------------------------------------------------
RIL------------------------------------------SLR-IVLHIPTFA
GFY------------------------------------------IFG-LDNTSPTFA
ILG------------------------------------------YNG-IKYSSPTLS
ILG------------------------------------------YNG-IKYSSPTLS
```

Fig. 1A

```
ITG--------------------------------------------GIG-IEYSNPTLA
ITG--------------------------------------------GIG-IEYSNPTLA
ITG--------------------------------------------GIG-IEYSNPTLA
ITG--------------------------------------------GIG-IEYSNPTLA
ITG--------------------------------------------YIG-IEYSSPTLA
ITG--------------------------------------------YIG-IEYSSPTLA
ITG--------------------------------------------YIG-IEYSSPTLA
ITG--------------------------------------------YIG-IEYSSPTLA
ITG--------------------------------------------YIG-IEYSSPTLA
------------------------------------------------------------
IMG--------------------------------------------YTG-INYSSPTLA
------------------------------------------------------------
QSL--------------------------------------------FLEGIRLTSPAMA
QTL--------------------------------------------FLEGIRLTSPAMA
AFLGSAGLTLQALTKFVKKSCQEVGGFTSLLSSSLLQGKAEHLHPQVYHASLKQTSATVA
xxx--------------------------------------------xxx-ixxxxptxa ------------------------------------------------------------
------------------------------------------------------------
SAIQNSVPAITFIMAAALRLEKVHISRRDGLAKIIGTVACVSGATIITLYKGPPITHIWR
SATENAVPAVSFLMAALLGIEKVELKRRDGVAKVVGTFVSVAGSLAITLYKGP---TIYQ
SAMSNVNPAFTFILAVVFRMENISLGKKSSVAKVLGTILSIIGALVVTLYHGP-------
SAMSNVNPAFTFILAVVFRMENISLGKKSSVAKVLGTILSIIGALVVTLYHGP-------
SAIGNIVPALTFILAVIFRMEKVSFKERSSVAKVMGTILSLIGAFVVIFYHGPRVFVASS
SAIGNIVPALTFILAVIFRMEKVSFKERSSVAKVMGTILSLIGAFVVIFYHGPRVFVASS
SAIGNIVPALTFILAVIFRMEKVSFKERSSVAKVMGTILSLIGAFVVIFYHGPRVFVASS
SAIGNIVPALTFILAVIFRMEKVSFKERSSVAKVMGTILSLIGAFVVIFYHGPRVFVASS
SAINNITPALTFILAIIFRMEKVSFKERSSLAKLMGTILSLIGALVVIFYHGPRVFLASS
SAINNITPALTFILAIIFRMEKVSFKERSSLAKLMGTILSLIGALVVIFYHGPRVFLASS
SAINNITPALTFILAIIFRMEKVSFKERSSLAKLMGTILSLIGALVVIFYHGPRVFLASS
SAINNITPALTFILAIIFRMEKVSFKERSSLAKLMGTILSLIGALVVIFYHGPRVFLASS
SAISNITPALTFILAIIFRMEKVSFKERSSVAKVMGTILSLIGALVVVLYHGPRVFVASS
--------------------MEKASFKEKSSVAKMVGTIVSLVGALVVVLYHGPRVFTPSS
SAISNLTPAFTFLLAILFRMESVSFKRTSSVARMLGTIVSIGGAFIVTLYNGPVVINMSP
--------------------MERIYWRHFSSQAKAIGTIVSMAGAFVVILYKGPPILKIHS
TAMPNLAPGLIFFIAWIVRLEKMNMKCVYSKLKILGTLLCVFGALTMSLMHSASIIQDEK
TAMPNLAPGLIFFIAWMVRLEKMDMKCVYSKLKILGTLLCVFGALTMSLMHSASIIQDEK
SAATNSMPVVTFLLALVLRMETIKLRRRSGLGKLAGVALCLAGVLVIAFYVGPSIRPLAH
saxxnxxpxxxfxxaxxxrmexxxxxxxssxakxxgtxxsxxgaxxxxxyxgpxxxxxxx -----------FLPDSKHVTASEDDNWILGCLLLLASSVFWSCWMIMQVPISSSCPDHVLST
-----------FLPDSKHVTASEDDNWILGCLLLLASSVFWSCWMIMQVPISSSCPDHVLST
PNLEVTASYFKAFQGNDLSAKSENWTLGCIYLLGNCLAWSGWIVLQAPVLKRYPARLSVT
PSLRSMD----QPTNAGEAEEQNKNWTLGCVCLMGHCLCWSSWIVLQSPLLKRYPARYSFV
-------------------MLMSSHSDWIIGGGLLALQYILVSVSYLVMAHTMGRYPSAVVVT
-------------------MLMSSHSDWIIGGGLLALQYILVSVSYLVMAHTMGRYPSAVVVT
P-----PYLNFRQLSPPLSSSKSDWLIGGAILTIQGIFVSVSFILQTHIMREYPEAFTVS
P-----PYLNFRQLSPPLSSSKSDWLIGGAILTIQGIFVSVSFILQTHIMREYPEAFTVS
P-----PYLNFRQLSPPLSSSKSDWLIGGAILTIQGIFVSVSFILQTHIMREYPEAFTVS
P-----PYLNFRQLSPPLSSSKSDWLIGGAILTIQGIFVSVSFILQAHIMREYPEAFTVS
P-------PYVNFRQFSPPLSSSNSDWLIGGALLTMQGIFVSVSFILQAHIMSVYPAAFRVS
P-------PYVNFRQFSPPLSSSNSDWLIGGALLTMQGIFVSVSFILQAHIMSVYPAAFRVS
P-------PYVNFRQFSPPLSSSNSDWLIGGALLTMQGIFVSVSFILQAHIMSVYPAAFRVS
```

Fig. 1B

```
P-----PYVNFRQFSPPLSSSNSDWLIGGALLTMQGIFVSVSFILQAHIMSVYPAAFRVS
P-----PYINFRQLSPPLSSSNSDWLIGGALLTIRDIFVSVSFILQAKIMSTYPAAFTVS
P-----PFPQLRQLLLPLSSSNSDWIIGGCLLAIKDTLVPVAFILQAHIMKLYPAPFTVS
P-----S------ISLRSQSPNHDWIIGAAFLAVEYFMVPLWYIVQTQIMREYPSEFTVV
S------IS------YNTLQFSPNLNWILGGFLCAGDSLLSSMWYIYQVSVTKKYPAVIVIV
D---------------NASIFVFDRDRVVGCIYLLGAVFVLSTNVVLQASTLAEFPAPISLS
D---------------NASIFVFDRDRVVGCMYLLGAVFILSSNVVLQASTLAEFPAPISLS
HP------------VFAHKTQSVGNGAWIRGTFLLILSCTTWSLWITLQVPLLIEYPNKLMAT
x------xxxxxxxxxxxxxsxxxdwxxGxxxlxxxxxxxxsxxxxlqxxxxxxyPxxxxxx FWMCLFATIQSAMFALLKEP-DLQAWILPSPLQ-ISCSLYAG-IGIAVSFFIQSWCISER
FWMCLFATIQSAIFALLKEP-DLQAWILPSPLQ-ISCSLYAG-IGIAVSFFIQSWCISER
SFTCFFGVIQFLIIAAFFET-DLEHWKIHSGGE-LFTILYAGFVASGIAFSVQIWCIDRG
SYSCLFAVFQIVGISAYFER-DLESWKIKSGRE-MYALLYTGLVGSGMVFAIQIYVVERG
LVHNVCIAVVCAFVSLLAEKDNPKAWVIRFDIT-LITVVATGILNSGYY-VIHTWAVSHK
LVHNVCIAVVCAFVSLLAEKDNPKAWVIRFDIT-LITVVATGILNSGYY-VIHTWAVSHK
ILYILCISIVTSMIGLVVEKNNPSIWIIHFDIT-LFTIVTTGIITSVYY-VIHSWAIRHK
ILYILCISIVTSMIGLVVEKNNPSIWIIHFDIT-LFTIVTTGIITSVYY-VIHSWAIRHK
ILYILCISIVTSMIGLVVEKNNPSIWIIHFDIT-LFTIVTTGIITSVYY-VIHSWAIRHK
ILYILCISIVTSMIGLVVEKNNPSIWIIHFDIT-LFTIVTTGIITSVYY-VIHSWAIRHK
FLYTVCVSIVTSTIGLVVEKNNPSVWIIHFDIT-LITIVTMAIVTSVYY-VIHSWTVRHK
FLYTVCVSIVTSTIGLVVEKNNPSVWIIHFDIT-LITIVTMAIVTSVYY-VIHSWTVRHK
FLYTVCVSIVTSTIGLVVEKNNPSVWIIHFDIT-LITIVTMAIVTSVYY-VIHSWTVRHK
FLYTVCVSIVTSTIGLVVEKNNPSVWIIHFDIT-LITIVTMAIVTSVYY-VIHSWTVRHK
FLYIVSVSIVTSMIGLVVEKNNPSVWIIRFDIT-LITIVTMAIITSVYY-VIHSWTVRHK
FFYFLIASILTSLIGIVAEKNNPSIWIIHFDIT-LVCIVVGGIFNPGYY-AIHLWAVRNK
CYYSFGVSFWTGLATLFTEGSDLSAWKIKPNIA-LVSIVCSGLFGSCINNTIHTWALRIK
FFQVVFITIQTGVYALIVVR-DPSAWELKLDMG-LIVILYQAVAAIGIRYFLQTWSVQRA
AITALIGVLITMLVQLLQNQSGKVLTRSLISIGNLVGFSLLGGMVSGACVSFNGWAMKKR
AITSLIGVVITTMLQLLQNPNTKVVTRSLISISNLVGFSLLGGMVSGACVSFNGWAMKKR
AMQCLFSALQSFVVAVVVEK-DFTKWKLGLDIG-----LLAAFLGTGALMYLQAWCAEMS
xxxxxxxxxxxxxxxlxxexxxxxxwxixxxix-lxxxxxxxxxxsxxxxxixxwxxxxx GPLYCAMFNPLATVITALVAATFLEEKLYVGSLVGAIGVTVGLYIVLWGKAKDFDG-----
GPLYCAMFNPLATVITALVAATFLEEKLYVGSLVGAIGVTVGLYIVLWGKAKDFDG-----
GPVFVAVYQPVQTIAVAIMASIILGEQFYLGGIFGAILIIIGLYLVLWGKSEEKR------
GPLFVSAYLPLQTLLAALLATFALGEHLYLGGLIGAILIICGLYLVVMGKSGRR------
GPVYLSMFKPLSILIAAVSTFIFLGESLYLGSVMGGILISIGFYMVLWGKA---------
GPVYLSMFKPLSILIAAVSTFIFLGESLYLGSVMGGILISIGFYMVLWGKA---------
RPLYLAIFKPLSILIAVVMGTIFLNDSLYLGCLIGGILITLGFYVVMWGKA---------
RPLYLAIFKPLSILIAVVMGTIFLNDSLYLGCLIGGILITLGFYVVMWGKA---------
RPLYLAIFKPLSILIAVVMGTIFLNDSLYLGCLIGGILITLGFYVVMWGKA---------
GPLYLAIFKPLSILIAVVMGTIFLNDSLYLGCLIGGILITLGFYAVMWGKS---------
GPLYLAIFKPLSILIAVVMGAIFLNDSLYLGWY-------------------
GPLYLAIFKPLSILIAVVMGAIFLNDSLYLGWY-------------------
GPLYLAIFKPLSILIAVVMGAIFLNDSLYLGCLIGGILITLGFYAVMWGKA---------
GPLYLAIFKPLSILIAVVMGAIFLNDSLYLGCLIGGILITLGFYAVMWGKA---------
GPLYLAIFKPLSILIAVVMSAVFLNDSLYLGCLIGGLLITLGFYAVMWGKA---------
GPVYLAIFRPLSILIAVIMGAIFLGDSFYLGSLVGGILISLGFYTVMWGKA---------
GPLFVAMFKPLSIAIAVAMGVIFLHDSLYIGSLIGATVITTGFYTVMWGKAKEAAMVEDD
GPLFCAMFKPIGIIFTVFLGSIFLGDDFYLGSLIGAVIIVVGFYAVQWGKA---------
GPVMVSMFSPFATVISVGFSVLTLGESICLGSVGGMALMFMGLYLVLWAKG----------
GPVMVSMFSPIATVISVGLSVVTLGEPVRIGSVGGMALMFIGLYLVLWAKG----------

GPVFVVMWSPLAFIFTIFSSSFFLGEVVHLGSILGGILLVGGLYSVLWGKSNERKNMILP
```

Fig. 1C

```
gPxxxaxfxPlxxxixxxxxxxxfLxxxlylGxxxgxxlxxxgxyxvxwgkx---------

TKQELPQSNMVDDERSNRTDLEEPLLAEKSEYVAEIKMEG--------------------
TKQELPQSNMVDDERSNRTDLEEPLLAEKSEYVAEIKMEG--------------------
LGLLQAKSSMVPENQPDNMDQSATLIINSSNGIKPNTSSSLTQPLLLDTSYKTVNIPSPS
-------------------------KLFANSNT---------------------------
-----KEDKVDIIGAIESSPSHNAPLLDNFKS----------------------------
-----KEDKVDIIGAIESSPSHNAPLLDNFKS----------------------------
----NEEKNKLL---SFSGKEKTPLLLSGKNDQI--------------------------
----NEEKNKLL---SFSGKEKTPLLLSGKNDQI--------------------------
----NEEKNKLL---SFSGKEKTPLLLSGKNDQI--------------------------
----NEEKDKLL---SFSGKEKTPLLLSGKNEQV--------------------------
------------------------------------------------------------
------------------------------------------------------------
-----NEEKDQLS----FSE-KEKTPLLLNRKNDQV------------------------
-----NEEKDQLS----FSE-KEKTPLLLNRKNDQV------------------------
------NEEKDQLL----LVSGKERTPLLLNG----------------------------
----KEGKTQFL---SLS--EETPLLDENIDDRI--------------------------
NKANNEDATNEADHDSPLASQKAPLLESYKNDEHV-------------------------
----SEEKVEKGIENLETQSNVVPLLQNKV------------------------------
-----KEGFSQIESFECEFDAKKPLLS---------------------------------
-----KEGFSQIDSFESEYDPKKPLLS---------------------------------
VMPEKSQGQGDGDGATTQEKHGETNLTSQV------------------------------
------xxxxxxxxxxxxxxxxxxxxpllxxxxxxxx----------------------

-------*
-----*
DEPQP*
-----*
-----*
-----*
-----*
-------*
-------*
----------*
-------*
-----*
-----*
-----*
-----*
-----*
-------*
----------*
-------*
----------*
-------*
-----*
```

Fig. 1D

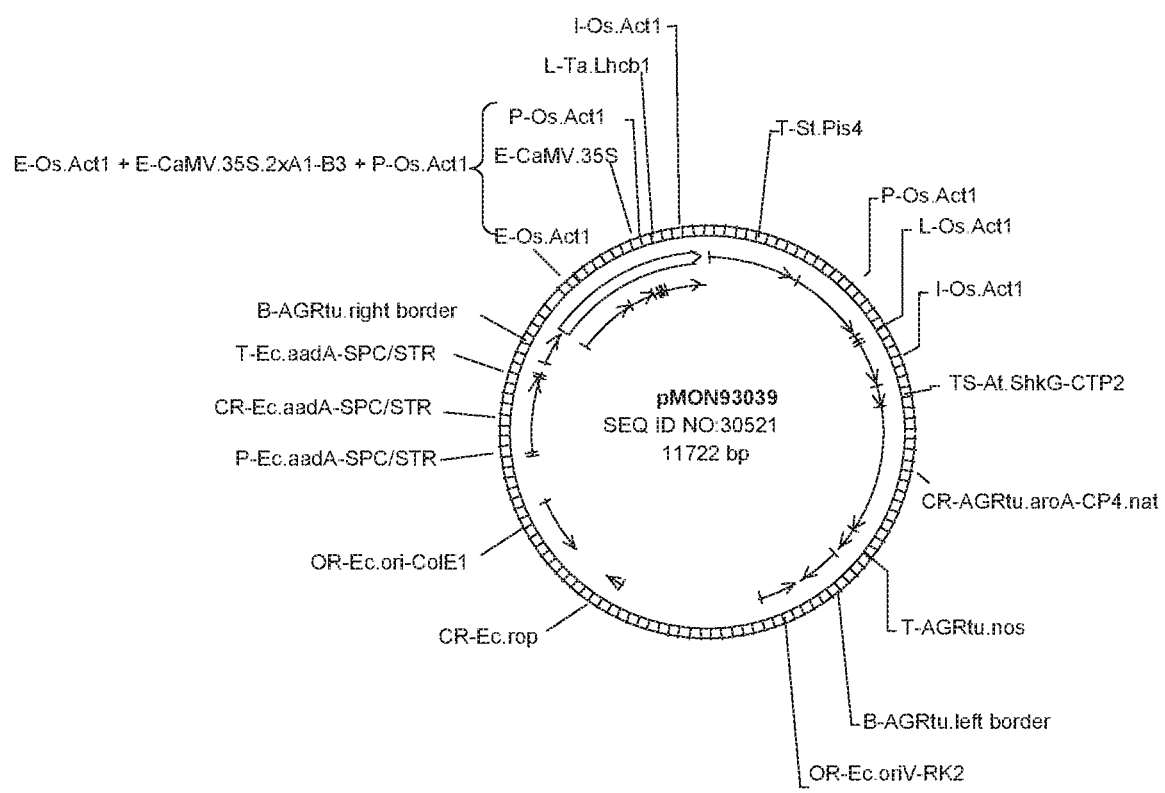
Fig. 2 Plasmid map of pMON93039

Fig. 3   Plasmid map of pMON82053
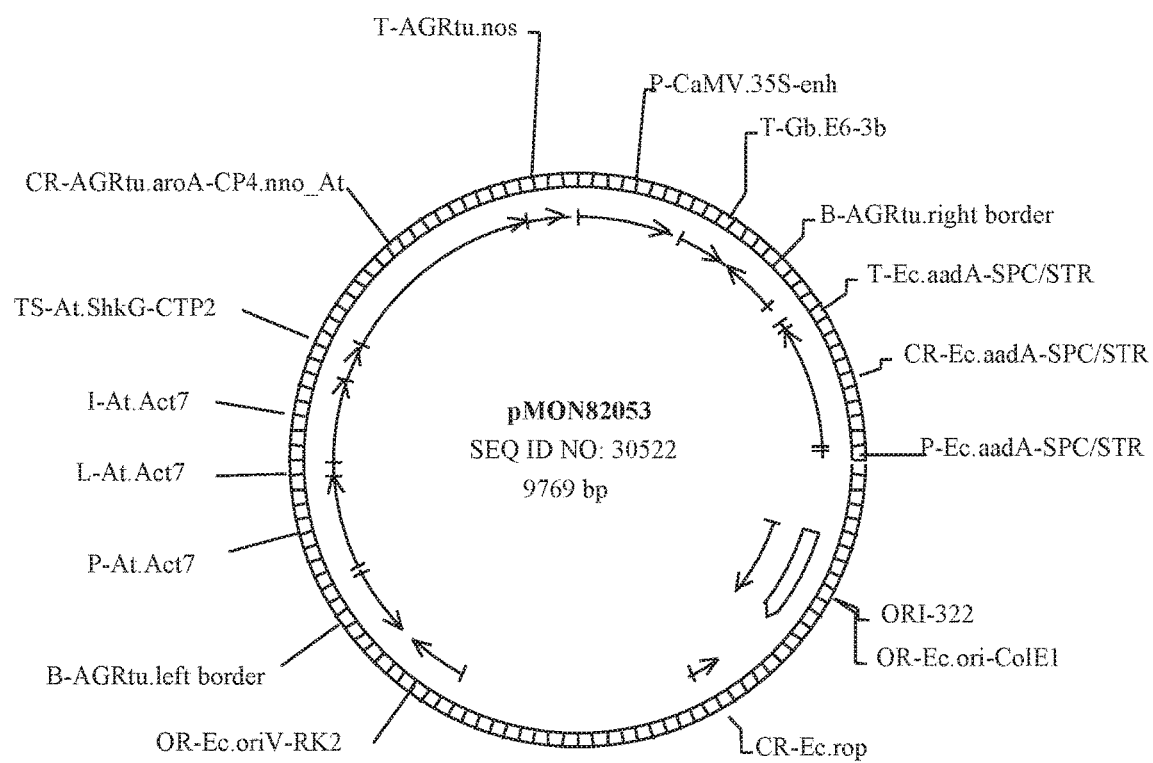

Fig. 4 Plasmid map of pMON99053
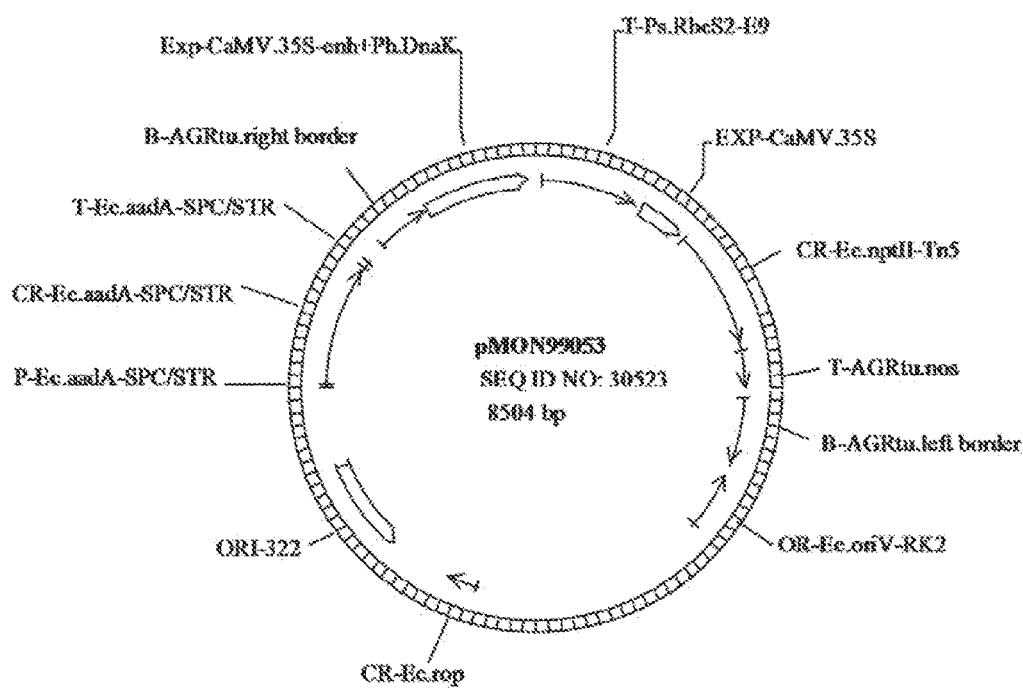

TRANSGENIC PLANTS WITH ENHANCED AGRONOMIC TRAITS

CROSS REFERENCE TO RELATED APPLICATIONS

This application is a continuation of U.S. application Ser. No. 14/998,728, filed Feb. 8, 2016, which application is a continuation of U.S. application Ser. No. 13/815,411, filed Feb. 27, 2013, which application is a continuation of U.S. application Ser. No. 12/218,251, filed Jul. 10, 2008, which application claims the benefit of priority under 35 USC § 119(e) of U.S. provisional application Ser. No. 60/958,909, filed Jul. 10, 2007, the contents of which are incorporated by reference in their entireties.

INCORPORATION OF SEQUENCE LISTING

Two copies of the sequence listing (Copy 1 Replacement Feb. 28, 2018 and Copy 2 Replacement Feb. 28, 2018) and a computer readable form (CRF) of the sequence listing, all on CD-Rs, each containing the text file named "3126.026US4.TXT", which is 105,787,392 bytes (measured in MS-WINDOWS), were created on Feb. 28, 2018 and are herein incorporated by reference.

INCORPORATION OF COMPUTER PROGRAM LISTING

Two copies of the Computer Program Listing (Copy 1 and Copy 2) and a computer readable form (CRF) containing folders hmmer-2.3.2 and 226pfamdir, all on CD-Rs are incorporated herein by reference in their entirety. Folder Hmmer-2.3.2 contains the source code and other associated file for implementing the HMMer software for Pfam analysis. Folder 226pfamDir contains 226 Pfam Hidden Markov Models. Both folders were created on CD-R on Dec. 5, 2017, having a total size of 19,449,856 bytes (measured in MS-WINDOWS).

FIELD OF THE INVENTION

Disclosed herein are recombinant DNA useful for providing enhanced traits to transgenic plants, seeds, pollen, plant cells and plant nucleui of such transgenic plants, methods of making and using such recombinant DNA, plants, seeds, pollen, plant cells and plant nuclei. Also disclosed are methods of producing hybrid seed comprising such recombinant DNA.

SUMMARY OF THE INVENTION

This invention employs recombinant DNA for expression of proteins that are useful for imparting enhanced agronomic traits to the transgenic plants. Recombinant DNA in this invention is provided in a construct comprising a promoter that is functional in plant cells and that is operably linked to a DNA segment that encodes a protein. In some embodiments of the invention, such protein defined by protein domains e.g. a "Pfam domain module" (as defined herein below) from the group of Pfam domain modules identified in Table 11. In other embodiments of the invention, e.g. where a Pfam domain module is not available, such protein is defined a consensus amino acid sequence of an encoded protein that is targeted for production e.g. a protein having amino acid sequence with at least 90% identity to a consensus amino acid sequence in the group of SEQ ID NO: 30526 through SEQ ID NO: 30550. In more specific embodiments of the invention the protein expressed in plant cells is a protein selected from the group of proteins identified in Table 2 and their homologs identified in Table 8.

Other aspects of the invention are specifically directed to plant cell nuclei and transgenic cells comprising the recombinant DNA construct of the invention, transgenic plants comprising a plurality of such plant cells, progeny transgenic seed, embryo and transgenic pollen from such plants. Such transgenic plants are selected from a population of transgenic plants regenerated from plant cells transformed with recombinant DNA construct and expressed the protein by screening transgenic plants in the population for an enhanced trait as compared to control plants that do not have the recombinant DNA construct, where the enhanced trait is selected from group of enhanced traits consisting of enhanced water use efficiency, enhanced cold tolerance, increased yield, enhanced nitrogen use efficiency, enhanced seed protein and enhanced seed oil.

In yet another aspect of the invention the plant cell nuclei, plant cells, transgenic plants, seeds, and pollen further comprise recombinant DNA expressing a protein that provides tolerance from exposure to an herbicide applied at levels that are lethal to a wild type plant cell. Such tolerance is especially useful not only as an advantageous trait in such plants but is also useful in a selection step in the methods of the invention. In aspects of the invention such herbicide is a glyphosate, dicamba, or glufosinate compound.

Yet other aspects of the invention provide transgenic plants which are homozygous for the recombinant DNA and transgenic seed of the invention from corn, soybean, cotton, canola, alfalfa, wheat or rice plants.

This invention also provides methods for manufacturing non-natural, transgenic seed that can be used to produce a crop of transgenic plants with an enhanced trait resulting from expression of stably-integrated, recombinant DNA construct provided by herein. More specifically the method comprises (a) screening a population of plants for an enhanced trait and a recombinant DNA construct of the invention, where individual plants in the population can exhibit the trait at a level less than, essentially the same as or greater than the level that the trait is exhibited in control plants which do not express the recombinant DNA, (b) selecting from the population one or more plants that exhibit the trait at a level greater than the level that said trait is exhibited in control plants, and (c) collecting seed from a selected plant. The method further comprises (d) verifying that the recombinant DNA construct is stably integrated in said selected plants, and (e) analyzing tissue of a selected plant to determine the production of a protein having the function of a protein selected from SEQ ID NO: 299 through SEQ ID NO: 30468. In one aspect of the invention the plants in the population further comprise DNA expressing a protein that provides tolerance to exposure to a herbicide applied at levels that are lethal to wild type plant cells and the selecting is affected by treating the population with the herbicide, e.g. a glyphosate, dicamba, or glufosinate compound. In another aspect of the invention the plants are selected by identifying plants with the enhanced trait. The methods are especially useful for manufacturing corn, soybean, cotton, canola, alfalfa, wheat or rice seed.

Another aspect of the invention provides a method of producing hybrid corn seed comprising acquiring hybrid corn seed from a herbicide tolerant corn plant which also has stably-integrated, recombinant DNA construct comprising a promoter that is (a) functional in plant cells and (b) is operably linked to DNA that encodes a protein provided by the invention. The methods further comprise producing corn plants from the hybrid corn seed, wherein a fraction of the plants produced from said hybrid corn seed is homozygous for said recombinant DNA, a fraction of the plants produced from said hybrid corn seed is hemizygous for the recombinant DNA construct, and a fraction of the plants produced from said hybrid corn seed has none of the recombinant DNA construct; selecting corn plants which are homozygous and hemizygous for the recombinant DNA construct by beating with an herbicide; collecting seed from herbicide-treated-surviving corn plants and planting the seed to produce further progeny corn plants; repeating the selecting and collecting steps at least once to produce an inbred corn line; and crossing the inbred corn line with a second corn line to produce hybrid seed.

BRIEF DESCRIPTION OF THE DRAWINGS

FIG. 1A-D is a consensus amino acid sequence of SEQ ID NO: 301 and its homologs.

FIGS. 2-4 are plasmid maps.

DETAILED DESCRIPTION OF THE INVENTION

In the attached sequence listing:

SEQ ID NO:1-298 are nucleotide sequences of the coding strand of DNA for "genes" used in the recombinant DNA imparting an enhanced trait in plant cells, i.e. each represents a coding sequence for a protein;

SEQ ID NO: 299-596 are amino acid sequences of the cognate protein of the "genes" with nucleotide coding sequences 1-298;

SEQ ID NO: 597-30468 are amino acid sequences of homologous proteins;

SEQ ID NO: 30469-30520 are nucleotide sequences of the elements in base plasmid vectors SEQ ID NO: 30521 is a nucleotide sequence of a base plasmid vector useful for corn transformation;

SEQ ID NO: 30522 is a nucleotide sequence of a base plasmid vector useful for soybean and canola transformation;

SEQ ID NO: 30523 is a nucleotide sequence of a base plasmid vector useful for cotton transformation;

SEQ ID NO: 30524 is a nucleotide sequence of a Sphas1 promoter from soybean;

SEQ ID NO: 30525 is a nucleotide sequence of a Sphas1 leader from soybean.

SEQ ID NO: 30526-30550 are consensus sequences.

Table 1 lists the protein SEQ ID NOs and their corresponding consensus SEQ ID NOs.

TABLE 1

| Gene ID | PEP SEQ ID NO | Consensus SEQ ID NO |
|---|---|---|
| PHE0006007__18714 | 301 | 30526 |
| PHE0006460__15962 | 453 | 30527 |
| PHE0006657__16192 | 334 | 30528 |
| PHE0006712__16273 | 415 | 30529 |
| PHE0006859__16873 | 376 | 30530 |
| PHE0006907__16797 | 594 | 30531 |
| PHE0006936__16828 | 348 | 30532 |
| PHE0006969__16871 | 428 | 30533 |
| PHE0007578__17852 | 446 | 30534 |
| PHE0007650__18175 | 358 | 30535 |
| PHE0008172__18471 | 397 | 30536 |
| PHE0008308__18841 | 392 | 30537 |
| PHE0008340__19155 | 410 | 30538 |

TABLE 1-continued

| Gene ID | PEP SEQ ID NO | Consensus SEQ ID NO |
|---|---|---|
| PHE0008422__18842 | 412 | 30539 |
| PHE0008698__24421 | 364 | 30540 |
| PHE0010197__21429 | 569 | 30541 |
| PHE0010201__21433 | 576 | 30542 |
| PHE0010201__21768 | 574 | 30543 |
| PHE0010223__21491 | 545 | 30544 |
| PHE0010397__21762 | 538 | 30545 |
| PHE0010398__21763 | 539 | 30546 |
| PHE0010615__22400 | 510 | 30547 |
| PHE0010838__22702 | 575 | 30548 |
| PHE0011447__23660 | 586 | 30549 |
| PHE0012170__24424 | 572 | 30550 |

As used herein a "plant cell" means a plant cell that is transformed with stably-integrated, non-natural, recombinant DNA construct, e.g. by *Agrobacterium*-mediated transformation or by bombardment using microparticles coated with recombinant DNA construct or other means. A plant cell of this invention can be an originally-transformed plant cell that exists as a microorganism or as a progeny plant cell that is regenerated into differentiated tissue, e.g. into a transgenic plant with stably-integrated, non-natural recombinant DNA, or seed or pollen derived from a progeny transgenic plant.

As used herein a "transgenic plant" means a plant whose genome has been altered by the stable integration of recombinant DNA construct. A transgenic plant includes a plant regenerated from an originally-transformed plant cell and progeny transgenic plants from later generations or crosses of a transformed plant.

As used herein "recombinant DNA" means DNA which has been a genetically engineered and constructed outside of a cell including DNA containing naturally occurring DNA or cDNA or synthetic DNA.

As used herein "consensus sequence" means an artificial sequence of amino acids in a conserved region of an alignment of amino acid sequences of homologous proteins, e.g. as determined by a CLUSTALW alignment of amino acid sequence of homolog proteins.

As used herein a "homolog" means a protein in a group of proteins that perform the same biological function, e.g. proteins that belong to the same Pfam protein family and that provide a common enhanced trait in transgenic plants of this invention. Homologs are expressed by homologous genes. Homologous genes include naturally occurring alleles and artificially-created variants. Degeneracy of the genetic code provides the possibility to substitute at least one base of the protein encoding sequence of a gene with a different base without causing the amino acid sequence of the polypeptide produced from the gene to be changed. Hence, a polynucleotide useful in the present invention may have any base sequence that has been changed from SEQ ID NO:1 through SEQ ID NO: 298 substitution in accordance with degeneracy of the genetic code. Homologs are proteins that, when optimally aligned, have at least 60% identity, more preferably about 70% or higher, more preferably at least 80% and even more preferably at least 90% identity over the full length of a protein identified as being associated with imparting an enhanced trait when expressed in plant cells. Homologs include proteins with an amino acid sequence that has at least 90% identity to a consensus amino acid sequence of proteins and homologs disclosed herein.

Homologs are identified by comparison of amino acid sequence, e.g. manually or by use of a computer-based tool using known homology-based search algorithms such as those commonly known and referred to as BLAST, FASTA, and Smith-Waterman. A local sequence alignment program, e.g. BLAST, can be used to search a database of sequences to find similar sequences, and the summary Expectation value (E-value) used to measure the sequence base similarity. As a protein hit with the best E-value for a particular organism may not necessarily be an ortholog or the only ortholog, a reciprocal query is used in the present invention to filter hit sequences with significant E-values for ortholog identification. The reciprocal query entails search of the significant hits against a database of amino acid sequences from the base organism that are similar to the sequence of the query protein. A hit is a likely ortholog, when the reciprocal query's best hit is the query protein itself or a protein encoded by a duplicated gene after speciation. A further aspect of the invention comprises functional homolog proteins that differ in one or more amino acids from those of disclosed protein as the result of conservative amino acid substitutions, for example substitutions are among: acidic (negatively charged) amino acids such as aspartic acid and glutamic acid; basic (positively charged) amino acids such as arginine, histidine, and lysine; neutral polar amino acids such as glycine, serine, threonine, cysteine, tyrosine, asparagine, and glutamine; neutral nonpolar (hydrophobic) amino acids such as alanine, leucine, isoleucine, valine, proline, phenylalanine, tryptophan, and methionine; amino acids having aliphatic side chains such as glycine, alanine, valine, leucine, and isoleucine; amino acids having aliphatic-hydroxyl side chains such as serine and threonine; amino acids having amide-containing side chains such as asparagine and glutamine; amino acids having aromatic side chains such as phenylalanine, tyrosine, and tryptophan; amino acids having basic side chains such as lysine, arginine, and histidine; amino acids having sulfur-containing side chains such as cysteine and methionine; naturally conservative amino acids such as valine-leucine, valine-isoleucine, phenylalanine-tyrosine, lysine-arginine, alanine-valine, aspartic acid-glutamic acid, and asparagine-glutamine. A further aspect of the homologs encoded by DNA useful in the transgenic plants of the invention are those proteins that differ from a disclosed protein as the result of deletion or insertion of one or more amino acids in a native sequence.

"Percent identity" describes the extent to which the sequences of DNA or protein segments are invariant throughout a window of alignment of nucleotide or amino acid sequences. An "identity fraction" for a sequence aligned with a reference sequence is the number of identical components which are shared by the sequences, divided by a length of the window of alignment, wherein the length does not include gaps introduced by an alignment algorithm. "Percent identity" ("% identity") is the identity fraction times 100. The alignment algorithm is preferably a local alignment algorithm, such as BLASTp. As used herein, sequences are "aligned" when the alignment produced by BLASTp has a minimal e-value.

"Pfam" database is a large collection of multiple sequence alignments and hidden Markov models covering many common protein families, e.g. Pfam version 19.0 (December 2005) contains alignments and models for 8183 protein families and is based on the Swissprot 47.0 and SP-TrEMBL 30.0 protein sequence databases. See S. R. Eddy, "Profile Hidden Markov Models", *Bioinformatics* 14:755-763, 1998. The Pfam database is currently maintained and updated by the Pfam Consortium. The alignments represent some evolutionary conserved structure that has implications for the protein's function. Profile hidden Markov models (profile HMMs) built from the protein family alignments are useful for automatically recognizing that a new protein belongs to an existing protein family even if the homology by alignment appears to be low.

Protein domains are identified by querying the amino acid sequence of a protein against Hidden Markov Models which characterize protein family domains ("Pfam domains") using HMMER software, a current version of which is provided in the appended computer listing. A protein domain meeting the gathering cutoff for the alignment of a particular Pfam domain is considered to contain the Pfam domain.

A "Pfam domain module" is a representation of Pfam domains in a protein, in order from N terminus to C terminus. In a Pfam domain module individual Pfam domains are separated by double colons "::". The order and copy number of the Pfam domains from N to C terminus are attributes of a Pfam domain module. Although the copy number of repetitive domains is important, varying copy number often enables a similar function. Thus, a Pfam domain module with multiple copies of a domain should define an equivalent Pfam domain module with variance in the number of multiple copies. A Pfam domain module is not specific for distance between adjacent domains, but contemplates natural distances and variations in distance that provide equivalent function. The Pfam database contains both narrowly- and broadly-defined domains, leading to identification of overlapping domains on some proteins. A Pfam domain module is characterized by non-overlapping domains. Where there is overlap, the domain having a function that is more closely associated with the function of the protein (based on the E value of the Pfam match) is selected.

Once one DNA is identified as encoding a protein which imparts an enhanced trait when expressed in transgenic plants, other DNA encoding proteins with the same Pfam domain module are identified by querying the amino acid sequence of protein encoded by candidate DNA against the Hidden Markov Models which characterizes the Pfam domains using HMMER software. Candidate proteins meeting the same Pfam domain module are in the protein family and have cognate DNA that is useful in constructing recombinant DNA for the use in the plant cells of this invention. Hidden Markov Model databases for use with HMMER software in identifying DNA expressing protein with a common Pfam domain module for recombinant DNA in the plant cells of this invention are also included in the appended computer listing.

The HMMER software and Pfam databases are version 19.0 and were used to identify known domains in the proteins corresponding to amino acid sequence of SEQ ID NO: 299 through SEQ ID NO: 596. All DNA encoding proteins that have scores higher than the gathering cutoff disclosed in Table 14 by Pfam analysis disclosed herein can be used in recombinant DNA of the plant cells of this invention, e.g. for selecting transgenic plants having enhanced agronomic traits. The relevant Pfams modules for use in this invention, as more specifically disclosed below, are zf-CCCH, PALP, GAF::HisKA::HATPase_c, TPR_2::TPR_1::TPR_2::TPR_1::TPR_4::TPR_2::TPR_1, efhand::efhand, Spermine_synth, ELFV_dehydrog_N::ELFV_dehydrog, PFK, PAS_3::PAS_3::Pkinase, S1, GDC-P, SWIM, B12-binding::Radical_SAM, S1, LRR_1::LRR_1::LRR_1::LRR_1::LRR_1::LRR_1::LRR_1, Chloroa_b-bind, LRRNT_2::LRR_1::LRR_1::LRR_1::LRR_1::LRR_1::LRR_1::LRR_1::LRR_1::LRR_1::LRR_1::LRR_1::LRR_1::LRR_1::LRR_1::LRR_1::LRR_1::LRR_1::LRR_1::Pkinase, WD40::WD40, YABBY, Ldh_1_N::Ldh_1_C, Sina, Na_H_antiport_1, ParBc, YABBY, Histone, Fe_bilin_red, Tryp_alpha_amyl, Pyr_redox_2::Thioredoxin, E2F_TDP, CN_hydrolase, YDG_SRA::Pre-SET::SET, APC8::TPR_1::TPR_1::TPR_1, Ras, tRNA_anti::tRNA-synt_2, Auxin_inducible, PGI, S1, Chloroa_b-bind, Bac_globin, Glyco_hydro_17, MGS, Spermine_synth, LRRNT_2::LRR_1::LRR_1::LRR_1::LRR_1::LRR_1::Pkinase, Aa_trans, LRRNT_2::LRR_1::LRR_1::LRR_1::LRR_1::LRR_1::LRR_1::LRR_1::LRR_1::LRR_1::LRR_1::LRR_1::LRR_1::LRR_1::LRR_1::LRR_1::LRR_1::LRR_1::LRR_1::LRR_1::Pkinase_Tyr, Gln-synt_N::Gln-synt_C, SAP18, TPP_enzyme_N::TPP_enzyme_M::TPP_enzyme_C, zf-C3HC4, eIF-1a, RPE65, PBP, Pkinase, AA_permease, F-box::LRR_1::LRR_2, zf-CCCH::zf-CCCH, Lactamase_B::Flavodoxin_1::Flavin_Reduct, Bac_globin, DSPc, adh_short, Tim17, Oxidored_molyb::Mo-co_dimer::Cyt-b5::FAD_binding_6::NAD_binding_1, ubiquitin::ubiquitin::ubiquitin::ubiquitin, MBD, CXC::CXC, HSF_DNA-bind, Spermine_synth, AP2, Peptidase_S10, PALP, EIN3, Gln-synt_N::Gln-synt_C, 2OG-FeII_Oxy, Glyco_hydro_9, GDC-P, B3, PTPA, Acyltransferase, Isochorismatase, FMO-like, Molybdop_Fe4S4::Molybdopterin::Molydop_binding::Fer2_BFD, Lir1, Prismane, Fer2, DEAD::Helicase_C, Molybdop_Fe4S4::Molybdopterin::Molydop_binding::Fer2_BFD, KNOX1::KNOX2::ELK, Glyoxalase, Sad1_UNC, Bac_globin, VPS28, PP2C, Pkinase::efhand::efhand::efhand, LEA_3, Peptidase_S10, Pkinase, CBFD_N-FYB_HMF, Gln-synt_N::Gln-synt_C, Pyr_redox_2::Fer2_BFD::NIR_SIR_ferr:NIR_SIR, NUDIX::NUDIX, FAD_binding_3, GST_N::GST_C, SAM_decarbox, Acyltransferase, NTP_transferase, G-patch, 2OG-FeII_Oxy, Gln-synt_N::Gln-synt_C, AAA::Vps4_C, Histone, Pkinase, TPR_1, F-box::Kelch_1::Kelch_1, Spermine_synth, Bac_globin, Bac_globin, zf-UBR, Homeobox::HALZ, Whirly, NAD_binding_1, PTR2, EIN3, 4HBT, adh_short, 2OG-FeII_Oxy, P-II, Myb_DNA-binding::Myb_DNA-binding, DAGK_cat, AP2, MFS_1, Chloroa_b-bind, DUF716, zf-Dof, CCT, Homeobox::HALZ, Histone, 2OG-FeII_Oxy, Globin, Pyr_redox_2::Fer2_BFD::NIR_SIR_ferr:NIR_SIR, Whirly, PsbP, bZIP_1, LRRNT_2::LRR_1::LRR_1::LRR_1::LRR_1::LRR_1::LRR_1::LRR_1::LRR_1::LRR_1::LRR_1::LRR_1::LRR_1::LRR_1::LRR_1::LRR_1::LRR_1::LRR_1::Pkinase_Tyr, Phil, BURP, Sterol_desat, DSPc, SNF5, Acyltransferase, GATase_2::Asn_synthase, adh_short, Homeobox::START, Pkinase, ParBc, SOI1L, DNA_photolyase::FAD_binding_7, Pkinase_Tyr, NAD_Gly3P_dh_N::NAD_Gly3P_dh_C, Na_H_Exchanger, peroxidase, Oxidored_molyb::Mo-co_dimer::Cyt-b5::FAD_binding_6::NAD_binding_1, Hexokinase_1::Hexokinase_2, DUF716, S10_plectin, Thi4, p450, CCT, adh_short, PSI_PSAK, DUF640, Thioredoxin, Globin, Ank::Pkinase, DAGAT, RPE65, Ank::Pkinase, GSHPx, Gln-synt_N::Gln-synt_C, MtN3_slv::MtN3_slv, Allene_ox_cyc, IGPD, MBD, CorA, Response_reg, Histone, AAA, Ribosomal_L10e, Pkinase, DUF26::DUF26::Pkinase, p450, mTERF, AA_kinase, PBP, GUN4, Lactamase_B::Flavodoxin_1::Rubredoxin, C2, RRM_1::RRM_1, Histone, Alpha-amylase, HLH, Thioredoxin, Histone_HNS, Myb_DNA-binding::Myb_DNA-binding, Cytochrom_C552, AP2::AP2, MtN3_slv::MtN3_slv, SHMT, ParBc, Mit_rib_S27, Ribosomal_S2, KNOX1::KNOX2::ELK, MFS_1, Glyco_transf_5::Glycos_transf_1, Cellulase, Ribosomal_L10e, Spermine_synth, Glyco_hydro_2_N::Glyco_hydro_2::Glyco_hydro_2_C, TP_methylase, AP2::AP2, Histone, Response_reg::CCT, Histone_HNS, DUF1716, p450, GATA, Pkinase, Sugar_tr, Aa_trans, Pribosyltran, Ribosomal_L10e, HLH, PMSR, DnaJ::DnaJ_CXXCXGXG::DnaJ_C, DUF1005, Glyco_transf_5::Glycos_transf_1, Spermine_synth, S1::EIF_2_alpha, RGS, Na_sulph_symp, S1, MtN3_slv::MtN3_slv, Lactamase_B::Flavin_Reduct, LRRNT_2::LRR_1::LRR_1::LRR_1::LRR_1::LRR_1::LRR_1::LRR_1::LRR_1::LRR_1::LRR_1::LRR_1::LRR_1::LRR_1::LRR_1::LRR_1::LRR_1::LRR_1::LRR_1::LRR_1::Pkinase, Chloroa_b-bind, PTR2, Agglutinin, PLATZ, NPH3, Auxin_inducible, PTR2, GAF::HisKA::Response_reg, PsbQ, GSH_synth_ATP, GATase_2::Asn_synthase, PHP, FtsJ, DUF6::TPT, Proteasome, PsbW_2, Glyco_hydro_9, NAD_binding_2::6 PGD, S1::EIF_2_alpha, Homeobox::START::MEKHLA, S1, Isoamylase_N::Alpha-amylase, E2F_TDP, and Rieske::PaO, for which the databases are included in the appended computer listing.

As used herein "promoter" means regulatory DNA for initializing transcription. A "plant promoter" is a promoter capable of initiating transcription in plant cells whether or not its origin is a plant cell, e.g. is it well known that *Agrobacterium* promoters are functional in plant cells. Thus, plant promoters include promoter DNA obtained from plants, plant viruses and bacteria such as *Agrobacterium* and *Bradyrhizobium* bacteria. Examples of promoters under developmental control include promoters that preferentially initiate transcription in certain tissues, such as leaves, roots, or seeds. Such promoters are referred to as "tissue preferred". Promoters that initiate transcription only in certain tissues are referred to as "tissue specific". A "cell type" specific promoter primarily drives expression in certain cell types in one or more organs, for example, vascular cells in roots or leaves. An "inducible" or "repressible" promoter is a promoter which is under environmental control. Examples of environmental conditions that may effect transcription by inducible promoters include anaerobic conditions, or certain chemicals, or the presence of light. Tissue specific, tissue preferred, cell type specific, and inducible promoters constitute the class of "non-constitutive" promoters. A "constitutive" promoter is a promoter which is active under most conditions.

As used herein "operably linked" means the association of two or more DNA fragments in a DNA construct so that the function of one, e.g. protein-encoding DNA, is controlled by the other, e.g. a promoter.

As used herein "expressed" means produced, e.g. a protein is expressed in a plant cell when its cognate DNA is transcribed to mRNA that is translated to the protein.

As used herein a "control plant" means a plant that does not contain the recombinant DNA that expressed a protein that impart an enhanced trait. A control plant is to identify and select a transgenic plant that has an enhance trait. A suitable control plant can be a non-transgenic plant of the parental line used to generate a transgenic plant, i.e. devoid of recombinant DNA. A suitable control plant may in some cases be a progeny of a hemizygous transgenic plant line that is does not contain the recombinant DNA, known as a negative segregant.

As used herein an "enhanced trait" means a characteristic of a transgenic plant that includes, but is not limited to, an enhance agronomic trait characterized by enhanced plant morphology, physiology, growth and development, yield, nutritional enhancement, disease or pest resistance, or environmental or chemical tolerance. In more specific aspects of this invention enhanced trait is selected from group of enhanced traits consisting of enhanced water use efficiency, enhanced cold tolerance, increased yield, enhanced nitrogen use efficiency, enhanced seed protein and enhanced seed oil. In an important aspect of the invention the enhanced trait is enhanced yield including increased yield under non-stress conditions and increased yield under environmental stress conditions. Stress conditions may include, for example, drought, shade, fungal disease, viral disease, bacterial disease, insect infestation, nematode infestation, cold temperature exposure, heat exposure, osmotic stress, reduced nitrogen nutrient availability, reduced phosphorus nutrient availability and high plant density. "Yield" can be affected by many properties including without limitation, plant height, pod number, pod position on the plant, number of internodes, incidence of pod shatter, grain size, efficiency of nodulation and nitrogen fixation, efficiency of nutrient assimilation, resistance to biotic and abiotic stress, carbon assimilation, plant architecture, resistance to lodging, percent seed germination, seedling vigor, and juvenile traits. Yield can also be affected by efficiency of germination (including germination in stressed conditions), growth rate (including growth rate in stressed conditions), ear number, seed number per ear, seed size, composition of seed (starch, oil, protein) and characteristics of seed fill.

Increased yield of a transgenic plant of the present invention can be measured in a number of ways, including test weight, seed number per plant, seed weight, seed number per unit area (i.e. seeds, or weight of seeds, per acre), bushels per acre, tonnes per acre, tons per acre, kilo per hectare. For example, maize yield may be measured as production of shelled corn kernels per unit of production area, for example in bushels per acre or metric tons per hectare, often reported on a moisture adjusted basis, for example at 15.5 percent moisture. Increased yield may result from improved utilization of key biochemical compounds, such as nitrogen, phosphorous and carbohydrate, or from improved responses to environmental stresses, such as cold, heat, drought, salt, and attack by pests or pathogens. Recombinant DNA used in this invention can also be used to provide plants having improved growth and development, and ultimately increased yield, as the result of modified expression of plant growth regulators or modification of cell cycle or photosynthesis pathways. Also of interest is the generation of transgenic plants that demonstrate enhanced yield with respect to a seed component that may or may not correspond to an increase in overall plant yield. Such properties include enhancements in seed oil, seed molecules such as tocopherol, protein and starch, or oil particular oil components as may be manifest by an alterations in the ratios of seed components.

A subset of the nucleic molecules of this invention includes fragments of the disclosed recombinant DNA consisting of oligonucleotides of at least 15, preferably at least 16 or 17, more preferably at least 18 or 19, and even more preferably at least 20 or more, consecutive nucleotides. Such oligonucleotides are fragments of the larger molecules having a sequence selected from the group consisting of SEQ ID NO:1 through SEQ ID NO: 298, and find use, for example as probes and primers for detection of the polynucleotides of the present invention.

In some embodiments of the invention a constitutively active mutant, e.g. SEQ ID NO: 203, is constructed to achieve the desired effect. In other embodiments of the invention, a dominant negative gene is constructed to adversely affect the normal, wild-type gene product within the same cell.

DNA constructs are assembled using methods well known to persons of ordinary skill in the art and typically comprise a promoter operably linked to DNA, the expression of which provides the enhanced agronomic trait. Other construct components may include additional regulatory elements, such as 5' leaders and introns for enhancing transcription, 3' untranslated regions (such as polyadenylation signals and sites), DNA for transit or signal peptides.

Numerous promoters that are active in plant cells have been described in the literature. These include promoters present in plant genomes as well as promoters from other sources, including nopaline synthase (NOS) promoter and octopine synthase (OCS) promoters carried on tumor-inducing plasmids of *Agrobacterium tumefaciens* and the CaMV35S promoters from the cauliflower mosaic virus as disclosed in U.S. Pat. Nos. 5,164,316 and 5,322,938. Useful promoters derived from plant genes are found in U.S. Pat. No. 5,641,876, which discloses a rice actin promoter, U.S. Pat. No. 7,151,204, which discloses a maize chloroplast aldolase promoter and a maize aldolase (FDA) promoter, and U.S. Patent Application Publication 2003/0131377 A1, which discloses a maize nicotianamine synthase promoter, all of which are incorporated herein by reference. These and numerous other promoters that function in plant cells are known to those skilled in the art and available for use in recombinant polynucleotides of the present invention to provide for expression of desired genes in transgenic plant cells.

In other aspects of the invention, preferential expression in plant green tissues is desired. Promoters of interest for such uses include those from genes such as *Arabidopsis thaliana* ribulose-1,5-bisphosphate carboxylase (Rubisco) small subunit (Fischhoff et al. (1992) *Plant Mol Biol*. 20:81-93), aldolase and pyruvate orthophosphate dikinase (PPDK) (Taniguchi et al. (2000) *Plant Cell Physiol*. 41(1): 42-48).

Furthermore, the promoters may be altered to contain multiple "enhancer sequences" to assist in elevating gene expression. Such enhancers are known in the art. By including an enhancer sequence with such constructs, the expression of the selected protein may be enhanced. These enhancers often are found 5' to the start of transcription in a promoter that functions in eukaryotic cells, but can often be inserted upstream (5') or downstream (3') to the coding sequence. In some instances, these 5' enhancing elements are introns. Particularly useful as enhancers are the 5' introns of the rice actin 1 (see U.S. Pat. No. 5,641,876) and rice actin 2 genes, the maize alcohol dehydrogenase gene intron, the maize heat shock protein 70 gene intron (U.S. Pat. No. 5,593,874) and the maize shrunken 1 gene.

In other aspects of the invention, sufficient expression in plant seed tissues is desired to affect improvements in seed composition. Exemplary promoters for use for seed composition modification include promoters from seed genes such as napin (U.S. Pat. No. 5,420,034), maize L3 oleosin (U.S. Pat. No. 6,433,252), zein Z27 (Russell et al. (1997) *Transgenic Res*. 6(2):157-166), globulin 1 (Belanger et al (1991) *Genetics* 129:863-872), glutelin 1 (Russell (1997) supra), and peroxiredoxin antioxidant (Per1) (Stacy et al. (1996) *Plant Mol Biol*. 31(6):1205-1216).

Recombinant DNA constructs prepared in accordance with the invention will also generally include a 3' element that typically contains a polyadenylation signal and site. Well-known 3' elements include those from *Agrobacterium tumefaciens* genes such as nos 3', tml 3', tmr 3', tms 3', ocs 3', tr7 3', for example disclosed in U.S. Pat. No. 6,090,627, incorporated herein by reference; 3' elements from plant genes such as wheat (*Triticum aesevitum*) heat shock protein 17 (Hsp17 3'), a wheat ubiquitin gene, a wheat fructose-1, 6-biphosphatase gene, a rice glutelin gene, a rice lactate dehydrogenase gene and a rice beta-tubulin gene, all of which are disclosed in U.S. published patent application 2002/0192813 A1, incorporated herein by reference; and the pea (*Pisum sativum*) ribulose biphosphate carboxylase gene (rbs 3'), and 3' elements from the genes within the host plant.

Constructs and vectors may also include a transit peptide for targeting of a gene to a plant organelle, particularly to a chloroplast, leucoplast or other plastid organelle. For descriptions of the use of chloroplast transit peptides see U.S. Pat. Nos. 5,188,642 and 5,728,925, incorporated herein by reference. For description of the transit peptide region of an *Arabidopsis* EPSPS gene useful in the present invention, see Klee, H. J. et al (*MGG* (1987) 210:437-442).

Transgenic plants comprising or derived from plant cells of this invention transformed with recombinant DNA construct can be further enhanced with stacked traits, e.g. a crop plant having an enhanced trait resulting from expression of DNA disclosed herein in combination with herbicide and/or pest resistance traits. For example, genes of the current invention can be stacked with other traits of agronomic interest, such as a trait providing herbicide resistance, or insect resistance, such as using a gene from *Bacillus thuringensis* to provide resistance against lepidopteran, coliopteran, homopteran, hemiopteran, and other insects. Herbicides for which transgenic plant tolerance has been demonstrated and the method of the present invention can be applied include, but are not limited to, glyphosate, dicamba, glufosinate, sulfonylurea, bromoxynil and norflurazon herbicides. Polynucleotide molecules encoding proteins involved in herbicide tolerance are well-known in the art and include, but are not limited to, a polynucleotide molecule encoding 5-enolpyruvylshikimate-3-phosphate synthase (EPSPS) disclosed in U.S. Pat. Nos. 5,094,945; 5,627,061; 5,633,435 and 6,040,497 for imparting glyphosate tolerance; polynucleotide molecules encoding a glyphosate oxidoreductase (GOX) disclosed in U.S. Pat. No. 5,463,175 and a glyphosate-N-acetyl transferase (GAT) disclosed in U.S. Patent Application publication 2003/0083480 A1 also for imparting glyphosate tolerance; dicamba monooxygenase disclosed in U.S. Patent Application publication 2003/0135879 A1 for imparting dicamba tolerance; a polynucleotide molecule encoding bromoxynil nitrilase (Bxn) disclosed in U.S. Pat. No. 4,810,648 for imparting bromoxynil tolerance; a polynucleotide molecule encoding phytoene desaturase (crtI) described in Misawa et al, (1993) *Plant J.* 4:833-840 and in Misawa et al, (1994) *Plant J.* 6:481-489 for norflurazon tolerance; a polynucleotide molecule encoding acetohydroxyacid synthase (AHAS, aka ALS) described in Sathasiivan et al. (1990) *Nucl. Acids Res.* 18:2188-2193 for imparting tolerance to sulfonylurea herbicides; polynucleotide molecules known as bar genes disclosed in DeBlock, et al. (1987) *EMBO J.* 6:2513-2519 for imparting glufosinate and bialaphos tolerance; polynucleotide molecules disclosed in U.S. Patent Application Publication 2003/010609 A1 for imparting N-amino methyl phosphonic acid tolerance; polynucleotide molecules disclosed in U.S. Pat. No. 6,107,549 for imparting pyridine herbicide resistance; molecules and methods for imparting tolerance to multiple herbicides such as glyphosate, atrazine, ALS inhibitors, isoxoflutole and glufosinate herbicides are disclosed in U.S. Pat. No. 6,376,754 and U.S. Patent Application Publication 2002/0112260, all of said U.S. patents and patent application Publications are incorporated herein by reference. Molecules and methods for imparting insect/nematode/virus resistance are disclosed in U.S. Pat. Nos. 5,250,515; 5,880,275; 6,506,599; 5,986,175 and U.S. Patent Application Publication 2003/0150017 A1, all of which are incorporated herein by reference.

Plant Cell Transformation Methods

Numerous methods for transforming chromosomes in a plant cell nucleus with recombinant DNA are known in the art and are used in methods of preparing a transgenic plant cell nucleus cell, and plant. Two effective methods for such transformation are *Agrobacterium*-mediated transformation and microprojectile bombardment. Microprojectile bombardment methods are illustrated in U.S. Pat. No. 5,015,580 (soybean); U.S. Pat. No. 5,550,318 (corn); U.S. Pat. No. 5,538,880 (corn); U.S. Pat. No. 5,914,451 (soybean); U.S. Pat. No. 6,160,208 (corn); U.S. Pat. No. 6,399,861 (corn); U.S. Pat. No. 6,153,812 (wheat) and U.S. Pat. No. 6,365,807 (rice) and *Agrobacterium*-mediated transformation is described in U.S. Pat. No. 5,159,135 (cotton); U.S. Pat. No. 5,824,877 (soybean); U.S. Pat. No. 5,463,174 (canola); U.S. Pat. No. 5,591,616 (corn); U.S. Pat. No. 6,384,301 (soybean), U.S. Pat. No. 7,026,528 (wheat) and U.S. Pat. No. 6,329,571 (rice), all of which are incorporated herein by reference. Transformation of plant material is practiced in tissue culture on a nutrient media, i.e. a mixture of nutrients that will allow cells to grow in vitro. Recipient cell targets include, but are not limited to, meristem cells, hypocotyls, calli, immature embryos and gametic cells such as microspores, pollen, sperm and egg cells. Callus may be initiated from tissue sources including, but not limited to, immature embryos, hypocotyls, seedling apical meristems, microspores and the like. Cells containing a transgenic nucleus are grown into transgenic plants.

In addition to direct transformation of a plant material with a recombinant DNA, a transgenic plant cell nucleus can be prepared by crossing a first plant having cells with a transgenic nucleus with recombinant DNA with a second plant lacking the trangenci nucleus. For example, recombinant DNA can be introduced into a nucleus from a first plant line that is amenable to transformation to transgenic nucleus in cells that are grown into a transgenic plant which can be crossed with a second plant line to introgress the recombinant DNA into the second plant line. A transgenic plant with recombinant DNA providing an enhanced trait, e.g. enhanced yield, can be crossed with transgenic plant line having other recombinant DNA that confers another trait, for example herbicide resistance or pest resistance, to produce progeny plants having recombinant DNA that confers both traits. Typically, in such breeding for combining traits the transgenic plant donating the additional trait is a male line and the transgenic plant carrying the base traits is the female line. The progeny of this cross will segregate such that some of the plants will carry the DNA for both parental traits and some will carry DNA for one parental trait; such plants can be identified by markers associated with parental recombinant DNA, e.g. marker identification by analysis for recombinant DNA or, in the case where a selectable marker is linked to the recombinant, by application of the selecting agent such as a herbicide for use with a herbicide tolerance marker, or by selection for the enhanced trait. Progeny plants carrying DNA for both parental traits can be crossed back into the female parent line multiple times, for example usually 6 to 8 generations, to produce a progeny plant with substantially the same genotype as one original transgenic parental line but for the recombinant DNA of the other transgenic parental line In the practice of transformation DNA is typically introduced into only a small percentage of target plant cells in any one transformation experiment. Marker genes are used to provide an efficient system for identification of those cells that are stably transformed by receiving and integrating a recombinant DNA molecule into their genomes. Preferred marker genes provide selective markers which confer resistance to a selective agent, such as an antibiotic or a herbicide. Any of the herbicides to which plants of this invention may be resistant are useful agents for selective markers. Potentially transformed cells are exposed to the selective agent. In the population of surviving cells will be those cells where, generally, the resistance-conferring gene is integrated and expressed at sufficient levels to permit cell survival. Cells may be tested further to confirm stable integration of the exogenous DNA. Commonly used selective marker genes include those conferring resistance to antibiotics such as kanamycin and paromomycin (nptII), hygromycin B (aph IV), spectinomycin (aadA) and gentamycin (aac3 and aacC4) or resistance to herbicides such as glufosinate (bar or pat), dicamba (DMO) and glyphosate (aroA or EPSPS). Examples of such selectable markers are illustrated in U.S. Pat. Nos. 5,550,318; 5,633,435; 5,780,708 and 6,118,047, all of which are incorporated herein by reference. Selectable markers which provide an ability to visually identify transformants can also be employed, for example, a gene expressing a colored or fluorescent protein such as a luciferase or green fluorescent protein (GFP) or a gene expressing a beta-glucuronidase or uidA gene (GUS) for which various chromogenic substrates are known.

Plant cells that survive exposure to the selective agent, or plant cells that have been scored positive in a screening assay, may be cultured in regeneration media and allowed to mature into plants. Developing plantlets regenerated from transformed plant cells can be transferred to plant growth mix, and hardened off, for example, in an environmentally controlled chamber at about 85% relative humidity, 600 ppm $CO_2$, and 25-250 microeinsteins $m^{-2}$ $s^{-1}$ of light, prior to transfer to a greenhouse or growth chamber for maturation. Plants are regenerated from about 6 weeks to 10 months after a transformant is identified, depending on the initial tissue, and plant species. Plants may be pollinated using conventional plant breeding methods known to those of skill in the art and seed produced, for example self-pollination is commonly used with transgenic corn. The regenerated transformed plant or its progeny seed or plants can be tested for expression of the recombinant DNA and selected for the presence of enhanced agronomic trait.

Transgenic Plants and Seeds

Transgenic plants derived from the plant cells of this invention are grown to generate transgenic plants having an enhanced trait as compared to a control plant and produce transgenic seed and pollen of this invention. Such transgenic plants with enhanced traits are identified by selection of transformed plants or progeny seed for the enhanced trait. For efficiency a selection method is designed to evaluate multiple transgenic plants (events) comprising the recombinant DNA, for example multiple plants from 2 to 20 or more transgenic events. Transgenic plants grown from transgenic seed provided herein have enhanced agronomic traits that contribute to increased yield or other trait that provides increased plant value, including, for example, improved seed quality. Of particular interest are plants having enhanced water use efficiency, enhanced cold tolerance, increased yield, enhanced nitrogen use efficiency, enhanced seed protein and enhanced seed oil.

Table 2 provides a list of protein encoding DNA ("genes") that are useful as DNA segment in a recombinant DNA construct for production of transgenic plants with enhanced agronomic trait, the elements of Table 2 are described by reference to:

"PEP SEQ ID NO" identifies an amino acid sequence from SEQ ID NO: 299 to 596.

"NUC SEQ ID NO" identifies a DNA sequence from SEQ ID NO:1 to 298.

"BV id" is a reference to the identifying number of base vectors in Table 3 used for construction of the transformation vectors of the recombinant DNA. Construction of plant transformation constructs is illustrated in Example 1.

"Gene Name" denotes a common name for protein encoded by the recombinant DNA.

"Annotation" refers to a description of the top hit protein obtained from an amino acid sequence query of each PEP SEQ ID NO to GenBank database of the National Center for Biotechnology Information (ncbi). More particularly, "gi" is the GenBank ID number for the top BLAST hit;

"% id" refers to the percentage of identically matched amino acid residues along the length of the portion of the sequences which is aligned by BLAST (–F T) between the sequence of interest provided herein and the hit sequence in GenBank.

TABLE 2

| NUC SEQ ID NO | PEP SEQ ID NO | Gene ID | BV ID | Gene Name | e-value | % id | GenBank ID | Annotation |
|---|---|---|---|---|---|---|---|---|
| 1 | 299 | PHE0007721_18998 | 21 | Corn Homeotic protein knotted-1 | 1.00E-152 | 77 | 123183 | gb|AAP76321.1| homeobox transcription factor KNOTTED1 [*Zea mays*] |
| 2 | 300 | PHE0007756_18009 | 33 | *Arabidopsis* 9-cis-epoxycarotenoid dioxygenase | 0 | 90 | 15231856 | dbj|BAB01336.1| 9-cis-epoxycarotenoid dioxygenase [*Arabidopsis thaliana*] |
| 3 | 301 | PHE0006007_18714 | 30 | *Arabidopsis* nodulin MtN21 family protein | 1.00E-105 | 86 | 79607902 | ref|NP_974371.2|unknown protein [*Arabidopsis thaliana*] |
| 4 | 302 | PHE0004988_15925 | 13 | *Arabidopsis* transport inhibitor response 1 | 0 | 100 | 18412567 | gb|AAN71945.1| transport inhibitor response TIR1, AtFBL1 protein [*Arabidopsis thaliana*] |
| 5 | 303 | PHE0007140_21771 | 30 | *Arabidopsis* nodulin MtN3 like protein-4 | 1.00E-121 | 92 | 18421965 | gb|AAM61405.1| MtN3 like [*Arabidopsis thaliana*] |
| 5 | 303 | PHE0007140_22049 | 13 | *Arabidopsis* nodulin MtN3 like protein-4 | 1.00E-121 | 92 | 18421965 | gb|AAM61405.1| MtN3 like [*Arabidopsis thaliana*] |
| 6 | 304 | PHE0006823_16403 | 13 | *Arabidopsis* class 2 non-symbiotic hemoglobin | 3.00E-85 | 100 | 15228313 | gb|AAM65188.1| Non symbiotic hemoglobin Hb2 [*Arabidopsis thaliana*] |
| 7 | 305 | PHE0007440_22555 | 18 | Corn putative GTP-binding protein Rab11 | 1.00E-107 | 91 | 115462975 | gb|AAS98506.1| GTP-binding protein Rab11 [*Oryza sativa* (japonica cultivar-group)] |
| 8 | 306 | PHE0000206_22432 | 9 | Corn CDPK kinase domain | 0 | 87 | 115450483 | sp|P53684|Calcium-dependent protein kinase, isoform 11 (CDPK 11) [*Oryza sativa* (japonica cultivar-group)] |
| 9 | 307 | PHE0000598_16824 | 9 | Corn B1 regulatory protein | 0 | 91 | 22195 | emb|CAA40544.1| regulatory protein [*Zea mays*] |
| 10 | 308 | PHE0007590_17883 | 8 | *E. coli* ribosomal protein S1 domain 3 | 7.00E-33 | 56 | 118740922 | ref|ZP_01588962.1| ribosomal protein S1 [*Enterobacter* sp. 638] |
| 11 | 309 | PHE0007588_17881 | 8 | *E. Coli* RNAse E S1 domain | 2.00E-45 | 98 | 52695516 | pdb|1SMX| the S1 domain of Rnase E from *E. Coli* (Native) |
| 12 | 310 | PHE0007592_17885 | 8 | Yeast pre-mRNA splicing factor RNA helicase S1 domain | 1.00E-40 | 98 | 6320850 | gb|AAB64546.1| pre-mRNA splicing factor RNA helicase [*Saccharomyces cerevisiae*] |
| 13 | 311 | PHE0007587_17880 | 8 | *E. coli* Polyribonucleotide nucleotidyltransferase | 7.00E-35 | 100 | 124525928 | ref|ZP_01697933.1| Polyribonucleotide nucleotidyltransferase [*Escherichia coli* B] |
| 14 | 312 | PHE0007624_17923 | 8 | *E. coli* translation initiation factor IF-1 | 8.00E-34 | 100 | 15800747 | ref|NP_286761.1| translation initiation factor IF-1 [*Escherichia coli* O157:H7 EDL933] |
| 15 | 313 | PHE0007591_17884 | 8 | *E. coli* ribosomal protein S1 domain 5 | 2.00E-20 | 51 | 118068082 | ref|ZP_01536336.1| ribosomal protein S1 [*Serratia proteamaculans* 568] |
| 16 | 314 | PHE0007623_17922 | 8 | *Arabidopsis* N-carbamoylputrescine amidohydrolase | 1.00E-172 | 100 | 18401429 | gb|AAM63266.1| putative nitrilase [*Arabidopsis thaliana*] |

TABLE 2-continued

| NUC SEQ ID NO | PEP SEQ ID NO | Gene ID | BV ID | Gene Name | e-value | % id | GenBank ID | Annotation |
|---|---|---|---|---|---|---|---|---|
| 17 | 315 | PHE0007583_17871 | 6 | Rice MtN3 homolog | 1.00E-130 | 100 | 125526770 | gb|EAY74884.1|hypothetical protein OsI_002731 [Oryza sativa (indica cultivar-group)] |
| 18 | 316 | PHE0006618_16146 | 13 | Corn putative ribosomal protein S10 | 4.00E-49 | 95 | 115442401 | dbj|BAB63622.1| putative 40S ribosomal protein S10 [Oryza sativa (japonica cultivar-group)] |
| 19 | 317 | PHE0006791_16374 | 9 | Arabidopsis GUN4_ARATH Tetrapyrrole-binding protein | 1.00E-120 | 83 | 15231674 | sp|Q9LX31|GUN4_ARATH Tetrapyrrole-binding protein, chloroplast precursor [Arabidopsis thaliana] |
| 20 | 318 | PHE0007620_17918 | 13 | Arabidopsis thylakoid ascorbate peroxidase | 0 | 96 | 15223971 | dbj|BAF01533.1| thylakoid-bound ascorbate peroxidase [Arabidopsis thaliana] |
| 21 | 319 | PHE0006659_16195 | 13 | Soy hypothetical protein | 1.00E-112 | 49 | 125540608 | gb|EAY87003.1|hypothetical protein OsI_008236 [Oryza sativa (indica cultivar-group)] |
| 22 | 320 | PHE0006662_16198 | 13 | Ralstonia metallidurans hypothetical protein | 1.00E-06 | 38 | 114582111 | ref|XP_001161638.1| hypothetical protein isoform 1 [Pan troglodytes] |
| 23 | 321 | PHE0006274_15867 | 13 | Corn Transcription factor E2Fb | 0 | 78 | 115487438 | gb|ABA96515.1| Transcription factor E2F[Oryza sativa (japonica cultivar-group)] |
| 24 | 322 | PHE0006637_16166 | 14 | Corn ABI1 homolog | 1.00E-145 | 78 | 115437928 | ref|NP_001043415.1 Os01g0583100 (Oryza sativa (japonica cultivar-group) |
| 25 | 323 | PHE0006926_16815 | 13 | Corn putative vacuolar protein sorting-associated protein | 1.00E-84 | 81 | 115440323 | dbj|BAB63580.1| putative vacuolar protein sorting 28 [Oryza sativa (japonica cultivar-group)] |
| 26 | 324 | PHE0006821_16402 | 13 | Corn 1-aminocyclopropane-1-carboxylate deaminase | 1.00E-176 | 79 | 115448975 | dbj|BAD16875.1| 1-aminocyclopropane-1-carboxylate deaminase [Oryza sativa (japonica cultivar-group)] |
| 27 | 325 | PHE0007687_18057 | 29 | Arabidopsis cytochrome P450 | 0 | 100 | 21536828 | gb|AAM61160.1| cytochrome P450 homolog (Arabidopsis thaliana) |
| 27 | 325 | PHE0007687_18200 | 13 | Arabidopsis cytochrome P450 | 0 | 100 | 21536828 | gb|AAM61160.1| cytochrome P450 homolog, [Arabidopsis thaliana] |
| 28 | 326 | PHE0007642_17999 | 29 | Arabidopsis Non-phototropic hypocotyl protein 1 | 0 | 94 | 15231245 | sp|O48963| Phototropin-1 (Root phototropism protein 1) [Arabidopsis thaliana] |
| 29 | 327 | PHE0007677_18052 | 29 | Arabidopsis oxidoreductase | 0 | 100 | 15239022 | ref|NP_196694.1|oxidoreductase [Arabidopsis thaliana] |
| 29 | 327 | PHE0007677_18179 | 13 | Arabidopsis oxidoreductase | 0 | 100 | 15239022 | ref|NP_196694.1|oxidoreductase [Arabidopsis thaliana] |
| 30 | 328 | PHE0007644_18001 | 29 | Arabidopsis receptor protein kinase | 0 | 88 | 15220455 | ref|NP_176918.1| protein serine/threonine kinase [Arabidopsis thaliana] |
| 30 | 328 | PHE0007644_18169 | 13 | Arabidopsis receptor protein kinase | 0 | 88 | 15220455 | ref|NP_176918.1| protein serine/threonine kinase [Arabidopsis thaliana] |

TABLE 2-continued

| NUC SEQ ID NO | PEP SEQ ID NO | Gene ID | BV ID | Gene Name | e-value | % id | GenBank ID | Annotation |
|---|---|---|---|---|---|---|---|---|
| 31 | 329 | PHE0007640_17992 | 29 | Soy magnesium transporter mrs2-1-like | 1.00E-165 | 80 | 92889086 | gb|ABE89684.1| Mg2+ transporter protein, CorA-like [Medicago truncatula] |
| 32 | 330 | PHE0007678_18053 | 29 | Arabidopsis acyl-CoA thioesterase | 1.00E-107 | 100 | 18399594 | ref|NP_564457.1| acyl-CoA thioesterase [Arabidopsis thaliana] |
| 32 | 330 | PHE0007678_18180 | 13 | Arabidopsis acyl-CoA thioesterase | 1.00E-107 | 100 | 18399594 | ref|NP_564457.1| acyl-CoA thioesterase [Arabidopsis thaliana] |
| 33 | 331 | PHE0007649_18006 | 29 | Arabidopsis putative ankyrin protein kinase | 0 | 99 | 42566072 | ref|NP_191542.2| protein kinase/threonine kinase/protein-tyrosine kinase [Arabidopsis thaliana] |
| 34 | 332 | PHE0006726_16298 | 25 | Arabidopsis putative ARP2/3 protein complex subunit p41 | 0 | 97 | 15224586 | gb|AAC20725.1| putative ARP2/3 protein complex subunit p41 [Arabidopsis thaliana] |
| 35 | 333 | PHE0006218_8776 | 25 | Arabidopsis thioredoxin-disulfide reductase | 0 | 85 | 18405775 | ref|NP_565954.1| disulfide oxidoreductase/thioredoxin-disulfide reductase (Arabidopsis thaliana) |
| 36 | 334 | PHE0006657_16192 | 13 | Corn putative ATP-binding protein | 2.00E-83 | 71 | 115462871 | gb|AAV31386.1| putative ATP-binding protein [Oryza sativa (japonica cultivar-group)] |
| 37 | 335 | PHE0002554_17876 | 13 | Corn Chlorophyll a/b-binding protein CP29 precursor | 1.00E-158 | 95 | 2326947 | emb|CAA90681.1| Chlorophyll a/b-binding protein CP29 precursor [Zea mays] |
| 37 | 335 | PHE0002554_23104 | 9 | Corn Chlorophyll a/b-binding protein CP29 precursor | 1.00E-158 | 95 | 2326947 | emb|CAA90681.1| Chlorophyll a/b-binding protein CP29 precursor [Zea mays] |
| 38 | 336 | PHE0006807_16388 | 13 | Corn transcription factor APRR9 like | 1.00E-140 | 64 | 115484281 | gb|ABG22372.1| CCT motif family protein (Oryza sativa (japonica cultivar-group)] |
| 39 | 337 | PHE0003359_8487 | 9 | Corn dw f4-like protein | 0 | 86 | 60677681 | dbj|BAD90972.1| cytochrome P450 [Oryza sativa (japonica cultivar-group)] |
| 40 | 338 | PHE0006542_15785 | 9 | Arabidopsis methionine sulfoxide reductase | 1.00E-149 | 100 | 15234942 | ref|NP_194243.1| protein-methionine-S-oxide reductase [Arabidopsis thaliana] |
| 41 | 339 | PHE0007622_17921 | 8 | Arabidopsis spermine synthase | 0 | 100 | 18419941 | gb|AAF01311.1| spermine synthase [Arabidopsis thaliana] |
| 42 | 340 | PHE0007630_17956 | 3 | Corn GA3ox1 | 1.00E-151 | 75 | 125544881 | gb|EAY91020.1| hypothetical protein OsL_012253 [Oryza sativa (indica cultivar-group)] |
| 43 | 341 | PHE0007593_17886 | 8 | Corn spermidine synthase | 1.00E-169 | 92 | 115471679 | dbj|BAD30581.1| spermidine synthase 1 [Oryza sativa (japonica cultivar-group)] |
| 44 | 342 | PHE0006475_15588 | 9 | Arabidopsis PsbQ_like | 9.00E-89 | 100 | 42571459 | ref|NP_973820.1| calcium ion binding (Arabidopsis thaliana) |
| 45 | 343 | PHE0007619_17915 | 13 | Soy methyl-CpG-binding domain-containing protein | 1.00E-44 | 43 | 18394229 | ref|NP_563971.1| MBD10; DNA binding [Arabidopsis thaliana] |

TABLE 2-continued

| NUC SEQ ID NO | PEP SEQ ID NO | Gene ID | BV ID | Gene Name | e-value | % id | GenBank ID | Annotation |
|---|---|---|---|---|---|---|---|---|
| 46 | 344 | PHE0006846_16447 | 13 | Soy cuticle protein | 0 | 70 | 9758349 | dbj|BAB08850.1| lipid transfer protein; glossy1 homolog [Arabidopsis thaliana] |
| 47 | 345 | PHE0007584_17874 | 13 | Arabidopsis methyl-CpG-binding domain-containing protein | 1.00E-124 | 65 | 18394229 | ref|NP_563971.1| MBD10; DNA binding [Arabidopsis thaliana] |
| 48 | 346 | PHE0003695_17913 | 17 | Arabidopsis Erecta | 0 | 95 | 15225286 | gb|AAC49302.1| ERECTA, receptor protein kinase [Arabidopsis thaliana] |
| 48 | 346 | PHE0011554_23650 | 32 | Arabidopsis Erecta | 0 | 95 | 15225286 | gb|AAC49302.1| ERECTA, receptor protein kinase [Arabidopsis thaliana] |
| 49 | 347 | PHE0003695_17879 | 8 | Arabidopsis Erecta | 0 | 95 | 15225286 | gb|AAK59615.1| receptor protein kinase, ERECTA [Arabidopsis thaliana] |
| 49 | 347 | PHE0003695_23448 | 22 | Arabidopsis Erecta | 0 | 95 | 15225286 | gb|AAK59615.1| receptor protein kinase, ERECTA [Arabidopsis thaliana] |
| 50 | 348 | PHE0006936_16828 | 29 | Soy GNS1/SUR4 membrane protein | 2.00E-91 | 66 | 92868497 | gb|ABE78502.1|GNS1/SUR4 membrane protein [Medicago truncatula] |
| 51 | 349 | PHE0007645_18002 | 29 | Soy DNA binding protein | 2.00E-26 | 32 | 21617964 | gb|AAM67014.1| DNA binding protein-like [Arabidopsis thaliana] |
| 52 | 350 | PHE0006784_16366 | 6 | Corn cysteine synthase | 1.00E-165 | 93 | 2829688 | emb|CAA59798.1| O-acetylserine (thiol) lyase; cysteine synthase [Zea mays] |
| 53 | 351 | PHE0006171_16491 | 13 | Sorghum bicolor Glyoxalase | 6.00E-91 | 86 | 115463027 | ref|NP_001055113.1|Os05g0295800 [Oryza sativa (japonica cultivar-group)] |
| 54 | 352 | PHE0006868_16682 | 13 | Arabidopsis ME01451 | 3.00E-05 | 100 | 21592593 | gb|AAM64542.1| unknown [Arabidopsis thaliana] |
| 55 | 353 | PHE0006906_16796 | 13 | Corn 20S proteasome subunit beta-6 | 1.00E-121 | 96 | 115480019 | dbj|BAA28276.1| beta 6 subunit of 20S proteasome [Oryza sativa (japonica cultivar-group)] |
| 56 | 354 | PHE0006649_16180 | 13 | Wheat putative DRE binding factor 2 | 5.00E-62 | 64 | 60547461 | gb|AAX23704.1|HvCBF7 [Hordeum vulgare subsp. vulgare] |
| 57 | 355 | PHE0006809_16390 | 13 | E. coli hydroxylamine reductase | 0 | 97 | 89107724 | ref|NP_415394.4| hydroxylamine reductase [Escherichia coli K12] |
| 58 | 356 | PHE0006918_16808 | 13 | Corn putative dihydropyrimidine dehydrogenase | 0 | 82 | 125571037 | gb|EAZ12552.1|hypothetical protein OsJ_002377 [Oryza sativa (japonica cultivar-group)] |
| 59 | 357 | PHE0007813_18219 | 6 | Rice MtN3 homolog | 1.00E-119 | 86 | 115445683 | dbj|BAD23335.1| putative NEC1 [Oryza sativa (japonica cultivar-group)] |
| 60 | 358 | PHE0007650_18175 | 13 | Arabidopsis Kin17 protein | 0 | 83 | 18405389 | AAD10649.1| Kin17 protein [Arabidopsis thaliana] |

TABLE 2-continued

| NUC SEQ ID NO | PEP SEQ ID NO | Gene ID | BV ID | Gene Name | e-value | % id | GenBank ID | Annotation |
|---|---|---|---|---|---|---|---|---|
| 61 | 359 | PHE0006825_16405 | 13 | E. coli cytochrome c nitrite reductase | 0 | 100 | 15834306 | ref|ZP_01699144.1| Nitrite reductase [Escherichia coli B] |
| 62 | 360 | PHE0006964_16864 | 9 | Corn asparaginyl-tRNA synthetase | 0 | 84 | 115436616 | dbj|BAB61140.1| putative asparagine-tRNA ligase [Oryza sativa (japonica cultivar-group)] |
| 62 | 360 | PHE0006964_16865 | 13 | Corn asparaginyl-tRNA synthetase | 0 | 84 | 115436616 | dbj|BAB61140.1| putative asparagine-tRNA ligase [Oryza sativa (japonica cultivar-group)] |
| 63 | 361 | PHE0008105_18407 | 13 | Yeast transcriptional activator HAP5 | 1.00E-116 | 88 | 6324934 | sp|Q02516| Transcriptional activator HAP5 [Saccharomyces cerevisiae] |
| 63 | 361 | PHE0008105_18733 | 30 | Yeast transcriptional activator HAP5 | 1.00E-116 | 88 | 6324934 | sp|Q02516| Transcriptional activator HAP5 [Saccharomyces cerevisiae] |
| 64 | 362 | PHE0006630_16159 | 13 | Corn malate dehydrogenase | 0 | 92 | 126888 | sp|P15719| MDHP_maize Malate dehydrogenase [NADP] |
| 65 | 363 | PHE0006966_16868 | 29 | Arabidopsis Cryptochrome 1 | 0 | 95 | 18413170 | ref|NP_567341.1|Cryptochrome 1 [Arabidopsis thaliana] |
| 66 | 364 | PHE0008698_24421 | 3 | Corn expressed protein | 9.00E-06 | 38 | 115484935 | gb|AAX96767.1| expressed protein [Oryza sativa (japonica cultivar-group)] |
| 67 | 365 | PHE0006608_16123 | 25 | Soy glutathione peroxidase | 2.00E-82 | 90 | 21068666 | emb|CAD31839.1|putative phospholipid hydroperoxide glutathione peroxidase [Cicer arietinum] |
| 68 | 366 | PHE0010462_21459 | na | Deinococcus radiodurans nudixhydrolase | 1.00E-155 | 86 | 15805358 | ref|NP_294052.1|MutT/nudix family protein [Deinococcus radiodurans R1] |
| 69 | 367 | PHE0009211_21774 | 30 | Arabidopsis PF02519-auxin inducible-3 | 5.00E-50 | 89 | 15236198 | ref|NP_195205.1|unknown protein [Arabidopsis thaliana] |
| 70 | 368 | PHE0006256_8775 | 27 | Arabidopsis 9-cis-epoxycarotenoid dioxygenase | 0 | 92 | 15231856 | dbj|BAB01336.1| 9-cis-epoxycarotenoid dioxygenase [Arabidopsis thaliana] |
| 71 | 369 | PHE0006989_16918 | 29 | Arabidopsis putative protein kinase | 0 | 79 | 15231840 | dbj|BAB01042.1| protein kinase [Arabidopsis thaliana] |
| 72 | 370 | PHE0007649_18166 | 13 | Arabidopsis putative ankyrin protein kinase | 0 | 100 | 42566072 | ref|NP_191542.2| protein kinase/serine/threonine kinase/tyrosine kinase [Arabidopsis thaliana] |
| 73 | 371 | PHE0006708_16264 | 29 | Soy DNA helicase 45 | 0 | 89 | 3097266 | emb|CAA76677.1| translation initiation factor [Pisum sativum] |
| 74 | 372 | PHE0001117_19094 | 4 | Corn transcription factor G1543-like | 1.00E-101 | 84 | 125527033 | gb|EAY75147.1|hypothetical protein OsI_002994 [Oryza sativa (indica cultivar-group)] |
| 74 | 372 | PHE0001117_19095 | 9 | Corn transcription factor G1543-like | 1.00E-101 | 84 | 125527033 | gb|EAY75147.1|hypothetical protein OsI_002994 [Oryza sativa (indica cultivar-group)] |
| 75 | 373 | PHE0006266_8814 | 9 | Corn phytochromobilin synthase | 1.00E-164 | 100 | 49472889 | gb|AAT66259.1| phytochromobilin synthase [Zea mays] |

TABLE 2-continued

| NUC SEQ ID NO | PEP SEQ ID NO | Gene ID | BV ID | Gene Name | e-value | % id | GenBank ID | Annotation |
|---|---|---|---|---|---|---|---|---|
| 75 | 373 | PHE0006266_15483 | 4 | corn phytochromobilin synthase | 1.00E-164 | 100 | 49472889 | gb|AAT66259.1| phytochromobilin synthase [Zea mays] |
| 76 | 374 | PHE0006795_16378 | 13 | E. coli pH-dependent sodium/proton antiporter | 1.00E-172 | 82 | 16128013 | ref|NP_414560.1| pH-dependent sodium/proton antiporter [Escherichia coli K12] |
| 77 | 375 | PHE0006956_16853 | 13 | Agrobacterium nitrate reductase | 0 | 98 | 15891062 | ref|NP_356734.1|hypothetical protein AGR_L_1895 [Agrobacterium tumefaciens str. C58] |
| 78 | 376 | PHE0006859_16873 | 9 | Corn bHLH protein family | 2.00E-31 | 92 | 115451023 | gb|EAZ25749.1| hypothetical protein OsJ_009232 [Oryza sativa (japonica cultivar-group)] |
| 79 | 377 | PHE0006824_16404 | 13 | Corn Nonlegume hemoglobin-like | 6.00E-86 | 98 | 3913789 | gb|AAA19576.1| haemoglobin apoprotein [Hordeum vulgare] |
| 80 | 378 | PHE0006812_16393 | 13 | Nostoc 2-on-2 hemoglobin | 1.00E-61 | 100 | 23130505 | ref|ZP_00112318.1| Truncated hemoglobins (Nostoc punctiforme PCC 73102) |
| 81 | 379 | PHE0006815_16396 | 13 | Rice Trb-like | 2.00E-98 | 100 | 115468746 | dbj|BAD32857.1| putative 2-on-2 hemoglobin [Oryza sativa (japonica cultivar-group)] |
| 82 | 380 | PHE0006806_16387 | 13 | Corn Trb-like | 7.00E-80 | 83 | 14165165 | gb|AAK55410.1|AF376063_12-on-2 hemoglobin [Hordeum vulgare] |
| 83 | 381 | PHE0006624_16153 | 13 | Corn putative cytosolic 6-phosphogluconate dehydrogenase | 0 | 98 | 3342802 | gb|AAC27703.1| putative cytosolic 6-phosphogluconate dehydrogenase [Zea mays] |
| 84 | 382 | PHE0005006_15823 | 13 | Corn chlorophyll a/b-binding apoprotein CP24 precursor | 1.00E-112 | 80 | 115458738 | gb|EAY94374.1| hypothetical protein OsI_015607 [Oryza sativa (indica cultivar-group)] |
| 85 | 383 | PHE0003991_16771 | 13 | Corn AfMONFEED000559 Protamine P1 | — | — | — | — |
| 86 | 384 | PHE0006683_16229 | 13 | Corn response regulator 4 | 1.00E-102 | 85 | 12060384 | dbj|BAB20579.1| response regulator 4 [Zea mays] |
| 87 | 385 | PHE0006884_16703 | 7 | Corn granule-bound starch synthase precursor | 0 | 89 | 33321047 | gb|AAQ06291.1| granule-bound starch synthase precursor [Zea mays] |
| 88 | 386 | PHE0006691_16237 | 3 | E. coli NAD(P)H-dependent glycerol-3-phosphate dehydrogenase | 0 | 100 | 15804152 | ref|NP_290191.1| NAD(PH-dependent glycerol-3-phosphate dehydrogenase [Escherichia coli O157:H7 EDL933] |
| 89 | 387 | PHE0006790_16372 | 9 | Arabidopsis chlorophyll A oxygenase | 0 | 95 | 15219408 | ref|NP_175088.1| chlorophyll a oxygenase [Arabidopsis thaliana] |
| 90 | 388 | PHE0009143_19932 | 30 | E. coli StpA | 2.00E-57 | 86 | 83569970 | ref|ZP_00921418.1| DNA-binding protein H-NS [Shigella dysenteriae 1012] |
| 91 | 389 | PHE0008406_18830 | 30 | Yeast general amino acid permease | 0 | 98 | 14318464 | sp|P43548| Yeast general amino acid permease AGP3 |
| 92 | 390 | PHE0008279_18708 | 30 | Corn hypothetical protein | 5.00E-25 | 73 | 115462095 | gb|EAY96551.1| hypothetical protein OsI_017784 [Oryza sativa (indica cultivar-group)] |
| 93 | 391 | PHE0009142_19931 | 30 | E. coli DNA-binding protein H-NS | 3.00E-45 | 72 | 15801465 | ref|NP_415753.1| global DNA-binding transcriptional dual |

TABLE 2-continued

| NUC SEQ ID NO | PEP SEQ ID NO | Gene ID | BV ID | Gene Name | e-value | % id | GenBank ID | Annotation |
|---|---|---|---|---|---|---|---|---|
| 94 | 392 | PHE0008308_18841 | 30 | Corn hypothetical protein | 5.00E-41 | 89 | 125537055 | gb\|EAY83543.1\| hypothetical protein OsI_037502 [Oryza sativa (indica cultivar group)] |
| 95 | 393 | PHE0007639_17991 | 29 | Chlorella optimized beta glutamate dehydrogenase | 0 | 99 | 118546 | emb\|CAA41636.1\| glutamate dehydrogenase (NADP+) [Chlorella sorokiniana] |
| 96 | 394 | PHE0007646_18170 | 13 | Arabidopsis kelch repeat-containing F-box family protein | 0 | 94 | 116831441 | gb\|ABK28673.1\| unknown [Arabidopsis thaliana] |
| 97 | 395 | PHE0007765_18182 | 13 | Arabidopsis glutathione transferase | 1.00E-130 | 100 | 15218872 | ref\|NP_176178.1\| glutathione transferase [Arabidopsis thaliana] |
| 98 | 396 | PHE0008167_18465 | 5 | Arabidopsis protein kinase | 1.00E-163 | 95 | 15233846 | ref\|NP_194179.1\| protein kinase/serine/threonine kinase/protein-tyrosine kinase [Arabidopsis thaliana] |
| 99 | 397 | PHE0008172_18471 | 5 | Arabidopsis putative thioredoxin H | 2.00E-46 | 97 | 4895214 | gb\|AAD32800.1\| putative thioredoxin H [Arabidopsis thaliana] |
| 100 | 398 | PHE0008183_18479 | 5 | Arabidopsis receptor protein kinase | 0 | 98 | 15239123 | ref\|NP_201371.1\| protein serine/threonine kinase [Arabidopsis thaliana] |
| 101 | 399 | PHE0007585_17875 | 6 | Arabidopsis drought-induced protein (Di21) | 2.00E-42 | 87 | 469112 | emb\|CAA55322.1\| Di21 [Arabidopsis thaliana] |
| 101 | 399 | PHE0007585_23902 | 30 | Arabidopsis drought-induced protein (Di21) | 2.00E-42 | 87 | 469112 | emb\|CAA55322.1\| Di21 [Arabidopsis thaliana] |
| 102 | 400 | PHE0006804_16385 | 6 | Rice small subunit of U2 snRNP auxiliary factor | 1.00E-107 | 100 | 125553324 | gb\|EAY99033.1\| hypothetical protein OsI_020266 [Oryza sativa (indica cultivar-group)] |
| 103 | 401 | PHE0006703_15751 | 15 | Lactobacillus ATP-dependent phosphofructokinase with ctp | 1.00E-164 | 92 | 104773899 | ref\|YP_618879.1\| 6-phosphofructokinase [Lactobacillus delbrueckii subsp. bulgaricus ATCC 11842] |
| 104 | 402 | PHE0007410_17653 | 3 | Umbelopsis glycerol-3-phosphate O-acyltransferase | 1.00E-144 | 42 | 58264662 | ref\|XP_569487.1\| glycerol-3-phosphate O-acyltransferase [Cryptococcus neoformans var. neoformans JEC21] |
| 105 | 403 | PHE0006854_16456 | 2 | Corn kernel specific yabby | 1.00E-115 | 71 | 32330681 | gb\|AAP79887.1\| yabby10 protein [Zea mays] |
| 106 | 404 | PHE0007721_21293 | 19 | Corn homeobox transcription factor KNOTTED1 | 1.00E-152 | 77 | 123183 | gb\|AAP76321.1\| homeobox transcription factor KNOTTED1 [Zea mays] |
| 107 | 405 | PHE0006563_15990 | 13 | Wheat glutamine-dependent asparagine synthetase | 0 | 97 | 53680379 | gb\|AAU89392.1\| glutamine-dependent asparagine synthetase [Triticum aestivum] |
| 107 | 405 | PHE0006563_16140 | 9 | Wheat glutamine-dependent asparagine synthetase | 0 | 97 | 53680379 | gb\|AAU89392.1\| glutamine-dependent asparagine synthetase [Triticum aestivum] |
| 108 | 406 | PHE0006619_16147 | 13 | Corn Delta 1-pyrroline-5- | 0 | 84 | 2081612 | dbj\|BAA19916.1\| delta-pyrroline-5-carboxylate |

TABLE 2-continued

| NUC SEQ ID NO | PEP SEQ ID NO | Gene ID | BV ID | Gene Name | e-value | % id | GenBank ID | Annotation |
|---|---|---|---|---|---|---|---|---|
| 109 | 407 | PHE0006813_16394 | 13 | carboxylate synthetase | 1.00E-67 | 93 | 16078221 | synthetase [Oryza sativa (japonica cultivar-group)] sp|O31607| Hemoglobin-like protein yjbI (Truncated BHb (trHbHb) [Bacillus Subtilis] |
| 110 | 408 | PHE0006688_16234 | 13 | Bacillus subtilis Hemoglobin-like protein TrHb | 1.00E-131 | 99 | 11467185 | sp|P16037| maize Chloroplast 30S ribosomal protein S2 |
| 111 | 409 | PHE0006635_16164 | 13 | Corn ribosomal protein S2 | 9.00E-86 | 100 | 15800822 | ref|NP_286838.1|methylglyoxal synthase [Escherichia coli O157:H7 EDL933] |
| 112 | 410 | PHE0008340_19155 | 30 | E. coli methylglyoxal synthase | 1.00E-178 | 78 | 92896427 | gb|ABE93200.1| conserved hypothetical protein [Medicago truncatula] |
| 113 | 411 | PHE0008416_18838 | 30 | Soy hypothetical protein | 0 | 58 | 115480880 | ref|NP_001064033.1|Os10g0110600 [Oryza sativa (japonica cultivar-group)] |
| 114 | 412 | PHE0008422_18842 | 30 | Corn putative oligopeptide transporter | 1.00E-121 | 55 | 115448163 | dbj|BAD08083.1| unknown protein (Oryza sativa (japonica cultivar-group)] |
| 115 | 413 | PHE0008599_19166 | 30 | Corn unknown protein | 0 | 95 | 16330244 | ref|NP_440972.1| glycogen operon protein; GlgX [Synechocystis sp. PCC 6803] |
| 116 | 414 | PHE0008375_18732 | 30 | Synechocystis glycogen operon protein | 6.00E-95 | 99 | 16077136 | sp|P37472| Hypoxanthine-guanine phosphoribosyl-transferase (HGPRTase) [Bacillus subtilis] |
| 117 | 415 | PHE0006712_16273 | 27 | Bacillus hypoxanthine-guanine phosphoribosyl transferase | 4.00E-92 | 100 | 15237778 | ref|NP_200700.1| unknown protein [Arabidopsis thaliana] |
| 117 | 415 | PHE0006712_16362 | 13 | Arabidopsis unknown function | 4.00E-92 | 100 | 15237778 | ref|NP_200700.1| unknown protein [Arabidopsis thaliana] |
| 117 | 415 | PHE0006712_16363 | 9 | Arabidopsis unknown function | 4.00E-92 | 100 | 15237778 | ref|NP_200700.1| unknown protein [Arabidopsis thaliana] |
| 117 | 415 | PHE0006712_16364 | 6 | Arabidopsis unknown function | 4.00E-92 | 100 | 15237778 | ref|NP_200700.1| unknown protein [Arabidopsis thaliana] |
| 118 | 416 | PHE0008394_18763 | 9 | Corn altered glutamine synthetase | 0 | 97 | 121341 | sp|P25462| Glutamine synthetase (Glutamate--ammonia ligase) (GS2) [Zea mays] |
| 119 | 417 | PHE0008395_18764 | 9 | Corn altered glutamine synthetase | 0 | 97 | 121341 | sp|P25462| Glutamine synthetase (Glutamate--ammonia ligase) (GS2) [Zea mays] |
| 120 | 418 | PHE0008444_18846 | 3 | Corn glutamine synthetase1 | 0 | 100 | 112490284 | dbj|BAA03430.1| glutamine synthetase [Zea mays] |
| 121 | 419 | PHE0006819_16400 | 13 | Synechocystis A-type flavoproteins | 0 | 100 | 16331685 | sp|Q55393| Diflavin flavoprotein A 1 (SsATF573) (NADH:oxygen oxidoreductase) [Synechocystis sp. PCC 6803] |
| 122 | 420 | PHE0007417_17663 | 15 | Corn EIL1 | 0 | 76 | 125543684 | gb|EAY89823.1| hypothetical protein OsI_011056 [Oryza sativa (indica cultivar-group)] |

TABLE 2-continued

| NUC SEQ ID NO | PEP SEQ ID NO | Gene ID | BV ID | Gene Name | e-value | % id | GenBank ID | Annotation |
|---|---|---|---|---|---|---|---|---|
| 123 | 421 | PHE0008443_18845 | 13 | Barley asparagine synthetase1 | 0 | 97 | 13925886 | gb|AAK49456.1| glutamine-dependent asparagine synthetase 1 [*Hordeum vulgare* subsp. *vulgare*] |
| 124 | 422 | PHE0006818_16399 | 13 | *E. coli* flavorubredoxin | 0 | 100 | 16130617 | ref|AP003277.1|flavorubredoxin oxidoreductase [*Escherichia coli* W3110] |
| 125 | 423 | PHE0006579_16031 | 13 | Corn thiazole biosynthetic enzyme | 0 | 97 | 2501189 | sp|Q41738| Thiazole biosynthetic enzyme 1-1, chloroplast precursor [*Zea mays*] |
| 126 | 424 | PHE0006808_16389 | 13 | Rice transcription factor APRR9 like | 0 | 97 | 115484281 | gb|ABG22372.1| CCT motif family protein [*Oryza sativa (japonica cultivar-group)*] |
| 127 | 425 | PHE0008160_18460 | 5 | *Arabidopsis* pyruvate decarboxylase | 0 | 100 | 15234062 | ref|NP_195033.1| pyruvate decarboxylase [*Arabidopsis thaliana*] |
| 128 | 426 | PHE0007571_17834 | 24 | Soy homoglutathione synthetase | 0 | 97 | 7799808 | emb|CAB91078.1| homoglutathione synthetase [*Glycine max*] |
| 129 | 427 | PHE0007586_17877 | 13 | *Arabidopsis* Chlorophyll a-b binding protein | 1.00E-151 | 96 | 15225630 | gb|AAD32843.1| putative chlorophyll a/b binding protein [*Arabidopsis thaliana*] |
| 130 | 428 | PHE0006969_16871 | 13 | Rice hypothetical protein | 4.00E-34 | 100 | 115451023 | gb|EAZ25749.1| hypothetical protein OsI_009232 [*Oryza sativa (japonica cultivar-group)*] |
| 131 | 429 | PHE0009729_21717 | 13 | *Arabidopsis* bHLH | 1.00E-91 | 89 | 30698765 | gb|AAO64014.1| putative homeodomain leucine zipper protein [*Arabidopsis thaliana*] |
| 132 | 430 | PHE0006424_15520 | 9 | photosystem II reaction center 6.1 KD protein | 3.00E-37 | 75 | 15224531 | gb|AAM64951.1| photosystem II reaction center 6.1 KD protein [*Arabidopsis thaliana*] |
| 133 | 431 | PHE0006392_15480 | 9 | Corn PsbP | 9.00E-99 | 84 | 115489108 | gb|ABA98969.2| Thylakoid lumenal 21.5 kDa protein [*Oryza sativa (japonica cultivar-group)*] |
| 134 | 432 | PHE0006589_16093 | 13 | *Arabidopsis* thioredoxin-like protein | 3.00E-84 | 100 | 42563272 | dbj|BAE99426.1| thioredoxin-like protein [*Arabidopsis thaliana*] |
| 135 | 433 | PHE0009258_21487 | 16 | *Arabidopsis* sodium proton exchanger1 | 0 | 87 | 15240448 | ref|NP_198067.1|NHX1 (NA+/H+ EXCHANGER); sodium:hydrogen antiporter [*Arabidopsis thaliana*] |
| 135 | 433 | PHE0009258_20132 | 34 | *Arabidopsis* sodium proton exchanger1 | 0 | 87 | 15240448 | ref|NP_198067.1|NHX1 (NA+/H+ EXCHANGER); sodium:hydrogen antiporter [*Arabidopsis thaliana*] |
| 136 | 434 | PHE0006680_16226 | 13 | Corn flavanone 3-hydroxylase | 1.00E-161 | 81 | 18057095 | gb|AAL58118.1| putative flavanone 3-hydroxylase [*Oryza sativa (japonica cultivar-group)*] |

TABLE 2-continued

| NUC SEQ ID NO | PEP SEQ ID NO | Gene ID | BV ID NO | Gene Name | e-value | % id | GenBank ID | Annotation |
|---|---|---|---|---|---|---|---|---|
| 137 | 435 | PHE0006481_16072 | 13 | Corn Os09g0570300 homolog | 1.00E−145 | 81 | 115480783 | ref|NP_001063985.1|Os09g0570300 [Oryza sativa (japonica cultivar-group)] |
| 138 | 436 | PHE0006269_8820 | 23 | Synechocystis conserved tetratricopeptide repeat protein | 0 | 96 | 16329708 | ref|NP_440436.1|hypothetical protein slr2048 [Synechocystis sp. PCC 6803] |
| 138 | 436 | PHE0006269_8821 | 9 | Synechocystis conserved tetratricopeptide repeat protein | 0 | 96 | 16329708 | ref|NP_440436.1|hypothetical protein slr2048 [Synechocystis sp. PCC 6803] |
| 139 | 437 | PHE0006783_16365 | 11 | Brassica napus amino acid permease 6 | 0 | 97 | 31455393 | emb|CAD92450.1|amino acid permease 6 [Brassica napus] |
| 140 | 438 | PHE0003151_18392 | 28 | Soy aintegumenta 2 | 1.00E−141 | 47 | 38492172 | gb|AAR22388.1| ANT-like protein [Nicotiana tabacum] |
| 141 | 439 | PHE0008272_18723 | 30 | Arabidopsis heat shock factor protein 5 | 0 | 88 | 15220611 | sp|Q9S7U5| Heat shock transcription factor 5) (HSTF 5) [Arabidopsis thaliana] |
| 142 | 440 | PHE0008277_18706 | 30 | Yeast chromatin structure remodeling complex protein SFH1 | 0 | 95 | 6323354 | sp|Q06168| Chromatin structure remodeling complex protein SFH1 [Saccharomyces cerevisiae] |
| 143 | 441 | PHE0008109_18411 | 30 | Yeast uncharacterized protein YOR154W precursor | 0 | 93 | 6324728 | sp|Q12232| Yeast uncharacterized protein YOR154W precursor |
| 143 | 441 | PHE0008109_18568 | 13 | Yeast uncharacterized protein YOR154W precursor | 0 | 93 | 6324728 | sp|Q12232| Yeast uncharacterized protein YOR154W precursor |
| 144 | 442 | PHE0008280_18826 | 30 | Sinorhizobium putative trehalose synthase | 0 | 93 | 16263847 | ref|NP_436639.1| putative trehalose synthase protein [Sinorhizobium meliloti 1021] |
| 145 | 443 | PHE0002424_15825 | 13 | Corn NADPH:protochlorophyllide oxidoreductase A | 1.00E−140 | 77 | 90398977 | gb|EAY96061.1| hypothetical protein OsI_017294 [Oryza sativa (indica cultivar group)] |
| 146 | 444 | PHE0006914_16804 | 13 | Corn 26S protease regulatory subunit 7 | 0 | 100 | 115466876 | dbj|BAD35266.1| 26S protease regulatory subunit 7 [Oryza sativa (japonica cultivar-group)] |
| 147 | 445 | PHE0006642_16172 | 14 | Rice ent-kaurene oxidase | 0 | 97 | 115468620 | dbj|BAD54598.1| ent-kaurene oxidase [Oryza sativa (japonica cultivar-group)] |
| 148 | 446 | PHE0007578_17852 | 29 | Arabidopsis unknown protein | 2.00E−71 | 100 | 18395285 | ref|NP_564202.1|unknown protein [Arabidopsis thaliana] |
| 149 | 447 | PHE0009926_21079 | 30 | Arabidopsis putative dual-specificity protein phosphatase | 1.00E−84 | 100 | 18397475 | gb|AAM62982.1| putative dual specificity protein phosphatase [Arabidopsis thaliana] |
| 150 | 448 | PHE0006206_19159 | 30 | Arabidopsis ubiquitin ligase SINAT5 | 0 | 97 | 15234306 | ref|NP_194517.1| ubiquitin-protein ligase/zinc ion binding [Arabidopsis thaliana] |

TABLE 2-continued

| NUC SEQ ID NO | PEP SEQ ID NO | Gene ID | BV ID | Gene Name | e-value | % id | GenBank ID | Annotation |
|---|---|---|---|---|---|---|---|---|
| 151 | 449 | PHE0008274_18705 | 30 | *Arabidopsis* putative BURP domain containing protein | 1.00E-154 | 95 | 15222103 | gb|AAD43166.1| Putative BURP domain containing protein [*Arabidopsis thaliana*] |
| 152 | 450 | PHE0009510_20526 | 30 | *Cucurbita* spermidine synthase | 1.00E-164 | 89 | 49425361 | gb|AAT66041.1| spermidine synthase [*Cucumis sativus*] |
| 153 | 451 | PHE0009937_21097 | 34 | *Cucurbita* spermidine synthase | 1.00E-164 | 89 | 49425361 | gb|AAT66041.1| spermidine synthase [*Cucumis sativus*] |
| 154 | 452 | PHE0009927_21080 | 30 | *Brassica* putative dual-specificity protein phosphatase | 4.00E-79 | 88 | 30679726 | dbj|BAC42108.1| putative dual-specificity protein phosphatase [*Arabidopsis thaliana*] |
| 155 | 453 | PHE0006460_15962 | 13 | *Arabidopsis* unknown protein | 0 | 86 | 18394658 | ref|NP_564064.1|unknown protein [*Arabidopsis thaliana*] |
| 156 | 454 | PHE0006445_15956 | 13 | *Arabidopsis* allene oxide cyclase | 1.00E-142 | 100 | 18404656 | emb|CAC83762.1| allene oxide cyclase [*Arabidopsis thaliana*] |
| 157 | 455 | PHE0006987_16893 | 13 | *Arabidopsis* calcineurin B-like protein 2 | 1.00E-125 | 99 | 15241101 | dbj|BAB09281.1| calcineurin B-like protein 2 [*Arabidopsis thaliana*] |
| 158 | 456 | PHE0004230_15865 | 13 | Corn E2F3 like | 0 | 72 | 115446539 | dbj|BAD73815.1| putative E2F homolog [*Oryza sativa (japonica cultivar-group)*] |
| 159 | 457 | PHE0006814_16395 | 13 | *Arabidopsis* 2-on-2 hemoglobin | 2.00E-99 | 100 | 18418064 | dbj|BAD42999.1| 2-on-2 hemoglobin (GLB3) [*Arabidopsis thaliana*] |
| 160 | 458 | PHE0002773_15881 | 13 | Rice glucose-1-phosphate adenylyltransferase large subunit 1 | 0 | 100 | 115465649 | ref|NP_001056424.1|Os05g0580000 [*Oryza sativa (japonica cultivar-group)*] |
| 161 | 459 | PHE0006060_15842 | 13 | Corn ubiquitin precursor | 0 | 86 | 60677681 | dbj|BAD90972.1|cytochrome P450 [*Oryza sativa (japonica cultivar-group)*] |
| 162 | 460 | PHE0006850_16451 | 2 | Corn kernel specific yabby | 4.00E-73 | 74 | 115454365 | dbj|BAF45803.1| YABBY2 protein [*Oryza sativa (japonica cultivar group)*] |
| 163 | 461 | PHE0008043_18199 | 2 | Corn homeobox-9 | 0 | 99 | 40950648 | gb|AAR97952.1| rolled leaf1 [*Zea mays*] |
| 164 | 462 | PHE0000125_18852 | 13 | Corn receiver domain (TOC1-like) 10 | 1.00E-171 | 73 | 51571875 | dbj|BAD38854.1| pseudo-response regulator 1 [*Oryza sativa (japonica cultivar-group)*] |
| 165 | 463 | PHE0008269_18720 | 30 | *Arabidopsis* protein kinase | 0 | 96 | 15222311 | ref|NP_172195.1|MAPKKK13; protein kinase/protein serine/threonine kinase/protein-tyrosine kinase [*Arabidopsis thaliana*] |
| 166 | 464 | PHE0008264_18712 | 30 | *Arabidopsis* ubiquitin-protein ligase | 0 | 97 | 42567081 | ref|NP_194117.3| ubiquitin-protein ligase/zinc ion binding [*Arabidopsis thaliana*] |
| 167 | 465 | PHE0002782_20059 | 8 | Corn phosphoglucose isomerase | 0 | 89 | 115479643 | dbj|BAD17509.1| putative glucose-6-phosphate isomerase [*Oryza sativa (japonica cultivar group)*] |

TABLE 2-continued

| NUC SEQ ID NO | PEP SEQ ID NO | Gene ID | BV ID | Gene Name | e-value | % id | GenBank ID | Annotation |
|---|---|---|---|---|---|---|---|---|
| 167 | 465 | PHE0002782_22452 | 13 | Corn phosphoglucose isomerase | 0 | 89 | 115479643 | dbj|BAD17509.1| putative glucose-6-phosphate isomerase [*Oryza sativa* (*japonica* cultivar-group)] |
| 168 | 466 | PHE0009438_20404 | 9 | Corn GNC | 8.00E-84 | 52 | 115445073 | dbj|BAD17612.1| zinc finger protein-like [*Oryza sativa* (*japonica* cultivar-group)] |
| 169 | 467 | PHE0009429_20392 | 13 | Rice sulphiredoxin | 6.00E-68 | 85 | 71905635 | gb|AAZ52795.1| sulfiredoxin-like protein [*Oryza sativa* (*japonica* cultivar-group)] |
| 170 | 468 | PHE0009440_20406 | 13 | Yeast sulphiredoxin | 3.00E-66 | 100 | 6322764 | sp|P36077|SRX1_YEAST Sulfiredoxin |
| 171 | 469 | PHE0008543_18945 | 13 | *Agrobacterium* siroheme synthase | 0 | 97 | 17937602 | ref|NP_534391.1| siroheme synthase [*Agrobacterium tumefaciens* str. C58] |
| 171 | 469 | PHE0008543_18946 | 20 | *Agrobacterium* siroheme synthase | 0 | 97 | 17937602 | ref|NP_534391.1| siroheme synthase [*Agrobacterium tumefaciens* str. C58] |
| 171 | 469 | PHE0008543_18947 | 10 | *Agrobacterium* siroheme synthase | 0 | 97 | 17937602 | ref|NP_534391.1| siroheme synthase [*Agrobacterium tumefaciens* str. C58] |
| 172 | 470 | PHE0006960_16857 | 8 | Rice nitrate reductase | 0 | 96 | 115448947 | dbj|BAD16843.1| putative nitrate reductase [*Oryza sativa* (*japonica* cultivar-group)] |
| 173 | 471 | PHE0009427_20389 | 13 | *Arabidopsis* imidazoleglycerol-phosphate dehydratase | 1.00E-118 | 88 | 30686639 | dbj|BAB01781.1| imidazoleglycerol-phosphate dehydratase [*Arabidopsis thaliana*] |
| 174 | 472 | PHE0006437_15906 | 13 | *Arabidopsis* putative protein kinase | 1.00E-170 | 95 | 22327062 | ref|NP_197926.2| protein kinase/protein serine/threonine kinase/protein-tyrosine kinase [*Arabidopsis thaliana*] |
| 175 | 473 | PHE0007409_17652 | 3 | Rice mono- or diacylglycerol acyltransferase | 0 | 99 | 115467862 | dbj|BAD33251.1| putative mono- or diacylglycerol acyltransferase (*Oryza sativa* (*japonica* cultivar-group)] |
| 176 | 474 | PHE0009426_20387 | 13 | Yeast histidinol phosphatase | 0 | 100 | 14318548 | dbj|BAA09264.1| histidinol phosphatase [*Saccharomyces cerevisiae*] |
| 177 | 475 | PHE0009430_20393 | 13 | Soy sulphiredoxin | 2.00E-45 | 74 | 85719364 | gb|ABC75369.1|ParB-like nuclease [*Medicago truncatula*] |
| 178 | 476 | PHE0007003_16906 | 13 | Rice putative phosphotyrosyl phosphatase activator | 1.00E-171 | 82 | 115467132 | dbj|BAD37240.1| putative phosphotyrosyl phosphatase activator [*Oryza sativa* (*japonica* cultivar-group)] |
| 179 | 477 | PHE0008378_18741 | 13 | Yeast general control protein | 1.00E-144 | 94 | 6320828 | sp|P03069| General control protein GCN4 (Amino acid biosynthesis regulatory |

TABLE 2-continued

| NUC SEQ ID NO | PEP SEQ ID NO | Gene ID | BV ID | Gene Name | e-value | % id | GenBank ID | Annotation |
|---|---|---|---|---|---|---|---|---|
| | | | | | | | | protein) [*Saccharomyces cerevisiae*] |
| 180 | 478 | PHE0008273_18725 | 30 | *Arabidopsis* nucleic acid binding protein | 0 | 95 | 30683900 | ref|NP_180412.2| nucleic acid binding [*Arabidopsis thaliana*] |
| 181 | 479 | PHE0008547_18953 | 20 | Corn ferredoxin | 1.00E-38 | 75 | 119961 | sp|P27789| Maize ferredoxin-5 (Ferredoxin V) |
| 182 | 480 | PHE0006922_16812 | 13 | Corn putative hexokinase I | 0 | 87 | 115439869 | gb|AAZ93623.1| hexokinase 6 [*Oryza sativa (japonica cultivar-group)*] |
| 183 | 481 | PHE0006920_16810 | 13 | Corn putative CAD ATPase | 0 | 88 | 115439215 | gb|AAP92128.1| putative ATPase ATP1 [*Oryza sativa (japonica cultivar-group)*] |
| 184 | 482 | PHE0008396_18765 | 9 | Corn altered glutamine synthetase2 | 0 | 97 | 121341 | sp|P25462| Maize glutamine synthetase (Glutamate-ammonia ligase) (GS2) |
| 185 | 483 | PHE0006957_16854 | 13 | Corn glutamine synthetase2 C299A/C364A double mutant | 0 | 97 | 121341 | sp|P25462| Maize glutamine synthetase (Glutamate-ammonia ligase) (GS2) |
| 186 | 484 | PHE0006404_15936 | 13 | *Arabidopsis* RNA-binding protein | 0 | 96 | 18423760 | ref|NP_568826.1| RNA binding protein [*Arabidopsis thaliana*] |
| 187 | 485 | PHE0006820_16401 | 13 | *Nostoc punctiforme* A-type flavoproteins | 0 | 97 | 23129576 | ref|ZP_00111402.1| Uncharacterized flavoproteins [*Nostoc punctiforme* PCC 73102] |
| 188 | 486 | PHE0006690_16236 | 13 | Corn putative high affinity nitrate transporter | 0 | 79 | 108794607 | gb|ABG20828.1| high affinity nitrate transporter NRT2.5 [*Hordeum vulgare* subsp. *vulgare*] |
| 189 | 487 | PHE0006395_15932 | 13 | *Arabidopsis* leucine-rich repeat protein | 0 | 100 | 18391461 | gb|AAW57412.1| plant intracellular Ras-group-related LRR protein 3 [*Arabidopsis thaliana*] |
| 190 | 488 | PHE0006759_16384 | 6 | *Arabidopsis* glycine hydroxymethyltransferase/serine hydroxymethyltransferase | 0 | 100 | 15235745 | ref|NP_195506.1| Serine hydroxymethyltransferase 1); glycine hydroxymethyltransferase [*Arabidopsis thaliana*] |
| 191 | 489 | PHE0006576_16028 | 13 | Corn tuber-specific and sucrose-responsive element binding factor | 1.00E-87 | 57 | 115469098 | dbj|BAD37513.1| putative tuber-specific and sucrose-responsive element binding factor [*Oryza sativa (japonica* cultivar-group)] |
| 192 | 490 | PHE0006979_16885 | 13 | *Arabidopsis* xylogen like protein 12 | 1.00E-103 | 100 | 18405294 | dbj|BAE73268.1| xylogen like protein 12 [*Arabidopsis thaliana*] |
| 193 | 491 | PHE0009786_21754 | 9 | *Arabidopsis* HFR1-delta N105 mutant | 1.00E-97 | 93 | 18378953 | sp|Q9FE22| Long hypocotyl in far-red 1 (bHLH-like protein HFR1); gb|AAK15282.1| basic helix-loop-helix FB1 protein [*Arabidopsis thaliana*] |
| 193 | 491 | PHE0009786_20911 | 30 | *Arabidopsis* HFR1-delta N105 mutant | 1.00E-97 | 93 | 18378953 | sp|Q9FE22| Long hypocotyl in far-red 1 (bHLH-like protein HFR1); gb|AAK10282.1| basic |

TABLE 2-continued

| NUC SEQ ID NO | PEP SEQ ID NO | Gene ID | BV ID | Gene Name | e-value | % id | GenBank ID | Annotation |
|---|---|---|---|---|---|---|---|---|
| 194 | 492 | PHE0006572_16007 | 13 | Arabidopsis phosphoenolpyruvate carboxylase kinase 2 | 1.00E-160 | 100 | 18396914 | helix-loop-helix FB1 protein [Arabidopsis thaliana] ref|NP_566229.1|Phosphoenol pyruvate carboxylase kinase 2 [Arabidopsis thaliana] |
| 195 | 493 | PHE0006828_16408 | 13 | Arabidopsis de-etiolated 1 | 0 | 94 | 42566387 | ref|NP_192756.2|DET1 (De-etiolated 1) [Arabidopsis thaliana] |
| 196 | 494 | PHE0006588_16092 | 13 | Corn electron transporter/thiol-disulfide exchange intermediate | 9.00E-90 | 100 | 30693659 | ref|NP_175021.2| electron transporter/thiol-disulfide exchange intermediate [Arabidopsis thaliana] |
| 197 | 495 | PHE0006985_16891 | 13 | Corn putative nuclear protein NAP | 0 | 75 | 115450034 | dbj|BAD23003.1| putative nuclear protein NAP [Oryza sativa (japonica cultivar-group)] |
| 198 | 496 | PHE0006875_16688 | 13 | Rice putative Photosystem I reaction center subunit V | 6.00E-61 | 85 | 115479799 | dbj|BAD33396.1| putative photosystem I reaction center subunit V [Oryza sativa (japonica cultivar-group)] |
| 199 | 497 | PHE0006626_16155 | 13 | Corn (1-3,1-4)-beta-glucanase | 1.00E-134 | 72 | 18984 | emb|CAA36801.1| (1-3,1-4)-beta-D-glucanase; emb|CAB41401.1| lichenase [Hordeum vulgare subsp. vulgare] |
| 200 | 498 | PHE0006689_16235 | 13 | Corn amino acid transporter family protein | 0 | 84 | 115443611 | dbj|BAD08181.1| putative amino acid transport protein [Oryza sativa (japonica cultivar-group)] |
| 201 | 499 | PHE0006799_16382 | 9 | Rhodopseudomonas Mg-protoporphyrin IX monomethylester cyclase | 0 | 97 | 39934738 | ref|NP_947014.1| Mg-protoporphyrin IX monomethyl ester oxidative cyclase 66 kD subunit [Rhodopseudomonas palustris CGA009] |
| 202 | 500 | PHE0006959_16856 | 8 | nitrate reductase | 0 | 95 | 115476820 | dbj|BAD09558.1| nitrate reductase apoenzyme [Oryza sativa (japonica cultivar-group)] |
| 203 | 501 | PHE0011615_23861 | 31 | Arabidopsis activated YODA | 0 | 78 | 38049268 | gb|AAR10436.1| YDA [Arabidopsis thaliana] |
| 204 | 502 | PHE0006925_16814 | 13 | Corn translocase inner membrane-like protein | 2.00E-74 | 66 | 115473245 | dbj|BAC83874.1| translocase inner membrane-like protein [Oryza sativa (japonica cultivar-group)] |
| 205 | 503 | PHE0006713_16274 | 25 | Arabidopsis cell division cycle protein 23-like | 0 | 96 | 15228343 | emb|CAB51062.1| cell division cycle protein 23 homolog [Arabidopsis thaliana] |
| 206 | 504 | PHE0008447_18848 | 13 | Corn light regulated protein | 1.00E-23 | 63 | 77023866 | gb|ABA61130.1| light-induced protein 1 [Lolium perenne] |

TABLE 2-continued

| NUC SEQ ID NO | PEP SEQ ID NO | Gene ID | BV ID | Gene Name | e-value | % id | GenBank ID | Annotation |
|---|---|---|---|---|---|---|---|---|
| 207 | 505 | PHE0006674_16221 | 13 | Rice putative nitrate transporter NRT1-5 | 0 | 95 | 115441781 | dbj|BAD82445.1| putative nitrate transporter NRT1-5 [*Oryza sativa (japonica* cultivar-group)] |
| 208 | 506 | PHE0010613_22398 | 3 | Corn high oil DAG kinase-like | 1.00E-165 | 80 | 115450433 | gb|ABF93745.1| expressed protein [*Oryza sativa (japonica* cultivar-group)] |
| 208 | 506 | PHE0010613_22404 | 7 | Corn high oil DAG kinase-like | 1.00E-165 | 80 | 115450433 | gb|ABF93745.1| expressed protein [*Oryza sativa (japonica* cultivar-group)] |
| 209 | 507 | PHE0002720_22558 | 18 | Corn DNA J protein | 0 | 83 | 115463255 | gb|AAV43840.1| putative DnaJ protein [*Oryza sativa (japonica* cultivar-group)] |
| 210 | 508 | PHE0011760_24005 | 31 | *Arabidopsis* YODA | 0 | 83 | 15222512 | ref|NP_176557.1| YDA (YODA); protein kinase/ protein serine/threonine kinase/protein-tyrosine kinase [*Arabidopsis thaliana*] |
| 211 | 509 | PHE0010612_22397 | 3 | Corn high oil nucleic acid binding | 1.00E-165 | 77 | 115450431 | gb|ABF93744.1| D111/G-patch domain-containing protein [*Oryza sativa (japonica* cultivar-group)] |
| 211 | 509 | PHE0010612_22403 | 7 | Corn high oil nucleic acid binding | 1.00E-165 | 77 | 115450431 | gb|ABF93744.1| D111/G-patch domain-containing protein [*Oryza sativa (japonica* cultivar-group)] |
| 212 | 510 | PHE0010615_22400 | 3 | Corn high oil unknown protein | 1.00E-32 | 28 | 125581548 | gb|EAZ22479.1| hypothetical protein OsJ_005962 [*Oryza sativa (japonica* cultivar-group)] |
| 213 | 511 | PHE0007411_17654 | 3 | Rice putative tafazzin isoform | 0 | 97 | 57899656 | dbj|BAD87325.1| putative tafazzin isoform [*Oryza sativa (japonica* cultivar-group)] |
| 214 | 512 | PHE0010617_22402 | 3 | Corn high oil hydrolase-like protein | 5.00E-98 | 69 | 115447203 | dbj|BAD20134.1| isochorismatase hydrolase-like protein [*Oryza sativa (japonica* cultivar-group)] |
| 215 | 513 | PHE0010610_22395 | 3 | Corn high oil RING-finger protein | 9.00E-27 | 75 | 2894379 | emb|CAA74911.1| ring finger protein [*Hordeum vulgare* subsp. *vulgare*] |
| 216 | 514 | PHE0006883_16702 | 7 | Corn glucosyl transferase | 0 | 93 | 136757 | sp|P04713| Granule-bound starch synthase 1, (GBSS-I) emb|CAA27574.1| glucosyl transferase [*Zea mays*] |
| 217 | 515 | PHE0010636_22408 | 3 | Corn glucose 6-phosphate translocator | 0 | 89 | 2997589 | gb|AAC08524.1| glucose-6-phosphate/phosphate-translocator precursor [*Zea mays*] |
| 217 | 515 | PHE0010636_22410 | 7 | Corn glucose 6-phosphate translocator | 0 | 89 | 2997589 | gb|AAC08524.1| glucose-6-phosphate/phosphate-translocator precursor [*Zea mays*] |

TABLE 2-continued

| NUC SEQ ID NO | PEP SEQ ID NO | Gene ID | BV ID | Gene Name | e-value | % id | GenBank ID | Annotation |
|---|---|---|---|---|---|---|---|---|
| 218 | 516 | PHE0011082_23038 | 30 | Soy SAG13 like | 3.00E-98 | 66 | 15239327 | gb|AAO22710.1| putative short chain alcohol dehydrogenase [Arabidopsis thaliana] |
| 219 | 517 | PHE0009475_20462 | 15 | Arabidopsis gibberellin 20-oxidase | 0 | 100 | 15235072 | ref|NP_194272.1| gibberellin 20-oxidase/gibberellin 3-beta-dioxygenase [Arabidopsis thaliana] |
| 219 | 517 | PHE0009475_20468 | 2 | Arabidopsis gibberellin 20-oxidase | 0 | 100 | 15235072 | ref|NP_194272.1| gibberellin 20-oxidase/gibberellin 3-beta-dioxygenase [Arabidopsis thaliana] |
| 219 | 517 | PHE0009475_20899 | 1 | Arabidopsis gibberellin 20-oxidase | 0 | 100 | 15235072 | ref|NP_194272.1| gibberellin 20-oxidase/gibberellin 3-beta-dioxygenase [Arabidopsis thaliana] |
| 219 | 517 | PHE0009475_21740 | any | Arabidopsis gibberellin 20-oxidase | 0 | 100 | 15235072 | ref|NP_194272.1| gibberellin 20-oxidase/gibberellin 3-beta-dioxygenase [Arabidopsis thaliana] |
| 219 | 517 | PHE0009475_20469 | 30 | Arabidopsis gibberellin 20-oxidase | 0 | 100 | 15235072 | ref|NP_194272.1| gibberellin 20-oxidase/gibberellin 3-beta-dioxygenase [Arabidopsis thaliana] |
| 220 | 518 | PHE0007415_17661 | 7 | Corn EIL2 | 0 | 75 | 125543684 | gb|EAY89823.1|hypothetical protein OsI_011056 [Oryza sativa (indica cultivar-group)] |
| 221 | 519 | PHE0006614_16129 | 22 | Soy STN7-LHCII protein kinase | 0 | 72 | 15241093 | emb|CAB82763.1| (1-4)-beta-mannan endohydrolase-like protein [Arabidopsis thaliana] |
| 222 | 520 | PHE0010611_22396 | 3 | Corn high oil flavin containing monooxygenase | 0 | 77 | 116317828 | gb|EAY92887.1| hypothetical protein OsI_014120 [Oryza sativa (indica cultivar-group)] |
| 223 | 521 | PHE0011719_23946 | na | Arabidopsis 1-acylglycerol-3-phosphate O-acyltransferase | 0 | 99 | 18410774 | ref|NP_567052.1| 1-acylglycerol-3-phosphate O-acyltransferase [Arabidopsis thaliana] |
| 224 | 522 | PHE0006861_16463 | 29 | Arabidopsis unknown protein | 0 | 87 | 5734789 | gb|AAD50054.1| Hypothetical protein [Arabidopsis thaliana] |
| 225 | 523 | PHE0006568_16005 | 13 | Corn receptor-like protein kinase | 0 | 60 | 115472561 | dbj|BAC84489.1| putative serine/threonine-specific protein kinase [Oryza sativa (japonica cultivar-group)] |
| 226 | 524 | PHE0010652_22429 | 3 | Corn high oil tRNA methyltransferase | 1.00E-172 | 94 | 115469828 | dbj|BAD53799.1| putative FtsJ homolog 1 isoform b [Oryza sativa (japonica cultivar-group)] |
| 227 | 525 | PHE0008158_18448 | 7 | ZMEN1 | 7.00E-65 | 56 | 115437056 | dbj|BAD73580.1| zinc-binding protein-like [Oryza sativa (japonica cultivar-group)] |

TABLE 2-continued

| NUC SEQ ID NO | PEP SEQ ID NO | Gene ID | BV ID | Gene Name | e-value | % id | GenBank ID | Annotation |
|---|---|---|---|---|---|---|---|---|
| 228 | 526 | PHE0003316_20755 | 30 | E. coli beta-glucuronidase with intron 2 from potato light-inducible tissue-specific gene | 0 | 100 | 475169 | emb|CAA83649.1| beta-glucuronidase [synthetic construct] |
| 229 | 527 | PHE0009478_20470 | 2 | Corn gibberellin 20 oxidase | 1.00E-167 | 82 | 37359180 | gb|AAN73384.1| putative gibberellin 20 oxidase [Oryza rufipogon] |
| 229 | 527 | PHE0009478_20900 | 1 | Corn gibberellin 20 oxidase | 1.00E-167 | 82 | 37359180 | gb|AAN73384.1| putative gibberellin 20 oxidase [Oryza rufipogon] |
| 229 | 527 | PHE0009478_20471 | any | Corn gibberellin 20 oxidase | 1.00E-167 | 82 | 37359180 | gb|AAN73384.1| putative gibberellin 20 oxidase [Oryza rufipogon] |
| 230 | 528 | PHE0010395_21760 | 30 | Soy DUF716 | 3.00E-84 | 55 | 124365521 | gb|ABN09755.1| Proteinase inhibitor I4, serpin [Medicago truncatula] |
| 231 | 529 | PHE0010391_21753 | 30 | Soy Unknown protein | 7.00E-64 | 91 | 115463333 | gb|AAV43818.1| unknown protein [Oryza sativa (japonica cultivar-group)] |
| 232 | 530 | PHE0010396_21761 | 30 | Soy DUF716 | 2.00E-83 | 56 | 124365521 | gb|ABN09755.1|Proteinase inhibitor I4, serpin [Medicago truncatula] |
| 233 | 531 | PHE0009511_22422 | 26 | Cucurbita S-adenosylmethionine decarboxylase | 1.00E-147 | 73 | 21239731 | gb|AAM44307.1| S-adenosylmethionine decarboxylase [Citrofortunella mitis] |
| 234 | 532 | PHE0010614_22399 | 3 | Corn high oil SOUL-like protein | 2.00E-94 | 80 | 115435220 | dbj|BAA96146.1| putative heme binding protein 2 [Oryza sativa (japonica cultivar-group)] |
| 235 | 533 | PHE0011420_23634 | 3 | Corn unknown protein | 0 | 91 | 115464535 | ref|NP_001055867.1|Os05g0482600 [Oryza sativa (japonica cultivar-group)] |
| 236 | 534 | PHE0011454_23667 | 13 | Corn H2B2 | 3.00E-36 | 87 | 122044864 | sp|P05621| Wheat histone H2B.2 |
| 237 | 535 | PHE0011443_24001 | 13 | Corn H2B1 | 2.00E-39 | 77 | 1708107 | sp|P54348| Maize histone H2B.5 (H2B) |
| 238 | 536 | PHE0011452_23665 | 13 | Corn H3-2 | 3.00E-69 | 99 | 15232146 | sp|P69246| Maize hHistone H3.2 |
| 239 | 537 | PHE0010394_21758 | 30 | Soy Sin3 associated polypeptide | 2.00E-52 | 82 | 115443887 | dbj|BAD07609.1| putative P18 [Oryza sativa (japonica cultivar-group)] |
| 240 | 538 | PHE0010397_21762 | 30 | Soy unknown protein | 7.00E-17 | 57 | 82568700 | dbj|BAE48663.1|Pm52 [Prunus mume] |
| 241 | 539 | PHE0010398_21763 | 30 | Soy unknown protein | 1.00E-17 | 56 | 82568700 | dbj|BAE48663.1|Pm52 [Prunus mume] |
| 242 | 540 | PHE0010100_21467 | 20 | Klebsiella nitrite reductase | 0 | 90 | 585562 | gb|AAA25099.1| nitrite reductase [Klebsiella oxytoca] |
| 243 | 541 | PHE0011503_23734 | 1 | Corn ethylene receptor etr1 mutant | 0 | 91 | 38607373 | gb|AAR25566.1| ethylene receptor [Zea mays] |
| 243 | 541 | PHE0011503_23736 | 15 | Corn ethylene receptor etr1 mutant | 0 | 91 | 38607373 | gb|AAR25566.1| ethylene receptor [Zea mays] |
| 244 | 542 | PHE0010099_21319 | 13 | Klebsiella nitrate reductase large subunit | 0 | 87 | 18314343 | gb|AAA25100.2| nitrate reductase large subunit [Klebsiella oxytoca] |

TABLE 2-continued

| NUC SEQ ID NO | PEP SEQ ID NO | Gene ID | BV ID | Gene Name | e-value | % id | GenBank ID | Annotation |
|---|---|---|---|---|---|---|---|---|
| 244 | 542 | PHE0010099_21461 | 9 | Klebsiella nitrate reductase large subunit | 0 | 87 | 18314343 | gb|AAA25100.2| nitrate reductase large subunit [Klebsiella oxytoca] |
| 244 | 542 | PHE0010099_21466 | 20 | Klebsiella nitrate reductase large subunit | 0 | 87 | 18314343 | gb|AAA25100.2| nitrate reductase large subunit [Klebsiella oxytoca] |
| 245 | 543 | PHE0011269_23400 | 13 | Arabidopsis HIO2019A | 0 | 96 | 42562138 | gb|AAF97271.1| meristem L1 layer homeobox protein like (ATML1) from Arabidopsis thaliana gb|U37589 and contains Transposase PF|01527, Homeobox PF|00046, and START PF|01852 domains. |
| 246 | 544 | PHE0008393_18762 | 20 | Corn roothairless 1 | 0 | 95 | 34733383 | gb|AAQ81632.1| roothairless 1 [Zea mays] |
| 247 | 545 | PHE0010223_21491 | 3 | Corn sucrose transport protein 4 | 0 | 87 | 49066602 | gb|AAT51689.1| sucrose transport protein [Zea mays] |
| 248 | 546 | PHE0011613_23858 | 3 | Corn WRI1 | 1.00E-109 | 56 | 85815798 | dbj|BAE78578.1|aintegumenta-like [Oryza sativa (japonica cultivar-group)] |
| 248 | 546 | PHE0011613_23860 | 7 | Corn WRI1 | 1.00E-109 | 56 | 85815798 | dbj|BAE78578.1|aintegumenta-like protein [Oryza sativa (japonica cultivar-group)] |
| 249 | 547 | PHE0001582_22064 | 1 | Corn ethylene receptor ETR1 like | 0 | 93 | 10241927 | gb|AAR25568.1| ethylene receptor [Zea mays] |
| 250 | 548 | PHE0007444_22314 | 18 | Corn aminopropyl transferase | 0 | 94 | 74481421 | gb|AAW57523.1| spermidine synthase [Zea mays] |
| 251 | 549 | PHE0010543_22298 | 16 | Corn en-like protein FDR2 | 4.00E-92 | 94 | 115498267 | gb|ABI98712.1| terminal flower 1 [Zea mays] |
| 252 | 550 | PHE0010543_22323 | 12 | Cen-like protein FDR2 | 3.00E-83 | 94 | 115498267 | gb|ABI98712.1| terminal flower 1 [Zea mays] |
| 253 | 551 | PHE0011081_23033 | 30 | Arabidopsis SUC2 | 0 | 88 | 15239921 | ref|NP_199174.1|carbohydrate/sugar transporter [Arabidopsis thaliana] |
| 254 | 552 | PHE0011075_23026 | 30 | Wheat P-II | 3.00E-62 | 77 | 125550734 | gb|EAY96443.1| hypothetical protein OsI_017676 [Oryza sativa (indica cultivar-group)] |
| 255 | 553 | PHE0010100_21462 | 9 | Klebsiella Nitrite reductase | 0 | 90 | 585562 | sp|Q06458| Nitrite reductase [NAD(PH] large subunit [Klebsiella oxytoca] |
| 256 | 554 | PHE0009640_21775 | 30 | Arabidopsis ME10609 | 3.00E-53 | 100 | 15236188 | ref|NP_195203.1| unknown protein [Arabidopsis thaliana] |
| 257 | 555 | PHE0010092_21307 | 13 | Corn translation initiation factor 2 alpha subunit | 1.00E-158 | 84 | 115452457 | gb|ABF95443.1| Eukaryotic translation initiation factor 2 alpha subunit [Oryza sativa (japonica cultivar-group)] |
| 258 | 556 | PHE0004611_24123 | 13 | Arabidopsis putative peptide transporter | 0 | 89 | 12325237 | gb|AAG52567.1| putative peptide transporter [Arabidopsis thaliana] |
| 259 | 557 | PHE0010093_21308 | 13 | Corn translation initiation factor 2 alpha subunit | 1.00E-162 | 85 | 115452457 | gb|ABF95443.1| Eukaryotic translation initiation factor 2 alpha subunit [Oryza sativa (japonica cultivar-group)] |

TABLE 2-continued

| NUC SEQ ID NO | PEP SEQ ID NO | Gene ID | BV ID | Gene Name | e-value | % id | GenBank ID | Annotation |
|---|---|---|---|---|---|---|---|---|
| 260 | 558 | PHE0008605_23084 | 13 | Arabidopsis putative histone H2B | 4.00E-40 | 98 | 15226943 | gb|AAM62619.1| putative histone H2B [Arabidopsis thaliana] |
| 261 | 559 | PHE0009939_21100 | 16 | Arabidopsis glycine dehydrogenase | 0 | 98 | 15234036 | ref|NP_195027.1| glycine dehydrogenase [Arabidopsis thaliana] |
| 262 | 560 | PHE0009941_21105 | 8 | Corn Moc1-like | 1.00E-124 | 80 | 125540188 | gb|EAY86583.1| hypothetical protein OsI_007816 [Oryza sativa (indica cultivar-group)] |
| 263 | 561 | PHE0009951_21135 | 8 | Yeast QSR1-like | 1.00E-115 | 93 | 6323104 | sp|P41805| Yeast 60S ribosomal protein L10 (L9) (Ubiquinol-cytochrome C reductase complex subunit VI-requiring protein) |
| 264 | 562 | PHE0009943_21127 | 8 | Arabidopsis QSR1-like | 1.00E-127 | 100 | 18408550 | gb|AAM64974.1| 60S ribosomal protein L10 [Arabidopsis thaliana] |
| 265 | 563 | PHE0009948_21132 | 8 | Soy QSR1-like | 1.00E-120 | 93 | 92870109 | gb|ABE79479.1| Ribosomal protein L10E [Medicago truncatula] |
| 266 | 564 | PHE0011084_23040 | 30 | Soy SNG1_sinapoylglucose:malate sinapoyltransferase | 0 | 77 | 92896730 | gb|ABE93328.1|Peptidase S10, serine carboxypeptidase [Medicago truncatula] |
| 267 | 565 | PHE0008233_23042 | 30 | Soy Phi-1 protein | 1.00E-122 | 71 | 3759184 | dbj|BAA33810.1| phi-1 [Nicotiana tabacum] |
| 268 | 566 | PHE0010854_22730 | 13 | Soy regulator of G-protein signaling | 1.00E-160 | 58 | 22331342 | ref|NP_189238.2| Regulator of G-protein signaling 1 [Arabidopsis thaliana] |
| 269 | 567 | PHE0003797_23051 | 10 | Corn DNA-binding protein Dof2 | 1.00E-44 | 63 | 1061306 | emb|CAA56287.1| Dof2 [Zea mays] |
| 270 | 568 | PHE0010194_21769 | 30 | Arabidopsis putative endo-1,4-beta glucanase | 0 | 94 | 15255301 | emb|CAB80722.1| putative endo-1,4-beta glucanase [Arabidopsis thaliana] |
| 271 | 569 | PHE0010197_21429 | 13 | Corn putative DNA binding protein | 2.00E-25 | 72 | 115451027 | gb|ABF94221.1| bHLH family protein [Oryza sativa (japonica cultivar-group)] |
| 271 | 569 | PHE0010197_21454 | 5 | Corn putative DNA binding protein | 2.00E-25 | 72 | 115451027 | gb|ABF94221.1| bHLH family protein [Oryza sativa (japonica cultivar-group)] |
| 271 | 569 | PHE0010197_21455 | 16 | Corn putative DNA binding protein | 2.00E-25 | 72 | 115451027 | gb|ABF94221.1| bHLH family protein [Oryza sativa (japonica cultivar-group)] |
| 271 | 569 | PHE0010197_21456 | 20 | Corn putative DNA binding protein | 2.00E-25 | 72 | 115451027 | gb|ABF94221.1| bHLH family protein [Oryza sativa (japonica cultivar-group)] |
| 271 | 569 | PHE0010197_21770 | 30 | Corn putative DNA binding protein | 2.00E-25 | 72 | 115451027 | gb|ABF94221.1| bHLH family protein [Oryza sativa (japonica cultivar-group)] |

TABLE 2-continued

| NUC SEQ ID NO | PEP SEQ ID NO | Gene ID | BV ID | Gene Name | e-value | % id | GenBank ID | Annotation |
|---|---|---|---|---|---|---|---|---|
| 272 | 570 | PHE0011665_23899 | 30 | Arabidopsis chlorophyll a/b binding protein | 1.00E-146 | 96 | 15225630 | gb|AAM20369.1| putative chlorophyll a/b binding protein [Arabidopsis thaliana] |
| 273 | 571 | PHE0012178_24443 | 3 | Corn putative chain C, structure of the plant transcriptional regulator Pbf-2 | 4.00E-99 | 78 | 115444353 | dbj|BAD28032.1| putative chain C, structure of the plant transcriptional regulator Pbf-2 [Oryza sativa (japonica cultivar-group)] |
| 274 | 572 | PHE0012170_24424 | 3 | Arabidopsis AGROS-like | 7.00E-40 | 74 | 30689607 | gb|ABC96792.1| ARGOS-like [Arabidopsis thaliana] |
| 275 | 573 | PHE0011064_22994 | 4 | Corn LPA1 | 0 | 85 | 115436512 | dbj|BAD52962.1| unknown protein [Oryza sativa (japonica cultivar-group)] |
| 275 | 573 | PHE0011064_23000 | 8 | Corn LPA1 | 0 | 85 | 115436512 | dbj|BAD52962.1| unknown protein [Oryza sativa (japonica cultivar-group)] |
| 275 | 573 | PHE0011064_23002 | 18 | Corn LPA1 | 0 | 85 | 115436512 | dbj|BAD52962.1| unknown protein [Oryza sativa (japonica cultivar-group)] |
| 275 | 573 | PHE0011064_23003 | 9 | Corn LPA1 | 0 | 85 | 115436512 | dbj|BAD52962.1| unknown protein [Oryza sativa (japonica cultivar-group)] |
| 275 | 573 | PHE0011064_23004 | 10 | Corn LPA1 | 0 | 85 | 115436512 | dbj|BAD52962.1| unknown protein [Oryza sativa (japonica cultivar-group)] |
| 276 | 574 | PHE0010201_21768 | 30 | Soy DNA-binding protein | 9.00E-30 | 75 | 30689711 | ref|NP_849712.1| transcription regulator [Arabidopsis thaliana] |
| 277 | 575 | PHE0010838_22702 | 30 | Soy PIN1 | 3.00E-32 | 71 | 25140423 | gb|AAN71616.1| PIN-like protein [Gossypium hirsutum] |
| 278 | 576 | PHE0010201_21433 | 13 | Soy DNA-binding protein | 1.00E-29 | 75 | 30689711 | ref|NP_849712.1| transcription regulator [Arabidopsis thaliana] |
| 279 | 577 | PHE0011446_23659 | 13 | Corn histone H3-1 | 7.00E-59 | 87 | 166384 | gb|AAA32655.1| histone H3 (H3-1.1) |
| 280 | 578 | PHE0001424_22077 | 9 | Corn seed storage protein, 35K isoform AmA1 - | 1.00E-68 | 41 | 57233444 | gb|AAW48295.1| pore-forming toxin-like protein Hfr-2 [Triticum aestivum] |
| 281 | 579 | PHE0011445_23658 | 13 | Corn putative elicitor-responsive gene-3 | 3.00E-71 | 89 | 115447529 | dbj|BAD25356.1| putative elicitor-responsive gene-3 [Oryza sativa (japonica cultivar-group)] |
| 282 | 580 | PHE0010090_21297 | 21 | Corn receptor protein kinase CLAVATA1 | 0 | 79 | 115451705 | gb|ABF94768.1| Receptor protein kinase CLAVATA1 precursor, [Oryza sativa (japonica cultivar-group)] |
| 283 | 581 | PHE0012180_24445 | 7 | Corn regulatory protein viviparous-1 | 0 | 83 | 138603 | sp|P26307| Maize regulatory protein viviparous-1 |
| 284 | 582 | PHE0011083_23039 | 30 | Soy SAG13 like homolog | 8.00E-87 | 63 | 15239327 | ref|NP_196225.1| oxidoreductase; dbj|BAA98195.1| short chain alcohol dehydrogenase-like [Arabidopsis thaliana] |

TABLE 2-continued

| NUC SEQ ID NO | PEP SEQ ID NO | Gene ID | BV ID | Gene Name | e-value | % id | GenBank ID | Annotation |
|---|---|---|---|---|---|---|---|---|
| 285 | 583 | PHE0011085_23041 | 30 | Soy SNG1_sinapoylglucose:malate sinapoyltransferase | 1.00E-157 | 62 | 92896727 | gb|ABE93325.1|Peptidase S10, serine carboxypeptidase [*Medicago truncatula*] |
| 286 | 584 | PHE0012175_24440 | 3 | Corn TSO1_like | 0 | 62 | 115489476 | gb|ABA99828.1| Tesmin/TSO1-like CXC domain containing protein [*Oryza sativa* (*japonica* cultivar-group)] |
| 286 | 584 | PHE0012175_24448 | 7 | Corn TSO1_like | 0 | 62 | 115489476 | gb|ABA99828.1| Tesmin/TSO1-like CXC domain containing protein [*Oryza sativa* (*japonica* cultivar-group)] |
| 287 | 585 | PHE0012177_24442 | 3 | Corn P24_like | 1.00E-101 | 74 | 119638471 | gb|ABL85062.1| expressed protein [*Brachypodium sylvaticum*] |
| 288 | 586 | PHE0011447_23660 | 13 | Corn P0031D02.12 protein | 1.00E-71 | 80 | 115440763 | gb|EAY76322.1| hypothetical protein OsI_004169 [*Oryza sativa* (*indica* cultivar-group)] |
| 289 | 587 | PHE0010194_21426 | 13 | *Arabidopsis* putative endo-1,4-beta glucanase | 0 | 95 | 15235301 | emb|CAB80722.1| putative endo-1,4-beta glucanase [*Arabidopsis thaliana*] |
| 290 | 588 | PHE0011666_23900 | 30 | Soy SPDS | 1.00E-165 | 87 | 99083515 | gb|ABF66657.1| spermidine synthase [*Ammopiptanthus mongolicus*] |
| 291 | 589 | PHE0011448_24160 | 13 | Corn histone H4-2 | 2.00E-30 | 80 | 115479301 | ref|NP_001063244.1| Os09g0433500 [*Oryza sativa* (*japonica* cultivar-group)] |
| 292 | 590 | PHE0008324_18636 | 13 | *Arabidopsis* T27I1.4 protein | 0 | 86 | 15218372 | ref|NP_172473.1| unknown protein [*Arabidopsis thaliana*] |
| 293 | 591 | PHE0006971_16875 | 13 | Ceres82Rice unknown protein | 1.00E-124 | 84 | 125583584 | gb|EAZ24515.1| hypothetical protein OsI_007998 [*Oryza sativa* (*japonica* cultivar-group)] |
| 294 | 592 | PHE0009939_21147 | 20 | *Arabidopsis* glycine dehydrogenase | 0 | 98 | 15234036 | ref|NP_195027.1| glycine dehydrogenase [*Arabidopsis thaliana*] |
| 295 | 593 | PHE0009953_21137 | 9 | Corn dicarboxylate translocator 1 | 0 | 89 | 40363459 | dbj|BAD06219.1| plastidic 2-oxoglutarate/malate transporter [*Zea mays*] |
| 296 | 594 | PHE0006907_16797 | 13 | Corn DUF150_MON_ZM4 1251 | 5.00E-94 | 60 | 115458524 | ref|NP_001052862.1| Os04g0438300 [*Oryza sativa* (*japonica* cultivar-group)] |
| 297 | 595 | PHE0008557_18970 | 13 | Corn FAD_binding_6[1]::NAD_binding_1[1] ferredoxin-NADP reductase | 0 | 89 | 115455751 | dbj|BAA07479.1| root ferredoxin-NADP+ reductase [*Oryza sativa* (*japonica* cultivar-group)] |
| 298 | 596 | PHE0006443_15955 | 13 | *Arabidopsis* putative SET-domain protein | 0 | 98 | 15226918 | gb|AAL32813.1| putative SET-domain protein [*Arabidopsis thaliana*] |

Selection Methods for Transgenic Plants with Enhanced Agronomic Trait

Within a population of transgenic plants regenerated from plant cells transformed with the recombinant DNA many plants that survive to fertile transgenic plants that produce seeds and progeny plants will not exhibit an enhanced agronomic trait. Selection from the population is necessary to identify one or more transgenic plant cells that can provide plants with the enhanced trait. Transgenic plants having enhanced traits are selected from populations of plants regenerated or derived from plant cells transformed as described herein by evaluating the plants in a variety of assays to detect an enhanced trait, e.g. enhanced water use efficiency, enhanced cold tolerance, increased yield, enhanced nitrogen use efficiency, enhanced seed protein and enhanced seed oil. These assays also may take many forms including, but not limited to, direct screening for the trait in a greenhouse or field trial or by screening for a surrogate trait. Such analyses can be directed to detecting changes in the chemical composition, biomass, physiological properties, morphology of the plant. Changes in chemical compositions such as nutritional composition of grain can be detected by analysis of the seed composition and content of protein, free amino acids, oil, free fatty acids, starch or tocopherols. Changes in biomass characteristics can be made on greenhouse or field grown plants and can include plant height, stem diameter, root and shoot dry weights; and, for corn plants, ear length and diameter. Changes in physiological properties can be identified by evaluating responses to stress conditions, for example assays using imposed stress conditions such as water deficit, nitrogen deficiency, cold growing conditions, pathogen or insect attack or light deficiency, or increased plant density. Changes in morphology can be measured by visual observation of tendency of a transformed plant with an enhanced agronomic trait to also appear to be a normal plant as compared to changes toward bushy, taller, thicker, narrower leaves, striped leaves, knotted trait, chlorosis, albino, anthocyanin production, or altered tassels, ears or roots. Other selection properties include days to pollen shed, days to silking, leaf extension rate, chlorophyll content, leaf temperature, stand, seedling vigor, internode length, plant height, leaf number, leaf area, tillering, brace roots, stay green, stalk lodging, root lodging, plant health, barreness/prolificacy, green snap, and pest resistance. In addition, phenotypic characteristics of harvested grain may be evaluated, including number of kernels per row on the ear, number of rows of kernels on the ear, kernel abortion, kernel weight, kernel size, kernel density and physical grain quality. Although the plant cells and methods of this invention can be applied to any plant cell, plant, seed or pollen, e.g. any fruit, vegetable, grass, tree or ornamental plant, the various aspects of the invention are preferably applied to corn, soybean, cotton, canola, alfalfa, wheat and rice plants.

The following examples are included to demonstrate aspects of the invention, those of skill in the art should, in light of the present disclosure, appreciate that many changes can be made in the specific aspects which are disclosed and still obtain a like or similar results without departing from the spirit and scope of the invention.

Example 1. Plant Expression Constructs

This example illustrates the construction of plasmids for transferring recombinant DNA into plant cells which can be regenerated into transgenic plants of this invention A. Plant Expression Constructs for Corn Transformation A base corn transformation vector pMON93039, as set forth in SEQ ID NO: 30521, illustrated in Table 3 and FIG. 2, was fabricated for use in preparing recombinant DNA for *Agrobacterium*-mediated transformation into corn tissue.

TABLE 3

| Function | Name | Annotation | Coordinates of SEQ ID NO: 30521 |
|---|---|---|---|
| *Agrobacterium* T-DNA transfer | B-AGRtu.right border | Agro right border sequence, essential for transfer of T-DNA. | 11364-11720 |
| Gene of interest expression cassette | E-Os.Act1 | Upstream promoter region of the rice actin 1 gene | 19-775 |
| | E-CaMV.35S.2xA1-B3 | Duplicated 35S A1-B3 domain without TATA box | 788-1120 |
| | P-Os.Act1 | Promoter region of the rice actin 1 gene | 1125-1204 |
| | L-Ta.Lhcb1 | 5' untranslated leader of wheat major chlorophyll a/b binding protein | 1210-1270 |
| | I-Os.Act1 | First intron and flanking UTR exon sequences from the rice actin 1 gene | 1287-1766 |
| | T-St.Pis4 | 3' non-translated region of the potato proteinase inhibitor II gene which functions to direct polyadenylation of the mRNA | 1838-2780 |
| Plant selectable marker expression cassette | P-Os.Act1 | Promoter from the rice actin 1 gene | 2830-3670 |
| | L-Os.Act1 | First exon of the rice actin 1 gene | 3671-3750 |
| | I-Os.Act1 | First intron and flanking UTR exon sequences from the rice actin 1 gene | 3751-4228 |
| | TS-At.ShkG-CTP2 | Transit peptide region of *Arabidopsis* EPSPS | 4238-4465 |
| | CR-AGRtu.aroA-CP4.nat | Coding region for bacterial strain CP4 native aroA gene. | 4466-5833 |
| | T-AGRtu.nos | A 3' non-translated region of the nopaline synthase gene of *Agrobacterium tumefaciens* Ti plasmid which functions to direct polyadenylation of the mRNA. | 5849-6101 |

TABLE 3-continued

| Function | Name | Annotation | Coordinates of SEQ ID NO: 30521 |
|---|---|---|---|
| *Agrobacterium* T-DNA transfer | B-AGRtu.left border | Agro left border sequence, essential for transfer of T-DNA. | 6168-6609 |
| Maintenance in *E. coli* | OR-Ec.oriV-RK2 | The vegetative origin of replication from plasmid RK2. | 6696-7092 |
| | CR-Ec.rop | Coding region for repressor of primer from the ColE1 plasmid. Expression of this gene product interferes with primer binding at the origin of replication, keeping plasmid copy number low. | 8601-8792 |
| | OR-Ec.ori-ColE1 | The minimal origin of replication from the *E. coli* plasmid ColE1. | 9220-9808 |
| | P-Ec.aadA-SPC/STR | Promoter for Tn7 adenylyltransferase (AAD(3")) | 10339-10380 |
| | CR-Ec.aadA-SPC/STR | Coding region for Tn7 adenylyltransferase (AAD(3")) conferring spectinomycin and streptomycin resistance. | 10381-11169 |
| | T-Ec.aadA-SPC/STR | 3' UTR from the Tn7 adenylyltransferase (AAD(3")) gene of *E. coli*. | 11170-11227 |

Other base vectors similar to the one described above were also constructed as listed in Table 4. These base corn transformation vectors are also used for wheat and rice transformations. See Table 4 for a summary of base vectors and base vector ID's which are referenced in Table 2. Also see Table 5 for a summary of regulatory elements used in the gene expression cassettes for these base vectors and the SEQ ID NOs for these elements.

Primers for PCR amplification of protein coding nucleotides of recombinant DNA are designed at or near the start and stop codons of the coding sequence, in order to eliminate most of the 5' and 3' untranslated regions. Each recombinant DNA coding for a protein identified in Table 2 is amplified by PCR prior to insertion into the insertion site within the gene of interest expression cassette of one of the base vectors as referenced in Table 2.

TABLE 4

| Base Vector ID | |
|---|---|
| | Corn Base Vector |
| 1 | pMON92709 |
| 2 | pMON92713 |
| 3 | pMON92715 |
| 4 | pMON92716 |
| 5 | pMON92718 |
| 6 | pMON92719 |
| 7 | pMON92721 |
| 8 | pMON92722 |
| 9 | pMON92724 |
| 10 | pMON92729 |
| 11 | pMON93025 |
| 12 | pMON93026 |
| 13 | pMON93039 |
| 14 | pMON93043 |
| 15 | pMON94781 |
| 16 | pMON94830 |
| 17 | pMON99009 |
| 18 | pMON99048 |
| 19 | pMON99051 |
| 20 | pMON99052 |
| 21 | pMON100406 |
| | Soy And Canola Base Vector |
| 22 | pMON74537 |
| 23 | pMON74552 |
| 24 | pMON74553 |
| 25 | pMON82053 |
| 26 | pMON83145 |
| 27 | pMON92671 |
| 28 | pMON97027 |
| 29 | pMON99006 |
| 30 | pMON100407 |
| 31 | pMON102815 |
| 32 | pMON102819 |
| | Cotton Base Vector |
| 33 | pMON95549 |
| 34 | pMON99053 |

TABLE 5

| Base vector | Promoter | SEQ ID NO | Leader | SEQ ID NO | Intron | SEQ ID NO |
|---|---|---|---|---|---|---|
| pMON92709 | P-Os.GT1 | 30469 | L-Os.GT1 | 30493 | I-Zm.DnaK | 30516 |
| pMON92713 | P-Zm.P39486 | 30470 | L-Zm.39486 | 30494 | I-Zm.DnaK | 30516 |
| pMON92715 | P-Hv.Per1 | 30471 | L-Hv.Per1 | 30495 | I-Zm.DnaK | 30516 |
| pMON92716 | P-Zm.FDA | 30472 | L-Zm.FDA | 30496 | I-Zm.DnaK | 30516 |
| pMON92718 | P-Zm.CLK1 | 30473 | L-Zm.Cik1 | 30497 | I-Zm.Cik1 | 30517 |
| pMON92719 | P-Zm.RAB17 | 30474 | L-Zm.RAB17 | 30498 | I-Zm.DnaK | 30516 |
| pMON92721 | P-Zm.SzeinC1 | 30475 | L-Zm.SzeinC1 | 30499 | I-Zm.DnaK | 30516 |

TABLE 5-continued

| Base vector | Promoter | SEQ ID NO | Leader | SEQ ID NO | Intron | SEQ ID NO |
|---|---|---|---|---|---|---|
| pMON92722 | P-CaMV.35S-enh | 30476 | L-CaMV.35S | 30500 | I-Zm.DnaK | 30516 |
| pMON92724 | P-Zm.-636aldolase-0:1:2 + P-Zm.PPDK | 30477 | L-Zm.PPDK | 30501 | I-Zm.DnaK | 30516 |
| pMON92729 | P-Zm.PPDK | 30478 | L-Zm.PPDK | 30501 | I-Zm.DnaK | 30516 |
| pMON93025 | P-At.SUC2 | 30479 | L-At.SUC2 | 30502 | I-Zm.DnaK | 30516 |
| pMON93026 | P-Os.H1 | 30480 | L-Os.H1 | 30503 | I Zm.DnaK | 30516 |
| pMON93039 | E-Os.Act1 + E-CaMV.35S.2xA1-B3 + P-Os.Act1 | 30481 | L-Ta.Lhcb1 | 30504 | I-Os.Act1 | 30518 |
| pMON93043 | P-Zm.EM | 30482 | L-Zm.EM | 30505 | I-Zm.DnaK | 30516 |
| pMON94781 | P-Zm.Brittle-2 | 30483 | L-Zm.Brittle-2 | 30506 | I-Zm.DnaK | 30516 |
| pMON94830 | P-Os.Act16 | 30484 | L-Os.Act16 | 30507 | I-Os.Act16 | 30519 |
| pMON99009 | P-CaMV.35S-enh | 30476 | L-Ph.DnaK | 30508 | None | / |
| pMON99048 | P-Os.Act1 + E-CaMV.35S.2xA1-B3 | 30485 | L-Ta.Lhcb1 | 30504 | I-Os.Act1 | 30518 |
| pMON99051 | P-Zm.Kn1 | 30486 | L-Zm.Kn1 | 30509 | None | / |
| pMON99052 | P-Os.Rcc.3 | 30487 | L-Os.Rcc3 | 30510 | I-Zm.DnaK | 30516 |
| pMON100406 | P-Zm.Kn1 | 30486 | L-Zm.Kn1 | 30509 | I-Zm.DnaK | 30516 |
| pMON74537 | P-At.RbcS4 | 30488 | L-At.RbcS4 | 30511 | None | / |
| pMON74552 | P-CaMV.35S-enh | 30476 | None | / | None | / |
| pMON74553 | P-CaMV.35S-enh | 30476 | None | / | None | / |
| pMON82053 | P-CaMV.35S-enh | 30476 | None | / | None | / |
| pMON83145 | P-Gm.Hsp20 | 30489 | L-Gm.Hsp20 | 30512 | None | / |
| pMON92671 | P-At.SAMS3 | 30490 | L-At.SAMS3 | 30513 | I-At.SAMS3 | 30520 |
| pMON97027 | P-At.GRP7 | 30491 | L-At.GRP7 | 30514 | None | / |
| pMON99006 | P-CaMV.35S-enh | 30476 | None | / | None | / |
| pMON100407 | P-CaMV.35S-enh | 30476 | L-Ph.DnaK | 30508 | None | / |
| pMON102815 | P-At.Erecta | 30492 | L-At.Erecta | 30515 | None | / |
| pMON102819 | P-CaMV.35S-enh | 30476 | None | / | None | / |
| pMON95549 | P-At.SAMS3 | 30490 | L-At.SAMS3 | 30513 | I-At.SMAS3 | 30520 |
| pMON99053 | P-CaMV.35S-enh | 30476 | L-Ph.DnaK | 30508 | None | / |

For construct pMON94830, the L-Os.Act16 leader sequence (SEQ ID IN 30507) is interrupted by the I-Os.Act16 intron sequence (SEQ ID NO 30519) between nucleotide positions 3344 and 3861.

B. Plant Expression Constructs for Soy and Canola Transformation

Vectors for use in transformation of soybean and canola were also prepared. Elements of an exemplary common expression vector pMON82053 are shown in Table 6 below and FIG. 3. Another example of elements used in plant expression cassette for gene of interest such as PEP SEQ ID NOs 366 and 521 were the P-Gm.Sphas1 promoter (SEQ ID NO: 30524) and the L-Gm.Sphas1 leader (SEQ ID NO: 30525) sequences.

TABLE 6

| Function | Name | Annotation | Coordinates of SEQ ID NO: 30522 |
|---|---|---|---|
| Agrobacterium T-DNA transfer | B-AGRtu.left border | Agro left border sequence, essential for transfer of T-DNA. | 6144-6585 |
| Plant selectable marker expression cassette | P-At.Act7 | Promoter from the Arabidopsis actin 7 gene | 6624-7861 |
| | L-At.Act7 | 5'UTR of Arabidopsis Act7 gene | |
| | I-At.Act7 | Intron from the Arabidopsis actin7 gene | |
| | TS-At.ShkG-CTP2 | Transit peptide region of Arabidopsis EPSPS | 7864-8091 |
| | CR-AGRtu.aroA-CP4.nno_At | Synthetic CP4 coding region with dicot preferred codon usage. | 8092-9459 |
| | T-AGRtu.nos | A 3' non-translated region of the nopaline synthase gene of Agrobacterium tumefaciens Ti plasmid which functions to direct polyadenylation of the mRNA. | 9466-9718 |
| Gene of interest expression cassette | P-CaMV.35S-enh | Promoter for 35S RNA from CaMV containing a duplication of the −90 to −350 region. | 1-613 |
| | T-Gb.E6-3b | 3' untranslated region from the fiber protein E6 gene of sea-island cotton. | 688-1002 |
| Agrobacterium T-DNA transfer | B-AGRtu.right border | Agro right border sequence, essential for transfer of T-DNA. | 1033-1389 |
| Maintenance in E. coli | OR-Ec.oriV-RK2 | The vegetative origin of replication from plasmid RK2. | 5661-6057 |
| | CR-Ec.rop | Coding region for repressor of primer from the ColE1 plasmid. Expression of this gene product interferes with primer binding at the | 3961-4152 |

TABLE 6-continued

| Function | Name | Annotation | Coordinates of SEQ ID NO: 30522 |
|---|---|---|---|
| | OR-Ec.ori-ColE1 | origin of replication, keeping plasmid copy number low. The minimal origin of replication from the *E. coli* plasmid ColE1. | 2945-3533 |
| | P-Ec.aadA-SPC/STR | Promoter for Tn7 adenylyltransferase (AAD(3")) | 2373-2414 |
| | CR-Ec.aadA-SPC/STR | Coding region for Tn7 adenylyltransferase (AAD(3")) conferring spectinomycin and streptomycin resistance. | 1584-2372 |
| | T-Ec.aadA-SPC/STR | 3' UTR from the Tn7 adenylyltransferase (AAD(3")) gene of *E. coli*. | 1526-1583 |

Primers for PCR amplification of protein coding nucleotides of recombinant DNA are designed at or near the start and stop codons of the coding sequence, in order to eliminate most of the 5' and 3' untranslated regions. Each recombinant DNA coding for a protein identified in Table 2 is amplified by PCR prior to insertion into the insertion site within the gene of interest expression cassette of one of the base vectors as referenced in Table 2.

C. Cotton Transformation Vector

Plasmids for use in transformation of cotton were also prepared. Elements of an exemplary common expression vector pMON99053 are shown in Table 7 below and FIG. 4. Primers for PCR amplification of protein coding nucleotides of recombinant DNA are designed at or near the start and stop codons of the coding sequence, in order to eliminate most of the 5' and 3' untranslated regions. Each recombinant DNA coding for a protein identified in Table 2 is amplified by PCR prior to insertion into the insertion site within the gene of interest expression cassette of one of the base vectors as referenced in Table 2.

TABLE 7

| Function | Name | Annotation | Coordinates of SEQ ID NO: 30523 |
|---|---|---|---|
| *Agrobacterium* T-DNA transfer | B-AGRtu.right border | Agro right border sequence, essential for transfer of T-DNA. | 1-357 |
| Gene of interest expression cassette | Exp-CaMV.35S-enh + Ph.DnaK | Enhanced version of the 35S RNA promoter from CaMV plus the petunia hsp70 5' untranslated region | 388-1091 |
| | T-Ps.RbcS2-E9 | The 3' non-translated region of the pea RbcS2 gene which functions to direct polyadenylation of the mRNA. | 1165 1797 |
| Plant selectable marker expression cassette | Exp-CaMV.35S | Promoter and 5' untranslated region from the 35S RNA of CaMV | 1828-2151 |
| | CR-Ec.nptII-Tn5 | Coding region for neomycin phosphotransferase gene from transposon Tn5 which confers resistance to neomycin and kanamycin. | 2185-2979 |
| | T-AGRtu.nos | A 3' non-translated region of the nopaline synthase gene of *Agrobacterium tumefaciens* Ti plasmid which functions to direct polyadenylation of the mRNA. | 3011-3263 |
| *Agrobacterium* T-DNA transfer | B-AGRtu.left border | Agro left border sequence, essential for transfer of T-DNA. | 3309-3750 |
| Maintenance in *E. coli* | OR-Ec.oriV-RK2 | The vegetative origin of replication from plasmid RK2. | 3837-4233 |
| | CR-Ec.rop | Coding region for repressor of primer from the ColE1 plasmid. Expression of this gene product interferes with primer binding at the origin of replication, keeping plasmid copy number low. | 5742-5933 |
| | OR-Ec.ori-ColE1 | The minimal origin of replication from the *E. coli* plasmid ColE1. | 6361-6949 |

TABLE 7-continued

| Function | Name | Annotation | Coordinates of SEQ ID NO: 30523 |
|---|---|---|---|
| | P-Ec.aadA-SPC/STR | Promoter for Tn7 adenylyltransferase (AAD(3")) | 7480-7521 |
| | CR-Ec.aadA-SPC/STR | Coding region for Tn7 adenylyltransferase (AAD(3")) conferring spectinomycin and streptomycin resistance. | 7522-8310 |
| | T-Ec.aadA-SPC/STR | 3' UTR from the Tn7 adenylyltransferase (AAD(3")) gene of E. coli. | 8311-8368 |

Example 2. Corn Transformation

This example illustrates plant cell transformation methods useful in producing transgenic corn plant cells, plants, seeds and pollen of this invention and the production and identification of transgenic corn plants and seed with an enhanced trait, i.e. enhanced water use efficiency, enhanced cold tolerance, increased yield, enhanced nitrogen use efficiency, enhanced seed protein and enhanced seed oil. Plasmid vectors were prepared by cloning DNA identified in Table 2 in the identified base vectors for use in corn transformation of corn plant cells to produce transgenic corn plants and progeny plants, seed and pollen.

For *Agrobacterium*-mediated transformation of corn embryo cells corn plants of a readily transformable line are grown in the greenhouse and ears are harvested when the embryos are 1.5 to 2.0 mm in length. Ears are surface sterilized by spraying or soaking the ears in 80% ethanol, followed by air drying. Immature embryos are isolated from individual kernels on surface sterilized ears. Prior to inoculation of maize cells, *Agrobacterium* cells are grown overnight at room temperature. Immature maize embryo cells are inoculated with *Agrobacterium* shortly after excision, and incubated at room temperature with *Agrobacterium* for 5-20 minutes. Immature embryo plant cells are then co-cultured with *Agrobacterium* for 1 to 3 days at 23° C. in the dark. Co-cultured embryos are transferred to selection media and cultured for approximately two weeks to allow embryogenic callus to develop. Embryogenic callus is transferred to culture medium containing 100 mg/L paromomycin and subcultured at about two week intervals. Transformed plant cells are recovered 6 to 8 weeks after initiation of selection.

For *Agrobacterium*-mediated transformation of maize callus immature embryos are cultured for approximately 8-21 days after excision to allow callus to develop. Callus is then incubated for about 30 minutes at room temperature with the *Agrobacterium* suspension, followed by removal of the liquid by aspiration. The callus and *Agrobacterium* are co-cultured without selection for 3-6 days followed by selection on paromomycin for approximately 6 weeks, with biweekly transfers to fresh media. Paromomycin resistant calli are identified about 6-8 weeks after initiation of selection.

For transformation by microprojectile bombardment maize immature embryos are isolated and cultured 3-4 days prior to bombardment. Prior to microprojectile bombardment, a suspension of gold particles is prepared onto which the desired recombinant DNA expression cassettes are precipitated. DNA is introduced into maize cells as described in U.S. Pat. Nos. 5,550,318 and 6,399,861 using the electric discharge particle acceleration gene delivery device. Following microprojectile bombardment, tissue is cultured in the dark at 27° C. Additional transformation methods and materials for making transgenic plants of this invention, for example, various media and recipient target cells, transformation of immature embryos and subsequence regeneration of fertile transgenic plants are disclosed in U.S. Pat. Nos. 6,194,636 and 6,232,526 and U.S. patent application Ser. No. 09/757,089, which are incorporated herein by reference.

To regenerate transgenic corn plants a callus of transgenic plant cells resulting from transformation and selection is placed on media to initiate shoot development into plantlets which are transferred to potting soil for initial growth in a growth chamber at 26° C. followed by a mist bench before transplanting to 5 inch pots where plants are grown to maturity. The regenerated plants are self-fertilized and seed is harvested for use in one or more methods to select seeds, seedlings or progeny second generation transgenic plants (R2 plants) or hybrids, e.g. by selecting transgenic plants exhibiting an enhanced trait as compared to a control plant.

Transgenic corn plant cells are transformed with recombinant DNA from each of the genes identified in Table 2. Progeny transgenic plants and seed of the transformed plant cells are screened for enhanced water use efficiency, enhanced cold tolerance, increased yield, enhanced nitrogen use efficiency, enhanced seed protein and enhanced seed oil as reported in Example 7.

Example 3. Soybean Transformation

This example illustrates plant transformation useful in producing the transgenic soybean plants of this invention and the production and identification of transgenic seed for transgenic soybean having enhanced water use efficiency, enhanced cold tolerance, increased yield, enhanced nitrogen use efficiency, enhanced seed protein and enhanced seed oil.

For *Agrobacterium* mediated transformation, soybean seeds are imbided overnight and the meristem explants excised. The explants are placed in a wounding vessel. Soybean explants and induced *Agrobacterium* cells from a strain containing plasmid DNA with the gene of interest cassette and a plant selectable marker cassette are mixed no later than 14 hours from the time of initiation of seed imbition, and wounded using sonication. Following wounding, explants are placed in co-culture for 2-5 days at which point they are transferred to selection media for 6-8 weeks to allow selection and growth of transgenic shoots. Resistant shoots are harvested approximately 6-8 weeks and placed into selective rooting media for 2-3 weeks. Shoots producing roots are transferred to the greenhouse and potted in soil. Shoots that remain healthy on selection, but do not produce roots are transferred to non-selective rooting media for an additional two weeks. Roots from any shoots that produce roots off selection are tested for expression of the plant selectable marker before they are transferred to the greenhouse and potted in soil. Additionally, a DNA construct can be transferred into the genome of a soybean cell by particle bombardment and the cell regenerated into a fertile soybean plant as described in U.S. Pat. No. 5,015,580, herein incorporated by reference.

Transgenic soybean plant cells are transformed with recombinant DNA from each of the genes identified in Table 2. Transgenic progeny plants and seed of the transformed plant cells are screened for enhanced water use efficiency, enhanced cold tolerance, increased yield, enhanced nitrogen use efficiency, enhanced seed protein and enhanced seed oil as reported in Example 7.

Example 4. Cotton Transgenic Plants with Enhanced Agronomic Traits

Cotton transformation is performed as generally described in WO00036911 and in U.S. Pat. No. 5,846,797. Transgenic cotton plants containing each of the recombinant DNA having a sequence of SEQ ID NO: 1 through SEQ ID NO: 298 are obtained by transforming with recombinant DNA from each of the genes identified in Table 1. Progeny transgenic plants are selected from a population of transgenic cotton events under specified growing conditions and are compared with control cotton plants. Control cotton plants are substantially the same cotton genotype but without the recombinant DNA, for example, either a parental cotton plant of the same genotype that was not transformed with the identical recombinant DNA or a negative isoline of the transformed plant. Additionally, a commercial cotton cultivar adapted to the geographical region and cultivation conditions, i.e. cotton variety ST474, cotton variety FM 958, and cotton variety Siokra L-23, are used to compare the relative performance of the transgenic cotton plants containing the recombinant DNA. The specified culture conditions are growing a first set of transgenic and control plants under "wet" conditions, i.e. irrigated in the range of 85 to 100 percent of evapotranspiration to provide leaf water potential of −14 to −18 bars, and growing a second set of transgenic and control plants under "dry" conditions, i.e. irrigated in the range of 40 to 60 percent of evapotranspiration to provide a leaf water potential of −21 to −25 bars. Pest control, such as weed and insect control is applied equally to both wet and dry treatments as needed. Data gathered during the trial includes weather records throughout the growing season including detailed records of rainfall; soil characterization information; any herbicide or insecticide applications; any gross agronomic differences observed such as leaf morphology, branching habit, leaf color, time to flowering, and fruiting pattern; plant height at various points during the trial; stand density; node and fruit number including node above white flower and node above crack boll measurements; and visual wilt scoring. Cotton boll samples are taken and analyzed for lint fraction and fiber quality. The cotton is harvested at the normal harvest timeframe for the trial area. Enhanced water use efficiency is indicated by increased yield, improved relative water content, enhanced leaf water potential, increased biomass, enhanced leaf extension rates, and improved fiber parameters.

The transgenic cotton plants of this invention are identified from among the transgenic cotton plants by agronomic trait screening as having increased yield and enhanced water use efficiency.

Example 5. Canola Transformation

This example illustrates plant transformation useful in producing the transgenic canola plants of this invention and the production and identification of transgenic seed for transgenic canola having enhanced water use efficiency, enhanced cold tolerance, increased yield, enhanced nitrogen use efficiency, enhanced seed protein and enhanced seed oil.

Tissues from in vitro grown canola seedlings are prepared and inoculated with overnight-grown *Agrobacterium* cells containing plasmid DNA with the gene of interest cassette and a plant selectable marker cassette. Following co-cultivation with *Agrobacterium*, the infected tissues are allowed to grow on selection to promote growth of transgenic shoots, followed by growth of roots from the transgenic shoots. The selected plantlets are then transferred to the greenhouse and potted in soil. Molecular characterization are performed to confirm the presence of the gene of interest, and its expression in transgenic plants and progenies. Progeny transgenic plants are selected from a population of transgenic canola events under specified growing conditions and are compared with control canola plants. Control canola plants are substantially the same canola genotype but without the recombinant DNA, for example, either a parental canola plant of the same genotype that is not transformed with the identical recombinant DNA or a negative isoline of the transformed plant Transgenic canola plant cells are transformed with recombinant DNA from each of the genes identified in Table 2. Transgenic progeny plants and seed of the transformed plant cells are screened for enhanced water use efficiency, enhanced cold tolerance, increased yield, enhanced nitrogen use efficiency, enhanced seed protein and enhanced seed oil as reported in Example 7.

Example 6. Homolog Identification

This example illustrates the identification of homologs of proteins encoded by the DNA identified in Table 2 which is used to provide transgenic seed and plants having enhanced agronomic traits. From the sequence of the homologs, homologous DNA sequence can be identified for preparing additional transgenic seeds and plants of this invention with enhanced agronomic traits.

An "All Protein Database" was constructed of known protein sequences using a proprietary sequence database and the National Center for Biotechnology Information (NCBI) non-redundant amino acid database (nr.aa). For each organism from which a polynucleotide sequence provided herein was obtained, an "Organism Protein Database" was constructed of known protein sequences of the organism; it is a subset of the All Protein Database based on the NCBI taxonomy ID for the organism.

The All Protein Database was queried using amino acid sequences provided herein as SEQ ID NO: 299 through SEQ ID NO: 596 using NCBI "blastp" program with E-value cutoff of 1e-8. Up to 1000 top hits were kept, and separated by organism names. For each organism other than that of the query sequence, a list was kept for hits from the query organism itself with a more significant E-value than the best hit of the organism. The list contains likely duplicated genes of the polynucleotides provided herein, and is referred to as the Core List. Another list was kept for all the hits from each organism, sorted by E-value, and referred to as the Hit List.

The Organism Protein Database was queried using polypeptide sequences provided herein as SEQ ID NO: 299 through SEQ ID NO: 596 using NCBI "blastp" program with E-value cutoff of 1e-4. Up to 1000 top hits were kept. A BLAST searchable database was constructed based on these hits, and is referred to as "SubDB". SubDB was queried with each sequence in the Hit List using NCBI "blastp" program with E-value cutoff of 1e-8. The hit with the best E-value was compared with the Core List from the corresponding organism. The hit is deemed a likely ortholog if it belongs to the Core List, otherwise it is deemed not a likely ortholog and there is no further search of sequences in the Hit List for the same organism. Homologs from a large number of distinct organisms were identified and are reported by amino acid sequences of SEQ ID NO: 597 through SEQ ID NO: 30468. These relationships of proteins of SEQ ID NO: 299 through 596 and homologs of SEQ ID NO: 597 through 30468 are identified in Table 8. The source organism for each homolog is found in the Sequence Listing.

TABLE 8

| PEP SEQ ID NO: | homolog SEQ ID NOs | | | | | | | | | | |
|---|---|---|---|---|---|---|---|---|---|---|---|
| 299: | 22505 | 17330 | 17332 | 3832 | 26661 | 24604 | 24601 | 26617 | 26553 | 26585 | 26591 | 26640 |
| | 26582 | 26471 | 26635 | 26572 | 26576 | 26556 | 26609 | 26423 | 25650 | 26551 | 2373 | 2405 |
| | 24690 | 25446 | 25450 | 26422 | 26473 | 25340 | 10489 | 21242 | 21238 | 21241 | 21279 | 24723 |
| | 24725 | 25494 | 25690 | 25164 | 16529 | 7978 | 10037 | 16615 | 16621 | 11055 | 12923 | 6955 |
| | 7874 | 7948 | 7839 | 8664 | 12144 | 14757 | 17096 | 14796 | 14828 | 26829 | 12171 | 21124 |
| | 23048 | 20000 | 23191 | 22333 | 20933 | 15625 | 22212 | 19851 | 28192 | 27896 | 22998 | 22992 |
| | 15629 | 28137 | 24133 | 22151 | 29931 | 985 | 2060 | 944 | 28955 | 28930 | 28990 | 29965 |
| | 15658 | 21486 | 21255 | 20071 | 19073 | 19014 | 18158 | 18127 | 18109 | 15620 | 2239 | 2233 |
| | 16398 | 14851 | 11657 | 12588 | 11744 | 14570 | 13748 | 13790 | 12143 | 12170 | 12173 | 12919 |
| | 15622 | 15628 | 15656 | 15604 | 16393 | 16394 | 16392 | 12916 | 11037 | 22432 | 8701 | 24656 |
| | 19135 | 19853 | 7817 | 18495 | 2869 | 8263 | 29437 | 29438 | 22440 | 22435 | 21711 | 22465 |
| | 21146 | 17031 | 19010 | 21907 | 27742 | 22415 | 5429 | 1188 | 5421 | 18365 | 23435 | 12382 |
| | 12090 | 12087 | 10571 | 18362 | 23640 | 15382 | 987 | 6445 | 6417 | 5413 | 8888 | 2538 |
| | 24892 | 15423 | 1089 | 1127 | 5417 | 21701 | 24630 | 24633 | 21702 | 21705 | 25589 | 25558 |
| | 21697 | 7438 | 22989 | 17339 | 1478 | 1506 | 1479 | 9199 | 25171 | 26307 | 1472 | 25424 |
| | 25418 | 5394 | 23942 | 8884 | 8887 | 12914 | 23541 | | | | | |
| 300: | 16906 | 20559 | 21806 | 5055 | 9056 | 13559 | 14510 | 4167 | 13364 | 13441 | 11165 | |
| | 3862 | 1913 | 6572 | 9353 | 29885 | 5672 | 23667 | 20433 | 11405 | 26215 | 8142 | 13983 |
| | 9317 | 1831 | 16167 | 26355 | 11049 | 12454 | 607 | 20163 | 21550 | 8941 | 3691 | 19336 |
| | 8960 | 11635 | 2500 | 12784 | 9832 | 13853 | 14431 | 6891 | 25892 | 24022 | 26873 | 8074 |
| | 10050 | 6314 | 15883 | 23231 | 829 | 4758 | 4754 | 28646 | 4717 | 20464 | 9858 | 7971 |
| | 12622 | 20501 | 4271 | 12195 | 9291 | 19503 | 21548 | 4124 | 10854 | 26029 | 12272 | 1775 |
| | 25590 | 22837 | 22812 | 22556 | 10678 | 16223 | 25625 | 21334 | 8456 | 22176 | 14327 | 14302 |
| | 17822 | 17624 | 16859 | 16850 | 17780 | 17619 | 17629 | 16852 | 10588 | 10650 | 1001 | 29219 |
| | 15690 | 20293 | 25766 | 12151 | 21485 | 14320 | 17504 | 15478 | 15477 | 15066 | 15835 | 30365 |
| | 30421 | 2696 | 20311 | 3417 | 19744 | 18488 | 3839 | 8782 | 17965 | 3743 | 3775 | 17509 |
| | 17514 | 7091 | 6457 | 12394 | 12411 | 4075 | 4077 | 17590 | 21909 | 28286 | 3388 | 16788 |
| | 15982 | 7848 | 29135 | 20349 | 19157 | 14248 | 29979 | 17396 | 17358 | 17398 | 17407 | 17324 |
| | 17410 | 17366 | 17403 | 17357 | 17368 | 17360 | 19996 | 19846 | 11904 | 23714 | 2173 | 22814 |
| | 22809 | 20197 | 29687 | 3983 | 24318 | 21492 | 20319 | 26103 | 28858 | 6802 | 20161 | 3448 |
| | 4055 | 12112 | 7750 | 12606 | 13406 | 12501 | 6292 | 9527 | 13807 | 3896 | 12598 | 5152 |
| | 5149 | 5155 | 368 | 10357 | 26816 | | | | | | | |
| 301: | 23796 | 2040 | 5965 | 5087 | 6920 | 4213 | 4210 | 3372 | 5323 | 16802 | 27336 | 6010 |
| | 8202 | 26922 | 2187 | 12208 | 19871 | 11517 | 22010 | 9197 | | | | |
| 302: | 23710 | 23757 | 13694 | 19592 | 23650 | 22298 | 8204 | 25706 | 24745 | 15742 | 30254 | 26637 |
| | 15339 | 21922 | 20145 | 25220 | 16474 | 13767 | 24177 | 23168 | 13704 | | | |
| 303: | 3118 | 4379 | 29540 | 19057 | 23492 | 24494 | 29662 | 25823 | 22886 | 22040 | 8636 | |
| 304: | 26286 | 15828 | 29381 | 9463 | 1447 | 21905 | 14853 | 28599 | 20781 | 27729 | 18418 | 27603 |
| | 25716 | 26765 | 16175 | 23282 | 13862 | 1876 | 2531 | 5158 | 2533 | 1911 | 11707 | 6224 |
| | 26059 | 22774 | 10047 | 19527 | 24245 | 14187 | 10461 | 29433 | 11856 | 11359 | 8254 | 1796 |
| | 13315 | 5545 | 10252 | 6191 | 13314 | 17203 | 23729 | 19203 | 6192 | 6228 | 29464 | 11849 |
| | 11846 | 6202 | 6193 | 27557 | 1797 | 10397 | 18417 | 9442 | 9470 | 9471 | 9441 | 2568 |
| | 1789 | 6233 | 6227 | 6222 | 2751 | 26484 | 19634 | 2753 | 2526 | 10548 | 2523 | 1794 |
| | 6151 | 4931 | 4935 | 5392 | 10581 | 10578 | 2167 | 28003 | 16045 | 2532 | 18805 | 25644 |
| | 25642 | 9834 | 12912 | 12907 | 15640 | 633 | 25781 | 4120 | 9293 | 11181 | 8741 | 3780 |
| | 18808 | 26630 | 26485 | 24195 | 4726 | 377 | 14947 | 2501 | 18997 | 20773 | 19301 | 16345 |
| | 18906 | 7189 | 15422 | 18210 | 21903 | 25270 | 24910 | 2503 | 10083 | 10113 | 10084 | |
| 305: | 18758 | 19672 | 29878 | 23393 | 24854 | 10271 | 27282 | 5416 | 23140 | 27083 | 2820 | 18194 |
| | 12159 | 9628 | 23204 | 13486 | 8110 | 12511 | 29407 | 1503 | 1698 | 28122 | 17599 | 5085 |
| | 4965 | 5960 | 13895 | 14534 | 22724 | 18476 | 18472 | 18083 | 6734 | 4997 | 23491 | 17752 |
| | 26978 | 29291 | 24877 | 24879 | 27070 | 7649 | 1949 | 21111 | 19488 | 21730 | 23945 | 21686 |
| | 27651 | 27650 | 25269 | 26607 | 2212 | 12263 | 12554 | 13918 | 14019 | 13994 | 24823 | |
| 306: | 4073 | 22555 | 4100 | 27267 | 26975 | 4996 | 15934 | 19811 | 15228 | 25434 | 15706 | 9550 |
| | 6935 | 23481 | 1480 | 1482 | 22482 | 23641 | 21374 | 10611 | 11281 | 1517 | 1518 | 20953 |
| | 27704 | 18146 | 5286 | 3202 | 20016 | 12556 | 8797 | 12122 | 11246 | 15875 | 7987 | 28966 |
| | 24975 | 15587 | 1524 | 1520 | 1525 | 22082 | 16220 | 12190 | 17779 | 13034 | 6068 | 14309 |
| | 1994 | 8624 | 24174 | 25476 | 7577 | 15375 | 9142 | 6515 | | | | |
| 307: | 16517 | 13655 | 16944 | 13657 | 7250 | 7253 | 12523 | 12555 | 12496 | 12558 | 12553 | 12525 |
| | 12447 | 12531 | 12529 | 11716 | 12499 | 12463 | 12453 | 11714 | 12577 | 12494 | 11711 | 21462 |
| | 12491 | 12601 | 12582 | 12580 | 21464 | 21465 | 21507 | 21503 | 16115 | 29908 | 3927 | 21531 |
| | 11721 | 12449 | 12456 | 12564 | 12574 | 12579 | 12597 | 4697 | 27420 | 29700 | 887 | 888 |
| | 29909 | 10124 | 10158 | 3563 | 3567 | 2220 | 19295 | 11183 | 6149 | 23835 | 18693 | 5946 |
| | 11374 | 7886 | 10617 | 22967 | 2516 | 25498 | 16862 | 19210 | 19213 | 20295 | 12609 | 20321 |
| | 19214 | 21959 | 21952 | 9615 | 9870 | 2134 | 24575 | 19069 | 12843 | 24557 | 21955 | 9616 |

TABLE 8-continued

| PEP SEQ ID NO: | homolog SEQ ID NOs | | | | | | | | | | |
|---|---|---|---|---|---|---|---|---|---|---|---|
| | 5341 | 17200 | 24499 | 19179 | 16766 | 27442 | 27444 | 27475 | 11328 | 16431 | 22721 | 27181 |
| | 5216 | 30264 | 17131 | 27106 | 28708 | 27417 | 27447 | 877 | 873 | 875 | 871 | 8082 |
| | 6820 | 25860 | 22904 | 13900 | 14638 | 15177 | 21498 | 16830 | 27002 | 26518 | 10906 | |
| 308: | 21299 | 5872 | 17817 | 22477 | 17074 | 5710 | 14819 | 10604 | 17874 | 1813 | 10959 | 10605 |
| | 15093 | 26425 | 26689 | 15978 | 7997 | 20445 | 27568 | 22238 | 24487 | 14436 | 8017 | 11460 |
| | 11177 | 23024 | 7463 | 17377 | 12864 | 16004 | 7043 | 10148 | 5131 | 17879 | 2644 | 4412 |
| | 30069 | 7754 | 23829 | 27906 | 18649 | 18440 | 12984 | 10731 | 1103 | 9112 | 16047 | 10098 |
| | 7912 | 16569 | 16562 | 6731 | 17991 | 27109 | 737 | 4745 | 1628 | 1918 | 8843 | 10143 |
| | 23669 | 15513 | 26808 | 624 | 8628 | 24803 | 29563 | 22820 | 5123 | 10502 | 15852 | 29463 |
| | 22220 | 10856 | 18502 | 23546 | 13041 | 11144 | 7740 | 22616 | 15720 | 20242 | 23531 | 5722 |
| | 20633 | 5177 | 20273 | 19174 | 27912 | 17072 | 2243 | 16163 | 25856 | 5049 | 6431 | 1557 |
| | 7243 | 920 | 10764 | 22406 | 29189 | 5927 | 25074 | 30314 | 11963 | 2240 | 3307 | 17229 |
| | 1852 | 25569 | 23447 | 28980 | 12872 | 29015 | 25605 | 11835 | 16360 | 5509 | 30059 | 20235 |
| | 4232 | 777 | 18344 | 30237 | 16693 | 10540 | 9369 | 8759 | 9835 | 6007 | 24894 | 10066 |
| | 18130 | 29536 | 17856 | 26868 | 3903 | 16811 | 18196 | 21620 | 26548 | 7365 | 15998 | 3435 |
| | 27303 | 23365 | 7429 | 11162 | 26510 | 12980 | 9574 | 23826 | 21579 | 5242 | 18786 | 14691 |
| | 24298 | 12247 | 3422 | 15077 | 5617 | 2735 | 26140 | 997 | 29968 | 12410 | 12430 | 10035 |
| | 14455 | 7492 | 23858 | 24253 | 17897 | 14804 | 22708 | 1951 | 3376 | 2209 | 19943 | 4307 |
| | 28095 | 17187 | 11974 | 15174 | 24900 | 18475 | 20119 | 16286 | 18268 | 17385 | 22117 | 27898 |
| | 8793 | 15872 | 15906 | 4708 | 21261 | 26796 | 17926 | 27187 | 29242 | 3511 | 15315 | 28909 |
| | 14450 | 15500 | 18402 | 15627 | 29217 | 28317 | 25837 | 1144 | 10601 | 28448 | 696 | 19865 |
| | 19308 | 28313 | 24999 | 21607 | 2359 | 23902 | 7170 | 26313 | 18751 | 16086 | 24401 | 23719 |
| | 26186 | 20994 | 6420 | 27239 | 24526 | 5823 | 15225 | 19802 | 25521 | 16776 | 22806 | |
| | 5296 | 9126 | 19695 | 20534 | 28027 | 27517 | 28414 | 17210 | 6379 | 15657 | 5267 | 30048 |
| | 12519 | 10872 | 7999 | 3409 | 15362 | 18419 | 9898 | 24104 | 13253 | 13534 | 12783 | 16649 |
| | 21079 | 7630 | 26772 | 22421 | 1477 | 28203 | 24992 | 8063 | 2672 | 9815 | 13717 | 30388 |
| | 28256 | 22915 | 19937 | 8726 | 10192 | 5739 | 848 | 22943 | 28147 | 3316 | 5705 | 29741 |
| | 13175 | 9919 | 22404 | 1054 | 27138 | 29191 | 24754 | 9604 | 14403 | 23630 | 10191 | 14456 |
| | 29106 | 21213 | 2964 | 12239 | 28568 | 17977 | 6904 | 14167 | 29917 | 25066 | 6760 | 11818 |
| | 10338 | 11895 | 9584 | 13160 | 28158 | 4901 | 13340 | 8682 | 19451 | 2848 | 22433 | 2436 |
| | 25490 | 10991 | 20029 | 19992 | 12490 | 12785 | 26327 | | | | | |
| 309: | 20952 | 3236 | 24334 | 17181 | 27703 | 2623 | 29914 | 6200 | 7062 | 3530 | 3554 | 23659 |
| | 25523 | 881 | 10869 | 12110 | 6449 | 24143 | 20219 | 18629 | 16735 | 28415 | 10036 | 20347 |
| | 20380 | 24855 | 4163 | 9382 | 18086 | 13740 | 12955 | 3770 | 21914 | 17308 | 26890 | 5621 |
| | 4316 | 22499 | 13629 | 7216 | 14424 | 1693 | 15401 | 20539 | 26693 | 4545 | 6048 | 10842 |
| | 24512 | 4305 | 18585 | 2506 | 19115 | 14873 | 12308 | 18961 | 24529 | 9057 | 20738 | 7334 |
| | 29837 | 22519 | 24768 | 3969 | 15041 | 24322 | 23592 | 29505 | 3601 | 11341 | 994 | 29145 |
| | 11268 | 22722 | 19591 | 4525 | 2445 | 29611 | 3707 | 4339 | 23545 | 23449 | 26341 | 20094 |
| | 26889 | 7940 | 9580 | 26304 | 16101 | 5572 | 635 | 10465 | 4954 | 10916 | 15869 | 8855 |
| | 6601 | 3351 | 23384 | 4094 | 29250 | 21718 | 17876 | 2598 | 28965 | 5077 | 21429 | 17490 | 6375 |
| | 25086 | 13446 | 13636 | 23483 | 22483 | 7618 | 2598 | 29424 | 27960 | 18996 | 2440 | 7224 |
| | 13322 | 7785 | 27104 | 8134 | 6761 | 3390 | 3119 | 13435 | 20599 | 17077 | 24289 | 23988 |
| | 18684 | 20468 | 22443 | 27060 | 22953 | 27019 | 17163 | 27831 | 3678 | 18733 | 1346 | 17225 |
| | 3681 | 5554 | 26543 | 26495 | 19458 | 25397 | 1456 | 21781 | 24859 | 9468 | 9688 | 8767 |
| | 27583 | 7360 | 22732 | 20947 | 14430 | 3682 | 8790 | 14166 | 5271 | 28857 | 4601 | 1785 |
| | 6220 | 8856 | 8812 | 14515 | 5548 | 17409 | 11560 | 19742 | 5005 | 1435 | 30386 | 18204 |
| | 11765 | 23599 | 25429 | 24305 | 3499 | 7990 | 5931 | 13351 | 3632 | 7908 | 14951 | 7389 |
| | 24053 | 1667 | 1034 | 21846 | 12920 | 10712 | 17253 | 14508 | 17438 | 17283 | 5056 | 15270 |
| | 6588 | 24518 | 25812 | 8928 | 19389 | 21797 | 1648 | 15618 | 22165 | | | |
| 310: | 27320 | 24987 | 3155 | 1338 | 1958 | 13881 | 9392 | 5380 | 13563 | 19750 | 8872 | 25913 |
| | 27110 | 26243 | 7854 | 7289 | 14448 | 28326 | 27162 | 12993 | 29870 | 16402 | 16956 | 13426 |
| | 7595 | 22122 | 24090 | 19304 | 11864 | 17988 | 24435 | 18484 | 5785 | 18625 | 19889 | 18382 |
| | 5708 | 21735 | 18955 | 9538 | 23623 | 5991 | 16978 | 9399 | 20682 | 16184 | 15467 | 13163 |
| | 12299 | 17857 | 17272 | 10117 | 9126 | 1908 | 20035 | 18868 | 1615 | 22344 | 21292 | 5575 |
| | 23780 | 14761 | 1271 | 2801 | 2661 | 28391 | 13388 | 947 | 29985 | 8245 | 4032 | 23900 |
| | 2123 | | | | | | | | | | | |
| 311: | 6221 | 29064 | 17247 | 6808 | 12617 | 7461 | 25019 | 27320 | 12138 | 11900 | 28785 | 24432 |
| | 20920 | 5932 | 28450 | 24155 | 15601 | 19264 | 24987 | 7778 | 9425 | 9977 | 3155 | 13839 |
| | 8427 | 13528 | 9037 | 22855 | 8895 | 10354 | 1338 | 26530 | 6364 | 28603 | 978 | 30171 |
| | 1958 | 13881 | 17361 | 1702 | 18189 | 20590 | 23012 | 27156 | 27060 | 13620 | 5486 | 27102 |
| | 9677 | 22229 | 9392 | 15962 | 3210 | 8742 | 24082 | 990 | 10488 | 5380 | 17512 | 6124 |
| | 6055 | 13719 | 17369 | 29156 | 12186 | 15574 | 8776 | 13563 | 6889 | 19750 | 20360 | 7363 |
| | 8872 | 28972 | 25913 | 25286 | 27110 | 16970 | 14626 | 19913 | 2952 | 10499 | 8629 | 9397 |
| | 7854 | 7289 | 25142 | 6264 | 25242 | 3113 | 14448 | 20014 | 28326 | 25736 | 851 | 26389 |
| | 29409 | 27162 | 3838 | 4400 | 21345 | 29155 | 19112 | 1496 | 12993 | 29870 | 26415 | 24607 |
| | 16710 | 29604 | 10623 | 23311 | 16956 | 3771 | 3699 | 26331 | 13426 | 28618 | 30342 | 10787 |
| | 22013 | 13395 | 26237 | 19387 | 22122 | 1749 | 7561 | 12534 | 7615 | 6209 | 14740 | 13822 |
| | 10582 | 29510 | 1198 | 29849 | 2778 | 3070 | 3166 | 17352 | 19559 | 9318 | 10204 | 19304 |
| | 11864 | 11889 | 20011 | 11452 | 13280 | 2476 | 24435 | 30405 | 5660 | 11638 | 18484 | 5785 |
| | 24573 | 13152 | 3500 | 14627 | 20999 | 5418 | 8515 | 13432 | 14110 | 18625 | 16324 | 19889 |
| | 23903 | 14217 | 18382 | 22486 | 11208 | 24088 | 18108 | 5708 | 21735 | 18955 | 1869 | 25143 |
| | 29060 | 2007 | 5397 | 18687 | 9538 | 12522 | 23623 | 5991 | 16978 | 19643 | 9399 | 28296 |
| | 9636 | 29475 | 29781 | 23052 | 2283 | 1872 | 2649 | 25655 | 16184 | 15467 | 27532 | |
| | 22123 | 13163 | 23406 | 23689 | 20203 | 25024 | 28677 | 26110 | 22300 | 16840 | 12299 | 13125 |
| | 22619 | 23418 | 17857 | 17272 | 1059 | 17654 | 18868 | 2175 | 1615 | 2433 | 22344 | 3860 |
| | 13709 | 5536 | 13550 | 10665 | 16641 | 9608 | 18406 | 26357 | 25798 | 10449 | 9776 | 23647 |
| | 12590 | 8900 | 3871 | 27728 | 25721 | 21292 | 23335 | 24835 | 5575 | 23780 | 14761 | 26853 |
| | 4020 | 1271 | 22742 | 23275 | 7890 | 9028 | 27304 | 8248 | 6207 | 23774 | 13864 | 6901 |

TABLE 8-continued

| PEP SEQ ID NO: | homolog SEQ ID NOs | | | | | | | | | | |
|---|---|---|---|---|---|---|---|---|---|---|---|
| | 12323 | 28812 | 5966 | 23795 | 779 | 8321 | 18640 | 15951 | 7688 | 14971 | 10176 | 28391 |
| | 13388 | 1939 | 18213 | 23163 | 9301 | 25502 | 7903 | 22199 | 947 | 14605 | 21289 | 21454 |
| | 22941 | 28142 | 19272 | 10044 | 22584 | 8166 | 13412 | 8832 | 24883 | 19366 | 29985 | 8245 |
| | 28021 | 18519 | 30379 | 9864 | 4032 | 8721 | 22066 | 14766 | 1086 | 24339 | 17531 | |
| 312: | 29436 | 14850 | 13477 | 2138 | 3208 | 3901 | 17105 | 2948 | 7829 | 14379 | 21505 | 29152 |
| | 6268 | 10681 | 7413 | 1697 | 1731 | 7698 | 8049 | 13604 | 29275 | 29284 | 9724 | 13742 |
| | 1912 | 21193 | 8715 | 7643 | 7828 | 6865 | 24632 | 20340 | 13530 | 7677 | 13192 | 7650 |
| | 2984 | 3158 | 979 | 13456 | 6629 | 12057 | 26973 | 23946 | 3277 | 12182 | 17057 | 2940 |
| | 27892 | 16501 | 6452 | 2036 | 11240 | 6210 | 22683 | 3338 | 29324 | 4421 | 21469 | 20398 |
| | 7304 | 3711 | 8803 | 17032 | 4068 | 13005 | 20760 | 28766 | 1534 | 5146 | 20442 | 11809 |
| | 25387 | 26506 | 13006 | 18535 | 7196 | 7064 | 7797 | 19077 | 5312 | 3279 | 8228 | 20792 |
| | 18218 | 17456 | 21741 | 28268 | 3449 | 1481 | 24411 | 24354 | 25922 | 1317 | 29360 | 20125 |
| | 30411 | 3217 | 23290 | 13664 | 3219 | 25611 | 15880 | 25305 | 24248 | 20131 | 7112 | 2860 |
| | 10646 | 5156 | 1470 | 1142 | 7481 | 27379 | 21217 | 6230 | 16593 | 24413 | 20460 | 13800 |
| | 16362 | 8125 | 29539 | 20075 | 11470 | 1373 | 26316 | 5280 | 7442 | 9227 | 24646 | 18094 |
| | 7327 | 7675 | 20848 | 17411 | 10319 | 5924 | 24410 | 6609 | 3336 | 26729 | 13018 | 1166 |
| | 30256 | 14697 | 2319 | 12709 | 15730 | 1236 | 20681 | 10163 | 8239 | 19379 | 2773 | 13935 |
| | 9389 | 23802 | 17412 | 25072 | 16369 | 18560 | 16294 | 18464 | 29689 | 24938 | 5940 | 29678 |
| | 23107 | 19130 | 20049 | 9432 | 5741 | 3798 | 7143 | 5470 | 18614 | 26706 | 20439 | |
| | 19245 | 18180 | 22739 | 29232 | 17824 | 7846 | 24483 | 6980 | 19439 | 28063 | 28034 | 28517 |
| | 25763 | 20531 | 15282 | 7841 | 21094 | 8144 | 23215 | 26615 | 21259 | 26797 | 24388 | 18397 |
| | 27274 | 2891 | 17860 | 21646 | 29940 | 13321 | 1420 | 9912 | 19499 | 21628 | 3982 | 29311 |
| | 7967 | 16916 | 7737 | 29790 | 1567 | 25570 | 914 | 5088 | 16568 | 8596 | 6487 | 4080 |
| | 17527 | 3796 | 28784 | 3642 | 28118 | 11444 | 3001 | 19749 | 15976 | 20597 | 22491 | 23919 |
| | 18063 | 1508 | 15331 | 27385 | 17740 | 20542 | 13927 | 23800 | 29486 | 7823 | 7753 | 11283 |
| | 24645 | 19328 | 16305 | 3555 | 7085 | 4166 | 1076 | 9070 | 13431 | 15843 | 29128 | 22802 |
| | 16427 | 27445 | 7383 | 15299 | 10655 | 29283 | 13136 | 6028 | 12296 | 11261 | 17252 | 8509 |
| | 7087 | 29978 | 13414 | 26066 | 14846 | 9161 | 1622 | 29281 | 29277 | 28982 | 28106 | 1945 |
| | 1948 | 3473 | 19244 | 22787 | 14026 | 7390 | 9284 | 1214 | 14000 | 26960 | 8568 | 8408 |
| | 26923 | 25805 | 7557 | 17660 | 28819 | 27080 | 1854 | 2004 | 20328 | 27090 | 21887 | 8492 |
| | 18262 | 16472 | 13196 | 19626 | 10568 | 1737 | 14022 | 24551 | 29274 | 5794 | 12100 | 22587 |
| | 16387 | 29535 | 4332 | | | | | | | | | |
| 313: | 17074 | 1813 | 10959 | 10605 | 26425 | 20445 | 24487 | 8017 | 11177 | 23024 | 17377 | 4412 |
| | 23829 | 27906 | 18440 | 12984 | 1103 | 9112 | 10098 | 7912 | 16569 | 6731 | 17991 | 27109 |
| | 15513 | 5123 | 29463 | 18502 | 23546 | 11144 | 7740 | 15720 | 23531 | 20633 | 5177 | 20273 |
| | 19174 | 17072 | 25856 | 6431 | 1557 | 7243 | 920 | 29189 | 5927 | 25074 | 3307 | 25569 |
| | 23447 | 12872 | 29015 | 25605 | 20235 | 18344 | 30237 | 16693 | 10540 | 9369 | 8759 | 6007 |
| | 24894 | 17856 | 3903 | 18196 | 7365 | 15998 | 3435 | 27303 | 23365 | 26510 | 12980 | 21579 |
| | 5242 | 14691 | 24298 | 12247 | 26140 | 997 | 12410 | 12430 | 14455 | 7492 | 17897 | 14804 |
| | 2209 | 19943 | 4307 | 28095 | 17187 | 24900 | 18475 | 16286 | 17385 | 22117 | 27898 | 8793 |
| | 15872 | 15906 | 26796 | 29242 | 3511 | 28909 | 14450 | 15500 | 28317 | 10601 | 28448 | 24999 |
| | 6679 | 2359 | 26313 | 18751 | 16086 | 24401 | 23719 | 26186 | 28878 | 24526 | 15225 | 16776 |
| | 22806 | 5296 | 22030 | 19695 | 27517 | 28414 | 17210 | 6379 | 30048 | 7999 | 3409 | 15362 |
| | 18419 | 24104 | 1477 | 2672 | 9815 | 13717 | 30388 | 28256 | 19937 | 8726 | 5739 | 3316 |
| | 23630 | 10191 | 14456 | 28568 | 17977 | 6904 | 11818 | 9584 | 13160 | 28158 | 8682 | 2436 |
| | 25490 | 10991 | 12785 | | | | | | | | | |
| 314: | 9654 | 9673 | 21777 | 15580 | 11528 | 13502 | 11533 | 23861 | 24407 | 28881 | 9929 | 15909 |
| | 2026 | 2024 | 7638 | 7707 | 18981 | 4927 | 13475 | 6598 | 27339 | 12683 | 27159 | 8136 |
| | 11205 | 14840 | 17413 | 8976 | 21085 | 5071 | 2448 | 10342 | 18420 | 21118 | 28447 | 1024 |
| | 3282 | 9796 | 8951 | 7939 | 21197 | 22681 | 27449 | 24935 | 6736 | 18000 | 11318 | 880 |
| | 17374 | 13543 | 10709 | 4698 | 5976 | 1821 | 30380 | 4667 | 8746 | 1571 | 1995 | 19769 |
| | 9883 | 27269 | 14225 | 28504 | 20918 | 24317 | 28199 | 29834 | 21756 | 6606 | 12161 | |
| | 16555 | 27422 | 20200 | 16342 | 10305 | 17133 | 15606 | 7528 | 12805 | 18973 | 5126 | 23875 |
| | 7430 | 19393 | 20409 | 26205 | 14250 | 20631 | 18778 | 5604 | 18595 | 7297 | 16963 | 15136 |
| | 15135 | 19183 | 12794 | 27123 | 20160 | 27325 | 8420 | 18843 | 3853 | 8018 | 7422 | 10462 |
| | 30217 | 1449 | 15623 | 24442 | 29425 | 30351 | 28856 | 5115 | 4153 | 9250 | 4081 | 7562 |
| | 19629 | 4705 | 17899 | 21080 | 7799 | 23958 | 28418 | 11541 | 4323 | 24962 | 4441 | 5928 |
| | 19504 | 22840 | 23320 | 16031 | 10320 | 15441 | 12039 | 6174 | 25674 | 29249 | 4442 | 20579 |
| | 19864 | 6356 | 22935 | 25802 | 2113 | 10844 | 20659 | 1874 | 28045 | 20108 | 13080 | 11030 |
| | 26034 | 20373 | 5727 | 27347 | 24097 | 13266 | 28543 | 2125 | 1297 | 3298 | 21535 | 26376 |
| | 19745 | 20768 | 10468 | 29066 | 26645 | 29554 | 20649 | 11031 | 2131 | 2254 | 4730 | 22057 |
| | 16885 | 8070 | 10596 | 14924 | 21006 | 28643 | 27597 | 3628 | 10128 | 24115 | 24861 | 12868 |
| | 4090 | 22353 | 2006 | 4106 | 679 | 20010 | 24600 | 27798 | 19820 | 12528 | 19062 | 8510 |
| | 27025 | 25014 | 27688 | 8284 | 3995 | 9618 | 18099 | 16934 | 4933 | 1952 | 13825 | 2931 |
| | 5249 | 12748 | 8512 | 9718 | 17730 | 27686 | 26250 | 14669 | 18570 | 17231 | 13642 | 19946 |
| | 9136 | 11816 | 2140 | 13857 | 11842 | 29791 | 8461 | 22782 | 8554 | 19208 | 18717 | 20751 |
| | 29893 | 13799 | 26993 | 622 | 8452 | 7662 | 27919 | 12893 | 7851 | 6094 | 8543 | 3579 |
| | 29612 | 8818 | 29889 | 5042 | 9234 | 3565 | 13553 | 30290 | 22431 | 4025 | 18277 | 10401 |
| | 23490 | 30353 | 26497 | 19487 | 18167 | 26040 | 16434 | 29150 | 12068 | 11858 | 9622 | 5826 |
| | 12216 | 14178 | 7205 | 5038 | 20245 | 30228 | 20272 | 6346 | 25653 | 21664 | 4904 | 10032 |
| | 29906 | 11628 | 7563 | 13947 | 16316 | 3321 | 11534 | | | | | |
| 315: | 3118 | 4379 | 29540 | 2230 | 27094 | 3912 | 25003 | 2178 | 21097 | 303 | 11912 | 6746 |
| | 5259 | 23092 | 8636 | 22040 | 13730 | 19057 | 8657 | 837 | 6085 | 7368 | 22651 | 23492 |
| | 29662 | 25823 | 22109 | 673 | 5141 | 29560 | 23755 | 2734 | 22886 | 23408 | 13219 | |
| 316: | 6564 | 7427 | 6336 | 20668 | 22550 | 26457 | 13359 | 16779 | 26477 | 19000 | 11179 | 17036 |
| | 3121 | 30118 | 27987 | 15803 | 14623 | 27522 | 26779 | 9522 | 5758 | 29784 | 11115 | 24890 |
| | 9393 | | | | | | | | | | | |

TABLE 8-continued

| PEP SEQ ID NO: | homolog SEQ ID NOs | | | | | | | | | | |
|---|---|---|---|---|---|---|---|---|---|---|---|
| 317: | 22698 | 12832 | 6510 | 17834 | 3265 | 3266 | 15773 | 10250 | 2204 | 30051 | 2238 | 8405 |
|  | 5904 | 17661 | 6167 | 4285 | 19376 | 6130 | 26175 | 5869 | 28747 | 5449 | 6624 | 7814 |
|  | 25438 | 21333 | 12669 | 24544 | 2355 | 16895 | 23343 | 16933 | 2968 | 9669 | 14563 | 7311 |
|  | 28933 | 17404 | 27009 | 12245 | 2219 | 21729 | 27869 | 23389 | 12413 | 20658 | 9323 | 7193 |
|  | 16576 | 8475 | 24849 | 10509 | | | | | | | | |
| 318: | 18449 | 21998 | 22263 | 19277 | 5755 | 4138 | 9752 | 21886 | 17107 | 20954 | 21871 | 21867 |
|  | 21863 | 21857 | 21855 | 21829 | 21827 | 21820 | 21795 | 21793 | 21792 | 21789 | 21785 | 21772 |
|  | 21771 | 21766 | 21765 | 21761 | 20959 | 20950 | 20946 | 20941 | 20919 | 20917 | 20914 | 20910 |
|  | 20905 | 20881 | 20877 | 20873 | 20868 | 20867 | 20831 | 20827 | 20825 | 20821 | 20820 | 20790 |
|  | 20787 | 20782 | 21824 | 21818 | 20785 | 21897 | 20637 | 20745 | 19572 | 20780 | 20608 | 19762 |
|  | 19717 | 19575 | 19571 | 20743 | 20710 | 20709 | 20708 | 20705 | 20679 | 20676 | 20674 | 20669 |
|  | 20641 | 20638 | 20636 | 20635 | 20605 | 20603 | 20600 | 20598 | 19756 | 19752 | 19721 | 19715 |
|  | 19712 | 19710 | 19694 | 19693 | 19691 | 19689 | 19687 | 19660 | 19657 | 19655 | 19654 | 19620 |
|  | 19616 | 19612 | 19609 | 19604 | 19567 | 19516 | 20741 | 20740 | 20667 | 19656 | 19759 | 20712 |
|  | 19753 | 19570 | 20746 | 19523 | 13571 | 25848 | 19519 | 18302 | 24610 | 22379 | 6469 | 17349 |
|  | 24271 | 7720 | 21370 | 6978 | 1196 | 24814 | 10106 | 5217 | 7616 | 24409 | 4076 | 6384 |
|  | 7983 | 24152 | 23262 | 24732 | 19225 | 13648 | 20811 | 1040 | 24592 | 9450 | 22410 | 19949 |
|  | 10476 | 13355 | 16531 | 19147 | 5456 | 11070 | 1883 | 20473 | 18871 | 4920 | 23294 | 23753 |
|  | 3891 | 14199 | 30174 | 26494 | 26403 | 26512 | 26413 | 12319 | 17214 | 27157 | 23022 | 13188 |
|  | 24085 | 18599 | 29112 | 4486 | 21763 | 11104 | 16652 | 7995 | 11615 | 6242 | 4565 | 29478 |
|  | 6514 | 751 | 29501 | 16056 | 18737 | 12351 | 23018 | 18292 | 4444 | 4445 | 3521 | 4448 |
|  | 17267 | 4418 | 11430 | 11427 | 8643 | 15491 | 13686 | 6088 | 25417 | 24759 | 11563 | 24750 |
|  | 24718 | 24753 | 13852 | 30117 | 15661 | 26934 | 28121 | 10590 | 26942 | 1316 | 1320 | 20034 |
|  | 15779 | 15535 | 30070 | 14860 | 28134 | 1625 | 2698 | 23360 | 24636 | 11118 | 11119 | 10752 |
|  | 22693 | 18670 | 22670 | 22700 | 22307 | 18243 | 29362 | 22720 | 11958 | 24449 | 1566 | 12619 |
|  | 10543 | 5772 | 22625 | 24323 | 5775 | 22034 | 6513 | 14730 | 2754 | 30114 | 17842 | 26470 |
|  | 10704 | 17770 | 30003 | 2442 | 8480 | 22913 | 19311 | 759 | 26087 | 11626 | 13701 | 13695 |
|  | 1133 | 24587 | 23737 | 28983 | 3745 | 12333 | 6905 | 22007 | 12137 | 23735 | 29010 | 29002 |
|  | 13707 | 22819 | 14237 | 4567 | 29009 | 12336 | 24589 | 22912 | 2145 | 29901 | 15075 | 14268 |
|  | 22966 | 29012 | 12338 | 27965 | 27967 | 16836 | 23001 | 6894 | 24717 | 14175 | 6896 | 18284 |
|  | 3719 | 3597 | 1208 | 28387 | 19098 | 18135 | 11462 | 11147 | 13685 | 11605 | 28136 | 27271 |
|  | 12387 | 6927 | 10747 | 29654 | 5321 | 26112 | 16485 | | | | | |
| 319: | 26025 | 18678 | 23145 | 13256 | 2599 | 3183 | 13467 | 25819 | 16238 | 13308 | 6705 | 1683 |
|  | 15932 | 20103 | 30009 | 21685 | 3348 | 10360 | 26570 | 15434 | 748 | 26368 | 14375 | 13242 |
|  | 23151 | 7201 | 17322 | 1161 | 6545 | 9836 | 10114 | 3229 | 25937 | 8839 | 7235 | 949 |
|  | 17714 | 739 | 5568 | 6916 | 2999 | 13445 | 18676 | 902 | 26933 | 4874 | 25186 | 19390 |
|  | 27280 | 18674 | 10718 | 23528 | 29206 | 8357 | 28616 | 12136 | 21610 | 22770 | 7991 | 29517 |
|  | 2812 | 7767 | 16949 | 2443 | 23899 | 30090 | 5231 | 23613 | 24635 | 17792 | 2197 | |
| 321: | 5713 | 5731 | 7666 | 23694 | 22911 | 18150 | 26649 | 2034 | 10177 | 30006 | 8001 | 4692 |
|  | 29033 | 14395 | 29544 | 19248 | 15443 | 10544 | 24797 | 10873 | 7935 | 29003 | 15255 | 4236 |
|  | 3050 | 19552 | 16592 | 11607 | 21180 | 26293 | 619 | 16587 | 5988 | 9434 | 13332 | 14583 |
|  | 23776 | | | | | | | | | | | |
| 322: | 28075 | 20429 | 25267 | 20452 | 5815 | 20569 | 12740 | 24463 | 12571 | 21240 | 28866 | 16145 |
|  | 7644 | 10890 | 4953 | 14249 | 1859 | 26961 | 28687 | 16646 | 13103 | 19372 | 1075 | 11012 |
|  | 28763 | 13279 | 16909 | 18634 | 14200 | 14252 | 15965 | 3957 | 14353 | 22537 | 27917 | 13290 |
|  | 24094 | 3042 | 24671 | 16559 | 8844 | 17230 | 26537 | 11160 | 4101 | 19149 | 14848 | 16476 |
|  | 19844 | 21324 | 25887 | 5879 | 25536 | 7634 | 22302 | 3583 | 5654 | 13582 | 8655 | 16714 |
|  | 18408 | 25134 | 25133 | 2085 | 9245 | 2169 | 25665 | 7734 | 7755 | 7733 | 7758 | 1434 |
|  | 1433 | 29679 | | | | | | | | | | |
| 323: | 26396 | 29158 | 4822 | 18244 | 12967 | 17134 | 11009 | 16725 | 8007 | 2954 | 8852 | 27845 |
|  | 2629 | 18814 | 10620 | 2865 | 8453 | 2299 | 15558 | 6294 | 2856 | 10541 | 15612 | 23099 |
|  | 28255 | 23798 | 22907 | 19283 | 14119 | 20596 | 6506 | 2591 | 2566 | 19934 | 27102 | 12576 |
|  | 19816 | 15649 | 20313 | | | | | | | | | |
| 324: | 4695 | 7074 | 23887 | 24207 | 15227 | 11280 | 12210 | 8914 | 8949 | 17044 | 27663 | 17180 |
|  | 23934 | 23176 | 23961 | 23927 | 27394 | 27343 | 28223 | 12241 | 26039 | 25285 | 25527 | 6322 |
|  | 8016 | 9270 | 29224 | 24488 | 28695 | 29408 | 14433 | 24132 | 8404 | 3641 | 14676 | 22027 |
|  | 4437 | 2493 | 7857 | 29733 | 5336 | 25833 | 17806 | 10942 | 20040 | 8399 | 946 | 10186 |
|  | 25139 | 16681 | 11108 | 8605 | 28765 | 30462 | 30451 | 10230 | 11253 | 29561 | 11973 | 9044 |
|  | 23566 | 6539 | 28864 | 8447 | 29005 | 24017 | 21967 | 4180 | 22319 | 4209 | 10735 | 18450 |
|  | 12851 | 26694 | 23680 | 19205 | 7685 | 11739 | 11644 | 19428 | 24159 | 19804 | 3474 | 25828 |
|  | 5463 | 5645 | 3079 | 6583 | 4887 | 21096 | 3694 | 11173 | 23896 | 23179 | 23966 | 23964 |
|  | 7714 | 21631 | 23889 | 23182 | 23185 | 23183 | 23935 | 17359 | 25599 | 5662 | 15746 | 2535 |
|  | 14447 | 11777 | 20276 | 10765 | 26312 | 12608 | 6708 | 5902 | 20403 | 9884 | 10697 | 22878 |
|  | 7423 | 20522 | 19966 | 5193 | 10888 | 3855 | 20278 | 5961 | 2105 | 21958 | 11736 | 15766 |
|  | 15662 | 9897 | 25980 | 20518 | 17889 | 9174 | 18487 | 7192 | 21168 | 18308 | 22258 | 5063 |
|  | 19649 | 5527 | 10969 | 10930 | 10821 | 21447 | 16001 | 11131 | 24448 | 20463 | 6646 | 5955 |
|  | 25911 | 10041 | 6833 | 12380 | 23924 | 4084 | 18274 | 6410 | 8977 | 11799 | 16364 | 19324 |
|  | 27752 | 9060 | 5578 | 5505 | 9725 | 2564 | 20300 | 8874 | 5198 | 23929 | 8495 | 17165 |
|  | 21496 | | | | | | | | | | | |
| 325: | 8611 | 9653 | 26340 | 19789 | 12546 | 28386 | 8352 | 23722 | 17235 | 25214 | 4644 | 11567 |
|  | 17882 | 18815 | 735 | 8786 | 21982 | 29719 | 19123 | 15025 | 1540 | 22947 | 4036 | 7410 |
|  | 24039 | 22052 | 2033 | 25780 | 20845 | 21131 | 691 | 9520 | 9519 | 9596 | 15571 | 10045 |
|  | 17616 | 3844 | 20503 | 6259 | 6256 | 10247 | 1982 | 23494 | 23476 | 20841 | 17362 | 28976 |
|  | 7855 | 24763 | 28796 | 26709 | 28664 | 16116 | 16110 | 16108 | 16105 | 16150 | 20118 | 11117 |
|  | 15068 | 10850 | 16042 | 15543 | 22735 | 3988 | 25929 | 8584 | | | | |
| 326: | 5173 | 5172 | 5168 | 5169 | 27559 | 25561 | 19375 | 19137 | 18295 | 18861 | 19386 | 2279 |
|  | 17868 | 23434 | 16705 | 19125 | 27453 | 8946 | 13210 | 24880 | 24875 | 18157 | 18159 | 15947 |
|  | 14260 | 14257 | 14254 | 15950 | 15944 | 10855 | 11632 | 28068 | 19547 | 1934 | 24077 | 830 |

TABLE 8-continued

| PEP SEQ ID NO: | homolog SEQ ID NOs | | | | | | | | | | |
|---|---|---|---|---|---|---|---|---|---|---|---|
| | 25657 | 25654 | 14069 | 17785 | 23074 | 6277 | 6628 | 6651 | 25105 | 26050 | 29300 | 12395 |
| | 8739 | 18551 | 6717 | 11421 | 11419 | 13511 | 20310 | 29056 | 16028 | 21964 | 7335 | 26976 |
| | 8151 | 4386 | 27197 | 12982 | 20558 | 14902 | | | | | | |
| 327: | 6523 | 2683 | 29664 | 3149 | 14631 | 26698 | 13673 | 25648 | 9595 | 7270 | 4370 | 4300 |
| | 5542 | 5514 | 12826 | 22624 | 12508 | 27027 | 27382 | 28234 | 28229 | 28231 | 19433 | 26539 |
| | 3935 | 20377 | 28506 | 21950 | 18357 | 27665 | 18383 | 28986 | | | | |
| 328: | 19276 | 1841 | 14664 | 18388 | 5957 | 14824 | 14760 | 7167 | 1035 | 18155 | 11169 | 16259 |
| | 26096 | 13766 | 7607 | 22092 | 22095 | 29366 | 9481 | 17141 | 22928 | 7514 | 22125 | 21071 |
| | 23933 | 7949 | 9348 | 21774 | | | | | | | | |
| 329: | 6168 | 16169 | 9899 | 16853 | 16513 | 7735 | 21101 | 28633 | 22355 | 25004 | 21037 | 27223 |
| | 2177 | 17270 | 22039 | 8241 | 21036 | 18249 | 14094 | 15487 | 24629 | 13783 | 23668 | 30074 |
| | 25464 | 8907 | 14778 | 4638 | 29988 | 23768 | 20567 | | | | | |
| 330: | 7943 | 16938 | 1020 | 19490 | 10414 | 28426 | 23340 | 13212 | 5437 | 23076 | 27780 | 9605 |
| | 2775 | 15369 | 5333 | 6213 | 5358 | 6217 | 17628 | 17625 | 18439 | 16130 | 16132 | 6753 |
| | 5251 | 21776 | 6751 | 2354 | 25879 | 23170 | 5391 | 22896 | 17441 | 24539 | 26184 | 17715 |
| | 15866 | 16050 | 4846 | 11166 | 8132 | 24293 | 8769 | 25206 | 28037 | | | |
| 331: | 24465 | 21401 | 11218 | 19349 | 9644 | 15930 | 1235 | 8351 | 23088 | 10788 | 5765 | 5761 |
| | 5738 | 26337 | 7764 | 5228 | 23488 | 11190 | 11189 | 29202 | 12910 | 7661 | 27041 | 5745 |
| | 14084 | 14115 | 29789 | 28902 | 28922 | 27512 | 9542 | 7402 | 10727 | 6303 | 29079 | 716 |
| | 8930 | 24123 | 23841 | 1025 | 2086 | 2205 | 9419 | 7665 | 17363 | 11564 | 30184 | 30212 |
| | 19808 | 370 | 27115 | 23497 | | | | | | | | |
| 332: | 9181 | 25440 | 11322 | 10394 | 23194 | 10121 | 4183 | 13824 | 7065 | 8038 | 24714 | 10120 |
| | 11384 | 7161 | 23913 | 10483 | 2137 | 29194 | 28776 | 2787 | 24809 | 21173 | 6535 | 3144 |
| | 4366 | 9814 | 28454 | 25455 | 15353 | 2377 | 1885 | 27695 | 21552 | 9640 | 18639 | 27572 |
| | 20691 | 1325 | 13958 | 18343 | 26799 | 29048 | 2200 | 20277 | | | | |
| 333: | 26921 | 7592 | 26493 | 11706 | 14645 | 6556 | 17968 | 10624 | 17587 | 25908 | 2924 | 17103 |
| | 13861 | 10511 | 27191 | 24114 | 5142 | 29172 | 28080 | 11050 | 10690 | 1510 | 4359 | 21319 |
| | 6781 | 8848 | 15538 | 19869 | 14896 | 29647 | 5668 | 19736 | 10237 | 20371 | 16072 | 24961 |
| | 24791 | 19941 | 12201 | 8982 | 17218 | 10782 | 10597 | 6729 | 11210 | 14810 | 18962 | 23027 |
| | 10203 | 13462 | 14488 | 9807 | 4423 | 12684 | 8425 | 8870 | 3915 | 21985 | 16768 | 8704 |
| | 1565 | 23789 | 23820 | 7418 | 9151 | 17139 | 10241 | 16395 | 28549 | 16696 | 26260 | 1956 |
| | 1703 | 9974 | 14018 | 11287 | 4189 | 8195 | 14013 | 13078 | 6214 | 7142 | 19515 | 15065 |
| | 19121 | 25225 | 16111 | 21188 | 22049 | 14688 | 8348 | 23070 | 7954 | 27039 | 22516 | 29328 |
| | 27544 | 4425 | 29377 | 21474 | 16358 | 19897 | 29844 | 22622 | 10011 | 25784 | 5095 | 29886 |
| | 10887 | 21494 | 1699 | 17405 | 6742 | 5555 | 7654 | 6372 | 20556 | 11433 | 18121 | 711 |
| | 28322 | 5144 | 26167 | 22414 | 16549 | 16597 | 15798 | 17840 | 25393 | 26386 | 13330 | 18534 |
| | 8148 | 28509 | 25713 | 12258 | 16300 | 6266 | 13692 | 9914 | 17936 | 11424 | 2357 | 1495 |
| | 24304 | 21624 | 17464 | 20510 | 27781 | 27048 | 20786 | 14629 | 25414 | 4338 | 23895 | 14753 |
| | 18215 | 6269 | 5292 | 20280 | 16964 | 15394 | 12038 | 24873 | 17753 | 29686 | 6533 | 2426 |
| | 1488 | 9811 | 15994 | 28936 | 8206 | 13312 | 20408 | 22408 | 29102 | 26302 | 1554 | 20563 |
| | 2819 | 22268 | 7694 | 26930 | 2121 | 28099 | 11690 | 1787 | 19364 | 26629 | 15073 | 5495 |
| | 4250 | 3598 | 15984 | 6688 | 6941 | 27400 | 25610 | 20744 | 21572 | 5473 | 26332 | 11258 |
| | 25472 | 20128 | 27341 | 8319 | 778 | 9788 | 13491 | 8473 | 9785 | 13060 | 2305 | 4534 |
| | 11432 | 7240 | 19025 | 6134 | 13537 | 23825 | 11385 | 13347 | 21546 | 2263 | 27192 | 14999 |
| | 11669 | 16530 | 10070 | 3837 | 26130 | 15679 | 11385 | 3071 | 7367 | 19028 | 15996 | 24811 |
| | 25231 | 18760 | 23302 | 2797 | 1180 | 30019 | 17130 | 18486 | 10099 | 4640 | 12422 | 2256 |
| | 28757 | 11972 | 10587 | 6380 | 15768 | 2288 | 28253 | 5920 | 24383 | 26272 | 6630 | 30366 |
| | 28281 | 2446 | 20384 | 8724 | 627 | 4476 | 29103 | 971 | 8313 | 3464 | 11450 | 30022 |
| | 8792 | 10444 | 3352 | 16722 | 6442 | 16727 | 30340 | 27469 | 22973 | 3264 | 26011 | 29776 |
| | 17287 | 15743 | 18432 | 17880 | 26952 | 13961 | 25018 | 18340 | 19202 | 15274 | 5435 | 21995 |
| | 15160 | 4212 | 943 | 29709 | 23128 | 8036 | 17273 | 18379 | 30305 | 28533 | 6803 | 3533 |
| | 26885 | 23893 | 6928 | 28065 | 24832 | 21918 | 2499 | 23892 | 18660 | 6839 | 28562 | 12495 |
| | 25452 | 23372 | 951 | 8972 | 22734 | 12787 | 20346 | 28751 | 14496 | 6087 | 8910 | 8697 |
| | 11602 | 18658 | 28451 | 26909 | 4399 | 6778 | 28644 | 7020 | 24981 | 22402 | 17087 | 29329 |
| | 23420 | 28028 | 26733 | 8106 | 21509 | 19461 | 15474 | 16610 | 10594 | 29838 | 23279 | 23544 |
| | 16578 | 19700 | 28770 | 27715 | 26058 | 23037 | 15867 | 30376 | 22462 | 18967 | 29967 | 27622 |
| | 2882 | 11130 | 28361 | 5759 | 15942 | 18029 | 24677 | 19079 | 21622 | 29035 | 17723 | 25854 |
| | 3944 | 6911 | 1013 | 1285 | 3866 | 15522 | 21141 | 9022 | 21237 | 8516 | 25349 | 10774 |
| | 23023 | 28634 | 29555 | 4833 | 25567 | 30236 | 21630 | 680 | 9494 | 15257 | 10339 | 5379 |
| | 30394 | 2868 | 5681 | 30347 | 2708 | 10852 | 12986 | 15666 | 14674 | 6885 | 18610 | 11485 |
| | 20890 | 22892 | 11785 | 5290 | 25687 | 14615 | 13909 | 17379 | 22873 | 22179 | 29449 | 5512 |
| | 11968 | 8969 | 21497 | 22024 | 13845 | 29869 | 28636 | 18910 | 1183 | 17646 | 24431 | 22296 |
| | 16313 | 4458 | 27105 | 5773 | 11788 | 26122 | 16133 | 29980 | 17375 | 28439 | 27195 | 23332 |
| | 11211 | 11001 | 15279 | 27997 | 27141 | 20862 | 27769 | 2151 | 20194 | 4217 | 24493 | 25932 |
| | 13065 | 14864 | 7786 | 7203 | 14865 | 7369 | 11416 | 1823 | 28111 | 17268 | 19952 | 20225 |
| | 11929 | 28655 | 23398 | 10698 | 16723 | 21172 | 14799 | 29547 | 2688 | 5893 | 25328 | 24057 |
| | 13650 | 29820 | 21343 | 812 | 1264 | 1169 | 23732 | 14946 | 10923 | 7611 | 13311 | 8602 |
| | 10777 | 20238 | 23184 | 29626 | 23392 | 7238 | 29288 | 3263 | 21728 | 18312 | 12521 | 7257 |
| | 26520 | 5819 | 2658 | 23965 | 18360 | 14324 | 15376 | 11178 | 9599 | 13503 | 22746 | 17189 |
| | 26221 | 2958 | 11993 | 15128 | 16521 | 22064 | 17401 | | | | | |
| 334: | 17584 | 24839 | 25351 | 25790 | 5253 | 27882 | 27330 | 1284 | 24348 | 7347 | 21775 | 6413 |
| | 3799 | 16219 | 22068 | 15991 | 22211 | 25843 | 19950 | 28434 | 29905 | 17960 | 29644 | 26172 |
| | 9257 | 3803 | 12421 | 1767 | 27864 | 19783 | 18725 | 23501 | 21744 | 1328 | 25808 | |
| 335: | 1205 | 1202 | 8703 | 21335 | 24048 | 24042 | 18376 | 12899 | 18378 | 20455 | 6551 | 19940 |
| | 19978 | 19981 | 12825 | 2128 | 18413 | 18415 | 16198 | 3185 | 15855 | 2967 | 2960 | 2966 |
| | 4462 | 28501 | 25905 | 11227 | 28186 | 984 | 986 | 13539 | 20789 | 20758 | 25229 | 24103 |
| | 19988 | 25087 | 21788 | 19912 | 21275 | 19982 | 19909 | 24881 | 18852 | 12055 | 16381 | 12191 |
| | 3089 | 27641 | 10110 | 28531 | 23127 | 14065 | 24960 | 8966 | 11153 | 12488 | 28405 | 19321 |

TABLE 8-continued

| PEP SEQ ID NO: | homolog SEQ ID NOs | | | | | | | | | | |
|---|---|---|---|---|---|---|---|---|---|---|---|
| | 21051 | 17845 | 1936 | 23577 | 27609 | 28429 | 27692 | 27667 | 28424 | 28432 | 27698 | 27637 |
| | 19872 | 18303 | 18438 | 18412 | 11878 | 10396 | 18013 | 9203 | 29169 | 12043 | 6503 | 1965 |
| | 22532 | 14756 | 2898 | 29469 | 15871 | 4778 | 25660 | 29924 | 3826 | 16729 | 20884 | 2141 |
| | 19907 | 14255 | 22922 | 2063 | 26239 | 19936 | 19119 | 21272 | 19915 | 19985 | 19916 | 18368 |
| | 18306 | 18331 | 18333 | 18338 | 17515 | 18481 | 24335 | 19056 | 8109 | 10257 | 21481 | |
| 336: | 27850 | 28787 | 28026 | 26562 | 17207 | 29605 | 25076 | 7242 | 9198 | 9200 | 424 | 17118 |
| | 13373 | 22737 | 1153 | | | | | | | | | |
| 337: | 3810 | 8611 | 17523 | 26405 | 19789 | 12546 | 11748 | 24669 | 1234 | 10024 | 16888 | 15528 |
| | 17235 | 25214 | 4644 | 8485 | 29178 | 11567 | 18815 | 24974 | 12957 | 27030 | 735 | 8786 |
| | 23475 | 21423 | 14874 | 21982 | 4004 | 29719 | 6724 | 10758 | 15025 | 5033 | 1540 | 15117 |
| | 16450 | 9585 | 7687 | 22955 | 18744 | 16796 | 2152 | 2153 | 4039 | 25006 | 25631 | 4196 |
| | 5802 | 2614 | 2033 | 1607 | 18080 | 29921 | 28076 | 18341 | 13401 | 8330 | 23494 | 20841 |
| | 17362 | 1450 | 22986 | 28262 | 11117 | 11357 | 20471 | 9486 | 15543 | 9266 | 8762 | 24787 |
| | 23218 | 29190 | 12248 | 26945 | 29898 | 8006 | 648 | 27416 | 27859 | | | |
| 338: | 1532 | 17999 | 20660 | 20852 | 2298 | 11954 | 13776 | 7351 | 9240 | 11237 | 1902 | 864 |
| | 7458 | 11352 | 5771 | 28801 | 14059 | 8736 | 8763 | 25084 | 15687 | 2005 | 5926 | 12347 |
| | 7054 | 29550 | 23007 | 7315 | 24549 | 14285 | 16812 | 10419 | 11288 | 14847 | 13984 | 3285 |
| | 6329 | 18622 | 1233 | 16886 | 3999 | 18800 | 7680 | 6033 | 17549 | 8031 | 8417 | 15471 |
| | 21865 | 7551 | 5627 | 8229 | 7599 | 16228 | 23341 | 1224 | 26016 | 2100 | 24000 | |
| | 7902 | 3115 | 9357 | 6047 | 8165 | 11186 | 14852 | 20690 | 19002 | 14878 | 14193 | 2130 |
| | 24486 | 24658 | 29371 | 16354 | 13148 | 13299 | 4197 | 23441 | 8614 | 29835 | 6385 | 8661 |
| | 11329 | 2232 | 30390 | 13377 | 4586 | 30292 | 26684 | 4155 | 3368 | 27633 | 9221 | 25619 |
| | 29523 | 9722 | 8015 | 11400 | 20624 | 17918 | 27236 | 25542 | 29054 | 8443 | 8830 | 20507 |
| | 20511 | 9288 | 7810 | 12224 | 23122 | 25274 | 11300 | 16731 | 18057 | 1353 | 28241 | 19257 |
| | 21965 | 24765 | 21694 | 1125 | 7717 | 6791 | 22020 | 1148 | 14224 | 22733 | 24951 | 21649 |
| | 6241 | 9518 | 13158 | 14875 | 24858 | 5084 | 22366 | 7028 | 12202 | 24920 | 17082 | 9127 |
| | 11254 | 30391 | 20015 | 26069 | 24302 | 29448 | 5980 | 26014 | 26315 | 14699 | 2622 | |
| | 18394 | 11319 | 6101 | 27921 | 13860 | 3498 | 1678 | 3084 | 17471 | 29396 | 3095 | 14274 |
| | 17931 | 22106 | 23225 | 9855 | 11936 | 13479 | 19400 | 7777 | 12383 | 17970 | 3162 | 4433 |
| | 22192 | 8713 | 12616 | 17948 | 28288 | 24165 | 15515 | 18838 | 21889 | 7556 | 23834 | 7107 |
| | 11092 | 1129 | 17601 | 9007 | 9789 | 12689 | 14835 | 3141 | 25715 | 2855 | 29595 | 29933 |
| | 15120 | 26443 | 11783 | 11324 | 11522 | 12743 | 25470 | 16063 | 15036 | 3347 | 19495 | 16854 |
| | 18899 | 24201 | 12320 | 22765 | 6488 | 5574 | 26350 | 7078 | 26001 | 13400 | 2218 | 14264 |
| | 7682 | 30017 | 9445 | 12342 | 12203 | 4006 | 29826 | 29693 | 30395 | 10395 | 4382 | 27177 |
| | 23868 | 12291 | 4450 | 15691 | 12714 | 17241 | 23071 | 18444 | 14129 | 22357 | 15241 | 17237 |
| | 19249 | 15343 | 29028 | 21072 | 6097 | 23904 | 4970 | 1907 | 6635 | 4853 | 21640 | 5489 |
| | 1954 | 17033 | 8213 | 22620 | 10867 | 7407 | 25023 | 12557 | 15733 | 27841 | 29063 | 8359 |
| | 11768 | 8523 | 10794 | 7199 | 27601 | 11344 | 15698 | 15562 | 18313 | 25350 | 7109 | 15847 |
| | 16754 | 24819 | 8270 | 29851 | 17635 | 5781 | 25211 | 4572 | 602 | 5629 | 26726 | 21733 |
| | 27410 | 25749 | 17944 | 20520 | 24876 | 14501 | 10115 | 10755 | 7998 | 19299 | 16232 | 13097 |
| | 16748 | 8979 | 7952 | 14568 | 24480 | 29273 | 5197 | 26225 | 27768 | 12870 | 18503 | 28013 |
| | 26560 | 12219 | 11508 | 13068 | 25354 | 6146 | 7354 | 3044 | 8777 | 6995 | 8302 | 9965 |
| | 17333 | 14357 | 15939 | 19984 | 18700 | 16989 | 17416 | 22345 | 4461 | 25893 | 10943 | 30285 |
| | 2135 | 1165 | 5209 | 10901 | 15915 | 11482 | 10549 | 28528 | 3250 | 24130 | 6957 | |
| | 11591 | 11622 | 26697 | 25532 | 8580 | 9770 | 12812 | 22831 | 19560 | 17766 | 11391 | 21678 |
| | 20871 | 8932 | 10629 | 12754 | 18823 | 19085 | 29701 | 3430 | 1588 | 1283 | 7080 | 7660 |
| | 11436 | 13176 | 6315 | 18768 | 28840 | 1822 | 23115 | 16121 | 20995 | 4376 | 16306 | 4524 |
| | 6782 | 15389 | 14317 | 15764 | 15155 | 5082 | 21232 | 16190 | 18907 | 12297 | 14962 | 13933 |
| | 2791 | 13699 | 25215 | 20587 | 14328 | 4661 | 16129 | 25195 | 25196 | 23200 | 8201 | 22384 |
| | 7619 | 11403 | 9694 | 12362 | 18675 | 19398 | 5522 | 29356 | 5552 | 2465 | 8000 | 872 |
| | 26812 | 21277 | 22087 | 20308 | 28842 | 19047 | 14693 | 636 | 13442 | 27334 | 24007 | 23210 |
| | 25337 | 11334 | 29623 | 15011 | 8539 | 12304 | 29752 | 12121 | 28087 | 12117 | 8338 | 29567 |
| | 1465 | 12886 | 28608 | 1938 | 22510 | 964 | 22511 | 23166 | 30028 | 26098 | 26125 | 11479 |
| | 27876 | 734 | 7265 | 17623 | 17621 | 10566 | 11401 | 13938 | 9224 | 6160 | 8933 | 8766 |
| | 16366 | 26385 | 1888 | 10126 | 15926 | 4281 | 9004 | 15702 | 7480 | 20553 | 1549 | 4910 |
| | 19455 | 4245 | 6617 | 8566 | 27120 | 8429 | 29942 | 8400 | 28926 | 17282 | 3874 | 4898 |
| 339: | 26090 | 24906 | 7328 | 13640 | 3987 | 14369 | 14201 | 29751 | 23972 | 19048 | 19124 | 19518 |
| | 16929 | 12836 | 10980 | 5385 | 12514 | 14006 | 11639 | 9621 | 29755 | 9131 | 13564 | 783 |
| | 18177 | 14122 | 16367 | 18197 | 16067 | 10484 | 27976 | 27790 | 10726 | 28360 | 7845 | 26641 |
| | 12573 | 11417 | 1937 | 8810 | 11764 | 27199 | 26491 | 7149 | 27631 | 850 | 24218 | 22409 |
| | 30220 | 23301 | 604 | 12792 | 28356 | 12273 | 24682 | 21304 | 19627 | 21743 | 5612 | 19043 |
| | 5266 | 6456 | 8388 | 22771 | 8450 | 17154 | 17655 | 21229 | 17981 | 24666 | 29419 | 13898 |
| | 2927 | 968 | 25866 | 11437 | 11556 | 29559 | 28036 | 22558 | 28576 | 18030 | 20487 | 13123 |
| | 6229 | 21755 | 4019 | 14826 | 8138 | 13751 | 26764 | 8521 | 15037 | 12464 | 15103 | 18931 |
| | 1990 | 16594 | 2573 | 20483 | 23359 | 14747 | 4684 | 21853 | 9108 | 9107 | 22021 | 22025 |
| | 24031 | 21991 | 26569 | 29011 | 3328 | 15130 | 15099 | 21719 | 26251 | 13720 | 2076 | 26107 |
| | 29685 | 2456 | 2459 | 2455 | 27370 | 27372 | 13269 | 13267 | 451 | 450 | 9730 | 9757 |
| | 7464 | 2859 | 18689 | 21426 | 14657 | 11572 | 11571 | 20099 | 21999 | 21996 | 14338 | 14342 |
| | 14140 | 14363 | 14341 | 5549 | 14372 | 14882 | 14890 | 14886 | 30442 | 10628 | 10627 | 13868 |
| | 14633 | 10603 | 18761 | 17083 | 26475 | 9727 | 16866 | 26608 | 8550 | 21992 | 24316 | 24297 |
| | 2970 | 22223 | 16540 | 16890 | 3910 | 16235 | 4535 | 4961 | 11545 | 28378 | 28077 | 2309 |
| | 14104 | 27167 | 10780 | 13561 | 10432 | 24018 | 30465 | 23865 | 12964 | 12659 | 15841 | 19746 |
| | 26552 | 28337 | 28331 | 28342 | 28339 | | | | | | | |
| 340: | 21770 | 28720 | 10863 | 27545 | 9178 | 26787 | 6519 | 23297 | 20095 | 29341 | 9143 | 13894 |
| | 10082 | 4256 | 17653 | 20883 | 24135 | 13621 | 21762 | 6232 | 3608 | 11358 | 11361 | 1942 |
| | 28197 | 10439 | 21415 | 1254 | 24609 | 25586 | 30150 | 14516 | 8798 | 19201 | 14538 | 15248 |
| | 5015 | 12220 | 11853 | 23977 | 6054 | 29227 | 6328 | 18661 | 3429 | 10058 | 10062 | 22266 |
| | 1003 | 7877 | 1102 | 7303 | 26430 | 26433 | 5031 | 6486 | 24905 | 22466 | 20061 | 18161 |

TABLE 8-continued

| PEP SEQ ID NO: | homolog SEQ ID NOs | | | | | | | | | | |
|---|---|---|---|---|---|---|---|---|---|---|---|
| | 23748 | 28575 | 13516 | 13519 | 1247 | 7513 | 23296 | 25872 | 28950 | 20096 | 12419 | 25604 |
| | 10881 | 10835 | 12150 | 3049 | 28826 | 1057 | 11975 | 11976 | 12001 | 14156 | 28285 | 22231 |
| | 2118 | 3482 | 7434 | 29857 | 28541 | 16535 | 22078 | | | | | |
| 341: | 26090 | 24906 | 7328 | 16079 | 13640 | 1998 | 3987 | 14369 | 10118 | 24547 | 10168 | 19534 |
| | 14201 | 29751 | 23972 | 19048 | 19124 | 19518 | 16929 | 12836 | 10980 | 5385 | 12514 | 8603 |
| | 21615 | 14006 | 9621 | 29755 | 3278 | 9131 | 13564 | 783 | 18177 | 14122 | 16367 | 18197 |
| | 10484 | 27976 | 27790 | 10726 | 28360 | 7845 | 8361 | 7214 | 3978 | 10445 | 26641 | 12573 |
| | 11417 | 1937 | 8810 | 18305 | 17353 | 26604 | 11764 | 14422 | 27199 | 13341 | 7149 | 27631 |
| | 850 | 24218 | 22409 | 8455 | 30360 | 3313 | 24294 | 14091 | 12152 | 23301 | 604 | 28356 |
| | 12273 | 17439 | 23202 | 5642 | 24682 | 21304 | 19627 | 21743 | 5612 | 2420 | 8426 | 27392 |
| | 19043 | 29067 | 5266 | 8170 | 5679 | 6456 | 10383 | 22771 | 8450 | 17154 | 17655 | 21229 |
| | 10695 | 22850 | 20714 | 3703 | 17981 | 27996 | 24666 | 29419 | 13898 | 25251 | 2927 | 968 |
| | 25866 | 11823 | 11437 | 11556 | 29559 | 28036 | 22558 | 28576 | 18030 | 644 | 20487 | 13123 |
| | 6229 | 21755 | 4019 | 11073 | 14826 | 8138 | 4868 | 5476 | 13751 | 26764 | 24215 | 21989 |
| | 8521 | 23457 | 15037 | 29764 | 12464 | 17472 | 1453 | 3416 | 1990 | 16594 | 2573 | 20483 |
| | 22565 | 23359 | 4684 | 14747 | 21853 | 9107 | 9108 | 22028 | 22025 | 22021 | 24031 | 21991 |
| | 26569 | 29011 | 5830 | 3328 | 15099 | 15130 | 21719 | 26251 | 13720 | 2076 | 22740 | 19986 |
| | 24231 | 21220 | 18601 | 26295 | 4537 | 15313 | 1807 | 11247 | 9328 | 2456 | 2455 | 2459 |
| | 27366 | 27372 | 27370 | 13267 | 13269 | 451 | 450 | 9730 | 9757 | 9762 | 588 | 27732 |
| | 10917 | 1804 | 21426 | 14657 | 11572 | 11571 | 15508 | 10874 | 22276 | 21996 | 21999 | 14338 |
| | 14342 | 14140 | 14363 | 14341 | 15131 | 6669 | 14372 | 14890 | 14882 | 14886 | 14908 | 30442 |
| | 13868 | 14633 | 10627 | 10628 | 10603 | 9996 | 18761 | 17083 | 26475 | 9727 | 16415 | 22604 |
| | 16765 | 21893 | 21349 | 21992 | 24297 | 24316 | 13140 | 2970 | 22223 | 16540 | 763 | 16890 |
| | 3910 | 16235 | 11545 | 28378 | 28077 | 2792 | 23797 | 2309 | 14104 | 7723 | 27167 | 10108 |
| | 12589 | 10780 | 13561 | 10432 | 24018 | 30465 | 23865 | 12964 | 15841 | 26552 | 3311 | |
| 342: | 18131 | 3643 | 22334 | 10822 | 30209 | 15630 | 21810 | 27026 | 11320 | 29856 | 23622 | 29187 |
| | 27221 | 8547 | 14689 | 5603 | | | | | | | | |
| 343: | 4916 | 6512 | 345 | 2099 | 26590 | 29097 | 7276 | 21156 | 11819 | 9423 | 11182 | 10242 |
| | 5366 | 29351 | 25711 | 2772 | 18527 | 8710 | 4915 | 11402 | 11843 | 12538 | 3981 | 12632 |
| | 13769 | 9753 | 20717 | 23105 | 611 | 27849 | 16602 | 13617 | 4590 | 11101 | 15611 | 26384 |
| | 29416 | 21142 | 17846 | 14279 | 9447 | 15785 | 3589 | 10641 | 3749 | 6668 | 18679 | 29123 |
| | 29078 | | | | | | | | | | | |
| 344: | 18538 | 5825 | 13713 | 17120 | 16141 | 18556 | 24151 | 1677 | 23605 | 29721 | 20155 | 17125 |
| | 5796 | 25356 | 18349 | 741 | 21058 | 23633 | 21577 | 28180 | 28596 | 24025 | 25564 | 5408 |
| | 12806 | 15740 | 13408 | 27067 | 4436 | 19652 | 26285 | 27529 | 7639 | 5954 | | |
| 345: | 11988 | 10714 | 23912 | 14861 | 5911 | 2052 | 5344 | 27421 | 5258 | 13297 | 7301 | 14114 |
| | 4493 | 8572 | 11229 | 16497 | 6319 | 15022 | 2066 | 13925 | 11919 | 9928 | 7922 | 794 |
| | 17978 | 6386 | 8649 | 4916 | 6512 | 11182 | 10242 | 29351 | 29078 | 343 | 7164 | 17921 |
| | 7227 | 9612 | 21317 | 11922 | 26878 | 2772 | 18527 | 8710 | 7789 | 4915 | 11402 | 11843 |
| | 13769 | 12538 | 3981 | 12632 | 20717 | 9753 | 23105 | 13617 | 11101 | 4590 | 29416 | 26384 |
| | 15611 | 17846 | 14279 | 21142 | 9447 | 15785 | 10641 | 6668 | 11800 | 25436 | 11027 | 7276 |
| | 11819 | 26590 | | | | | | | | | | |
| 346: | 7938 | 7964 | 7962 | 19565 | 11649 | 1841 | 24052 | 25942 | 28102 | 21218 | 21222 | 21226 |
| | 25813 | 8989 | 13495 | 2802 | 17982 | 11467 | 19113 | 4583 | 3706 | 3705 | 5387 | 4585 |
| | 5393 | 5465 | 5445 | 5501 | 5472 | 5471 | 5448 | 5444 | 5469 | 14414 | 5998 | 20172 |
| | 13331 | 27590 | 7516 | 10486 | 24909 | 14569 | 18186 | 27256 | 29588 | 7905 | 7870 | 9487 |
| | 7775 | 5987 | 8194 | 2774 | 20986 | 6870 | 3660 | 11002 | 22398 | 15468 | | |
| 347: | 7938 | 7964 | 7962 | 19565 | 11649 | 1841 | 24052 | 25942 | 28102 | 21218 | 21222 | 21226 |
| | 25813 | 8989 | 13495 | 2802 | 17982 | 11467 | 19113 | 4583 | 3706 | 3705 | 5387 | 4585 |
| | 5393 | 5465 | 5445 | 5501 | 5472 | 5471 | 5448 | 5444 | 5469 | 14414 | 5998 | 20172 |
| | 13331 | 27590 | 7516 | 10486 | 24909 | 14569 | 18186 | 27256 | 29588 | 7905 | 7870 | 9487 |
| | 7775 | 5987 | 8194 | 2774 | 20986 | 3779 | 6870 | 3660 | 11002 | 22398 | 15468 | |
| 348: | 29418 | 22857 | 9311 | 17119 | 2104 | 25847 | 13088 | 3752 | 23347 | 15078 | 5810 | 13222 |
| | 3310 | | | | | | | | | | | |
| 349: | 614 | 724 | 3578 | 22853 | 3894 | 14408 | 17617 | 16005 | 5028 | 4994 | 6144 | 18942 |
| | 1739 | 19146 | 19006 | 21205 | 19955 | 18334 | 1836 | 688 | 8318 | 8309 | 8009 | 18573 |
| | 12586 | 2590 | 2565 | 2467 | 10589 | 12733 | 15544 | 27685 | 16097 | 11960 | 8314 | 8418 |
| | 30026 | 13264 | 25960 | 20279 | 28604 | 9168 | 9102 | 4334 | 18164 | 22788 | 19095 | 19662 |
| | 19042 | 19049 | 24125 | 27121 | 19723 | 2837 | | | | | | |
| 350: | 25920 | 24644 | 1529 | 23814 | 24344 | 15084 | 14227 | 18006 | 14646 | 23448 | 24200 | 9536 |
| | 18059 | 16068 | 8120 | 12166 | 1157 | 9942 | 23891 | 19467 | 18975 | 17571 | 13916 | 17062 |
| | 13954 | 30032 | 30072 | 21873 | 22881 | 22429 | 22033 | 14744 | 17913 | 8446 | 21245 | 13213 |
| | 11202 | 2023 | 21284 | 6453 | 13606 | 28247 | 18363 | 16827 | 7499 | 10306 | 2885 | 7034 |
| | 15748 | 18795 | 7135 | 2826 | 14349 | 26534 | 10017 | 9581 | 18077 | 16809 | 20911 | 1848 |
| | 1845 | 959 | 4109 | 6111 | 11844 | 17914 | 14967 | 21673 | 22031 | 7359 | 28409 | 10418 |
| | 22205 | 27228 | 15974 | 5704 | 793 | 8850 | 1706 | 29890 | 23956 | 11944 | 17184 | 1355 |
| | 27378 | 12341 | 6759 | 28306 | 28653 | 18936 | 29307 | 17520 | 27607 | 5304 | 17259 | 26939 |
| | 26965 | 29799 | 2845 | 2062 | 2070 | 15520 | 12492 | 15827 | 1192 | 30408 | 1139 | 15665 |
| | 19538 | 9816 | 13901 | 7716 | 19422 | 15897 | 12124 | 21262 | 15110 | 25363 | 7683 | 28049 |
| | 27480 | 18637 | 24637 | 26219 | 19136 | 7204 | 22563 | 15505 | 24643 | 5121 | 4350 | 4408 |
| | 3906 | 23597 | 8160 | 8131 | 2297 | 2304 | 25927 | 7095 | 17066 | 29209 | 25772 | 29350 |
| | 29562 | 5066 | 3637 | 28920 | 3057 | 6612 | 7770 | 20393 | 27662 | 28290 | 24705 | 16499 |
| | 19142 | 30186 | 3253 | 4552 | 27648 | 23462 | 16787 | 28442 | 22697 | 23321 | 3065 |
| | 10292 | 26395 | 22899 | 19141 | 6948 | 12559 | 19278 | 5533 | 27315 | 9016 | 7324 | 4683 |
| | 6113 | 15854 | 18924 | 20234 | 22655 | 26469 | 17177 | 14622 | 22318 | 755 | 7895 | 5074 |
| | 7569 | 19265 | 1098 | 2571 | 12840 | 10817 | 25634 | 3112 | 3358 | 28513 | 21346 | 21320 |
| | 29139 | 22925 | 18545 | 11825 | 12196 | 7530 | 24976 | 17397 | 10164 | 15770 | 30252 | 5196 |
| | 23259 | 1359 | 25426 | 3667 | 26115 | 19548 | 8687 | 6627 | 26061 | 21214 | 4028 | 3534 |

TABLE 8-continued

| PEP SEQ ID NO: | homolog SEQ ID NOs | | | | | | | | | | |
|---|---|---|---|---|---|---|---|---|---|---|---|
| | | 1345 | 23886 | 6923 | 11242 | 23901 | 4165 | 17152 | 9868 | 14083 | 20806 | 18263 | 25213 |
| | | 28694 | 21031 | 27059 | 24261 | 20030 | 13360 | 10494 | 22152 | 7226 | 27863 | 16168 | 17204 |
| | | 3394 | 26821 | 9744 | 19873 | 18837 | 941 | 28538 | 3543 | 9582 | 30164 | 22864 | 24540 |
| | | 15680 | 14586 | 22420 | 25280 | 29030 | 21767 | 23702 | 28314 | 12167 | 20702 | 16527 | 10572 |
| | | 4802 | 27738 | 3757 | 15681 | 19454 | 22509 | 25425 | 27457 | 2671 | 4541 | 2977 | 6184 |
| | | 27539 | 21872 | 28762 | 22278 | 19735 | 29493 | 29520 | 893 | 25366 | 16876 | 6305 | 25875 |
| | | 8993 | 28377 | 2624 | 2609 | 4566 | 21103 | 21943 | 17451 | 1319 | 29185 | 21139 | 28390 |
| | | 28171 | 6402 | 9696 | 14677 | 27369 | 26819 | 27805 | 22984 | 14700 | 11887 | 8472 | 14831 |
| | | 26049 | 7746 | 20854 | 7394 | 3365 | 3485 | 27032 | 3326 | 26432 | 23857 | 9779 | 26282 |
| | | 30359 | 22798 | 10974 | 10979 | 18841 | 11792 | 4797 | 2799 | 30300 | 5683 | 21944 | 30343 |
| | | 23272 | 23277 | 10554 | 22580 | 11539 | 11511 | 9920 | 2608 | 9023 | 14336 | 22381 | 14360 |
| | | 28647 | 10025 | 28641 | 28668 | 2851 | 7776 | 22358 | 20703 | 18665 | 697 | 26328 | 10907 |
| | | 5004 | 27589 | 25190 | 29584 | 24187 | 12314 | 3043 | 6989 | 14709 | 14830 | 14402 | 14008 |
| | | 4431 | 13366 | 16410 | 10783 | 22185 | 2470 | 25841 | 8458 | 24608 | 27170 | 30062 | 18922 |
| | | 21399 | 827 | 2011 | 5154 | 14132 | 11928 | 12070 | 30309 | 3467 | 30274 | 5877 | 25132 |
| | | 17987 | 7023 | 6872 | 2268 | 19346 | 10853 | 24176 | 19904 | 22368 | 19309 | 27844 | 25995 |
| | | 10199 | 13501 | 30377 | 10737 | 11418 | 8376 | 10584 | 8674 | 2911 | 12275 | 9547 | 21566 |
| | | 22643 | 9313 | 3260 | 13786 | 3783 | 26800 | 4169 | 21924 | 12461 | 11937 | 6408 | 19340 |
| | | 26860 | 9768 | 12050 | 14552 | 11573 | 3100 | 22475 | 2668 | 29923 | 19381 | | |
| 351: | | 27554 | 18984 | 16422 | 1088 | 21669 | 8135 | 26926 | 13594 | 10710 | 26801 | 21191 | 25806 |
| | | 19067 | 13318 | 26155 | 21968 | 14870 | 30140 | 13350 | 29241 | 8402 | 15374 | 8222 | 6863 |
| | | 4123 | 22839 | 6073 | 18370 | 28847 | 26587 | 25126 | 16326 | 26809 | 14380 | 29148 | 26255 |
| | | 23674 | 10803 | 28685 | 13691 | 17933 | 7223 | 25533 | 8619 | 22779 | 7749 | 11265 | 21339 |
| | | 22750 | 5454 | 17264 | 15289 | 1974 | 12428 | 29460 | 2817 | 29727 | 25125 | 1463 | 26610 |
| | | 11994 | 23682 | 25519 | 24067 | 14043 | 664 | 4760 | 13668 | 15516 | 4680 | 9993 | 5301 |
| | | 8221 | 863 | 25180 | 10815 | 13635 | 18926 | 10248 | 27340 | 26253 | 17205 | 5052 | 24731 |
| | | 3006 | 22102 | 24591 | 10529 | 11102 | 29117 | 17395 | 26634 | 21754 | 6987 | 6542 | 9467 |
| | | 9217 | 22531 | 19097 | 14241 | 13334 | 18834 | 16236 | 25886 | 24311 | 1160 | 22903 | 27329 |
| | | 26308 | 10311 | 8833 | 21593 | 25617 | 17687 | 24914 | 4346 | 23671 | 21206 | 1309 | 20939 |
| | | 12229 | 1669 | 27028 | 11980 | 12133 | 6357 | 9205 | 9991 | 1562 | 16106 | 28483 | 8149 |
| | | 2711 | 3792 | 19632 | 26474 | 7977 | 20623 | 7684 | 13424 | 19673 | 19421 | 18576 | 22127 |
| | | 29532 | 5384 | 8604 | 11038 | 24779 | 704 | 27058 | 22603 | 26792 | 11899 | 21119 | 22498 |
| | | 14504 | 20023 | 7267 | 24872 | 21452 | 24455 | 3454 | 9355 | 24853 | 2569 | 4671 | 1000 |
| | | 13281 | 1626 | 12768 | 18743 | 5214 | 2570 | 27862 | 15145 | 1812 | 28364 | 30374 | 27113 |
| | | 26507 | 709 | 20394 | 3836 | 11121 | 7396 | 3423 | 3421 | 795 | 12040 | 28488 | 29630 |
| | | 3405 | 2732 | 25092 | 14244 | 22841 | 629 | 30123 | 9528 | 23288 | 17596 | 8300 | 24721 |
| | | 26374 | 24739 | 2497 | 3304 | 30420 | 14660 | 13548 | 24948 | 20419 | 29868 | 6943 | 20416 |
| | | 22894 | 22859 | 27337 | 14992 | 14571 | 23208 | 25793 | 2678 | 6112 | 7622 | 13744 | 13286 |
| | | 25052 | 26379 | 7041 | 3766 | 17142 | 18468 | 3360 | 11148 | 27763 | 9737 | 3538 | 22901 |
| | | 21811 | 26786 | 1972 | 19313 | 21553 | 30449 | 8816 | 27617 | 5788 | 7097 | 20050 | 14214 |
| | | 4551 | 9042 | 7331 | 9689 | 17354 | 24391 | 29154 | 16347 | 22964 | 7835 | 6178 | 13509 |
| | | 28079 | | | | | | | | | | | |
| 352: | | 13149 | 13153 | 13126 | 30250 | 1216 | 10749 | 2895 | 19399 | 17847 | 24949 | 15664 | 6429 |
| | | 12123 | 15763 | 12183 | 17890 | 20990 | 5779 | 19020 | 9916 | 29404 | 16096 | 7457 | 17135 |
| | | 20086 | 19385 | 6032 | 19796 | 1721 | 18771 | 4608 | 1976 | 22526 | 4362 | 10279 | 29199 |
| | | 1925 | 29177 | 6255 | 18462 | 7822 | 27052 | 9938 | 23807 | 18227 | 15448 | 29130 | 8747 |
| 353: | | 2103 | 25480 | 1928 | 18714 | 20436 | 28906 | 29484 | 3073 | 13735 | 7476 | 27824 | 19963 |
| | | 3221 | 23291 | 5213 | 17979 | 16388 | 29603 | 10312 | 18230 | 8127 | 3934 | 18173 | 7813 |
| | | 9068 | 15259 | 5109 | 26784 | 12473 | 24998 | 2334 | 4049 | | | | |
| 354: | | 5363 | 22299 | 22301 | 18169 | 7872 | 29363 | 11251 | 27268 | 21532 | 6371 | 13796 | 15408 |
| | | 27858 | 1452 | 12799 | 20799 | 26602 | 10254 | 27046 | 18892 | 27064 | 15196 | 836 | 29137 |
| | | 2170 | 20807 | 16073 | 6012 | 4356 | 2303 | 2144 | 2301 | 7982 | 7959 | 3510 | 3537 |
| | | 3540 | 16997 | 11960 | 20516 | 1023 | 21047 | 18627 | 13264 | 25960 | 20817 | 19883 | 9992 |
| | | 13216 | 21440 | 18164 | 22230 | 2196 | 10569 | | | | | | |
| 355: | | 8451 | 16682 | 1584 | 27346 | 18635 | 8003 | 19163 | 12457 | 7316 | 6045 | 6044 | 17900 |
| | | 22128 | 8570 | 23399 | 30100 | 25277 | 12720 | 6355 | 26292 | 16567 | 1079 | 8261 | 25412 |
| | | 9771 | 29428 | 23374 | 22050 | 2217 | 1444 | 29813 | 17572 | 13343 | 28131 | 29052 | 27403 |
| | | 23936 | 20663 | 16582 | 7543 | 29769 | 19223 | 789 | 13517 | 26690 | 13362 | 4302 | 3466 |
| | | 5327 | 12303 | 6407 | 5508 | 16712 | 15042 | 2939 | 14381 | 14524 | 9050 | 20655 | 21318 |
| | | 4880 | 23357 | 21527 | 11747 | 3488 | 9924 | 4579 | 769 | 7405 | 25601 | 19728 | 28790 |
| | | 8577 | 8448 | 2136 | 3087 | 2120 | 26757 | 24202 | 8662 | 13752 | 13506 | 28251 | 15837 |
| | | 24079 | 6461 | 17052 | 30227 | 1404 | 13525 | 13831 | 26920 | 26744 | 26741 | 12815 | 7548 |
| | | 25652 | 20404 | 13389 | 29841 | 13200 | 13244 | | | | | | |
| 356: | | 21248 | 17257 | 15761 | 6077 | 10470 | 21419 | 28104 | 30402 | 17958 | 18501 | 29763 | 26183 |
| | | 17591 | 24404 | | | | | | | | | | |
| 357: | | 3118 | 4379 | 29540 | 25003 | 3912 | 2230 | 27094 | 5259 | 6746 | 23092 | 21097 | 2178 |
| | | 303 | 11912 | 22040 | 13730 | 19057 | 8657 | 6085 | 7368 | 837 | 22651 | 24494 | 29662 |
| | | 25823 | 24934 | 6049 | 13521 | 17683 | 12327 | 11243 | 15290 | 5880 | 16826 | 27443 | 10119 |
| | | 22886 | 23408 | 13219 | | | | | | | | | |
| 358: | | 9617 | 28607 | 25085 | 11495 | 9739 | 27311 | 12711 | 5185 | 9235 | 13544 | 13808 | 9009 |
| | | 27602 | 8237 | 4455 | 11195 | 2458 | 15832 | 1788 | 21739 | 23423 | 17693 | 12584 | 20756 |
| | | 756 | 22343 | 4327 | 1640 | 7725 | 7574 | 21227 | 13293 | | | | |
| 359: | | 28684 | 4984 | 832 | 5070 | 2944 | 20878 | 5124 | 1682 | 28846 | 11289 | 28431 | 1786 |
| | | 12260 | 12483 | 6765 | 22494 | 24751 | 7648 | 6170 | 19016 | 15428 | 12071 | 3106 | 23678 |
| | | 4676 | 2425 | 23478 | 15882 | 4252 | 25154 | 22484 | 16505 | 16511 | 6634 | 22008 | 16947 |
| | | 17749 | 14952 | 11908 | 6956 | 6530 | 10997 | 12539 | 10459 | 10823 | 19254 | 29444 | 22729 |
| | | 22727 | 22758 | 22327 | 1828 | 22257 | 29992 | 27891 | 22718 | 19452 | 19045 | 1825 | 1826 |

TABLE 8-continued

| PEP SEQ ID NO: | homolog SEQ ID NOs | | | | | | | | | | |
|---|---|---|---|---|---|---|---|---|---|---|---|
| | 15341 | 15298 | 15303 | 15262 | 15306 | 15271 | 15265 | 15268 | 15311 | 15309 | 15336 | 25966 |
| | 28410 | 14218 | 18529 | 22756 | 6300 | 11942 | 22731 | 18512 | 29862 | 27836 | | |
| 360: | 28688 | 17211 | 26128 | 17387 | 23775 | 5365 | 26559 | 10961 | 18822 | 10503 | 22874 | 29796 |
| | 14123 | 7003 | 21340 | 11377 | 5264 | 4239 | 18505 | 2866 | 20538 | 21900 | 7647 | 9387 |
| | 18205 | 26100 | 7093 | 15997 | 12852 | 18902 | 8422 | 22844 | 30200 | 17155 | 5287 | 19410 |
| | 26763 | 20062 | 7400 | 6080 | 9861 | 16848 | 25160 | 18543 | 15870 | 18615 | 23353 | 19198 |
| | 16391 | 28108 | 9713 | 24307 | 17164 | 23894 | 6206 | 3507 | 1631 | 2286 | 28040 | 30068 |
| | 12264 | 13732 | 29215 | 24056 | 23390 | 30206 | 28355 | 29773 | 21662 | 28161 | 2281 | 26370 |
| | 14301 | 23849 | 30240 | 12305 | 29871 | 15094 | 3700 | 10428 | 17841 | 9963 | 29073 | 16907 |
| | 16972 | 8905 | 3869 | 29354 | 27448 | 27478 | 9010 | 12163 | 7974 | 5888 | 7928 | 10870 |
| | 15645 | 17121 | 16716 | 25487 | 24456 | 2828 | 3557 | 14315 | 20357 | 14439 | 22800 | 18117 |
| | 1779 | 7914 | 1064 | 9183 | 20763 | 16844 | 4515 | 15386 | 9097 | 29839 | 13999 | 18441 |
| | 13092 | 18142 | 8838 | 9939 | 26169 | 20545 | 25488 | 10152 | 2093 | 15314 | 8718 | 21581 |
| | 2227 | 26903 | 20611 | 19297 | 20761 | 15531 | 9829 | 17574 | 5586 | 14373 | 10366 | 29285 |
| | 25386 | 30014 | 27087 | 22645 | 17679 | 18245 | 25448 | 3081 | 28033 | 24084 | 5192 | 6132 |
| | 9367 | 764 | 787 | 1636 | 1627 | 16919 | 15377 | 10883 | 10983 | 4309 | 5256 | 6796 |
| | 18974 | 30205 | 6832 | 24492 | 14656 | 14765 | 29798 | 3769 | 22805 | 5516 | 17371 | 17317 |
| | 11940 | 21083 | 29120 | 24185 | 1692 | 27644 | 11970 | 1802 | 23371 | 21941 | 17992 | 7532 |
| | 3424 | 29397 | 8878 | 22232 | 16936 | 13554 | 2872 | 11041 | 27470 | 10993 | 20650 | |
| | 27939 | 13950 | 11472 | 28305 | 6423 | 24864 | 23555 | 25522 | 24614 | 11793 | 3644 | 6286 |
| | 19468 | 27503 | 22255 | 25915 | 18081 | 650 | 12010 | 20661 | 27286 | 27001 | 29762 | 8647 |
| | 9237 | 10195 | 22777 | 9220 | 18437 | 18530 | 2266 | 12075 | 7366 | 28968 | 10244 | 14170 |
| | 21723 | | | | | | | | | | | |
| 361: | 20823 | 2065 | 3740 | 29754 | 27616 | 16665 | 3258 | 29600 | 23203 | 5289 | 8232 | 9063 |
| | 13002 | 29519 | 5947 | 19480 | 13551 | 12956 | 13622 | 16014 | 10672 | 2626 | 1050 | 19251 |
| | 29655 | 20406 | 9443 | 10553 | 29333 | 6383 | 1522 | 23646 | 16011 | 30464 | 18467 | 27376 |
| | 24258 | 15734 | 21223 | 811 | 1519 | 19496 | 26946 | 21837 | 5538 | 29836 | 26932 | 27468 |
| | 23870 | 27575 | 20557 | 2174 | 23926 | 9038 | 7620 | 20397 | 22248 | 22851 | 5602 | 22100 |
| | 6652 | 7388 | 7409 | 16957 | 23824 | 5434 | 5440 | 868 | 19270 | 20395 | 8343 | 1605 |
| | 18399 | 10105 | 2846 | 15337 | 19186 | 4373 | 28413 | 11503 | 27576 | 9876 | 24770 | 16314 |
| | 12067 | 29458 | 29558 | 26762 | 26758 | 28098 | 28094 | 4443 | 14685 | 2818 | 19017 | 10523 |
| | 26823 | 14859 | 700 | 9279 | 22665 | 7808 | 16000 | 965 | 23839 | 20428 | 19429 | 23065 |
| | 903 | 3801 | 19241 | 27786 | 6527 | 1164 | 1824 | 2840 | 22056 | 25554 | 9345 | 8675 |
| | 13300 | 24757 | 5814 | 10436 | 17186 | 8522 | 2572 | 22682 | 16438 | 25061 | 6301 | 14085 |
| | 18137 | 21354 | 26564 | 7491 | 24235 | | | | | | | |
| 362: | 25116 | 20229 | 16730 | 22738 | 8586 | 26303 | 20226 | 13995 | 15707 | 1726 | 11759 | 8532 |
| | 13981 | 13998 | 27885 | 26299 | 8534 | 28938 | 17481 | 11321 | 25163 | 21157 | 2971 | 16512 |
| | 3778 | 2602 | 19898 | 16631 | 6841 | 25316 | 27754 | 16884 | 5747 | 29427 | 23158 | 3708 |
| | 4679 | 10307 | 1145 | 1141 | 29694 | 6698 | 23809 | 15972 | 15251 | 29720 | 28672 | 2165 |
| | 11791 | 658 | 11787 | 25801 | 6900 | 8911 | 25947 | 3997 | 7019 | 6926 | 28841 | 24822 |
| | 29695 | 21328 | 10194 | 13178 | 29171 | 4182 | 1487 | 2710 | 16708 | 11397 | 2160 | 25082 |
| | 19944 | 12238 | 11755 | 28934 | 12376 | 1469 | 28249 | 19059 | 23089 | 22728 | 23922 | 23662 |
| | 23471 | 26428 | 1408 | 13990 | 26052 | 28932 | 13985 | 963 | 11250 | 13791 | 26321 | 29119 |
| | 8525 | 9308 | 12348 | 22463 | | | | | | | | |
| 363: | 15667 | 15776 | 22048 | 25867 | 17058 | 9020 | 7889 | 10022 | 18296 | 18319 | 12699 | 12695 |
| | 12694 | 25226 | 12728 | 30056 | 6650 | 3103 | 14968 | 10608 | 18148 | 18528 | 18524 | 18552 |
| | 19492 | 19418 | 15886 | 3386 | 807 | 17060 | 6797 | 25166 | 7038 | 15150 | 11717 | 9681 |
| | 18850 | 18174 | 6173 | 6712 | 29925 | 11786 | 1834 | 11518 | 30333 | 12530 | 17034 | |
| | 25336 | 7174 | 3863 | 7544 | 14005 | 24497 | 4940 | 16038 | 17380 | 21409 | 30142 | 21841 |
| | 29278 | 26033 | 29682 | 21293 | 4840 | 28067 | 6183 | 27778 | 23352 | 17951 | 21724 | 14579 |
| | 9563 | 6096 | 30288 | 27610 | 27694 | 21571 | 10653 | 26224 | 28712 | 8784 | 8496 | 14222 |
| | 11163 | 6525 | 27216 | 7812 | 8898 | 6843 | 20097 | 29008 | 20982 | 19178 | 12819 | 22895 |
| | 28642 | 25585 | 16520 | 4262 | 24359 | 20068 | 14181 | 12388 | 20657 | 17858 | 2269 | 26336 |
| | 26367 | 16777 | 25776 | 6318 | 8010 | 16987 | 5653 | 13632 | 12818 | 21521 | 17193 | 20965 |
| | 9383 | 18372 | 9808 | 14077 | 17063 | 7742 | 11557 | 1339 | 28816 | 15224 | 27290 | 3204 |
| | 8760 | 28905 | 28652 | 10278 | 4532 | 26722 | 11212 | 14889 | 21758 | 22755 | 14932 | 19394 |
| | 17448 | 29998 | 24340 | 27705 | 14497 | 25437 | 8285 | 26905 | 21137 | 9334 | 10649 | 6848 |
| | 14466 | 15626 | 19031 | 13549 | 21786 | 18681 | 14609 | 22115 | 21015 | 25885 | 18914 | 6131 |
| | 1455 | 5386 | 17446 | 26557 | 23061 | 1493 | 28497 | 28584 | 29041 | 24654 | 2156 | 5383 |
| | 18842 | 6373 | 19824 | 3455 | 26912 | 1490 | 21675 | 23514 | 26648 | 29447 | 28503 | 10441 |
| | 12732 | 16897 | 8507 | 9798 | 11583 | 30154 | 13257 | 10074 | 23974 | 11860 | 1799 | 26872 |
| | 23840 | 17313 | 16112 | 11678 | 11316 | 19613 | 7092 | 25376 | 25691 | 25616 | 25612 | 26421 |
| | 14665 | 9085 | 7134 | 8896 | 2989 | 2982 | 3018 | 2986 | 20461 | 9745 | 18327 | 19918 |
| | 5316 | 25580 | 23692 | 26322 | 2890 | 15963 | 27494 | 19237 | 4479 | 30042 | 3330 | 8748 |
| | 15124 | 8210 | 9098 | 29359 | 9092 | 9090 | 9094 | 1085 | 29959 | 10995 | 28851 | 26542 |
| | 1616 | 5906 | 20434 | 18154 | 9408 | 23004 | 30122 | 17973 | 9119 | 9121 | 10525 | 7876 |
| | 17415 | 2025 | 29336 | 5914 | 24606 | 10971 | 28989 | 20207 | 8265 | 10446 | 17494 | 27213 |
| | 8943 | 29723 | 1853 | 21594 | 22689 | 24233 | 23030 | 18934 | 3418 | 5128 | 5127 | 27418 |
| | 15304 | 9543 | 19187 | 7190 | 5712 | 29111 | 13759 | 16651 | 25827 | 3856 | 25514 | 9252 |
| | 12225 | 17196 | 23786 | 11120 | 22759 | 9241 | 19663 | 1331 | | | | |
| 364: | 572 | 22726 | 21868 | 23521 | 25117 | 27051 | 5777 | 25600 | 16565 | 22552 | 25832 | 16503 |
| | 21817 | 14728 | 10501 | 20312 | 1922 | 26143 | | | | | | |
| 365: | 2785 | 19798 | 21971 | 22501 | 8026 | 7044 | 7049 | 7046 | 18750 | 13666 | 3024 | 3038 |
| | 11039 | 14074 | 1429 | 8606 | 24553 | 1757 | 17726 | 17774 | 14618 | 22129 | 28723 | 16336 |
| | 19191 | 22207 | 23370 | 9532 | 17297 | 9218 | 2923 | 24024 | 18932 | 4361 | 17829 | 15456 |
| | 2364 | 6363 | 12612 | 6922 | 19498 | 13030 | 8341 | 28164 | 4258 | 13106 | 1811 | 16122 |
| | 1051 | 744 | 6529 | 5135 | 8908 | 4810 | 30047 | 13016 | 20550 | 6474 | 30079 | 4836 |
| | 14390 | 5894 | 15952 | 25952 | 16984 | 20565 | 22999 | 1037 | 1906 | 20526 | 30247 | 27474 |

TABLE 8-continued

| PEP SEQ ID NO: | homolog SEQ ID NOs | | | | | | | | | | |
|---|---|---|---|---|---|---|---|---|---|---|---|
| | 6834 | 24461 | 14477 | 26589 | 30015 | 9849 | 1281 | 29262 | 13270 | 27735 | 10808 | 20109 |
| | 6263 | 20296 | 23246 | 9911 | 1792 | 21541 | 2813 | 23854 | 22660 | 13873 | 6244 | 10328 |
| | 20192 | 17484 | 5593 | 28954 | 9444 | 11167 | 11388 | 30348 | 4972 | 20561 | 7018 | 16985 |
| | 24560 | 27578 | 2880 | 22305 | 16973 | 25664 | 19344 | 25467 | 10696 | 27992 | 6966 | 22703 |
| | 1278 | 30261 | 1231 | 22393 | 13639 | 2521 | 29348 | 12061 | 16655 | 25510 | 6733 | 6732 |
| | 11771 | 6758 | 6444 | 14367 | 16745 | 24525 | 22445 | 22666 | 28946 | 15182 | 3933 | 11820 |
| | 13952 | 14634 | 30178 | 2943 | 15060 | 9260 | 28357 | 13601 | 11022 | 28236 | 10389 | 16217 |
| | 3746 | 26696 | 24173 | 4154 | 1411 | 22141 | 21833 | 19331 | 10144 | 13294 | 20437 | 17754 |
| | 26947 | 19779 | 14906 | 15100 | 2107 | 21251 | 21025 | 5624 | 20001 | 1696 | 20726 | 10463 |
| | 8705 | 22313 | 3107 | 9503 | 10905 | 26121 | 1864 | 16828 | 19196 | 2247 | 22768 | 6517 |
| | 26490 | 26065 | 7392 | 14197 | 12658 | 3963 | 3966 | 14009 | 16539 | 22561 | 21947 | 24506 |
| | 26284 | 28532 | 22833 | 29368 | 16464 | 1131 | 10026 | 22163 | 3111 | 20784 | 27389 | 17201 |
| | 2905 | 2904 | 11350 | 9206 | 3509 | 18221 | 5579 | 11463 | 15132 | 28420 | 3182 | 4791 |
| | 29620 | 26713 | 3292 | 22543 | 20897 | 28545 | 18113 | 10753 | 23273 | 9930 | 16623 | 12945 |
| | 4291 | 7077 | 12747 | 14095 | 24406 | 16041 | 26991 | 27952 | 28566 | 1376 | 18300 | 8551 |
| | 6522 | 6532 | 14836 | 23677 | 3289 | 23409 | 28366 | 23851 | 10686 | 22521 | 6218 | 24927 |
| | 18916 | 24313 | 28124 | 5915 | 5547 | 11080 | 17068 | 1558 | 18371 | 8407 | 28877 | 9854 |
| | 9856 | 11911 | 3309 | 18232 | 21621 | 21105 | 17867 | 5002 | 16760 | 26441 | 6986 | 621 |
| | 11013 | 4343 | 12443 | 27133 | 11221 | 3252 | 9012 | 18375 | 25497 | 1413 | 24252 | 20195 |
| | 29884 | 15905 | 24567 | 21424 | 30284 | 11730 | 20007 | 9492 | 4599 | 28904 | 6016 | 25147 |
| | 18784 | 26867 | 7588 | 29200 | 30025 | 11149 | 1917 | 16252 | 17539 | 18416 | 5001 | 7760 |
| | 1275 | 2959 | 12722 | 12808 | 10813 | 14056 | 9706 | 28730 | 27579 | | | |
| 366: | 17662 | 23368 | 19260 | 953 | 2080 | 23266 | 11645 | 1187 | 23379 | 25541 | 3060 |
| | 30258 | 23236 | 15985 | 23812 | 18038 | 15864 | 23014 | 24985 | 23250 | 23331 | 7256 | 29218 |
| | 6537 | 8282 | 6825 | 16290 | 25482 | 5950 | 2607 | 10789 | 10812 | 1498 | 1122 | 26002 |
| | 16188 | 19194 | 21599 | 29031 | 11984 | 20400 | 13964 | 4133 | 25096 | 30080 | 24402 | 6338 |
| | 7573 | 18596 | 30323 | 16553 | 29248 | 30191 | 3818 | 16246 | 13336 | 15485 | 9429 | 7547 |
| | 2333 | 25054 | 20670 | 27775 | 8648 | 5878 | 21125 | | | | | |
| 367: | 12532 | 1185 | 15693 | 12627 | 19292 | 28786 | 14537 | 28010 | 20382 | 18294 | 18887 | 18885 |
| | 5808 | 17684 | 768 | 26489 | 30213 | | | | | | | |
| 368: | 16906 | 20559 | 21806 | 5055 | 9056 | 13559 | 14510 | 4167 | 13364 | 13441 | 11165 | 3862 |
| | 1913 | 6572 | 9353 | 29885 | 5672 | 23667 | 20433 | 11405 | 26215 | 8142 | 13983 | 9317 |
| | 1831 | 16167 | 26355 | 11049 | 12454 | 607 | 20163 | 21550 | 8941 | 3691 | 19336 | 8960 |
| | 11635 | 2500 | 12784 | 9832 | 13853 | 14431 | 6891 | 25892 | 24022 | 8074 | 10050 | 6314 |
| | 15883 | 23231 | 829 | 4758 | 4754 | 28646 | 4717 | 20464 | 9858 | 7971 | 12622 | 20501 |
| | 4271 | 12195 | 9291 | 19503 | 21548 | 4124 | 10854 | 6713 | 26029 | 12272 | 1775 | 25590 |
| | 22837 | 22812 | 22556 | 10678 | 16223 | 25625 | 21334 | 8456 | 22176 | 14327 | 14302 | 17822 |
| | 17624 | 16859 | 16850 | 17780 | 17619 | 17629 | 16852 | 10588 | 10650 | 1001 | 29219 | 15690 |
| | 20293 | 25766 | 12151 | 21485 | 14320 | 17504 | 15478 | 15477 | 15066 | 15835 | 30365 | 30421 |
| | 2696 | 20311 | 3417 | 19744 | 18488 | 3839 | 8782 | 17965 | 3743 | 3775 | 17509 | 17514 |
| | 7891 | 6457 | 12394 | 12411 | 4075 | 4077 | 17590 | 21909 | 28286 | 3388 | 16788 | 15982 |
| | 7848 | 29135 | 20349 | 19157 | 14248 | 29979 | 17396 | 17358 | 17398 | 17407 | 17410 | 17366 |
| | 17324 | 17403 | 17357 | 17368 | 17360 | 19996 | 19846 | 11904 | 23714 | 2173 | 22814 | 22809 |
| | 20197 | 29687 | 3983 | 24318 | 21492 | 20319 | 26103 | 28858 | 6802 | 20161 | 3448 | 4055 |
| | 12112 | 10358 | 7750 | 12606 | 13406 | 12501 | 6292 | 9527 | 13807 | 3896 | 12598 | 5152 |
| | 5149 | 5155 | 26816 | 300 | | | | | | | | |
| 369: | 12105 | 25662 | 9969 | 17226 | 25561 | 19375 | 19137 | 18295 | 18861 | 19386 | 13836 | 2279 |
| | 4873 | 4876 | 3820 | 3091 | 17868 | 23434 | 19125 | 27453 | 13210 | 8946 | 6913 |
| | 24880 | 24875 | 10855 | 10851 | 11632 | 4175 | 1889 | 28068 | 16417 | 3807 | 24970 | 19547 |
| | 25083 | 28222 | 27062 | 1397 | 28093 | 20514 | 1934 | 17351 | 5340 | 17475 | 6651 | 6628 |
| | 23848 | 21516 | 6717 | 11419 | 11421 | 6570 | 4635 | 11278 | 2641 | 27197 | 4386 | 12120 |
| | 12982 | 8875 | 9649 | 9303 | 29572 | 20558 | 24896 | 25979 | | | | |
| 370: | 24465 | 21401 | 11218 | 19349 | 9644 | 15930 | 1235 | 8351 | 23088 | 10788 | 5765 | 5761 |
| | 5738 | 26337 | 7764 | 5228 | 23488 | 11190 | 11189 | 29202 | 12910 | 7661 | 27041 | 5745 |
| | 14084 | 14115 | 29789 | 28902 | 28922 | 27512 | 9542 | 7402 | 10727 | 6303 | 29079 | 716 |
| | 8930 | 24123 | 23841 | 1025 | 2086 | 2205 | 9419 | 7665 | 11564 | 30212 | 17363 | 30184 |
| | 19808 | 23497 | 331 | | | | | | | | | |
| 371: | 20828 | 2018 | 29819 | 22216 | 5134 | 18043 | 29124 | 3400 | 30311 | 10221 | 10919 | 3008 |
| | 15824 | 27737 | 18632 | 30109 | 912 | 9609 | 19414 | 27547 | 13910 | 2325 | 30046 | 16563 |
| | 11184 | 12474 | 23560 | 19933 | 9705 | 23325 | 15597 | 24532 | 13595 | 18630 | 3813 | 21147 |
| | 23666 | 18452 | 8173 | 5530 | 10225 | 29269 | 26847 | 28198 | 27549 | 5423 | 8517 | 14755 |
| | 13305 | 17340 | 6951 | 17444 | 21075 | 19610 | 11191 | 9314 | 3484 | 5919 | 26028 | 27327 |
| | 16925 | 19302 | 23459 | 8937 | 18660 | 4087 | 21301 | 13146 | 5106 | 7307 | 9531 | 3669 |
| | 6992 | 21099 | 926 | 9546 | 25033 | 11143 | 7866 | 18849 | 25639 | 4131 | 14731 | 12666 |
| | 24674 | 21956 | 22772 | 10908 | 1840 | 26236 | 9375 | 8676 | 28261 | 29411 | 21699 | 8916 |
| | 6548 | 15637 | 14791 | 14919 | 1712 | 24713 | 27435 | 27895 | 13310 | 25971 | 13333 | 25998 |
| | 25969 | 25973 | 28430 | 17161 | 28170 | 24203 | 9153 | 3761 | 29294 | 4059 | 14595 | 5098 |
| | 16330 | 17529 | 26472 | 26351 | 22799 | 1837 | 898 | 10563 | 10556 | 16982 | 23987 | 28072 |
| | 3664 | 25730 | 13500 | 8168 | 18229 | 24508 | 7542 | 27295 | 25549 | | | |
| 372: | 29272 | 16408 | 7305 | 25504 | 30120 | 18562 | 6104 | 429 | 23539 | 19011 | 28591 | 13463 |
| | 16590 | 20339 | 29410 | 30183 | 4993 | 7120 | 6985 | 5112 | 26266 | 18260 | 4678 | 8552 |
| | 19030 | 28248 | 7679 | 4918 | 16318 | 21717 | 24060 | 21344 | 25297 | 22138 | 25346 | 22012 |
| | 5650 | 27496 | 21794 | | | | | | | | | |
| 373: | 11083 | 30232 | 9501 | 9499 | 14909 | 18574 | 1318 | 8956 | 22144 | 11445 | 7700 | 20469 |
| | 12900 | 25243 | 11836 | 6695 | 6670 | 17570 | 5294 | 27600 | 14930 | 2838 | 28257 | 7119 |
| | 28769 | 26445 | 3685 | 25444 | 20074 | 27152 | 929 | 27785 | 16606 | 2132 | 18223 | 15995 |
| | 2915 | 11331 | 21100 | 28868 | 26048 | 11852 | 12981 | 18993 | 5507 | 29666 | 15787 | 3078 |
| | 12343 | 3108 | 25390 | 25081 | 11565 | 11953 | 9652 | 19597 | 10514 | 29625 | | |

TABLE 8-continued

| PEP SEQ ID NO: | homolog SEQ ID NOs | | | | | | | | | | |
|---|---|---|---|---|---|---|---|---|---|---|---|
| 374: | 29995 | 13858 | 16799 | 15409 | 7506 | 3900 | 25479 | 27924 | 27233 | 26714 | 5749 | 2520 |
| | 7621 | 16752 | 5140 | 22422 | 2229 | 7907 | 2887 | 8548 | 27352 | 15383 | 9281 | 7088 |
| | 26440 | 22113 | 14246 | 8179 | 8157 | 4779 | 4777 | 2392 | 4396 | 19826 | 6526 | 22480 |
| | 5338 | 3048 | 26281 | 15964 | 17212 | 8814 | 2324 | 18317 | 15694 | 19860 | 6349 | 13128 |
| | 5556 | 1251 | 21951 | 28755 | 29722 | 2879 | 20185 | 13869 | 21210 | 23806 | 6702 | 4543 |
| | 4405 | 15007 | 2089 | 16413 | 24264 | 14941 | 14247 | 10125 | 9932 | 20980 | 20977 | 18088 |
| | 10848 | 15567 | 24471 | 1084 | 19325 | 23594 | 11486 | 16253 | 16264 | 9590 | 14117 | 17223 |
| | 10557 | 5623 | 2088 | 14385 | 1561 | 21395 | 6327 | 16898 | 29226 | 4670 | 18933 | 27066 |
| | 13458 | 18355 | 21569 | 9407 | 15436 | 21510 | 20305 | 14741 | 21830 | 24223 | 20078 | 20082 |
| | 20752 | 27132 | 21671 | 14238 | 13121 | 18767 | 19238 | 23101 | 9162 | 9163 | 5194 | 20027 |
| | 6622 | 19420 | 11795 | 9430 | 21095 | 15669 | 15672 | 15675 | 18014 | 18012 | 20048 | 20045 |
| | 28705 | 3175 | 25584 | 28625 | 27436 | 3545 | 10450 | 1515 | 13631 | 10778 | 16642 | 8141 |
| | 26233 | 14215 | 1191 | 23002 | 8096 | 27240 | 27799 | 2057 | 15673 | 29892 | 11139 | |
| 375: | 20858 | 26142 | 10809 | 14612 | 16454 | 19545 | 19537 | 19540 | 8482 | 24371 | 4160 | 20283 |
| | 14553 | 6799 | 25202 | 9659 | 14445 | 24224 | 19737 | 19738 | 8866 | 7937 | 25944 | 25059 |
| | 10155 | 21478 | 7852 | 7102 | 14451 | 6950 | 5026 | 14406 | 28090 | 5094 | 21421 | 13411 |
| | 27424 | 6366 | 22169 | 26988 | 24801 | 13224 | 14409 | 14494 | 14517 | 14518 | 14520 | 14521 |
| | 7173 | 19631 | 19633 | 29864 | 19674 | 19669 | 22743 | 15525 | 12661 | 4381 | 8374 | 12058 |
| | 12037 | 27740 | 24959 | 11750 | 1665 | 14092 | 11686 | 12278 | 12798 | 15327 | 29534 | 9738 |
| | 4989 | 7115 | 25912 | 26228 | 24830 | 26620 | 23068 | 23086 | 1638 | 4563 | 4496 | 15519 |
| | 1197 | 14710 | 5891 | 27244 | 7083 | 26941 | 26940 | 26894 | 26897 | 26904 | 26938 | 26888 |
| | 26891 | 4320 | 28614 | 15349 | 2396 | 5649 | 3734 | 7833 | 7900 | 2208 | 22821 | 15320 |
| | 29934 | 11345 | 22535 | 1531 | 14482 | 8469 | 14454 | 29548 | 28635 | 9987 | 2543 | 10952 |
| | 12764 | 20540 | 23787 | 21038 | 27498 | 21551 | 15465 | 9285 | 17855 | 5288 | 27678 | 14444 |
| | 14239 | 19778 | 7222 | 9980 | 3724 | 6735 | 17248 | 12325 | 8355 | 5396 | 7572 | 4642 |
| | 26594 | 30266 | 12513 | 15663 | 1676 | 1570 | 5326 | 30229 | 25028 | 13712 | 25204 | 15030 |
| | 8967 | 9847 | 17346 | 22369 | 24433 | 3228 | 1492 | 21919 | 3457 | 18490 | 16560 | 16356 |
| | 20957 | 8669 | 8556 | 27349 | 22593 | 19181 | 14071 | 26913 | 23223 | 19740 | 19741 | 19702 |
| | 6424 | 12427 | 3756 | 19528 | 28651 | 26436 | 23695 | 9106 | 18680 | 25651 | 29778 | 3385 |
| | 25547 | 16465 | 29957 | 23660 | 28119 | 25123 | 23161 | 12673 | 10341 | 10337 | 17877 | 16926 |
| | 5335 | 6313 | 27126 | 12985 | 8913 | 19166 | 26170 | 15524 | 3225 | 25803 | 17431 | 19242 |
| | 22221 | 19232 | 21302 | 5455 | 21808 | 25987 | 3306 | 21033 | 5949 | 12951 | 11207 | 26677 |
| | 5377 | 3154 | 4237 | 10277 | 10464 | 21397 | 26222 | 22976 | 24026 | 16432 | 14172 | 24505 |
| | 5159 | 8923 | 20766 | 30063 | 22214 | 8234 | 27929 | 29711 | 2824 | 13307 | 1027 | 2055 |
| | 10073 | 17104 | 8541 | 15113 | 10000 | 24419 | 9110 | 10493 | 28628 | 22247 | 5404 | 29270 |
| | 16863 | 3428 | 28997 | 21506 | 14549 | 25281 | 11006 | 28867 | 17838 | 27771 | 12933 | 20692 |
| | 19733 | 19704 | 27251 | 2386 | 19598 | 10663 | 23428 | 2637 | 27711 | 19997 | 18774 | 25727 |
| | 27718 | 9402 | 24817 | 6666 | 9647 | 13556 | 5248 | 11562 | 16054 | 13064 | 20698 | 15992 |
| | 23836 | 26766 | 12367 | 9376 | 25609 | 21567 | 12837 | 15575 | 19584 | 14844 | 25156 | 21026 |
| | 3140 | 25275 | 24917 | 17394 | 24748 | 18515 | 8565 | 28120 | 13593 | 17015 | 26924 | 4610 |
| | 13573 | 23412 | 6478 | 10079 | 7860 | 12653 | 7702 | 19415 | 11774 | 6562 | 10481 | 11804 |
| | 6051 | 18624 | 18909 | 8442 | 14265 | 17929 | 12311 | 22061 | 17975 | 11180 | 3404 | 6618 |
| | 3733 | 12950 | 9766 | 5493 | 3980 | 23627 | 23968 | 14205 | 26388 | 16017 | 19226 | 30230 |
| | 22394 | 8620 | 15956 | 19582 | 19549 | 19585 | 19666 | 19638 | 19635 | 29483 | 23233 | 4151 |
| | 18853 | 16248 | 21296 | 24366 | 10967 | 7110 | 2896 | 26390 | 27580 | 16446 | 16451 | 17612 |
| | 28143 | 14479 | 5845 | 17298 | 8885 | 14415 | 14487 | 14489 | 14491 | 14465 | 13581 | 13609 |
| | 14378 | 14371 | 13583 | 14374 | 13608 | 13616 | 13572 | 14384 | 14389 | 13612 | 14449 | 13619 |
| | 13577 | 13570 | 14523 | 14419 | 15849 | 542 | 17911 | 14411 | 16057 | 19767 | 23470 | 27608 |
| | 15894 | 16817 | 25786 | 11375 | 29808 | 2582 | 28328 | 20366 | 22975 | 16439 | 22295 | 21402 |
| | 19862 | 28494 | 14459 | 1199 | 24733 | 4349 | 14073 | 5733 | 23439 | 29533 | 4372 | 13627 |
| | 8409 | 28221 | 27151 | 25982 | 25978 | 25981 | 26080 | 25984 | 26010 | 25976 | 26106 | 26083 |
| | 25956 | 25959 | 26017 | 26055 | 26133 | 26026 | 26060 | 26822 | 26852 | 26132 | 26109 | |
| | 26820 | 26022 | 26850 | 26131 | 26825 | 26859 | 26085 | 26104 | 26102 | 26135 | 26053 | 26015 |
| | 26054 | 26827 | 26057 | 26076 | 26159 | 20846 | 26818 | 26136 | 26160 | 26163 | 20849 | 20842 |
| | 20808 | 20838 | 26156 | 20885 | 21828 | 20850 | 20891 | 26161 | 20886 | 25951 | 20718 | 26078 |
| | 25955 | 19799 | 20687 | 19772 | 21981 | 19794 | 19833 | 19803 | 21976 | 21960 | 19770 | 21983 |
| | 20719 | 19805 | 20686 | 20689 | 26854 | 19842 | 16456 | 21980 | 19839 | 19832 | 21803 | 19797 |
| | 26858 | 16489 | 20895 | 20804 | 21012 | 20767 | 20754 | 20923 | 20972 | 20970 | 16491 | 21010 |
| | 20926 | 20759 | 21004 | 20925 | 20721 | 16486 | 21908 | 21847 | 21953 | 20973 | 20723 | 21003 |
| | 20966 | 20930 | 20796 | 21946 | 21044 | 21948 | 21911 | 21880 | 21838 | 21050 | 20927 | 21844 |
| | 20969 | 21879 | 21014 | 21915 | 21055 | 21884 | 21048 | 21916 | 21882 | 21957 | 20893 | |
| | 21845 | 21877 | 2162 | 1916 | 5079 | 2116 | 14186 | 4604 | 4553 | 4521 | 13195 | 24012 |
| | 20562 | 18518 | 6546 | 13095 | 2878 | 25070 | 5498 | 20329 | 27871 | | | |
| 376: | 9514 | 18208 | 27699 | 24672 | 695 | 19688 | 17787 | 10946 | 18811 | 24157 | 17433 | 18211 |
| | 27587 | 29573 | 11124 | 574 | 576 | 16146 | 13361 | 26217 | 825 | 17239 | 428 | 13932 |
| | 5348 | | | | | | | | | | | |
| 377: | 26286 | 15828 | 29381 | 13729 | 9463 | 1447 | 21905 | 14853 | 28599 | 29214 | 29216 | 20781 |
| | 27729 | 18418 | 27603 | 25716 | 25707 | 12847 | 2534 | 2531 | 5406 | 28031 | 304 | 13896 |
| | 16751 | 5158 | 2533 | 10046 | 13689 | 22774 | 1911 | 1796 | 5545 | 10252 | 13315 | 6191 |
| | 13314 | 17203 | 23729 | 2537 | 6202 | 11849 | 11846 | 6193 | 27557 | 1797 | 10397 | 9442 |
| | 9470 | 2568 | 9471 | 9441 | 1789 | 6233 | 19634 | 2753 | 6222 | 6227 | 2751 | 26484 |
| | 2526 | 2523 | 10548 | 1794 | 6151 | 4931 | 4935 | 5392 | 10581 | 10578 | 28003 | 18285 |
| | 19177 | 10078 | 18805 | 25642 | 25644 | 9834 | 9293 | 12912 | 12907 | 633 | 4120 | 25781 |
| | 15640 | 18808 | 18210 | 19601 | 21903 | 25270 | 24910 | 10083 | 10084 | 10113 | 14947 | |
| 378: | 25474 | 14771 | 4723 | 2695 | 18286 | 1459 | 29180 | 29184 | 29182 | 29179 | 19650 | 6427 |
| | 4021 | 24424 | 19821 | 5833 | 15452 | 23315 | 26642 | 29704 | 7761 | 21612 | 25030 | 2327 |
| | 22167 | 2330 | 29528 | 5148 | 2361 | 26318 | 19158 | 12389 | | | | |

TABLE 8-continued

| PEP SEQ ID NO: | homolog SEQ ID NOs | | | | | | | | | | |
|---|---|---|---|---|---|---|---|---|---|---|---|
| 379: | 8336 | 407 | 28490 | 22527 | 23461 | 681 | 14155 | 24237 | 27107 | 21443 | 2665 | 27172 |
| | 24706 | 20420 | 5892 | 8105 | 6246 | 22041 | 16218 | 457 | 12930 | 14021 | 5230 | 9685 |
| | 2316 | 4924 | 22112 | 26146 | 19293 | 8274 | 19356 | 14025 | 3477 | 18809 | 753 | 18266 |
| | 26407 | 21926 | 380 | 25408 | 9209 | 8783 | 19607 | 25045 | 5143 | 16074 | 18650 | |
| 380: | 8336 | 28490 | 6567 | 22527 | 14155 | 27107 | 27172 | 5892 | 6246 | 16218 | 457 | 12930 |
| | 14021 | 5230 | 9685 | 2316 | 4924 | 22112 | 26146 | 19293 | 8274 | 19356 | 379 | 10900 |
| | 3477 | 18809 | 753 | 18266 | 26407 | 19607 | 25045 | 21926 | | | | |
| 381: | 16800 | 8883 | 21392 | 15014 | 12994 | 30175 | 24358 | 9344 | 16428 | 17993 | 26003 | 11292 |
| | 4948 | 4270 | 7148 | 7144 | 11585 | 29803 | 7628 | 23978 | 14719 | 15713 | 26051 | 23186 |
| | 21364 | 21363 | 12313 | 19211 | 12293 | 3184 | 21361 | 4251 | 29309 | 11106 | 8601 | 3656 |
| | 16575 | 10384 | 2231 | 6272 | 4440 | 25890 | 14003 | 23017 | 26886 | 10116 | 11138 | 3058 |
| | 29575 | 12636 | 14228 | 16945 | 13960 | 28481 | 24804 | 18612 | 23683 | 1560 | 30210 | 18531 |
| | 30124 | 14051 | 2951 | 28691 | 12583 | 14895 | 20570 | 29295 | 29014 | 15159 | 12881 | 19438 |
| | 17037 | 23643 | 18407 | 22380 | 13761 | 21280 | 30267 | 2114 | 20769 | 10123 | 3437 | 6949 |
| | 16125 | 22314 | 4257 | 7538 | 22317 | 29065 | 671 | 22201 | 19766 | 21568 | 7030 | |
| | 26970 | 24582 | 18078 | 23130 | 26658 | 19377 | 18835 | 4249 | 2051 | 3595 | 7527 | 7053 |
| | 6212 | 24385 | 17648 | 24821 | 22780 | 1333 | 6654 | 11266 | 21602 | 8339 | 27388 | 13866 |
| | 29872 | 6882 | 17417 | 1384 | 15154 | 16018 | 21174 | 17763 | 10140 | 15398 | 24041 | 661 |
| | 1818 | 16244 | 22194 | 810 | 28619 | 11611 | 9962 | 3017 | 19246 | 28744 | 7208 | 12671 |
| | 672 | 23171 | 27081 | 12060 | 14764 | 17741 | 19417 | 19866 | 4641 | 10040 | 3665 | 9316 |
| | 1443 | 4097 | 19724 | 7171 | 27471 | 4065 | 17292 | 620 | 19967 | 27285 | 16254 | 10426 |
| | 1031 | 3059 | 5751 | 26298 | 13298 | 14103 | 25415 | 17608 | 13073 | 19838 | 27082 | 22416 |
| | 19471 | 15554 | 10375 | 23326 | 21373 | 13529 | 6175 | 9427 | 27649 | 27791 | 23281 | 26347 |
| | 29100 | 20879 | 4801 | 4447 | 20578 | 6231 | 3817 | 23863 | 19942 | 2207 | 2783 | 15650 |
| | 15652 | 28992 | 2875 | 2749 | 29286 | 28367 | 9937 | 10318 | 13071 | 5030 | 20791 | 13306 |
| | 4353 | 5500 | 16715 | 20116 | 9338 | 11613 | 17692 | 17546 | 17543 | 17784 | 17742 | 17699 |
| | 17737 | 17696 | 17656 | 17533 | 17750 | 17649 | 17618 | 17581 | 17746 | 17578 | 17776 | |
| | 17611 | 17771 | 17576 | 17575 | 17541 | 17781 | 17580 | 28563 | 28525 | 17689 | 29296 | 28524 |
| | 29338 | 28567 | 28522 | 29382 | 29305 | 28486 | 29334 | 29299 | 28530 | 28485 | 28589 | 28586 |
| | 28588 | 28487 | 29292 | 29379 | 28491 | 28592 | 28571 | 29302 | 29344 | 28569 | 29383 | 28526 |
| | 29342 | 29335 | 28590 | 28564 | 11658 | 19964 | 2715 | 3367 | 5854 | 12104 | 13405 | 24584 |
| | 12771 | 4129 | 14512 | 13409 | 15647 | 27015 | 7234 | 8595 | 4345 | 7033 | 16467 | 23527 |
| | 26124 | 22096 | 14235 | 8758 | 13036 | 17632 | 2019 | 3016 | 687 | 30211 | 23375 | 4883 |
| | 27225 | 1110 | 27730 | 19218 | 25296 | 15643 | 4998 | 13345 | 11303 | 28411 | 17555 | 10819 |
| | 9658 | 20264 | 9656 | 16736 | 17026 | 13302 | 27306 | 27308 | 26348 | 16197 | 12340 | 21834 |
| | 15619 | 5295 | 5325 | 5349 | 5319 | 8477 | 29481 | 2737 | 2740 | 2743 | 25884 | 28722 |
| | 12157 | 18095 | 21273 | 982 | 21276 | 8514 | 21387 | 2038 | 9428 | 9426 | 9406 | 2039 |
| | 28482 | 4030 | 1407 | 22661 | 22664 | 22626 | 1244 | 2512 | 25499 | 18163 | 2228 | 1267 |
| | 2486 | 2513 | 2472 | 23931 | 7782 | 1424 | 2482 | 1430 | 1393 | 1241 | 1427 | 1273 |
| | 1431 | 25534 | 1323 | 9583 | 29887 | 26073 | 1270 | 1390 | 17236 | 6763 | 9490 | 9404 |
| | 9433 | 9458 | 17758 | 17797 | 17793 | 17680 | 9436 | 17721 | 17762 | 17716 | 9469 | 9464 |
| | 9460 | 9466 | 9498 | 17799 | 9495 | 17710 | 9489 | 17764 | 17705 | 9055 | 693 | 27326 |
| | 7084 | 2475 | 2479 | 17801 | 2042 | 29402 | 8012 | 14509 | 7859 | 17826 | 17505 | 13261 |
| | 7957 | 17507 | 2045 | 2047 | 10364 | 11896 | 27150 | 13110 | 1341 | 6977 | 2048 | |
| | 28835 | 19388 | 16841 | 28869 | 28890 | 28779 | 2075 | 19681 | 17476 | 2077 | 29442 | 14157 |
| | 19919 | 22184 | 27747 | 28149 | 25245 | 21260 | 21257 | 21303 | 13243 | 5590 | 10785 | 11128 |
| | 18281 | 9736 | 10648 | 12566 | 10739 | 10616 | 10472 | 11621 | 11554 | 10467 | 11661 | 10517 |
| | 9731 | 10518 | 10519 | 8358 | 7079 | 21804 | 27252 | 20822 | 28597 | 21562 | 8288 | 6342 |
| | 16743 | 21832 | 2502 | 12234 | 25288 | 26621 | 26623 | 26625 | 22586 | 22585 | 22611 | 22583 |
| | 22617 | 22590 | 22581 | 22614 | 22658 | 11770 | 23025 | 18987 | 4575 | 10505 | 26256 | 29981 |
| 382: | 1205 | 1202 | 23043 | 19105 | 13208 | 6551 | 6559 | 19940 | 19978 | 19981 | 4490 | 16198 |
| | 1306 | 1301 | 1305 | 14162 | 22654 | 23684 | 22719 | 28186 | 984 | 28534 | 25229 | |
| | 27701 | 17690 | 19988 | 21788 | 25087 | 19912 | 21275 | 19982 | 19909 | 18852 | 1894 | 7697 |
| | 1981 | 27932 | 27807 | 17275 | 17258 | 26144 | 8753 | 10153 | 2234 | 20381 | 10110 | 28531 |
| | 20355 | 28470 | 5936 | 14511 | 15482 | 19230 | 2975 | 29138 | 8877 | 5395 | 18703 | 5364 |
| | 19321 | 21051 | 17845 | 28539 | 28536 | 28429 | 27692 | 25933 | 28424 | 27698 | 27667 | 28432 |
| | 27637 | 19792 | 18013 | 13358 | 27690 | 9342 | 6730 | 28714 | 11798 | 8785 | 17920 | 25660 |
| | 16729 | 26290 | 19907 | 14255 | 26258 | 26234 | 26261 | 19936 | 19119 | 21272 | 19915 | 19985 |
| | 13259 | 19916 | 6608 | 29643 | 20900 | 5842 | | | | | | |
| 383: | 0 | | | | | | | | | | | |
| 384: | 29743 | 28452 | 28384 | 7106 | 15703 | 29461 | 18893 | 6003 | 3086 | 4606 | 25491 | 17772 |
| | 6933 | 10268 | 14470 | 14190 | 3145 | 9692 | 7299 | 5291 | 28343 | 28601 | 930 | 15288 |
| | 26611 | 1829 | 7925 | 17355 | 15633 | 7031 | 28578 | 30033 | 4956 | 8779 | 16006 | 17318 |
| | 2748 | 18821 | 21598 | 27933 | 16171 | 6850 | 25460 | 12668 | 24351 | 24345 | 24349 | 14361 |
| | 24867 | 22348 | 21002 | 29297 | 9784 | 10736 | 26297 | 27736 | 30295 | 23749 | 16572 | 16124 |
| 385: | 25583 | 25602 | 25606 | 25629 | 25635 | 25666 | 25668 | 25671 | 25675 | 25704 | 25708 | 30450 |
| | 19353 | 2616 | 2612 | 11581 | 2606 | 3607 | 2652 | 2656 | 4666 | 4562 | 4595 | 10715 |
| | 10757 | 10723 | 15148 | 7011 | 10145 | 10555 | 10562 | 10885 | 4615 | 4614 | 10592 | 11306 |
| | 11308 | 10950 | 11366 | 10981 | 11484 | 11491 | 11066 | 11524 | 11067 | 11589 | 11559 | |
| | 10940 | 11337 | 4867 | 15696 | 4771 | 15762 | 9196 | 16637 | 16636 | 9226 | 9230 | 16803 |
| | 4936 | 17828 | 5784 | 11301 | 10012 | 29367 | 10763 | 11274 | 11399 | 11435 | 10139 | 10137 |
| | 10135 | 11305 | 11363 | 11368 | 11409 | 11440 | 13737 | 22631 | 22635 | 14535 | 22638 | 14593 |
| | 14597 | 22671 | 22673 | 21171 | 21028 | 21175 | 20934 | 2618 | 10795 | 10798 | | |
| | 2619 | 2676 | 2675 | 2677 | 2679 | 5524 | 2681 | 2780 | 4637 | 3564 | 3605 | 29322 |
| | 29325 | 4600 | 4598 | 10792 | 10790 | 5599 | 5600 | 29374 | 21064 | 20944 | 20940 | 20937 |
| | 21061 | 20981 | 11767 | 21126 | 21092 | 21020 | 21069 | 22000 | 22029 | 22032 | 24069 | 24083 |
| | 24120 | 24194 | 24086 | 24122 | 24117 | 24119 | 24158 | 24182 | 24186 | 24188 | 24153 | 24216 |
| | 24219 | 24126 | 24244 | 24246 | 24249 | 24251 | 4774 | 4701 | 19529 | 19581 | 19532 | 3151 |

TABLE 8-continued

| PEP SEQ ID NO: | homolog SEQ ID NOs | | | | | | | | | | |
|---|---|---|---|---|---|---|---|---|---|---|---|
| | 19583 | 19617 | 19573 | 19536 | 19576 | 19621 | 19661 | 19578 | 26326 | 26323 | 5703 | 19524 |
| | 9634 | 14630 | 11338 | 10945 | 10937 | 10933 | 11094 | 11535 | 22003 | 16871 | 23011 | 13888 |
| | 10687 | 10759 | 10725 | 10691 | 10751 | 23322 | 15023 | 16600 | 24154 | 24080 | 30427 | 19348 |
| | 30456 | 25633 | 14773 | 7124 | 7178 | 7157 | 7150 | 7246 | 7182 | 7255 | 7101 | 7245 |
| | 7215 | 7094 | 7118 | 7210 | 7156 | 7153 | 7286 | 7220 | 7186 | 7293 | 7249 | 7125 |
| | 7151 | 7288 | 7326 | 7294 | 7296 | 7329 | 7333 | 8052 | 5631 | 3602 | 3600 | 4390 |
| | 4392 | 4393 | 4385 | 4446 | 4452 | 4449 | 4422 | 4491 | 4492 | 4495 | 4517 | 4518 |
| | 4547 | 4559 | 4555 | 4550 | 5523 | 5520 | 4718 | 5529 | 5560 | 5619 | 5626 | 5622 |
| | 5601 | 11610 | 5667 | 5673 | 5669 | 5635 | 4457 | 4454 | 10732 | 5675 | 5678 | 7123 |
| | 4852 | 4693 | 15678 | 4735 | 4821 | 15700 | 4736 | 4737 | 4741 | 4770 | 4773 | 4776 |
| | 4806 | 15757 | 15786 | 15788 | 15791 | 15812 | 15817 | 15840 | 15842 | 4825 | 16603 | 16634 |
| | 4856 | 16647 | 4860 | 16669 | 4863 | 16737 | 4894 | 4899 | 4900 | 4903 | 16778 | 16801 |
| | 16807 | 4929 | 16832 | 4932 | 16867 | 4939 | 17668 | 4969 | 4973 | 4976 | 4977 | 17722 |
| | 17725 | 5746 | 9982 | 10007 | 17788 | 17794 | 17800 | 5753 | 5757 | 5783 | 16703 | 10014 |
| | 17832 | 17757 | 16772 | 16706 | 9973 | 9976 | 16739 | 17708 | 11576 | 11608 | 29646 | 19212 |
| | 29648 | 29650 | 19215 | 29652 | 29668 | 19219 | 29669 | 29673 | 19240 | 29674 | 29676 | 19243 |
| | 29697 | 19247 | 29699 | 19252 | 690 | 20263 | 29702 | 19256 | 29703 | 652 | 19284 | 642 |
| | 20220 | 29734 | 19285 | 19287 | 29736 | 29737 | 30422 | 19322 | 30424 | 30426 | 19329 | 20265 |
| | 19350 | 30446 | 19351 | 19352 | 686 | 20223 | 20169 | 30457 | 20173 | 647 | 20228 | |
| | 605 | 608 | 16891 | 9952 | 10009 | 17765 | 9177 | 16643 | 9979 | 9983 | 14045 | 14016 |
| | 14039 | 14040 | 13976 | 13974 | 13980 | 14012 | 14993 | 1358 | 4588 | 4584 | 4571 | 4574 |
| | 4578 | 13670 | 13711 | 22598 | 22601 | 14564 | 14562 | 22667 | 16664 | 9182 | 9188 | 9223 |
| | 9950 | 9954 | 10004 | 10761 | 10667 | 10688 | 10717 | 11500 | 11507 | 11505 | 14991 | 17532 |
| | 1647 | 14787 | 14781 | 10730 | 13599 | 20410 | 2756 | 4380 | 3612 | 29364 | 29331 | 4522 |
| | 4519 | 11579 | 11601 | 26325 | 4631 | 4630 | 4633 | 10824 | 2657 | 29369 | 29372 | 10693 |
| | 4542 | 4540 | 4690 | 11333 | 11224 | 4733 | 4612 | 1900 | 10729 | 1898 | 1893 | 1896 |
| | 11599 | 2714 | 5565 | 5563 | 5564 | 2721 | 2752 | 2723 | 2747 | 3571 | 3573 | 3569 |
| | 4413 | 4411 | 4416 | 4420 | 4489 | 4485 | 4629 | 4603 | 4605 | 4660 | 4663 | 4702 |
| | 4674 | 4669 | 4710 | 4714 | 11582 | 4704 | 5526 | 5597 | 5567 | 5596 | 13979 | 21993 |
| | 13987 | 13992 | 13996 | 12409 | 13942 | 14015 | 1360 | 21231 | 14017 | 14782 | 14841 | 26664 |
| | 11552 | 18066 | 18134 | 18070 | 18101 | 18206 | 2768 | 20087 | 7036 | 18946 | 18255 | |
| | 18945 | 18264 | 13982 | 4581 | 4582 | 4908 | 11244 | 4616 | 4621 | 28178 | 4815 | 9947 |
| | 9192 | 16893 | 18369 | 17217 | 14632 | 29645 | 19209 | 13830 | 14636 | 14637 | 13919 | 13914 |
| | 13920 | 13917 | 13944 | 13945 | 13893 | 10689 | 21093 | 13854 | 13841 | 13847 | 17547 | 17545 |
| | 20904 | 20906 | 20899 | 19127 | 19155 | 19150 | 27482 | 15098 | 726 | 2332 | 10069 | 17569 |
| | 22026 | 14028 | 4404 | 4544 | 2336 | 13885 | 24342 | 9373 | 5634 | 19773 | 9371 | 16355 |
| | 12698 | 14876 | 2402 | 22790 | 17017 | 940 | 939 | 10096 | 12386 | 14050 | 14053 | 12408 |
| | 13921 | 750 | 749 | 782 | 745 | 747 | 23094 | 13889 | 1437 | 9150 | 15701 | 15718 |
| | 16604 | 16769 | 4942 | 9955 | 17675 | 17719 | 5750 | 10034 | 15754 | 15676 | 14020 | 14046 |
| | 24075 | 21228 | 13946 | 13951 | 14044 | 21225 | 21215 | 21221 | 14024 | 21178 | 21130 | 14818 |
| | 13135 | 14805 | 14808 | 4966 | 15784 | 7918 | 1366 | 1369 | 1505 | 1403 | 1396 | 1475 |
| | 1514 | 1389 | 1436 | 20903 | 14048 | 11618 | 10831 | 10827 | 10832 | 11612 | 20983 | 4694 |
| | 11282 | 15719 | 15838 | 16670 | 9229 | 5754 | 8876 | 25306 | 19624 | 11594 | 21987 | 21997 |
| | 14640 | 8051 | 649 | 610 | 20183 | 19318 | 715 | 20268 | 19159 | 10713 | 19358 | 19475 |
| | 2718 | 2719 | 23072 | 23044 | 23046 | 23077 | 13891 | 6915 | 6774 | 6817 | 6790 | 19354 |
| | 19357 | 13705 | 13708 | 13710 | 13714 | 13716 | 13747 | 13739 | 13741 | 13743 | 13745 | 13781 |
| | 13782 | 13785 | 13789 | 14809 | 14784 | 13828 | 13833 | 14817 | 14777 | 13835 | 13840 | 4611 |
| | 7376 | 7096 | 7374 | 7373 | 936 | 934 | 21135 | 20975 | 21169 | 21087 | 20978 | 10586 |
| | 21134 | 20935 | 14270 | 13778 | 17534 | 17537 | 9633 | 20901 | 4832 | 10134 | 21098 | 27949 |
| | 514 | 28711 | 16920 | | | | | | | | | |
| 386: | 7882 | 12624 | 24648 | 7567 | 20731 | 29246 | 13557 | 24299 | 11349 | 26482 | 23197 | 30121 |
| | 11007 | 18272 | 6064 | 28273 | 8156 | 23323 | 18696 | 2199 | 21366 | 18611 | 817 | 13520 |
| | 29728 | 24844 | 25005 | 12000 | 7747 | 11457 | 4078 | 4318 | 2050 | 17518 | 9735 | 11098 |
| | 6203 | 22233 | 10599 | 7752 | 15287 | 23469 | 26750 | 24405 | 1630 | 26154 | 26137 | 14899 |
| | 25769 | 7610 | 7037 | 10086 | 27409 | 27407 | 17049 | 17151 | 20444 | 7523 | 25492 | 28406 |
| | 15590 | 10197 | 23316 | 3750 | 9054 | 28523 | 4158 | 13211 | 28948 | 26806 | 30382 | 9535 |
| | 25501 | 13533 | 15796 | 29318 | 26382 | 14370 | 12937 | 14574 | 9931 | 5799 | 11078 | 13746 |
| | 10020 | 20282 | 6416 | 25298 | 5849 | 29006 | 22869 | 17306 | 26462 | 14226 | 16058 | 14263 |
| | 17573 | 14786 | 26451 | 28923 | 9374 | 4429 | 25618 | 22773 | 28275 | 12865 | 20976 | 27294 |
| | 828 | 8708 | 26360 | 9275 | 22574 | 22262 | 30310 | 4283 | 18068 | 4968 | 24285 | 25256 |
| | 28977 | 5519 | 15217 | 5412 | 10884 | 24397 | 17694 | 25575 | 30088 | 23404 | 24081 | 16839 |
| | 5107 | 8862 | 20079 | 17553 | 6918 | 7696 | 12535 | 17038 | 8997 | 20832 | 10223 | 9073 |
| | 18132 | 29509 | 5478 | 11312 | 1409 | 21181 | 26012 | 23113 | 10978 | 5297 | 11298 | 4964 |
| | 17101 | 16605 | 20370 | 24570 | 22259 | 6108 | 10236 | 12212 | 7445 | 18469 | 27353 | 5467 |
| | 1077 | 7762 | 21239 | 26187 | 16131 | 29514 | 23591 | 11815 | 18999 | 8501 | 12139 | 5767 |
| | 21383 | 2686 | 29757 | 11839 | 4301 | 3462 | 11447 | 16522 | 11623 | 28752 | 3179 | 14591 |
| | 6976 | 3373 | 20987 | 29125 | 7401 | 10219 | 7317 | 17818 | 15097 | 26598 | 26704 | 20088 |
| | 23312 | 10793 | 18246 | 17592 | 14273 | 4691 | 1993 | 14136 | 27321 | 20931 | 13690 | 10369 |
| | 26931 | 9853 | 28138 | 26603 | 11477 | 15496 | 13725 | 14514 | 13407 | 10283 | 29222 | 11832 |
| | 26502 | 26670 | 9114 | 1924 | 1412 | 28350 | 5281 | 16091 | 19855 | 17086 | 27176 | 27611 |
| | 25357 | 21603 | 30077 | 26906 | 8350 | 22679 | 18673 | 9140 | 18666 | 28921 | 23251 | 23519 |
| | 20361 | 20770 | 25453 | 20837 | 29966 | 27231 | 15403 | 28609 | 11201 | 11848 | 25518 | 16868 |
| | 22889 | 29735 | 17124 | 8175 | 20739 | 20369 | 12154 | 28580 | 8190 | 15884 | 15044 | 21154 |
| | 9315 | 9642 | 19788 | 4835 | 6578 | 1253 | 8773 | 15685 | 10431 | 5352 | 6871 | 25767 |
| | 14950 | 19775 | 5114 | 5589 | 17452 | 8608 | 27854 | 10987 | 21757 | 29392 | 8503 | 8481 |
| | 12839 | 19718 | 22926 | 9040 | 14900 | 7830 | 29421 | 9537 | 6500 | 16012 | 23512 | 25104 |
| | 656 | 17645 | 27804 | 15352 | 9712 | 5913 | 29582 | 26892 | 13949 | 15176 | 11476 | 25094 |
| | 2764 | 7380 | 6284 | 23799 | 18323 | 27153 | 25398 | 3341 | 11241 | 18735 | 1521 | 22016 |

TABLE 8-continued

| PEP SEQ ID NO: | homolog SEQ ID NOs | | | | | | | | | | |
|---|---|---|---|---|---|---|---|---|---|---|---|
| | 19647 | 18401 | 21554 | 20513 | 2805 | 17878 | 1940 | 26070 | 7663 | 3610 | 6563 | 24008 |
| | 6643 | 12824 | 29049 | 5076 | 5078 | 13223 | 6440 | 16674 | 2417 | 22702 | 14743 | 14797 |
| | 25787 | 24474 | 25771 | 15181 | 25271 | 28750 | 639 | 20190 | 18757 | 991 | 24602 | 11311 |
| | 21751 | 18315 | 23688 | 2908 | 26458 | 26270 | 5283 | 3627 | 25101 | 15350 | 12381 | 25545 |
| | 12033 | 9795 | 16156 | 15164 | 19152 | 1170 | 3238 | 4739 | 15254 | 9262 | 8304 | 27537 |
| | 30349 | 25524 | 30092 | 11304 | | | | | | | | |
| 387: | 4558 | 11893 | 13421 | 5582 | 23804 | 26468 | 26466 | 20275 | 14838 | 14839 | 17735 | 29084 |
| | 18188 | 29076 | 15600 | 30039 | 919 | 11408 | 901 | 8685 | 2371 | 9440 | 3547 | 7111 |
| | 8276 | 25471 | 17939 | 30262 | 29401 | 11076 | 10207 | 16596 | 21431 | 13490 | 7553 | 11422 |
| | 21043 | 4627 | 5438 | 17143 | 3476 | 4884 | 20375 | 14672 | 3777 | 11489 | 5053 | 24683 |
| | 24466 | 17525 | 8594 | 9714 | 24798 | 16490 | 28159 | 28437 | 27535 | 23196 | 23263 | 28941 |
| | 29147 | 3370 | 17964 | 11414 | 23349 | 27411 | 29195 | 20137 | 21695 | 21637 | 20399 | 20446 |
| | 12487 | 29234 | 6701 | 28295 | 3357 | 26876 | 13268 | 12016 | 1402 | 25239 | 27993 | 9006 |
| | 26508 | 24009 | 9842 | 27164 | 9843 | 8093 | 14174 | 14907 | 14180 | 8251 | 11223 | 29131 |
| | 14904 | 6743 | 26915 | 26914 | 12587 | 11766 | 3977 | 27351 | 13842 | 13838 | 17934 | 10791 |
| | 11651 | 21246 | 17945 | 17022 | 10818 | 13428 | 9709 | 24623 | 16581 | 22949 | 7546 | 19064 |
| | 23636 | 27599 | 24670 | 29538 | 26358 | 26361 | 16328 | 6121 | 1030 | 7784 | 4435 | 20083 |
| | 5003 | 4716 | 791 | 3702 | 7029 | 9167 | 28702 | 14596 | 14556 | 11538 | 24982 | 21152 |
| | 9549 | 15247 | 17111 | 16632 | 17709 | 21966 | 17305 | 16424 | 28354 | 28724 | 27364 | 24574 |
| | 16426 | 6348 | 6280 | 15221 | 1997 | 12742 | 22001 | 15753 | 7248 | 12877 | 12875 | 24109 |
| | 22403 | 5450 | 6999 | 22405 | 1130 | 17140 | 29251 | 7185 | 1810 | 3076 | 28353 | 26874 |
| | 24295 | 29943 | 10644 | 1049 | 12979 | 14037 | 21570 | 18712 | 15540 | 8936 | 3161 | 4570 |
| | 4539 | 4465 | 27883 | 12020 | 25071 | 28733 | 9892 | 29788 | 1819 | 29812 | 11598 | 3410 |
| | 9138 | 2585 | 23556 | 28874 | 2934 | 12374 | 1664 | 29691 | 29088 | 3921 | | |
| 388: | 16278 | 11063 | 25422 | 1816 | 11982 | 26099 | 6004 | 16365 | 28692 | 20122 | 20303 | 26654 |
| | 786 | 10182 | 4508 | 1343 | 20478 | 7988 | 24286 | 24386 | 3094 | 25259 | 20056 | 18347 |
| | 19690 | 23376 | 6317 | 27472 | 10522 | 30317 | 30020 | 22656 | 12232 | 4531 | 12165 | 28455 |
| | 10913 | 19443 | 4173 | 9125 | 24324 | 30454 | 2037 | 9909 | 15010 | 15153 | 25931 | |
| 389: | 21076 | 21074 | 24054 | 19303 | 4397 | 8433 | 9597 | 13681 | 25701 | 8529 | 13682 | 29417 |
| | 3329 | 6368 | 1930 | 18796 | 23129 | 8137 | 27913 | 27943 | 3570 | 15220 | 1921 | 23484 |
| | 26097 | 10322 | 15273 | 21458 | 24501 | 30004 | 1058 | 17126 | 20178 | 13780 | 27821 | 21499 |
| | 11343 | 2474 | 2429 | 23148 | 14120 | 1136 | 28029 | 5188 | 8301 | 2074 | 28682 | 23207 |
| | 25234 | 4592 | 6577 | 15018 | 25183 | 20104 | 25311 | 27014 | 28022 | 2407 | 29658 | 27137 |
| | 21835 | 22946 | 4286 | 2453 | 23771 | 1121 | 15152 | 7508 | 18125 | 14815 | 1806 | 16918 |
| | 22338 | 8216 | 27934 | 28665 | 22072 | 14984 | 16297 | 19962 | 20824 | 5496 | 16107 | 10178 |
| | 28394 | 3392 | 3438 | 3668 | 29062 | 28435 | 7617 | 14723 | 26147 | 15111 | 6330 | 5903 |
| | 5261 | 12168 | 13265 | 20572 | 669 | 29113 | 8533 | 12630 | 12759 | 5382 | 29134 | 603 |
| | 14259 | 15218 | 11176 | 19111 | 16904 | 4137 | 30155 | 22315 | 26211 | 5171 | 4474 | 13423 |
| | 699 | 26857 | 25889 | 15695 | 5656 | 13452 | 16624 | 24229 | 19905 | 19885 | 12708 | 13922 |
| | 18917 | 26895 | 14843 | 14806 | 24003 | 20069 | 6597 | 4337 | 21353 | 24639 | 8520 | 9720 |
| | 4430 | 1118 | 20387 | 24437 | 3181 | 3281 | 28201 | 2323 | 28358 | 10379 | 28321 | 7579 |
| | 2307 | 2278 | 15208 | 2901 | 8613 | 21511 | 5811 | 10636 | 18192 | 13404 | 28598 | 1556 |
| | 616 | 30406 | 655 | 29004 | 28129 | 3850 | 9148 | 20126 | 5502 | 2166 | 3650 | 16685 |
| | 26728 | 11100 | 9014 | 20231 | 843 | 845 | 23137 | 7834 | 6945 | 5583 | 30396 | |
| | 28421 | 1577 | 27492 | 11302 | 1987 | 30225 | 6290 | 11946 | 14973 | 840 | 13085 | 13054 |
| | 27292 | 9981 | 9959 | 28958 | 3716 | 14277 | 2285 | 24091 | 11256 | 28742 | 28741 | 15833 |
| | 21106 | 24036 | 26077 | 23993 | 20117 | 30096 | 10683 | 21582 | 21738 | 23681 | 21984 | 21885 |
| | 13678 | 25157 | 20887 | 19948 | 24070 | 27527 | 23997 | 16961 | 8064 | 29845 | 1884 | 9986 |
| | 7187 | 9957 | 7894 | 21587 | 13384 | 7772 | 26614 | 12745 | 27838 | 22022 | 22147 | 15901 |
| | 18009 | 8985 | 7805 | 29129 | 23495 | 20727 | 8101 | 8067 | 6335 | 6333 | 22062 | 24049 |
| | 3494 | 2983 | 19995 | 18749 | 3037 | 18015 | 5211 | 29352 | 9366 | 29282 | 9452 | 1093 |
| | 28291 | 24425 | 17497 | 29099 | 14986 | 7133 | 29551 | 12227 | 12228 | 24624 | 24420 | 22559 |
| | 13301 | 8373 | 9341 | 25695 | 24780 | 13044 | 6000 | 18736 | 24773 | 15831 | 26257 | 24398 |
| | 2928 | 18271 | 19938 | 8219 | 18147 | 28191 | 26595 | 18550 | 19355 | 26346 | 2776 | 12184 |
| | 28768 | 23707 | 9255 | 28548 | 7459 | 22182 | 17454 | 5995 | 16136 | 9213 | 8471 | 2315 |
| | 17099 | 29529 | 3898 | 12065 | 3718 | 1743 | 10595 | 28519 | 25835 | 28283 | 13197 | 17310 |
| | 21045 | 8375 | 25339 | 21500 | 24781 | 21655 | 1200 | 23953 | 28006 | 6543 | 9145 | 22710 |
| | 20132 | 12235 | 16370 | 19810 | | | | | | | | |
| 390: | 22423 | 29361 | 12542 | 16648 | 24697 | 17759 | 12099 | 3299 | 2596 | 1967 | | |
| 391: | 16278 | 11063 | 25422 | 1816 | 11982 | 21406 | 6004 | 24783 | 16365 | 20122 | 20303 | 26654 |
| | 3249 | 786 | 10182 | 26408 | 1343 | 20478 | 7988 | 3094 | 25259 | 20056 | 18347 | 19690 |
| | 23376 | 6317 | 27472 | 10522 | 30317 | 30020 | 22656 | 12232 | 4531 | 8668 | 14561 | 14464 |
| | 29649 | 11699 | 25874 | 12165 | 15149 | 26411 | 28455 | 10913 | 26414 | 4173 | 9125 | 24324 |
| | 30454 | 2037 | 9909 | 15010 | 15153 | 25931 | | | | | | |
| 392: | 12517 | 6596 | 26601 | 26683 | 5868 | 17245 | 28699 | 13374 | 16403 | 20008 | 26900 | 25162 |
| | 14567 | | | | | | | | | | | |
| 393: | 28605 | 4248 | 3296 | 29412 | 1544 | 4971 | 25372 | 29811 | 1043 | 22936 | 29875 | 15017 |
| | 12913 | 14832 | 11897 | 7444 | 7783 | 1580 | 1575 | 7449 | 27975 | 1736 | 10963 | 18607 |
| | 5012 | 4790 | 19491 | 26181 | 26164 | 26179 | 6084 | 22822 | 22119 | 11926 | 6143 | |
| | 18802 | 24675 | 1642 | 22297 | 12158 | 18339 | 19224 | 8729 | 8745 | 12629 | 14650 | 1776 |
| | 1741 | 1707 | 1778 | 12954 | 12140 | 17986 | 7486 | 14323 | 29298 | 6358 | 30249 | 7435 |
| | 16020 | 7899 | 28663 | 18034 | 27243 | 3117 | 16040 | 5952 | 12823 | 8778 | 27116 | 22716 |
| | 5812 | 26114 | 12292 | 27504 | 14526 | 25559 | 15865 | 2010 | 25596 | 8728 | 28654 | |
| | 24775 | 1378 | 24778 | 14306 | 24842 | 12932 | 25247 | 10314 | 18165 | 7012 | 28721 | 21714 |
| | 19012 | 6704 | 25342 | 19555 | 29166 | 25312 | 20859 | 13168 | 20643 | 10542 | 7494 | 20348 |
| | 24013 | 29672 | 30463 | 1523 | 9707 | 25278 | 30341 | 26500 | 17219 | 28319 | 7490 | 8545 |
| | 29013 | 27753 | 9225 | 26782 | 21073 | 23700 | 23703 | 6862 | 18520 | 30018 | 12861 | 4577 |
| | 15163 | 6845 | 3397 | 13969 | 1984 | 1624 | 4624 | 26478 | 30397 | 28565 | 17213 | 12054 |

TABLE 8-continued

| PEP SEQ ID NO: | homolog SEQ ID NOs | | | | | | | | | | |
|---|---|---|---|---|---|---|---|---|---|---|---|
| | 12089 | 10866 | 17773 | 23206 | 29565 | 21514 | 1401 | 11549 | 28292 | 23164 | 4926 | 23911 |
| | 4949 | 11088 | 10104 | 16644 | 1094 | 13688 | 6671 | 27258 | 3303 | 15049 | 2352 | 2991 |
| | 11713 | 19314 | 23318 | 8230 | 24947 | 27463 | 5484 | 30384 | 1163 | 17893 | 1416 | 9330 |
| | 12405 | 9333 | 15391 | 2936 | 8998 | 19519 | 19525 | 12156 | 7757 | 28818 | 30141 | 8398 |
| | 10740 | 15295 | 20325 | 17325 | 5730 | 18713 | 25031 | 2365 | 22116 | 25257 | 22657 | 29389 |
| | 28650 | 19315 | 17650 | 30443 | 20699 | 7510 | 7155 | 6448 | 1112 | 12915 | 6331 | 29239 |
| | 17760 | 17835 | 14733 | 25882 | 3979 | 21962 | 17861 | 18807 | 6030 | 23278 | 24272 | 29330 |
| | 27365 | 17805 | 8719 | 13173 | 12233 | 22827 | 19739 | 18618 | 18706 | 13658 | 4700 | 23121 |
| | 24243 | 12467 | 11326 | 26575 | 26573 | 20560 | 4045 | 10190 | 25319 | 26814 | 27915 | 23651 |
| | 707 | 12290 | 9084 | 9682 | 6494 | 3914 | 15760 | 5693 | 20537 | 26901 | 24888 | 6684 |
| | 22797 | 22636 | 11814 | 19188 | 29380 | 8147 | 19574 | 30403 | 20874 | 10580 | 21715 | 16700 |
| | 1474 | 26695 | 24247 | 25000 | 9657 | 18453 | 30101 | 23513 | 19849 | 24716 | 23516 | 1946 |
| | 1947 | 19018 | 26271 | 25477 | 25484 | 26363 | 25473 | 25441 | 25410 | 25409 | 26442 | 26406 |
| | 26437 | 26435 | 25385 | 15727 | 15923 | 20963 | 17949 | 17789 | 17795 | 26324 | 29456 | 30066 |
| | 26418 | 4838 | 18314 | 19403 | 15957 | 29036 | 6998 | 8654 | 6240 | 26356 | 28440 | 9269 |
| | 17028 | 10474 | 26202 | 10677 | 2087 | 2800 | 28132 | 22715 | 6476 | 20654 | 4987 | 15578 |
| | 6289 | 3621 | 2930 | 28144 | 27716 | 21519 | 21613 | 14654 | 25403 | 7163 | 6716 | 28476 |
| | 10944 | 1063 | 17188 | 5320 | 17158 | 26089 | 22149 | 5983 | 8791 | 8789 | 8788 | 28070 |
| | 13263 | 6861 | 19701 | 30278 | 19126 | 15936 | 18120 | 20620 | 4222 | 729 | 12941 | 18345 |
| | 10382 | 12252 | 9624 | 23119 | 14949 | 12867 | 907 | 911 | 13144 | 12938 | 730 | 14135 |
| | 3636 | 11786 | 23990 | 27897 | 10675 | 7456 | 12498 | 1820 | 28552 | 10722 | 11720 | 19506 |
| | 20979 | 774 | 24722 | 22877 | 7362 | 18911 | 10471 | 28039 | 23542 | 22349 | 3768 | 13202 |
| | 16598 | 6715 | 6484 | 4027 | 11381 | 2468 | 20475 | 8622 | 9998 | 25324 | 14855 | |
| | 27500 | 10138 | 26954 | 8111 | 10504 | 13274 | 8108 | 22554 | 26174 | 6009 | 12944 | 12936 |
| | 19730 | 12943 | 22572 | 23515 | 6827 | 10166 | 28974 | 24489 | 20584 | 21430 | 19541 | 26962 |
| | 25404 | 1595 | 9869 | 18282 | 24908 | 23226 | 20984 | 27679 | 25034 | 30447 | 9096 | 16204 |
| | 4650 | 8044 | 7260 | 17195 | 12935 | 21446 | 19526 | 20129 | 3842 | 17736 | 15276 | 2794 |
| | 22503 | 3051 | 5227 | 11362 | 4113 | 17220 | 15966 | 7488 | 28369 | | | |
| 394: | 13283 | 26673 | 13372 | 15811 | 26338 | 10282 | 13817 | 6554 | 14047 | 11667 | 10532 | 2214 |
| | 1074 | 7236 | 16820 | 12807 | 3295 | 23864 | 2601 | 24596 | 16280 | 17983 | 25511 | 29357 |
| | 25240 | 26751 | 12803 | 12244 | 7105 | 11527 | 20080 | 23916 | 10142 | 938 | 16901 | |
| | 25535 | 19825 | 15340 | 7736 | 7452 | 27777 | 19857 | 3690 | 18820 | 16411 | 29415 | 6075 |
| | 13087 | 15907 | 4322 | 4242 | 17935 | 4377 | 30307 | | | | | |
| 395: | 5925 | 5923 | 30049 | 5276 | 646 | 3497 | 16821 | 4682 | 4024 | 4026 | 3989 | 4022 |
| | 4201 | 3419 | 4089 | 11871 | 21479 | 11456 | 22786 | 12064 | 16900 | 7864 | 7137 | 27519 |
| | 23009 | 22962 | 27386 | 5910 | 9782 | 13669 | 5022 | 5922 | 28232 | 28240 | 28245 | 14945 |
| | 2384 | 26153 | 9863 | 17122 | 9701 | 4513 | 24276 | 24303 | 14985 | 11226 | 19391 | 7568 |
| | 7623 | 1468 | 5050 | 5147 | 22361 | 8683 | 16205 | 16243 | 16210 | 16234 | 16200 | 16272 |
| | 16237 | 16201 | 16178 | 22362 | 16267 | 16266 | 8681 | 16202 | 16269 | 16288 | 16274 | 16263 |
| | 16207 | 16241 | 16295 | 20101 | 18903 | 18977 | 3714 | 2312 | 18880 | 3684 | 18869 | 18905 |
| | 3713 | 30399 | 28299 | 18939 | 18972 | 18846 | 27074 | 17528 | 18898 | 18848 | 30321 | 23708 |
| | 19003 | 3689 | 3662 | 19026 | 18935 | 27273 | 19602 | 2620 | 27279 | 28024 | 18645 | 18667 |
| | 18669 | 928 | 20551 | 19019 | 14467 | 18251 | 3846 | 1656 | 20430 | 4364 | 30027 | 20555 |
| | 11096 | 24440 | 21580 | 25207 | 29141 | 10133 | 5354 | 7744 | 7942 | 17790 | 2061 | |
| | 18662 | 8642 | 23923 | 27214 | 15651 | 23078 | 14362 | 7927 | 10619 | 1018 | 14617 | 25685 |
| | 12777 | 22187 | 11042 | 18732 | 12198 | 29306 | 5504 | 15836 | 9171 | 30044 | 6414 | 25669 |
| | 13863 | 24429 | 11873 | 18064 | 27521 | 4646 | 10130 | 20051 | 3139 | 25845 | 30336 | 10377 |
| | 9691 | 5577 | 30414 | 1012 | 24812 | 5492 | 4428 | 1204 | 26650 | 18168 | 18283 | 4355 |
| | 21394 | 5462 | 4099 | 4071 | 4122 | 9325 | 15857 | 4125 | 4127 | 10368 | 816 | 814 |
| | 833 | 8020 | 12594 | 11867 | 25573 | 27585 | 27146 | 16588 | | | | |
| 396: | 10985 | 24465 | 5389 | 21752 | 27373 | 11218 | 19349 | 8484 | 27565 | 9644 | 15930 | 18320 |
| | 10788 | 1620 | 7764 | 5228 | 20488 | 8231 | 3344 | 26554 | 18643 | 8540 | 22162 | 6528 |
| | 5847 | 14377 | 7956 | 11564 | 7665 | 30212 | 26544 | 19808 | 27823 | | | |
| 397: | 10015 | 28467 | 9949 | 16910 | | | | | | | | |
| 398: | 14943 | 7938 | 7964 | 7962 | 19565 | 11649 | 1841 | 3138 | 18175 | 16084 | 28102 | 25813 |
| | 4265 | 27430 | 11048 | 5711 | 13120 | 2802 | 8841 | 19091 | 28086 | 27114 | 3741 | 21369 |
| | 19052 | 1394 | 21023 | 927 | 20385 | 28263 | 19113 | 7946 | 7941 | 28293 | 4583 | 3706 |
| | 3705 | 5387 | 4585 | 5998 | 1847 | 1844 | 18466 | 16361 | 28638 | 27344 | 7934 | 11733 |
| | 20519 | 14569 | 22469 | 24958 | 7905 | 7870 | 14980 | 580 | 6150 | 9513 | 28956 | 12098 |
| | 18280 | 9800 | 24457 | | | | | | | | | |
| 399: | 26644 | 4656 | 6625 | | | | | | | | | |
| 400: | 13109 | 6571 | 9398 | 6996 | 22385 | 12637 | 8380 | 28556 | 20052 | 30329 | 13485 | 10400 |
| | 27196 | 27193 | 15191 | 20656 | 10460 | 13771 | 3445 | 16498 | 12884 | 12318 | 3470 | 16845 |
| | 20269 | 5461 | 20330 | 20335 | 24308 | 4110 | 931 | 20492 | 19564 | 5770 | 24535 | 4499 |
| | 1881 | 9120 | 7450 | 18506 | 18374 | | | | | | | |
| 401: | 19639 | 6086 | 22364 | 24585 | 25042 | 23621 | 30345 | 28252 | 17067 | 23995 | 9310 | 22994 |
| | 5072 | 16172 | 25659 | 1771 | 16962 | 16937 | 8287 | 28032 | 28064 | 24087 | 25025 | 24400 |
| | 24269 | 970 | 14519 | 18442 | 9210 | 7765 | 21881 | 1530 | 26626 | 3698 | 12231 | 18434 |
| | 12830 | 13547 | 3947 | 11008 | 3887 | 4234 | 4319 | 9555 | 18366 | 17971 | 28689 | 20851 |
| | 19953 | 6180 | 28096 | 29797 | 13032 | 25388 | 3829 | 12069 | 11806 | 16075 | 26665 | 12135 |
| | 3790 | 11742 | 25940 | 28091 | 9662 | 28734 | 21963 | 29545 | 21722 | 7781 | 12477 | 7536 |
| | 29955 | 25777 | 5118 | 9304 | 15780 | 23706 | 14555 | 13156 | 18084 | 11085 | 25550 | 28520 |
| | 26030 | 15158 | 16126 | 9147 | 14340 | 25656 | 30430 | 27229 | 6216 | 18028 | 10276 | 6531 |
| | 25120 | 4464 | 28347 | 25326 | 5415 | 5702 | 2194 | 22060 | 25588 | 17643 | 24707 | 21709 |
| | 1406 | 19556 | 12441 | 11544 | 2972 | 18250 | 7310 | 18048 | 3005 | 5805 | 29963 | 9130 |
| | 27259 | 10371 | 19075 | 7197 | 10797 | 28371 | 6145 | 7878 | 14446 | 25400 | 29587 | 13473 |
| | 9117 | 7469 | 8935 | 28237 | 1268 | 5108 | 27560 | 30429 | 25279 | 29310 | 1971 | 9953 |
| | 27476 | 6140 | 2328 | 3186 | 1062 | 7447 | 28183 | 24438 | 1880 | 29932 | 28813 | 7346 |

TABLE 8-continued

| PEP SEQ ID NO: | homolog SEQ ID NOs | | | | | | | | | | |
|---|---|---|---|---|---|---|---|---|---|---|---|
| | 3575 | 23091 | 4502 | 10351 | 11558 | 27380 | 26117 | 24357 | 16376 | 18325 | 12600 | 30196 |
| | 11062 | 26767 | 17070 | 8022 | 28167 | 29891 | 16350 | 16423 | 23738 | 14399 | 17149 | 11103 |
| | 18776 | 4471 | 29877 | 2963 | 22453 | 23060 | 5677 | 19269 | 27154 | 22938 | 9041 | 21540 |
| | 16319 | 10029 | 7970 | 17888 | 22885 | 23452 | 18578 | 22148 | 6455 | 27794 | 5238 | 26759 |
| | 14078 | 28332 | 6196 | 3954 | 9208 | 7314 | 28148 | 5595 | 8962 | 26277 | 19037 | 2014 |
| | 10201 | 8980 | 7269 | 17510 | 17508 | 11702 | 1422 | 27709 | 9030 | 11694 | 14189 | 2206 |
| | 29095 | 15026 | 21970 | 28753 | 18638 | 12949 | 15782 | 23500 | 29566 | 19561 | 8922 | 18888 |
| | 8635 | 27031 | 7730 | 22273 | 26855 | 7802 | 29170 | 28338 | 12192 | 1857 | 20955 | 651 |
| | 22972 | 24396 | 11729 | 22455 | 22464 | 18763 | 22460 | 18762 | 22487 | 18739 | 22467 | 22485 |
| | 7470 | 7471 | 11693 | 18710 | 3193 | 13348 | 28870 | 15039 | 9841 | 5648 | 20114 | 7565 |
| | 12240 | 9101 | 5901 | 20829 | 13698 | 14604 | 10081 | 20528 | 2863 | 8077 | 2416 | 4156 |
| | 2415 | 27851 | 5551 | 28791 | 17075 | 30460 | 4848 | 2262 | 19771 | 25640 | 23109 | 12887 |
| | 6142 | 23733 | 3666 | 27756 | 6285 | 26283 | 21176 | 935 | 19132 | 4843 | 30126 | 22186 |
| | 4284 | 25896 | 18049 | 8295 | 19156 | 15981 | 1011 | 22968 | 22088 | 9857 | 14290 | 23049 |
| | 26397 | 13284 | 14418 | 4602 | 24020 | 6118 | 1395 | 23400 | 23507 | 21706 | 5367 | 19834 |
| | 8873 | 2302 | 8667 | 15171 | 22085 | 5729 | 16959 | 23940 | 5011 | 26616 | 18548 | 14054 |
| | 10262 | 5150 | 12512 | 25370 | 15464 | 13513 | 18053 | 17598 | 13448 | 14364 | 11233 | 11270 |
| | 21656 | 11011 | 22908 | 30151 | 8955 | 22425 | 17923 | 3380 | 1438 | 17594 | 19013 | 27621 |
| | 28389 | 28913 | 7821 | 28912 | 2786 | 11164 | 6678 | 15747 | 27497 | 20266 | 26776 | 29512 |
| | 28226 | 11971 | 28017 | 4008 | 20628 | 24450 | 3536 | 13603 | 8954 | 15550 | 17185 | 24310 |
| | 28797 | 23569 | 4473 | 20625 | 25921 | 3147 | 21089 | 14413 | 27638 | 5831 | 28480 | 1539 |
| | 27117 | 14704 | 3725 | 24113 | 28453 | 24936 | 18521 | 22134 | 4546 | 1552 | 12470 | 30034 |
| | 27520 | 23954 | 16139 | 16135 | 21623 | 24776 | 21357 | 28055 | 28940 | 10264 | 27628 | 12480 |
| | 27627 | 27654 | 25661 | 2259 | 25343 | 16930 | 7393 | 19140 | 13385 | 20057 | 8377 | 8740 |
| | 20298 | 23308 | 29768 | 12802 | 17381 | 1340 | 3519 | 24380 | 15106 | 23114 | 10043 | 17563 |
| | 665 | 11696 | 28774 | 3712 | 28052 | 28795 | 3710 | 28803 | 28004 | 1100 | 1745 | 6823 |
| | 28059 | 28007 | 28821 | 28831 | 28828 | 28011 | 1056 | 27973 | 7917 | 20110 | 20111 | 11689 |
| | 11735 | 11660 | 11691 | 11688 | 11656 | 11734 | 28885 | 28886 | 15549 | 12475 | 8397 | 11726 |
| | 11727 | 25525 | 28802 | 28800 | 28050 | 20013 | 7169 | 889 | 22332 | 15319 | 15635 | 19445 |
| | 8489 | 2563 | 5224 | 21062 | 14388 | 4477 | 8449 | 13099 | 25576 | 21311 | 13238 | 12634 |
| | 18024 | 8959 | 23255 | 13076 | 815 | 27247 | 3102 | 19128 | 16024 | 15512 | 6801 | 16846 |
| | 18133 | 28443 | 20053 | 8193 | 10003 | 3852 | 29972 | 24550 | 17915 | 23552 | 4315 | 4280 |
| | 4387 | 4277 | 11738 | 4275 | 4360 | 4233 | 4358 | 4229 | 26798 | 12704 | 8354 | 22489 |
| | 25836 | 5697 | 7788 | 23578 | 24327 | 24329 | 3364 | 3402 | 3399 | 3396 | 28914 | 7718 |
| | 7713 | 29806 | 15542 | 15541 | 17839 | 28097 | 11663 | 11455 | 11459 | 11454 | 11499 | 11496 |
| | 11664 | 11654 | 11509 | 11652 | 27004 | 28725 | 11740 | 18772 | 22365 | 16071 | 5570 | 15151 |
| | 6005 | 25563 | 15361 | 414 | 2505 | 20554 | 4205 | 4202 | 4162 | 4199 | 4164 | 15024 |
| 402: | 21731 | 19306 | 27634 | 10169 | 11204 | 28554 | 2003 | 8294 | 19828 | 26964 | 17294 | 22015 |
| | 26278 | 28659 | 19087 | 9113 | 12024 | 13846 | 12988 | 10512 | 22492 | 11099 | 10957 | 5104 |
| | 6103 | 7321 | 15346 | 2280 | 2464 | 29656 | 18958 | | | | | |
| 403: | 23201 | 8902 | 17383 | 26008 | 26005 | 9941 | 5941 | 28758 | 17348 | 25230 | 22478 | 22649 |
| | 5636 | 21104 | 21891 | 6072 | 16847 | 13755 | 10088 | 8809 | 14343 | 2411 | 23363 | 20102 |
| | 2593 | 10779 | 26745 | 24719 | 2096 | 19888 | 862 | 5398 | 2646 | 28899 | 17727 | 8324 |
| | 7614 | 24127 | | | | | | | | | | |
| 404: | 22505 | 17330 | 17332 | 3832 | 26661 | 24604 | 24601 | 26617 | 26553 | 26585 | 26591 | 26640 |
| | 26582 | 26471 | 26635 | 26572 | 26576 | 26556 | 26609 | 26423 | 25650 | 26551 | 2373 | 2405 |
| | 24690 | 25446 | 25450 | 26422 | 26473 | 25340 | 10489 | 21242 | 21238 | 21241 | 21279 | 24723 |
| | 24725 | 25494 | 25690 | 25164 | 16529 | 7978 | 10037 | 16615 | 16621 | 11055 | 12923 | 6955 |
| | 7874 | 7948 | 7839 | 8664 | 12144 | 14757 | 17096 | 14796 | 14828 | 26829 | 12171 | 21124 |
| | 23048 | 20000 | 23191 | 22333 | 20933 | 15625 | 22212 | 19851 | 28192 | 27896 | 22998 | 22992 |
| | 15629 | 28137 | 24133 | 22151 | 29931 | 985 | 2060 | 944 | 28955 | 28930 | 28990 | 29965 |
| | 15058 | 21486 | 21255 | 20071 | 19073 | 19014 | 18158 | 18127 | 18109 | 15620 | 2239 | 2233 |
| | 16398 | 14851 | 11657 | 12588 | 11744 | 14570 | 13748 | 13790 | 12143 | 12170 | 12173 | 12919 |
| | 15622 | 15628 | 15656 | 15604 | 16393 | 16394 | 16392 | 12916 | 11037 | 22432 | 8701 | 24656 |
| | 19135 | 19853 | 7817 | 18495 | 2869 | 8263 | 29437 | 29438 | 22440 | 22435 | 21711 | 22465 |
| | 21146 | 17031 | 19010 | 21907 | 27742 | 22415 | 5429 | 1188 | 5421 | 18365 | 23435 | 12382 |
| | 12090 | 12087 | 10571 | 18362 | 23640 | 15382 | 987 | 6445 | 6417 | 5413 | 8888 | 2538 |
| | 24892 | 15423 | 1089 | 1127 | 5417 | 21701 | 24630 | 24633 | 21702 | 21705 | 25589 | 25558 |
| | 21697 | 7438 | 22989 | 17339 | 1478 | 1506 | 1479 | 9199 | 25171 | 26307 | 1472 | 25424 |
| | 25418 | 5394 | 23942 | 8884 | 8887 | 12914 | 23541 | | | | | |
| 405: | 17859 | 1238 | 22054 | 28433 | 14522 | 12713 | 2265 | 30161 | 7453 | 4765 | 16339 | 3623 |
| | 16249 | 30466 | 23897 | 24523 | 18199 | 12780 | 12018 | 8775 | 20575 | 9860 | 9828 | 17997 |
| | 22323 | 12760 | 6777 | 25696 | 8048 | 7233 | 7159 | 10567 | 11570 | 5422 | 13420 | 743 |
| | 20960 | 20777 | 13662 | 6471 | 6450 | 722 | 1999 | 22130 | 15016 | 24746 | 17989 | 21018 |
| | 18525 | 29549 | 4744 | 4911 | 15417 | 16008 | 14299 | 4655 | 18309 | 20204 | 13162 | 27357 |
| | 28445 | 29670 | 12438 | 2514 | 2700 | 25507 | 27408 | 21700 | 6258 | 15916 | 23219 | 8612 |
| | 21584 | 7769 | 21090 | 21432 | 24336 | 2356 | 30137 | 4195 | 24837 | 12189 | 4171 | 20221 |
| | 23536 | 26716 | 7664 | 11285 | 23505 | 6454 | 21901 | 13438 | 27127 | 6046 | 28726 | 23456 |
| | 15186 | 1641 | 24978 | 18008 | 19271 | 13956 | 24528 | 17271 | 1119 | 18682 | 4177 | 14894 |
| | 2489 | 29476 | 22053 | 1277 | 2172 | 26999 | 13676 | 22871 | 16889 | 8678 | 12883 | 23881 |
| | 9761 | 20677 | 12855 | 3738 | 22399 | 20134 | 18998 | 18171 | 2684 | 15899 | 7332 | 29308 |
| | 9846 | 23454 | 17170 | 1559 | 28849 | 2839 | 27226 | 11010 | 10112 | 1021 | 29279 | 19520 |
| | 19722 | 26879 | 28081 | 15983 | 17146 | 15924 | 5208 | 2143 | 4634 | 16484 | 3406 | 25815 |
| | 25097 | 16791 | 9830 | 25112 | 1379 | 28559 | 28606 | 16292 | 16260 | 16208 | 16320 | 8188 |
| | 28196 | 5518 | 5513 | 11332 | 7484 | 24098 | 25192 | 11722 | 7295 | 4070 | 3808 | 20017 |
| | 21780 | 1418 | 3680 | 9910 | 7166 | 23057 | 22218 | 23084 | 16029 | 9268 | 11075 | 26038 |
| | 12485 | 7431 | 18804 | 6947 | 8806 | 3674 | 28046 | 5006 | 28297 | 7847 | 24808 | 19618 |
| | 22706 | 21561 | 4782 | 24417 | 3843 | 24691 | 11449 | 9680 | 30005 | 10365 | 4403 | 14746 |

TABLE 8-continued

| PEP SEQ ID NO: | homolog SEQ ID NOs | | | | | | | | | | |
|---|---|---|---|---|---|---|---|---|---|---|---|
| | 20774 | 4849 | 29201 | 28648 | 20671 | 18342 | 23463 | 29918 | 24863 | 14394 | 9080 | 25560 |
| | 8423 | 7517 | 27591 | 30030 | 7571 | 29151 | 7460 | 3064 | 8500 | 8416 | 18919 | 15655 |
| | 22879 | 22882 | 14872 | 2032 | 28860 | 21021 | 11112 | 2577 | 10386 | 7462 | 7356 | 9905 |
| | 21034 | 29197 | 8891 | 6388 | 15308 | 29956 | 25999 | 24693 | 19760 | 18166 | 14979 | 10427 |
| | 18403 | 23159 | 5100 | 26531 | 26168 | 9132 | 29747 | 26986 | 7010 | 6925 | 9803 | 26555 |
| | 30057 | 7883 | 20362 | 13923 | 21199 | 17720 | 10375 | 13693 | 28462 | 5696 | 15243 | 4681 |
| | 11036 | 28713 | 23116 | 22490 | 18697 | 15953 | 16090 | 8882 | 29422 | 26513 | 10652 | 10658 |
| | 14981 | 6819 | 823 | 19664 | 14931 | 2181 | 15988 | 17595 | 11629 | 10661 | 12706 | 6147 |
| | 6518 | 28422 | 8191 | 15040 | 11675 | 3972 | 3697 | 28043 | 5953 | 21288 | 17280 | 10246 |
| | 18586 | 18588 | 19908 | 19910 | 15765 | 26810 | 19134 | 17663 | 17697 | 3638 | 21052 | 16371 |
| | 15495 | 20728 | 421 | 2409 | 22097 | 3355 | 11327 | 6847 | 1500 | 24226 | 15048 | 13579 |
| | 1887 | 8939 | 8964 | 13794 | 9157 | 24816 | 21858 | 5885 | 22336 | 3805 | 3802 | 24169 |
| | 2292 | 26734 | 26770 | 6657 | 13127 | 26043 | 12384 | 16093 | 3544 | 14897 | 2567 | 27765 |
| | 27766 | 27677 | 15125 | 20964 | 23705 | 23066 | 24145 | 25943 | 24093 | 17443 | 7635 | 1827 |
| | 22760 | 29245 | 18346 | 14261 | 16514 | 16482 | 16233 | 16542 | 18557 | 9646 | 13061 | 28991 |
| | 23979 | 2413 | 30304 | 24393 | 6062 | 867 | 1186 | 8879 | 3327 | 2945 | 11059 | 22618 |
| 406: | 20907 | 20913 | 3191 | 25797 | 8462 | 1879 | 4652 | 24363 | 24360 | 10871 | 12810 | 10583 |
| | 10437 | 19450 | 18493 | 11510 | 27173 | 15212 | 15214 | 8588 | 8590 | 9632 | 24462 | 24484 |
| | 28260 | 23999 | 14749 | 8029 | 12739 | 14780 | 18654 | 18652 | 2625 | 8464 | 5633 | 5628 |
| | 27588 | 16686 | 3828 | 21787 | 21790 | 3125 | 13953 | 3308 | 4204 | 18019 | 7272 | 7273 |
| | 15636 | 28388 | 5136 | 17046 | 12262 | 11394 | 8268 | 3615 | 21005 | 16635 | 4983 | 7531 |
| | 30344 | 1135 | 10374 | 5166 | 10372 | 18447 | 18445 | 24095 | 21224 | 10039 | 10660 | 13773 |
| | 13775 | 2682 | 15088 | 15091 | 17289 | 28854 | 4389 | 6838 | 18118 | 25300 | 25284 |
| | 3909 | 19553 | 19550 | 9896 | 30410 | 6350 | 6352 | 21644 | 4235 | 14421 | 1655 | 1687 |
| | 11225 | 4512 | 25728 | 4126 | 13936 | 2284 | 9577 | 2434 | 9351 | 19189 | 736 | 738 |
| | 19080 | 19078 | 11886 | 14543 | 12731 | 5616 | 945 | 24661 | 29479 | 29477 | 19310 | 15449 |
| | 7264 | 7262 | 16117 | 8641 | 9679 | 13198 | 23382 | 16013 | 13897 | 21305 | 9361 | 26329 |
| | 25272 | 13326 | 6626 | 25686 | 24764 | 25861 | 11330 | 20684 | 25383 | 25380 | 19817 | 25252 |
| | 15330 | 15329 | 15599 | 19590 | 19588 | 8432 | 8434 | 6633 | 6636 | 7787 | 8665 | 22993 |
| | 14957 | 24628 | 15222 | 24197 | 24196 | 10768 | 12515 | 9666 | 21632 | 21629 | 29385 | 7904 |
| | 24043 | 27042 | 4463 | 8488 | 7594 | 18889 | 8468 | 7705 | 16095 | 15379 | 25365 | 1105 |
| | 1256 | 9781 | 9756 | 24514 | 13875 | 13877 | 29068 | 29070 | 25581 | 26936 | 641 | 18655 |
| | 13276 | 17422 | 6035 | 3456 | 10575 | 10285 | 22383 | 18810 | 27581 | 24301 | 19856 | 23293 |
| | 19774 | 14585 | 13837 | 18045 | 12415 | 28809 | 1719 | 6283 | 3275 | 5721 | 18107 | 18138 |
| | 14770 | 4010 | 29287 | 28310 | 24971 | 19974 | 19972 | 25303 | 12114 | 23538 | 19092 | 18207 |
| | 3401 | 8653 | 18020 | 28233 | 10290 | 27800 | 13497 | 12795 | 21143 | 24208 | 10362 | 14358 |
| | 30035 | 26498 | 26480 | 2579 | 2581 | 25553 | 30468 | 19029 | 11898 | 4098 | 14169 | 15514 |
| | 7910 | 7526 | 13171 | 27054 | 12790 | 1986 | 12789 | 23005 | 19231 | 2976 | 15569 | 20232 |
| | 15921 | 15922 | 23759 | 23842 | 28666 | 18692 | 18690 | 23244 | 23407 | 17423 | 17427 | 2897 |
| | 27714 | 25824 | 25996 | 7047 | 2917 | 12909 | 4107 | 4108 | 21136 | 12211 | 2611 | 3592 |
| | 10480 | 18755 | 1028 | 1083 | 1963 | 22608 | 22456 | 29314 | 12417 | 28403 | 1979 | 17156 |
| | 17153 | 13292 | 26514 | 19436 | 12547 | 19440 | 9160 | 14472 | 23872 | 23739 | 29989 | 1335 |
| | 14762 | 15717 | 8060 | 8059 | 23117 | 29375 | 29376 | 26898 | 26902 | 18701 | 18704 | 29253 |
| | 7320 | 30440 | 30441 | 20734 | 23837 | 10657 | 27536 | 27533 | 24001 | 20961 | 23981 | 24460 | 19850 |
| | 3286 | 25065 | 23832 | 17487 | 28157 | 27536 | 27533 | 4371 | 15156 | 17678 | 22952 | 16046 |
| | 5165 | 5370 | 8837 | 21890 | 19970 | 29406 | 8021 | 23986 | 28783 | 28553 | 5644 | 5641 |
| | 21285 | 22940 | 22969 | 13328 | 28250 | 4134 | 28550 | 3444 | 26567 | 21414 | 958 | 8881 |
| | 12551 | 1716 | 17811 | 17812 | 12712 | 13880 | 22545 | 22546 | 3504 | 3506 | 11188 | 11214 |
| | 17887 | 4937 | 3552 | 3551 | 17399 | 17402 | 10773 | 8411 | 5793 | 5318 | 16770 | 9716 |
| | 17927 | 8463 | 27561 | 29358 | 11998 | 27717 | 14721 | 14058 | 11597 | 28740 | 2871 | 26354 |
| | 25451 | 20098 | 7924 | 12550 | 6100 | 24279 | 24277 | 20396 | 2049 | 1065 | 11232 | 21892 |
| | 28207 | 25149 | 27734 | 6497 | 9417 | 26597 | 14974 | 20985 | 12570 | 20521 | 18886 | 17886 |
| | 23304 | 18904 | 19175 | 1387 | 29485 | 3384 | 16225 | 11238 | 9062 | 13183 | 17080 | 2487 |
| | 2491 | 27726 | 29848 | 3609 | 5598 | 22808 | 19182 | 24278 | 16173 | 8744 | 28044 | 1695 |
| | 3387 | 15194 | 27618 | 7048 | 3389 | 29713 | 5176 | 27037 | 9625 | 20426 | 29634 | 29188 |
| | 18873 | 18872 | 25945 | 27822 | 16344 | 11957 | 28964 | 17260 | 18190 | 24580 | 5580 | 6177 |
| | 17614 | 29315 | 23000 | 29323 | 23763 | 27598 | 26802 | 2068 | 8800 | 27178 | 22450 | 20363 |
| | 19397 | 16749 | 24564 | 22557 | 24273 | 24092 | 11197 | 13251 | 5525 | 11883 | 12610 | 8401 |
| | 5939 | 3180 | 17437 | 8733 | 19094 | 16076 | 16080 | 13482 | 15213 | 25017 | 14352 | 13469 |
| | 24642 | 29487 | 23655 | 19380 | 5916 | 10810 | 21784 | 3872 | 21783 | 10211 | 14168 | 20997 |
| | 3827 | | | | | | | | | | | |
| 407: | 21969 | 3426 | 23405 | 5511 | 8336 | 7035 | 21611 | 12774 | 12091 | 28615 | 20024 | 28014 |
| | 12005 | 3736 | 28490 | 17277 | 6567 | 2642 | 5615 | 22527 | 23461 | 23548 | 2510 | 16657 |
| | 14727 | 18948 | 681 | 14155 | 24237 | 9719 | 27107 | 2157 | 12368 | 4881 | 21443 | 3211 |
| | 6740 | 29290 | 12934 | 12791 | 15334 | 6320 | 12678 | 2665 | 7340 | 27172 | 25880 | 13369 |
| | 18111 | 20334 | 20201 | 24004 | 17227 | 1996 | 25095 | 15305 | 2617 | 8320 | 14635 | 5475 |
| | 24706 | 20420 | 5892 | 20894 | 8105 | 9553 | 6246 | 22041 | 14153 | 27670 | 20341 | 10564 |
| | 27658 | 2795 | 4144 | 6083 | 17408 | 6067 | 23247 | 16218 | 457 | 14021 | 12930 | 5230 |
| | 2316 | 26146 | 22112 | 8274 | 19356 | 14025 | 379 | 10900 | 3477 | 11849 | 25408 | 19607 |
| | 21727 | 2858 | 24353 | 25045 | 28887 | 5143 | 16074 | 9958 | 11336 | 4365 | 18650 | |
| 408: | 8062 | 25546 | 1621 | 1614 | 3009 | 3717 | 29164 | 16148 | 12892 | 13560 | 16717 | 22076 |
| | 27209 | 9526 | 29022 | 8028 | 19060 | 6866 | 9859 | 9521 | 7039 | 26735 | 8846 | 1715 |
| | 1672 | 28893 | 13883 | 2631 | 6794 | 16995 | 1850 | 14668 | 6858 | 28859 | 4514 | 23601 |
| | 16164 | 6975 | 12533 | 9365 | 9172 | 4159 | 21035 | 10240 | 18547 | 5671 | 11514 | 11548 |
| | 5676 | 11550 | 5680 | 5674 | 6470 | 6468 | 7842 | 12045 | 5223 | 8553 | 3704 | 24541 |
| | 4607 | 10019 | 18105 | 29082 | 29077 | 1410 | 15795 | 28994 | 29007 | 28915 | 29042 | 28911 |
| | 28939 | 28963 | 29040 | 28907 | 28213 | 28212 | 29071 | 29037 | 30138 | 29832 | 8948 | 2225 |
| | 5778 | 20322 | 28399 | 16532 | 28220 | 2469 | 4696 | 15116 | 16142 | 27979 | 3696 | 2867 |

TABLE 8-continued

| PEP SEQ ID NO: | homolog SEQ ID NOs | | | | | | | | | | |
|---|---|---|---|---|---|---|---|---|---|---|---|
| | 12965 | 28477 | 3280 | 12359 | 27750 | 22948 | 1258 | 5427 | 5460 | 18149 | 28362 | 4902 |
| | 17917 | 13498 | 14814 | 28150 | 24160 | 15483 | 12750 | 17479 | 1662 | 6433 | 9794 | 1592 |
| | 15146 | 9280 | 3088 | 12015 | 4354 | 20546 | 24902 | 11555 | 4335 | 22457 | 16123 | 17558 |
| | 17717 | 910 | 10438 | 28145 | 6908 | 10708 | 28408 | 5252 | 16374 | 26917 | 9238 | 8861 |
| | 24620 | 23131 | 22834 | 26229 | 28302 | 6235 | 26899 | 7779 | 4266 | 29616 | 1606 | 1609 |
| | 1467 | 1691 | 1659 | 1689 | 1661 | 1694 | 1501 | 1476 | 2647 | 2750 | 2746 | 1727 |
| | 1761 | 1734 | 1728 | 1725 | 1473 | 803 | 1587 | 10610 | 1574 | 1579 | 1572 | 2811 |
| | 1541 | 2561 | 2586 | 2589 | 2604 | 3580 | 10615 | 1509 | 2651 | 2742 | 2739 | 1768 |
| | 1763 | 1612 | 1651 | 1613 | 1618 | 1654 | 1583 | 1543 | 1537 | 2527 | 2530 | 2524 |
| | 1582 | 23525 | 19216 | 29085 | 7774 | 2331 | 23154 | 29609 | 25022 | 25381 | 23955 | 30244 |
| | 11367 | 9700 | 22351 | 15912 | 2551 | 3728 | 13514 | 17240 | 7818 | 21759 | 10429 | 19954 |
| | 10825 | 21007 | 15393 | 21331 | 25505 | 7916 | 9568 | 25938 | 11553 | 10131 | 3137 | 9322 |
| | 9027 | 3962 | 21216 | 11719 | 27112 | 30197 | 20407 | 2703 | 30094 | 10217 | 14312 | 23485 |
| | 10245 | 3529 | 12563 | 27224 | 10266 | 28943 | 23369 | 9552 | 22613 | 18513 | 21022 | 5606 |
| | 1546 | 1548 | 1573 | 1578 | 1586 | 1590 | 1608 | 1611 | 1617 | 1653 | 1657 | 1658 |
| | 6919 | 11797 | 11827 | 4451 | 19065 | 29618 | 5285 | 3288 | 7613 | 660 | 8693 | 27839 |
| | 2810 | 2553 | 18726 | 7901 | 24270 | 9299 | 2519 | 16420 | 6984 | 15297 | 18483 | 25174 |
| | 26789 | 23155 | 22686 | 14076 | 11152 | 16256 | 23295 | 20948 | 28788 | 22250 | 5411 | 3126 |
| | 25705 | 25265 | 6921 | 28113 | 5057 | 8743 | 14281 | 6158 | 9273 | 19478 | 10433 | 6792 |
| | 17640 | 27860 | 27003 | 9451 | 12592 | 28271 | 29712 | 22575 | 28981 | 27857 | 4096 | 24847 |
| | 12257 | 27013 | 8199 | 18182 | 20431 | 15357 | 7763 | 3491 | 24846 | 6182 | 18010 | 25888 |
| | 25407 | 25088 | 21588 | 16819 | 28637 | 24389 | 11216 | 5543 | 4135 | 7475 | 8609 | 22226 |
| | 24673 | 27255 | 1489 | 15644 | 21618 | 13285 | 6198 | 12085 | 18071 | 14682 | 13139 | 1415 |
| | 17807 | 17061 | 13474 | 13119 | 22434 | 6677 | 16352 | 23720 | 8083 | 6895 | 18930 | 28697 |
| | 24175 | 21438 | 5025 | 13598 | 6340 | 30086 | 17974 | 12976 | 25371 | 28537 | 22086 | 10711 |
| | 5962 | 18451 | 3617 | 1645 | 16773 | 18011 | 7668 | 8086 | 8075 | 8073 | 8445 | 11782 |
| | 19317 | 25997 | 25060 | 20401 | 23914 | 23917 | 23120 | 14111 | 3590 | 15442 | 9295 | 27636 |
| | 11966 | 7992 | 8095 | 14960 | 27986 | 24824 | 1538 | 25046 | 30318 | 28351 | 15917 | 9687 |
| | 10435 | 9187 | 20535 | 1599 | 24522 | 2542 | 19104 | 16153 | 2680 | 23937 | 14540 | 15961 |
| | 12126 | 2020 | 20693 | 26760 | 11857 | 1513 | 11794 | 4643 | 16921 | 21899 | 17288 | 2017 |
| | 7349 | 8476 | 19382 | 17169 | 13154 | 10448 | 913 | 11040 | 20243 | 13186 | 13142 | 13116 |
| | 13151 | 1753 | 14453 | 6037 | 6586 | 21167 | 17127 | 7728 | 14141 | 9472 | 14953 | 15731 |
| | 20138 | 20246 | 20354 | 13399 | 981 | 20198 | 796 | 1710 | 7487 | 1596 | 20288 | 723 |
| | 1471 | 11035 | 28184 | 28181 | 28156 | 28190 | 28189 | 28844 | 27928 | 17042 | 4772 | 1151 |
| | 24320 | 18465 | 13396 | 9570 | 20364 | 21253 | 20359 | 21250 | 20323 | 20157 | 20202 | 20153 |
| | 20158 | 20240 | 20356 | 20260 | 20257 | 20162 | 20255 | 20326 | 20367 | 20331 | 20208 | 20317 |
| | 20320 | 2605 | 2709 | 2716 | 2713 | 2615 | 2610 | 3587 | 3586 | 20193 | 797 | 20196 |
| | 20290 | 20164 | 2550 | 30289 | 13056 | 28817 | 10607 | 29043 | 26783 | 29075 | 28947 | 28944 |
| | 29964 | 26807 | 29192 | 1681 | 13082 | 7027 | 14335 | 25964 | 11058 | 4240 | 18756 | 14942 |
| | 12023 | 15451 | 27741 | 17482 | 27091 | 12350 | 25793 | 5974 | 1126 | 25128 | 13028 | 27746 |
| | 22847 | 22159 | 1639 | 13191 | 1751 | 13053 | 13124 | 13184 | 1643 | 20287 | 27063 | 7593 |
| | 15102 | 29000 | 8297 | 7129 | 12975 | 20523 | 17084 | 22500 | 3163 | 1310 | 13081 | 1504 |
| | 18430 | 25198 | 25679 | 25678 | 25106 | 25248 | 25175 | 25169 | 25255 | 25181 | 18459 | 18461 |
| | 18435 | 25396 | 25394 | 25329 | 25362 | 25335 | 25320 | 25282 | 25263 | 25325 | 28975 | 14262 |
| | 4747 | 28996 | 28999 | 16645 | 22944 | 8114 | 27237 | 13113 | 13084 | 13115 | 28318 | 13059 |
| | 13194 | 13147 | 13187 | 13145 | 13033 | 13086 | 13031 | 13189 | 1809 | 25865 | 14139 | 15466 |
| | 4851 | 1603 | 1633 | 1635 | 20284 | 20292 | 1747 | 1670 | 1748 | 1674 | 11704 | 14332 |
| | 15281 | 28967 | 29044 | 12730 | 29730 | 7399 | 1708 | 9253 | | | | |
| 409: | 13427 | 23058 | 5243 | 11587 | 23453 | 12652 | 21459 | 6252 | 7672 | 2947 | 5347 | 2102 |
| | 5688 | 25571 | 26365 | 10626 | 27508 | 18241 | 12440 | 12814 | 19050 | 23328 | 2423 | 8167 |
| | 4061 | 29223 | 10487 | 30179 | 8917 | 30231 | 2636 | 26203 | 18152 | 10949 | 28873 | 5376 |
| | 3157 | 16589 | 21681 | 25670 | 30177 | 16958 | 8840 | 18876 | 19876 | 12650 | 29394 | 16675 |
| | 15087 | 25201 | 4368 | 12753 | 6475 | 7056 | 17215 | 24280 | 20601 | 22335 | 8505 | 25901 |
| | 21973 | 4263 | 28089 | 16284 | 24470 | 19929 | 22991 | 17198 | 8765 | 21482 | 13324 | 3652 |
| | 17262 | 5517 | 4750 | 15168 | 2054 | 9507 | 4111 | 27757 | 20646 | 14592 | 19951 | 27118 |
| | 11142 | 15189 | 9637 | 14837 | 20735 | 12436 | 4064 | 30293 | 18039 | 24028 | 1259 | 3440 |
| | 10545 | 7446 | 25216 | 4415 | 11879 | 27148 | 26516 | | | | | |
| 410: | 17488 | 14670 | 25907 | 13589 | 14392 | 28308 | 12688 | 3967 | 27108 | 3325 | 11903 | 27253 |
| | 24850 | 14090 | 16633 | 5804 | 8233 | 11276 | | | | | | |
| 411: | 23960 | 23994 | 23991 | 24179 | 24180 | 24076 | 24118 | 24146 | 24149 | 24030 | 24181 | 24184 |
| | 24209 | 24210 | 24213 | 24217 | 24110 | 24232 | 24034 | 24105 | 24236 | 24238 | 23998 | 24071 |
| | 23989 | 24241 | 23996 | 24178 | 24037 | 24027 | 19800 | 24996 | 29453 | 11999 | 10858 | 30053 |
| | 28316 | 7212 | 16755 | 20729 | 22270 | 7627 | 11355 | 12504 | 27348 | 20733 | 28622 | 3242 |
| | 5744 | 13159 | 7477 | 4347 | 10410 | 10411 | 11339 | 10413 | 18220 | 15424 | 23615 | 717 |
| | 719 | 19472 | 26754 | 20123 | 11575 | 29990 | 17924 | 26612 | 26213 | 26212 | 26210 | 14807 |
| 412: | 14671 | 15692 | 15987 | 22073 | 5813 | 23395 | 3235 | 19033 | 861 | 4626 | 2988 | 10228 |
| | 766 | 6195 | 16805 | 18479 | | | | | | | | |
| 413: | 12549 | 18187 | 6723 | 6893 | 30215 | 24496 | 11543 | 17447 | 19279 | 30095 | 26452 | 14203 |
| | 8981 | 10294 | 25217 | 11910 | 25862 | 23600 | 25330 | 18729 | 1209 | 22132 | 7771 | 19809 |
| | 19840 | 1324 | 7421 | 28894 | 24897 | 15572 | 10412 | 10385 | 4017 | 10179 | 7291 | 7330 |
| | 15721 | 3227 | 9290 | 4031 | 22627 | 22621 | 1295 | 23614 | 16939 | 1294 | 13096 | 14594 |
| | 10826 | 23830 | 9875 | 14458 | 6600 | 11620 | 4115 | 7279 | 29579 | 6250 | 14102 | 12301 |
| | 24256 | 18504 | 3243 | 18239 | 21132 | 24871 | 24482 | 9462 | 30400 | 27319 | 12028 | 23195 |
| | 2195 | 2112 | 19258 | 27367 | 11902 | 1380 | 4207 | 1377 | 28739 | 28780 | 2560 | 2251 |
| | 8457 | 30203 | 20391 | 27431 | 2912 | 11442 | 14775 | 24603 | 20302 | 20411 | 25165 | 16179 |
| | 11959 | 10309 | 22529 | 14726 | 13772 | 6477 | 20236 | 5695 | 5369 | 19255 | 25035 | 28140 |
| | 25754 | 13122 | 17090 | 17088 | 19199 | 21934 | 19434 | 16556 | 7415 | 27702 | 23319 | 8854 |
| | 16044 | 22249 | 28264 | 10440 | 27671 | 28727 | 1022 | 26381 | 29304 | 1004 | 23153 | 27331 |

TABLE 8-continued

| PEP SEQ ID NO: | homolog SEQ ID NOs | | | | | | | | | | |
|---|---|---|---|---|---|---|---|---|---|---|---|
| | 14795 | 14064 | 30180 | 5439 | 7076 | 20788 | 2578 | 20541 | 6750 | 7219 | 17952 | 17206 |
| | 2016 | 29825 | 10673 | 2098 | 19307 | 28535 | 16396 | 19692 | 29355 | 23257 | 11756 | 8181 |
| | 25454 | 3487 | 3490 | 7146 | 4986 | 21626 | 17743 | 17657 | 4306 | 30116 | 15904 | 22714 |
| | 20998 | 23432 | 15302 | 14276 | 17895 | 11156 | 12032 | 30445 | 29816 | 989 | 26655 | 26656 |
| | 24099 | 24101 | 4219 | 4218 | 28402 | 28336 | 2249 | 23351 | 961 | 3797 | 24100 | 1464 |
| | 28397 | 24921 | 20495 | 25816 | 3359 | 13439 | 28969 | 9704 | 19131 | 19554 | 28472 | 19193 |
| | 6493 | 3128 | 24287 | 29398 | 8945 | 29802 | 23794 | 9455 | 8508 | 6576 | 6785 | 21286 |
| | 8869 | 9559 | 8824 | 8823 | 6225 | 1015 | 9878 | 30412 | 29319 | 16475 | 21186 | 13968 |
| | 10743 | 12132 | 10002 | 14558 | 15461 | 11653 | 11655 | 27592 | 8987 | 9015 | 26600 | 22337 |
| | 29254 | 16672 | 5661 | 23871 | 27946 | 8717 | 16536 | 2729 | 7175 | 6458 | 2730 | 19886 |
| | 19884 | 26668 | 26666 | 3562 | 28005 | 27490 | 27944 | 22845 | 6463 | 4095 | 3000 | 14154 |
| | 9000 | 3542 | 3458 | 17748 | 7558 | 5488 | 12500 | 8528 | 15560 | 7439 | 6739 | 3611 |
| | 19323 | 25663 | 28683 | 6590 | 776 | 21017 | 21203 | 12649 | 14927 | 12693 | 14937 | 23123 |
| | 15889 | 27918 | 14923 | 24230 | 11753 | 4148 | 19106 | 20058 | 6880 | 12738 | 10316 | 10405 |
| | 28971 | 11945 | 21707 | 8901 | 17579 | 11315 | 15603 | 14965 | 11951 | 15789 | 27908 | 11068 |
| | 25881 | 15610 | 8857 | 28019 | 30319 | 22677 | 9164 | 26279 | 23628 | 22792 | 12255 | 11290 |
| | 20508 | 27661 | 13605 | 10261 | 22573 | 22577 | 22576 | 23487 | 16010 | 10061 | 24578 | 9544 |
| | 26041 | 13967 | 27940 | 22051 | 7263 | 9033 | 29592 | 6788 | 16551 | 16002 | 10443 | 15858 |
| | 15862 | 10300 | 15860 | 28315 | 8379 | 15207 | 15170 | 15140 | 15137 | 15173 | 26987 |
| | 16524 | 14204 | 14211 | 12261 | 18209 | 977 | 30115 | 10746 | 17054 | 11609 | 10585 | 22918 |
| | 22916 | 22982 | 23033 | 28626 | 24555 | 25261 | 25520 | 9166 | 10297 | 30131 | 9872 | 8915 |
| | 9272 | 5608 | 22842 | 11082 | 13193 | 1660 | 11466 | 13161 | 10196 | 10255 | 8292 | 24977 |
| | 19456 | 24387 | 16983 | 25788 | 17307 | 14298 | 23921 | 24520 | 11546 | 15021 | 3035 | 19122 |
| | 22397 | 8387 | 30428 | 12614 | 18816 | 29994 | 29186 | 22807 | 27437 | 26000 | 24509 | 24477 |
| | 24511 | 24515 | 24517 | 8909 | 9968 | 19447 | 10561 | 19507 | 16661 | 12928 | 29264 | 5409 |
| | 15284 | 8889 | 19268 | 27219 | 27217 | 26835 | 27423 | 26663 | 25782 | 8129 | 26565 | 7796 |
| | 19841 | 28880 | 20239 | 27075 | | | | | | | | |
| 414: | 28852 | 15638 | 17009 | 6683 | 16039 | 5647 | 28427 | 890 | 18228 | 6105 | 16172 | 1771 |
| | 7145 | 10622 | 6022 | 2613 | 28259 | 29515 | 4357 | 8326 | 19653 | 12830 | 12478 | 401 |
| | 8441 | 9141 | 18198 | 4527 | 17869 | 26532 | 24923 | 21211 | 976 | 17092 | 7122 | 1167 |
| | 4885 | 8002 | 20762 | 23274 | 20547 | 25649 | 19161 | 10754 | 5179 | 6465 | 25364 | 3395 |
| | 27640 | 24980 | 7840 | 29738 | 12477 | 17516 | 9474 | 3936 | 16980 | 19557 | 13703 | 16878 |
| | 22607 | 25235 | 13904 | 13250 | 1047 | 13392 | 6129 | 30257 | 6509 | 24453 | 23187 | 26194 |
| | 21355 | 11222 | 26605 | 6397 | 13313 | 10666 | 3577 | 8479 | 14823 | 11666 | 18856 | 30297 |
| | 14116 | 7827 | 22359 | 7791 | 20046 | 25765 | 1385 | 26631 | 19200 | 21539 | 19116 | 28056 |
| | 23396 | 16713 | 5651 | 23317 | 14513 | 25124 | 16180 | 15307 | 17556 | 27259 | 14768 | 8865 |
| | 13696 | 18699 | 19395 | 11033 | 12605 | 28945 | 17006 | 16032 | 9880 | 24412 | 28474 | 25974 |
| | 22541 | 22540 | 30368 | 30401 | 19370 | 14995 | 2369 | 13973 | 18212 | 11309 | 9695 | 9324 |
| | 22518 | 23300 | 4831 | 3345 | 2257 | 9702 | 21449 | 18968 | 3503 | 24702 | 1266 | 12286 |
| | 11393 | 21501 | 6804 | 25638 | 15689 | 21091 | 28116 | 20314 | 13050 | 13353 | 12953 | 19169 |
| | 27681 | 25991 | 3553 | 27783 | 8863 | 21558 | 6432 | 3585 | 19009 | 8984 | 22488 | 28425 |
| | 28372 | 20493 | 14706 | 15432 | 28301 | 15697 | 7947 | 22520 | 22749 | 20146 | 29086 | 25985 |
| | 2650 | 29707 | 21537 | 20350 | 20618 | 16287 | 14042 | 7804 | 18046 | 6176 | 14412 | 27806 |
| | 22536 | 22090 | 4038 | 16872 | 2541 | 6592 | 15938 | 11702 | 17508 | 17510 | 1422 | 3635 |
| | 11694 | 14189 | 10388 | 2142 | 27706 | 23269 | 4150 | 9767 | 6994 | 9838 | 24831 | 1730 |
| | 11855 | 4622 | 16400 | 4426 | 4456 | 18745 | 20869 | 24274 | 21316 | 5871 | 27263 | 25036 |
| | 7801 | 14267 | 16965 | 24586 | 22741 | 28908 | 11729 | 22455 | 18739 | 22464 | 18763 | 22467 |
| | 22487 | 22460 | 18762 | 22485 | 11693 | 18710 | 3193 | 13348 | 28870 | 15039 | 5551 | 7913 |
| | 29439 | 9149 | 17075 | 30460 | 4848 | 2262 | 19771 | 25640 | 23109 | 12887 | 6142 | 23733 |
| | 3666 | 27756 | 935 | 4843 | 28791 | 4284 | 30126 | 10081 | 15981 | 2415 | 2416 | 27851 |
| | 7565 | 5901 | 20829 | 13698 | 14604 | 21706 | 23400 | 14418 | 24020 | 25799 | 14956 | 20528 |
| | 26397 | 9627 | 20378 | 14290 | 1395 | 21176 | 19132 | 19806 | 6002 | 24924 | 8295 | 26523 |
| | 1011 | 22939 | 22968 | 4602 | 13284 | 18049 | 22528 | 6267 | 9857 | 4757 | 6118 | 6053 |
| | 19156 | 17418 | 617 | 10776 | 27467 | 18329 | 24475 | 12655 | 22088 | 13133 | 6137 | 5743 |
| | 27955 | 11718 | 15232 | 14150 | 11737 | 12375 | 11728 | 11641 | 27323 | 4620 | 2147 | 4967 |
| | 23049 | 25416 | 5541 | 15260 | 11047 | 13972 | 13504 | 1010 | 21041 | 4417 | 29749 | 5930 |
| | 15783 | 7966 | 3003 | 29823 | 14759 | 19481 | 2779 | 27454 | 11537 | 22341 | 2883 | 5343 |
| | 22493 | 22883 | 2906 | 6396 | 13663 | 1168 | 5729 | 5011 | 15171 | 22085 | 10262 | 16959 |
| | 5150 | 12512 | 23940 | 15464 | 18548 | 14054 | 26616 | 19834 | 18053 | 8873 | 13448 | 25370 |
| | 2302 | 14364 | 11270 | 11233 | 13513 | 17598 | 22425 | 8667 | 17594 | 22908 | 30151 | 17923 |
| | 19013 | 8955 | 27899 | 5428 | 27481 | 4282 | 14393 | 25953 | 8707 | 1438 | 11011 | 2360 |
| | 28214 | 3380 | 14004 | 21652 | 12442 | 9823 | 14608 | 16151 | 11314 | 7692 | 14481 | 9809 |
| | 27621 | 28389 | 28913 | 7821 | 28912 | 11698 | 2786 | 16182 | 30108 | 28226 | 24310 | 8954 |
| | 15550 | 28017 | 4008 | 20628 | 24450 | 3536 | 13603 | 28797 | 25921 | 4473 | 20625 | 3147 |
| | 14413 | 21089 | 1539 | 23569 | 18521 | 14704 | 5831 | 22134 | 24936 | 18035 | 28480 | 4546 |
| | 799 | 27117 | 11365 | 4143 | 8899 | 30102 | 4689 | 18234 | 15735 | 3232 | 7395 | 27043 |
| | 14845 | 3725 | 12816 | 20902 | 25355 | 16212 | 16823 | 17436 | 25565 | 29860 | 3294 | 21972 |
| | 20025 | 11084 | 27638 | 24113 | 3434 | 28595 | 12042 | 3002 | 14802 | 8280 | 22114 | 13288 |
| | 7247 | 4188 | 30324 | 18791 | 1552 | 23915 | 25341 | 12470 | 16139 | 16135 | 21623 | 24776 |
| | 28775 | 28055 | 25677 | 28940 | 10264 | 27627 | 12480 | 27628 | 27654 | 28416 | 27817 | 3098 |
| | 3450 | 17563 | 11696 | 665 | 3712 | 28774 | 28052 | 28795 | 3710 | 19046 | 28803 | 28004 |
| | 6823 | 1100 | 1745 | 28059 | 28007 | 28831 | 28821 | 28828 | 1056 | 27973 | 28011 | 7917 |
| | 20110 | 20111 | 11689 | 11660 | 11735 | 11688 | 11691 | 11734 | 28885 | 28886 | 15549 |
| | 12475 | 8397 | 11726 | 11727 | 25525 | 28800 | 28802 | 28050 | 28794 | 27983 | 28773 | 10507 |
| | 889 | 7932 | 9202 | 9772 | 25449 | 6644 | 9821 | 21194 | 13207 | 13099 | 16098 | 13238 |
| | 15967 | 1671 | 26108 | 27788 | 26849 | 28704 | 24124 | 16660 | 25348 | 3363 | 1759 | 8750 |
| | 22058 | 17197 | 12031 | 19854 | 4329 | 8752 | 12335 | 8926 | 14096 | 3870 | 2640 | 22222 |
| | 21042 | 12635 | 6801 | 13076 | 815 | 3102 | 19128 | 28443 | 23255 | 10003 | 24550 | 8193 |

TABLE 8-continued

| PEP SEQ ID NO: | | | | homolog SEQ ID NOs | | | | | | |
|---|---|---|---|---|---|---|---|---|---|---|
| | 18024 | 18913 | 10475 | 20706 | 29365 | 8732 | 25064 | 7381 | 7862 | 4280 | 4387 | 4315 |
| | 4275 | 4360 | 4233 | 4358 | 4229 | 4277 | 11738 | 22193 | 18443 | 28274 | 3364 | 3396 |
| | 3402 | 3399 | 28914 | 4375 | 12215 | 4677 | 12631 | 11664 | 11654 | 11663 | 11652 | 11499 |
| | 11496 | 11455 | 11509 | 11459 | 11454 | 16704 | 19282 | 16740 | 27227 | 11740 | 6436 | 10899 |
| | 19172 | 8486 | 5666 | 21822 | 29680 | 23925 | 30438 | 26094 | 23888 | 23957 | 21627 | 4202 |
| | 4162 | 4205 | 4199 | 4164 | 9176 | 2146 | 12300 | | | | | |
| 415: | 15090 | 9360 | 19558 | 17391 | 10057 | 17102 | 15552 | 29057 | 1555 | 15910 | 6334 | |
| 416: | 23286 | 11758 | 1274 | 8225 | 27981 | 25684 | 25757 | 16457 | 16452 | 1391 | 12214 | 23260 |
| | 23289 | 1744 | 11105 | 11360 | 5199 | 25720 | 25688 | 14705 | 6709 | 6649 | 16261 | 22979 |
| | 22977 | 16994 | 16270 | 2059 | 2009 | 16265 | 20642 | 23803 | 20644 | 15180 | 15175 | 4941 |
| | 4914 | 3758 | 4703 | 4713 | 16785 | 10080 | 16509 | 27451 | 6582 | 12093 | 3831 | 1155 |
| | 9438 | 17429 | 4505 | 9638 | 12510 | 11369 | 12332 | 11407 | 12298 | 12366 | 12270 | 11488 |
| | 11530 | 12277 | 12432 | 12339 | 12269 | 17458 | 17460 | 19786 | 19822 | 21082 | 19790 | 19696 |
| | 19761 | 19793 | 19758 | 19719 | 19935 | 19903 | 19827 | 19930 | 19868 | 21151 | 21148 | 21112 |
| | 19763 | 21144 | 19928 | 3788 | 4668 | 4665 | 4699 | 4673 | 16783 | 4824 | 16782 | 6878 |
| | 6991 | 6910 | 6932 | 6936 | 6940 | 5992 | 4628 | 3791 | 4740 | 4743 | 26710 | 23228 |
| | 28484 | 14653 | 14703 | 17093 | 15617 | 15646 | 15668 | 15641 | 15642 | 15670 | 15639 | 22762 |
| | 13093 | 20149 | 2079 | 4751 | 4775 | 4982 | 6024 | 6061 | 6868 | 16810 | 4978 | 6837 |
| | 5982 | 6907 | 26794 | 25144 | 24355 | 5247 | 3727 | 3754 | 16757 | 3755 | 3784 | 3787 |
| | 4632 | 4659 | 4662 | 4707 | 4746 | 4749 | 4830 | 4834 | 4879 | 4909 | 4907 | 4912 |
| | 4944 | 4945 | 4980 | 5768 | 5792 | 5829 | 5862 | 5899 | 5895 | 5938 | 5942 | 5975 |
| | 5986 | 6059 | 6091 | 6093 | 6099 | 6869 | 6897 | 6902 | 6942 | 6961 | 6964 | 6969 |
| | 3748 | 3751 | 25626 | 18897 | 18900 | 11659 | 3110 | 1332 | 23097 | 27977 | 1190 | 15240 |
| | 5284 | 5204 | 5307 | 5306 | 5310 | 5201 | 5331 | 5329 | 5234 | 5232 | 5226 | 5278 |
| | 5236 | 5239 | 5277 | 10149 | 2306 | 12349 | 27947 | 19479 | 19484 | 25020 | 24994 | 14113 |
| | 14253 | 14109 | 14251 | 14282 | 15069 | 14138 | 30160 | 14321 | 14278 | 19566 | 14326 | 14195 |
| | 19682 | 14068 | 14161 | 29739 | 10181 | 17666 | 10210 | 17706 | 17711 | 17670 | 17681 | 23292 |
| | 16447 | 13249 | 28736 | 13813 | 4269 | 8971 | 24172 | 10784 | 6621 | 6581 | 21799 | 28030 |
| | 14647 | 5282 | 27990 | 28015 | 16419 | 5909 | 5945 | 6619 | 6614 | 14800 | 17524 | 28146 |
| | 21825 | 21826 | 8124 | 8126 | 8159 | 8214 | 28025 | 28023 | 28020 | 8218 | 8196 | 30192 |
| | 4794 | 15242 | 2511 | 14452 | 25359 | 13419 | 1836 | 2576 | 16666 | 1428 | 1423 | 19836 |
| | 1910 | 7820 | 10218 | 20683 | 29045 | 6026 | 6025 | 16449 | 4481 | 14869 | 10745 | 11813 |
| | 20059 | 22400 | 11648 | 7691 | 16414 | 8183 | 16455 | 16412 | 16460 | 13181 | 2994 | 2965 |
| | 26527 | 16462 | 11863 | 7168 | 20675 | 16443 | 20678 | 967 | 17461 | 2509 | 11502 | 7375 |
| | 17492 | 28280 | 6553 | 17455 | 2264 | 16409 | 16416 | 16418 | 16407 | 16444 | 4844 | 14779 |
| | 20794 | 12379 | 7963 | 19990 | 15714 | 670 | 11705 | 25327 | 26672 | 28323 | 23256 | 17560 |
| | 18542 | 22080 | 13354 | 13352 | 21460 | 21463 | 3023 | 16390 | 14532 | 29577 | 29581 | 29580 |
| | 29552 | 29576 | 29541 | 8329 | 6616 | 6645 | 6642 | 16406 | 5279 | 20860 | 3939 | 8558 |
| | 3973 | 4297 | 17449 | 19743 | 8597 | 25495 | 25466 | 23522 | 22778 | 809 | 27528 | 1300 |
| | 23760 | 29578 | 25760 | 25761 | 20932 | 11894 | 20864 | 9396 | 3800 | 15568 | 9826 | 11866 |
| | 20815 | 26007 | 7525 | 8113 | 8080 | 19979 | 20833 | 20882 | 19973 | 20991 | 20988 | 21040 |
| | 20992 | 20962 | 20958 | 20922 | 20875 | 7061 | 20135 | 14531 | 6555 | 3548 | 3465 | 3461 |
| | 21597 | 21821 | 7008 | 19716 | 7001 | 19725 | 13816 | 19729 | 19765 | 25693 | 21823 | 15215 |
| | 4827 | 5081 | 20680 | 8119 | 12128 | 7002 | 25110 | 5305 | 16506 | 4866 | 4872 |
| | 4875 | 4869 | 1977 | 15074 | 15072 | 15105 | 23221 | 23227 | 18915 | 6585 | 4781 | 15238 |
| | 28000 | 27811 | 27816 | 27832 | 27962 | 27900 | 27901 | 27903 | 27966 | 27969 | 27994 | 27907 |
| | 27909 | 27835 | 27840 | 27842 | 27865 | 27870 | 27873 | 27877 | 27808 | 27809 | 27810 | 27999 |
| | 27925 | 27926 | 27879 | 27930 | 28002 | 27935 | 27938 | 27998 | 27958 | 27959 | 9095 | 3804 |
| | 22867 | 17450 | 483 | 482 | 417 | 4731 | | | | | | |
| 417: | 23286 | 11758 | 1274 | 8225 | 27981 | 25684 | 25757 | 16457 | 16452 | 1391 | 12214 | 23260 |
| | 23289 | 1744 | 11105 | 11360 | 5199 | 25720 | 25688 | 14705 | 6709 | 6649 | 16261 | 22979 |
| | 22977 | 16994 | 16270 | 2059 | 2009 | 16265 | 20642 | 23803 | 20644 | 15180 | 15175 | 4941 |
| | 4914 | 3758 | 4703 | 4713 | 16785 | 10080 | 16509 | 27451 | 6582 | 12093 | 3831 | 1155 |
| | 9438 | 17429 | 4505 | 9638 | 12510 | 11369 | 12332 | 11407 | 12298 | 12366 | 12270 | 11488 |
| | 11530 | 12277 | 12432 | 12339 | 12269 | 17458 | 17460 | 19786 | 19822 | 21082 | 19790 | 19696 |
| | 19761 | 19793 | 19758 | 19719 | 19935 | 19903 | 19827 | 19930 | 19868 | 21151 | 21148 | 21112 |
| | 19763 | 21144 | 19928 | 3788 | 4668 | 4665 | 4699 | 4673 | 16783 | 4824 | 16782 | 6878 |
| | 6991 | 6910 | 6932 | 6936 | 6940 | 5992 | 4628 | 3791 | 4740 | 4743 | 26710 | 23228 |
| | 28484 | 14653 | 14703 | 17093 | 15617 | 15646 | 15668 | 15641 | 15642 | 15670 | 15639 | 22762 |
| | 13093 | 20149 | 2079 | 4751 | 4775 | 4982 | 6024 | 6061 | 6868 | 16810 | 4978 | 6837 |
| | 5982 | 6907 | 26794 | 25144 | 24355 | 5247 | 3727 | 3754 | 16757 | 3755 | 3784 | 3787 |
| | 4632 | 4659 | 4662 | 4707 | 4746 | 4749 | 4830 | 4834 | 4879 | 4909 | 4907 | 4912 |
| | 4944 | 4945 | 4980 | 5768 | 5792 | 5829 | 5862 | 5899 | 5895 | 5938 | 5942 | 5975 |
| | 5986 | 6059 | 6091 | 6093 | 6099 | 6869 | 6897 | 6902 | 6942 | 6961 | 6964 | 6969 |
| | 3748 | 3751 | 25626 | 18897 | 18900 | 11659 | 3110 | 1332 | 23097 | 27977 | 1190 | 15240 |
| | 5284 | 5204 | 5307 | 5306 | 5310 | 5201 | 5331 | 5329 | 5234 | 5232 | 5226 | 5278 |
| | 5236 | 5239 | 5277 | 10149 | 2306 | 12349 | 27947 | 19479 | 19484 | 25020 | 24994 | 14113 |
| | 14253 | 14109 | 14251 | 14282 | 15069 | 14138 | 30160 | 14321 | 14278 | 19566 | 14326 | 14195 |
| | 19682 | 14068 | 14161 | 29739 | 10181 | 17666 | 10210 | 17706 | 17711 | 17670 | 17681 | 23292 |
| | 16447 | 13249 | 28736 | 13813 | 4269 | 8971 | 24172 | 10784 | 6621 | 6581 | 21799 | 28030 |
| | 14647 | 5282 | 27990 | 28015 | 16419 | 5909 | 5945 | 6619 | 6614 | 14800 | 17524 | 28146 |
| | 21825 | 21826 | 8124 | 8126 | 8159 | 8214 | 28025 | 28023 | 28020 | 8218 | 8196 | 30192 |
| | 4794 | 15242 | 2511 | 14452 | 25359 | 13419 | 1836 | 2576 | 16666 | 1428 | 1423 | 19836 |
| | 1910 | 7820 | 10218 | 20683 | 29045 | 6026 | 6025 | 16449 | 4481 | 14869 | 10745 | 11813 |
| | 20059 | 22400 | 11648 | 7691 | 16414 | 8183 | 16455 | 16412 | 16460 | 13181 | 2994 | 2965 |
| | 26527 | 16462 | 11863 | 7168 | 20675 | 16443 | 20678 | 967 | 17461 | 2509 | 11502 | 7375 |
| | 17492 | 28280 | 6553 | 17455 | 2264 | 16409 | 16416 | 16418 | 16407 | 16444 | 4844 | 14779 |
| | 20794 | 12379 | 7963 | 19990 | 15714 | 670 | 11705 | 25327 | 26672 | 28323 | 23256 | 17560 |

TABLE 8-continued

| PEP SEQ ID NO: | homolog SEQ ID NOs | | | | | | | | | | |
|---|---|---|---|---|---|---|---|---|---|---|---|
| | 18542 | 22080 | 13354 | 13352 | 21460 | 21463 | 3023 | 16390 | 14532 | 29577 | 29581 | 29580 |
| | 29552 | 29576 | 29541 | 8329 | 6616 | 6645 | 6642 | 16406 | 5279 | 20860 | 3939 | 8558 |
| | 3973 | 4297 | 17449 | 19743 | 8597 | 25495 | 25466 | 23522 | 22778 | 809 | 27528 | 1300 |
| | 23760 | 29578 | 25760 | 25761 | 20932 | 11894 | 20864 | 9396 | 3800 | 15568 | 9826 | 11866 |
| | 20815 | 26007 | 7525 | 8113 | 8080 | 19979 | 20833 | 20882 | 19973 | 20991 | 20988 | 21040 |
| | 20992 | 20962 | 20958 | 20922 | 20875 | 7061 | 20135 | 14531 | 6555 | 3548 | 3465 | 3461 |
| | 21597 | 21821 | 7008 | 19716 | 7001 | 19725 | 13816 | 19729 | 19765 | 25693 | 21823 | 15215 |
| | 4827 | 5081 | 20680 | 8119 | 12128 | 7002 | 5206 | 25110 | 5305 | 16506 | 4866 | 4872 |
| | 4875 | 4869 | 1977 | 15074 | 15072 | 15105 | 23221 | 23227 | 18915 | 6585 | 4781 | 15238 |
| | 28000 | 27811 | 27816 | 27832 | 27962 | 27900 | 27901 | 27903 | 27966 | 27969 | 27994 | 27907 |
| | 27909 | 27835 | 27840 | 27842 | 27865 | 27870 | 27873 | 27877 | 27808 | 27809 | 27810 | 27999 |
| | 27925 | 27926 | 27879 | 27930 | 28002 | 27935 | 27938 | 27998 | 27958 | 27959 | 9095 | 3804 |
| | 22867 | 17450 | 483 | 482 | 416 | 4731 | | | | | | |
| 418: | 23286 | 11758 | 1274 | 8225 | 27981 | 25684 | 25757 | 16457 | 16452 | 1391 | 12214 | 23260 |
| | 23289 | 1744 | 11105 | 11360 | 5199 | 25720 | 14705 | 6709 | 6649 | 16261 | 22979 |
| | 22977 | 16994 | 16270 | 2059 | 2009 | 16265 | 20642 | 23803 | 20644 | 15180 | 15175 | 4941 |
| | 4914 | 3758 | 4703 | 4713 | 16785 | 15326 | 16509 | 6582 | 9011 | 8975 | 12093 | 3831 |
| | 1155 | 17429 | 4505 | 9638 | 12510 | 11369 | 12332 | 11407 | 12298 | 12366 | 12270 | 11488 |
| | 11530 | 12277 | 12432 | 12339 | 12269 | 17458 | 17540 | 19786 | 19822 | 21082 | 19790 | 19696 |
| | 19761 | 19793 | 19758 | 19719 | 19935 | 19903 | 19827 | 19930 | 19868 | 21151 | 21148 | 21112 |
| | 19763 | 21144 | 19928 | 3788 | 4665 | 4668 | 4699 | 4673 | 16783 | 4824 | 16782 | 6878 |
| | 6991 | 6910 | 6932 | 6936 | 6940 | 5992 | 4628 | 3791 | 4740 | 4743 | 26710 | 23228 |
| | 28484 | 17093 | 15617 | 15646 | 15668 | 15641 | 15642 | 22762 | 13093 | 20149 | 2079 | 4751 |
| | 4775 | 4982 | 6024 | 6061 | 6868 | 16810 | 6837 | 5982 | 6907 | 26794 | 25144 | 24355 |
| | 5247 | 3727 | 3754 | 16757 | 3784 | 3787 | 4632 | 4659 | 4662 | 4707 | 4746 | 4749 |
| | 4830 | 4834 | 4879 | 4909 | 4907 | 4912 | 4944 | 4945 | 4980 | 5768 | 5792 | 5829 |
| | 5862 | 5899 | 5938 | 5942 | 5975 | 5986 | 6059 | 6091 | 6093 | 6099 | 6869 | 6897 |
| | 6902 | 6942 | 6961 | 6964 | 6969 | 3748 | 3751 | 25626 | 18897 | 18900 | 11659 | 3110 |
| | 1332 | 23097 | 27977 | 1190 | 15240 | 5284 | 5204 | 5307 | 5306 | 5310 | 5201 | 5331 |
| | 5329 | 5234 | 5232 | 5226 | 5278 | 5236 | 5239 | 5277 | 10149 | 2306 | 12349 | 27947 |
| | 19479 | 19484 | 25020 | 24994 | 14113 | 14253 | 14251 | 14282 | 15069 | 14138 | 30160 |
| | 14321 | 14278 | 19566 | 14326 | 14195 | 19682 | 14068 | 14161 | 29739 | 10181 | 17666 | 10210 |
| | 17706 | 17711 | 17670 | 17681 | 23292 | 16447 | 13249 | 28736 | 13813 | 4269 | 8971 | 24172 |
| | 10784 | 6621 | 6581 | 21799 | 28030 | 27428 | 5282 | 27990 | 28015 | 16419 | 2481 | 2473 |
| | 28172 | 6619 | 6614 | 14800 | 17524 | 28146 | 21825 | 21826 | 8124 | 8126 | 8159 | 8214 |
| | 28025 | 28023 | 28020 | 8218 | 8196 | 30192 | 4794 | 15242 | 14452 | 2511 | 25359 | 13419 |
| | 1836 | 22347 | 8504 | 29236 | 1910 | 7825 | 10218 | 20683 | 29045 | 6026 | 6025 | 16449 |
| | 4481 | 4203 | 8291 | 16087 | 7549 | 23421 | 5273 | 5270 | 29657 | 25948 | 5275 | 6968 |
| | 15722 | 21480 | 14769 | 12074 | 6737 | 3041 | 3986 | 11648 | 5607 | 7691 | 16414 | 8183 |
| | 16455 | 16412 | 16460 | 13181 | 2994 | 2965 | 12670 | 27234 | 6265 | 14420 | 3760 | 17424 |
| | 8749 | 12663 | 29710 | 9123 | 11863 | 7168 | 20675 | 16443 | 20678 | 967 | 17461 | 2509 |
| | 12471 | 4719 | 17457 | 17421 | 17489 | 6553 | 17419 | 2745 | 26006 | 16409 | 16416 | 16418 |
| | 23189 | 16407 | 16444 | 4844 | 14779 | 20115 | 23570 | 19989 | 15714 | 670 | 11705 | 26672 |
| | 25327 | 28323 | 23256 | 17560 | 18542 | 22080 | 13354 | 13352 | 21463 | 21460 | 3023 | 16390 |
| | 14532 | 29552 | 29541 | 29576 | 13203 | 8329 | 6616 | 6645 | 6642 | 16406 | 5279 | 20860 |
| | 3939 | 8558 | 3973 | 4297 | 26020 | 4934 | 16268 | 6700 | 5817 | 7285 | 24569 | 30389 |
| | 25857 | 27134 | 25760 | 25761 | 20932 | 11894 | 20864 | 9396 | 3800 | 15568 | 9826 | 11866 |
| | 20815 | 26007 | 7525 | 8113 | 8076 | 19979 | 20992 | 19973 | 20991 | 20988 | 20833 | 21040 |
| | 20882 | 20962 | 20958 | 20922 | 20875 | 7061 | 20135 | 14531 | 6555 | 3548 | 3465 | 3461 |
| | 21597 | 21821 | 7008 | 19716 | 7001 | 19725 | 13816 | 19729 | 19765 | 25693 | 21823 | 15215 |
| | 4827 | 5081 | 20680 | 8119 | 12128 | 7002 | 5206 | 25110 | 5305 | 16506 | 4866 | 4872 |
| | 4875 | 4869 | 1977 | 15074 | 15072 | 15105 | 4732 | 13465 | 23221 | 23227 | 18915 | 6585 |
| | 4781 | 15238 | 28000 | 27811 | 27816 | 27832 | 27962 | 27900 | 27901 | 27903 | 27966 | 27969 |
| | 27994 | 27907 | 27909 | 27835 | 27840 | 27842 | 27865 | 27870 | 27873 | 27877 | 27808 | 27809 |
| | 27810 | 27999 | 27925 | 27926 | 27879 | 27930 | 28002 | 27935 | 27938 | 27998 | 27958 | 27959 |
| | 9095 | 3804 | 22436 | 16838 | 20688 | 4511 | 25167 | | | | | |
| 419: | 14198 | 870 | 17932 | 16069 | 13851 | 13461 | 12701 | 18143 | 19044 | 9845 | 28935 | 12911 |
| | 9746 | 12378 | 26844 | 6279 | 3256 | 6492 | 1927 | 14725 | 5210 | 16911 | 19053 | 15107 |
| | 10053 | 10052 | 17902 | 18728 | 14921 | 21008 | 27672 | 15861 | 22004 | 25826 | 27570 | 30385 |
| | 24545 | 7602 | 11773 | 2106 | 25012 | 29882 | 5639 | 8632 | 19341 | 3676 | 13801 | 17969 |
| | 18455 | 7576 | 29000 | 30010 | 25127 | 8356 | 9350 | 10154 | 5237 | 9923 | 12796 | 8187 |
| | 29896 | 5402 | 643 | 24362 | 15888 | 14391 | 3369 | 3240 | 19906 | 23740 | 26063 | 12643 |
| | 4304 | 13273 | 11196 | 13304 | 30067 | 3274 | 7355 | 14440 | 5431 | 27525 | 12373 | 26674 |
| | 13025 | 10728 | 19975 | 19976 | 13989 | 13166 | 13167 | 28931 | 27390 | 2736 | 27297 | 485 |
| | 28745 | 7015 | 29168 | 3670 | 5562 | 12710 | 9729 | 16719 | 17020 | 1225 | 28194 | 28348 |
| | 22794 | 9021 | 15530 | 5874 | 9984 | 11413 | 1550 | 422 | 19877 | 19878 | 26951 | 17946 |
| | 2877 | 17097 | 18956 | 15056 | 21779 | 18201 | 2127 | 713 | 5162 | 15588 | 18293 | 7479 |
| | 10639 | 7629 | 27675 | 7385 | 23019 | 8438 | 20405 | 25592 | 15584 | 9862 | 19958 |
| 420: | 1766 | 25623 | 2634 | 8567 | 8546 | 8030 | 8035 | 28060 | 8033 | 13487 | 12426 | 12425 |
| | 27566 | 16382 | 13471 | 13472 | 27829 | 21056 | 7641 | 5010 | 7722 | 17728 | 13546 | 9391 |
| | 8454 | 11625 | 8039 | 26982 | 2216 | 28645 | 19396 | 6428 | 12857 | 6029 | 8927 | 26241 |
| | 28882 | 2058 | 17137 | 23307 | 23313 | 14163 | 30357 | 1758 | 1762 | 1765 | 22795 | 1007 |
| | 12696 | 20720 | 20722 | 21606 | 21600 | 20724 | 9877 | 8100 | 8623 | 9032 | 26511 | 15887 |
| | 17511 | 19373 | 11822 | 19998 | 25957 | 20063 | 20812 | 20816 | 20818 | 24166 | 23982 | 8056 |
| | 30201 | 2731 | 26481 | 8640 | 22623 | 518 | 24795 | | | | | |
| 421: | 17859 | 1238 | 22054 | 28433 | 14522 | 12713 | 2265 | 30161 | 7453 | 4765 | 16339 | 3623 |
| | 16249 | 30466 | 23897 | 24523 | 18199 | 12780 | 12018 | 8775 | 20575 | 9860 | 9828 | 17997 |
| | 22323 | 12760 | 6777 | 25696 | 8048 | 7233 | 7159 | 10567 | 11570 | 5422 | 13420 | 743 |

TABLE 8-continued

| PEP SEQ ID NO: | homolog SEQ ID NOs | | | | | | | | | | |
|---|---|---|---|---|---|---|---|---|---|---|---|
| | 20960 | 20777 | 13662 | 6471 | 6450 | 722 | 1999 | 22130 | 15016 | 24746 | 17989 | 21018 |
| | 18525 | 16321 | 25778 | 29549 | 4744 | 4911 | 15147 | 16008 | 14299 | 4655 | 18309 | 20204 |
| | 13162 | 27357 | 28445 | 29670 | 12438 | 2514 | 2700 | 25507 | 27408 | 21700 | 6258 | 15916 |
| | 23219 | 8612 | 21584 | 7769 | 21090 | 21432 | 24336 | 2356 | 30137 | 4195 | 24837 | 12189 |
| | 4171 | 20221 | 23536 | 26716 | 7664 | 11285 | 23505 | 6454 | 21901 | 13438 | 27127 | 6046 |
| | 28726 | 23456 | 15186 | 1641 | 24978 | 18008 | 19271 | 13956 | 24528 | 17271 | 1119 | 18682 |
| | 4177 | 14894 | 2489 | 29476 | 22053 | 1277 | 2172 | 26999 | 13676 | 22871 | 16889 | 8678 |
| | 12883 | 23881 | 9761 | 12855 | 20677 | 3738 | 22399 | 20134 | 18998 | 18171 | 2684 | 15899 |
| | 7332 | 29308 | 9846 | 23454 | 17170 | 1559 | 28849 | 2839 | 27226 | 11010 | 10112 | 1021 |
| | 29279 | 19520 | 19722 | 26879 | 28081 | 15983 | 17146 | 15924 | 5208 | 2143 | 4634 | 16484 |
| | 3406 | 25815 | 25097 | 16791 | 22937 | 9830 | 25112 | 1379 | 28559 | 28606 | 16292 | 16260 |
| | 16208 | 16320 | 8188 | 28196 | 5518 | 5513 | 11332 | 7484 | 24098 | 25192 | 11722 | 7295 |
| | 4070 | 3808 | 20017 | 21780 | 1418 | 3680 | 9910 | 7166 | 23057 | 22218 | 23084 | 9268 |
| | 11075 | 26038 | 12485 | 7431 | 18804 | 6947 | 8806 | 3674 | 28046 | 5006 | 28297 | 7847 |
| | 24808 | 19618 | 22706 | 21561 | 4782 | 24417 | 3843 | 24691 | 11449 | 9680 | 30005 | 10365 |
| | 4403 | 14746 | 20774 | 4849 | 29201 | 28648 | 20671 | 18342 | 23463 | 29918 | 24863 | 14394 |
| | 9080 | 25560 | 8423 | 7517 | 27591 | 30030 | 7571 | 29151 | 7460 | 3064 | 8500 | 8416 |
| | 18919 | 15655 | 22879 | 22882 | 14872 | 2032 | 28860 | 21021 | 11112 | 2577 | 10386 | 7462 |
| | 7356 | 9905 | 21034 | 29197 | 8891 | 6388 | 15308 | 29956 | 25999 | 24693 | 19760 | 18166 |
| | 14979 | 10427 | 18403 | 23159 | 5100 | 26531 | 26168 | 9132 | 29747 | 26986 | 7010 | 6925 |
| | 9803 | 26555 | 30057 | 7883 | 20362 | 13923 | 21199 | 17720 | 10376 | 13693 | 28462 | 5696 |
| | 15243 | 4681 | 11036 | 28713 | 23116 | 22490 | 18697 | 15953 | 16090 | 8882 | 29422 | 26513 |
| | 10652 | 10658 | 12898 | 14981 | 6819 | 823 | 17872 | 2674 | 19462 | 20810 | 2655 |
| | 17278 | 17299 | 29880 | 9890 | 17589 | 14931 | 19664 | 2181 | 15988 | 17595 | 11629 | 10661 |
| | 7177 | 12706 | 6147 | 6518 | 8191 | 28422 | 15040 | 11675 | 3972 | 3697 | 28043 | 5019 |
| | 689 | 19234 | 10006 | 7229 | 7695 | 3574 | 29895 | 19441 | 28177 | 28498 | 18428 | 15614 |
| | 3789 | 15573 | 29663 | 7406 | 22093 | 3093 | 27495 | 16461 | 8817 | 19093 | 18724 | 25322 |
| | 6607 | 14736 | 5953 | 21288 | 17280 | 10246 | 18588 | 18586 | 19908 | 19910 | 15765 | 26810 |
| | 19134 | 17663 | 17697 | 3638 | 21052 | 16371 | 21054 | 2935 | 15495 | 20728 | 22097 | 813 |
| | 5137 | 9972 | 18986 | 10167 | 27136 | 14751 | 15479 | 22618 | 405 | 27122 | 29583 | 15609 |
| | 7933 | 3355 | 24226 | 15048 | 13579 | 1887 | 8939 | 8964 | 13794 | 9157 | 24816 | 21858 |
| | 5885 | 22336 | 3805 | 3802 | 24169 | 2292 | 26734 | 26770 | 6657 | 13127 | 26043 | 12384 |
| | 16093 | 3544 | 14897 | 2567 | 27765 | 27766 | 27677 | 15125 | 20964 | 23705 | 23066 | 24145 |
| | 25943 | 24093 | 17443 | 7635 | 1827 | 22760 | 29245 | 18346 | 14261 | 16514 | 16482 | 16233 |
| | 16542 | 18557 | 9646 | 13061 | 28991 | 23979 | 2413 | 30304 | 24393 | 6062 | 867 | 1186 |
| | 8879 | 3327 | 2945 | 11059 | | | | | | | | |
| 422: | 866 | 7071 | 17930 | 870 | 17932 | 7072 | 16069 | 13851 | 13381 | 13461 | 13464 | 12701 |
| | 12702 | 8312 | 13470 | 8308 | 419 | 19755 | 18143 | 19044 | 9845 | 28935 | 27346 | 12911 |
| | 12908 | 9746 | 6906 | 12378 | 12755 | 26844 | 6279 | 3256 | 29096 | 6492 | 6491 | 1927 |
| | 1926 | 14725 | 14724 | 5210 | 5182 | 19053 | 16911 | 15107 | 10053 | 10052 | 17902 | 18728 |
| | 15861 | 21008 | 27672 | 14921 | 25826 | 22004 | 27570 | 30385 | 24545 | 17631 | 11773 | 2106 |
| | 29882 | 25012 | 8632 | 5639 | 19341 | 3676 | 8591 | 5630 | 13801 | 18455 | 17969 | 12282 |
| | 7576 | 29080 | 10256 | 30010 | 25127 | 9350 | 10154 | 5237 | 8356 | 9923 | 12796 | 8187 |
| | 29896 | 5402 | 643 | 678 | 24362 | 24361 | 15888 | 14391 | 15244 | 3240 | 19906 | 23741 |
| | 25136 | 23740 | 26062 | 26063 | 25138 | 12643 | 4304 | 3209 | 13273 | 13304 | 11196 | 13277 |
| | 13296 | 30067 | 3274 | 7355 | 1871 | 5431 | 5433 | 10593 | 12373 | 26674 | 13025 | 10728 |
| | 19975 | 19976 | 19969 | 18860 | 13989 | 13166 | 13167 | 28931 | 28928 | 2736 | 27390 | 27297 |
| | 26448 | 485 | 7015 | 28745 | 29168 | 3670 | 5562 | 12710 | 21159 | 25904 | 16719 | 28194 |
| | 1225 | 28348 | 22794 | 9021 | 15530 | 5874 | 9984 | 1486 | 11413 | 1550 | 26951 | 26948 |
| | 17946 | 17941 | 2877 | 2996 | 17097 | 17095 | 18956 | 818 | 15055 | 18335 | 21779 | 15056 |
| | 24735 | 24579 | 18201 | 2127 | 25041 | 713 | 5162 | 5181 | 15588 | 15582 | 18293 | 7479 |
| | 7474 | 10639 | 10640 | 7629 | 27675 | 7385 | 23019 | 23020 | 12990 | 8438 | 25592 | 20405 |
| | 15584 | 15585 | 9862 | 19958 | | | | | | | | |
| 423: | 15029 | 25307 | 9676 | 8311 | 26916 | 23959 | 11677 | 23081 | 2694 | 13387 | 5447 | 10573 |
| | 11670 | 13978 | 11123 | 26839 | 27158 | 3619 | 28393 | 16399 | 14284 | 11420 | 30182 | 18878 |
| | 10160 | 16007 | 26522 | 15577 | 10156 | 24813 | 10771 | 10742 | 26803 | 2343 | 2380 | 2382 |
| | 1591 | 2460 | 2383 | 2353 | 2462 | 2053 | 27103 | 26865 | 22418 | 18140 | 8068 | 27942 |
| | 26009 | 29347 | 26834 | 8774 | 15488 | 13383 | 15874 | 8921 | 12705 | 14118 | 14258 | 21153 |
| | 24198 | 28012 | 5588 | 16861 | 10216 | 23576 | 3923 | 6699 | 3918 | 3926 | 3920 | 20836 |
| | 22849 | 892 | 16183 | 27978 | 26550 | 9488 | 20021 | 16915 | 6824 | 30294 | 16762 | 8804 |
| | 7419 | 23008 | 25744 | 29149 | 14295 | 30146 | 25107 | 16558 | 19890 | 14319 | 4639 | 20402 |
| | 8947 | 5643 | 1147 | 11395 | 728 | 5293 | 4510 | 26624 | 12288 | 27309 | 15368 | 17961 |
| | 15252 | 23928 | 24860 | 11838 | 29987 | 14792 | 3414 | 11679 | 19671 | 2183 | 14230 | 13870 |
| | 13912 | 27989 | 7587 | 26711 | 14106 | 3481 | 14124 | 24519 | 26046 | 6594 | 30393 | 22818 |
| 424: | 28787 | 28026 | 26562 | 27850 | 3993 | 21457 | 13373 | 22737 | 25673 | 336 | 13510 | 1153 |
| | 27040 | 13055 | 17285 | | | | | | | | | |
| 425: | 14715 | 27077 | 7091 | 8238 | 15342 | 28311 | 28335 | 29231 | 9534 | 4494 | 13615 | 18789 |
| | 27725 | 1230 | 10455 | 804 | 9254 | 10865 | 12623 | 18172 | 22589 | 640 | 26535 | 13575 |
| | 8164 | 6881 | 25375 | 27163 | 27466 | 27305 | 29441 | 9966 | 628 | 26476 | 23339 | 23425 |
| | 23698 | 14548 | 21310 | 12160 | 5898 | 30372 | 17110 | 2245 | 22497 | 22275 | 20136 | 29114 |
| | 3433 | 19544 | 22006 | 16128 | 16917 | 10830 | 10600 | 18991 | 28811 | 1336 | 25859 | 8919 |
| | 13541 | 13587 | 27186 | 4947 | 3845 | 11723 | 27086 | 3520 | 15911 | 14958 | 14920 | 13075 |
| | 25073 | 24384 | 24215 | 8424 | 26449 | 23782 | 7578 | 24615 | 5515 | 12565 | 1052 | 20622 |
| | 9144 | 9083 | 30107 | 24035 | 11692 | 4715 | 26578 | 10028 | 19100 | 15396 | 12004 | 2277 |
| | 26427 | 22150 | 4990 | 17320 | 14898 | 4014 | 11890 | 10187 | 2273 | 19281 | 17315 | 1602 |
| | 25789 | 12947 | 23230 | 20113 | 8781 | 3902 | 3335 | 8931 | 22254 | 23950 | 15881 | 16378 |
| | 21068 | 18992 | 28385 | 24260 | 21185 | 10953 | 17209 | 4756 | 23880 | 12048 | 2515 | 6473 |
| | 2545 | 26896 | 667 | 13227 | 19734 | 29717 | 17470 | 5067 | 17620 | 1371 | 29876 | 5086 |

TABLE 8-continued

| PEP SEQ ID NO: | homolog SEQ ID NOs | | | | | | | | | | |
|---|---|---|---|---|---|---|---|---|---|---|---|
| | 29140 | 12846 | 11469 | 8066 | 16701 | 15123 | 17065 | 16699 | 19711 | 23152 | 28749 | 28891 |
| | 897 | 20121 | 27569 | 5843 | 22595 | 22600 | 26841 | 4709 | 4712 | 12337 | 22378 | 22374 |
| | 24033 | 2913 | 24701 | 14475 | 23715 | 26245 | 19991 | 7584 | 10643 | 15179 | 18396 | 7609 |
| | 23792 | 13602 | 7586 | 11956 | 19021 | 26545 | 15237 | 29474 | 19066 | 22629 | 22597 | 15821 |
| | 1174 | 1175 | 21504 | 21692 | 27022 | 27441 | 10473 | 24973 | 12482 | 20713 | 6929 | 10056 |
| | 2246 | 19651 | 27645 | 10303 | 24352 | 4478 | 17176 | 3654 | 2540 | 29431 | 22009 | 15070 |
| | 1261 | 25439 | 5968 | 7887 | 7727 | 12448 | 24300 | 15193 | 18608 | 30313 | 6505 | 613 |
| | 22166 | 17182 | 15820 | 23530 | 721 | 24333 | 10326 | 5506 | 9091 | 1357 | 3649 | 24309 |
| | 9988 | 19229 | 13908 | 24866 | 1512 | 2914 | 20798 | 20262 | 13907 | 13447 | 12842 | 13566 |
| | 6367 | 21312 | 19637 | 6549 | 5840 | 25058 | 18097 | 18571 | 15246 | 11060 | 27827 | 25710 |
| | 1091 | 21748 | 21747 | 3653 | 17000 | 12027 | 29642 | 30144 | 22522 | 15275 | 11882 | 9236 |
| | 28312 | 15527 | 18156 | 27362 | 22428 | 24687 | 5611 | 15499 | 19435 | 16504 | 7875 | 20945 |
| | 15534 | 24214 | 28466 | 28436 | 28715 | 21448 | 28469 | 22921 | 27957 | 10454 | 20564 | 1417 |
| | 15157 | 29858 | 20076 | 22634 | 25089 | 27558 | 8378 | 16523 | 4289 | 7819 | 22253 | 28208 |
| | 5308 | 18162 | 18114 | 14939 | 801 | 19072 | 7646 | 9780 | 29973 | 5857 | 5882 | 26190 |
| | 14988 | 17199 | 25151 | 28781 | 28804 | 24016 | 11569 | 13634 | 8363 | 10492 | 22387 | 13363 |
| | 17138 | 14970 | 25926 | | | | | | | | | |
| 426: | 30316 | 28341 | 20440 | 21403 | 28460 | 8764 | 5483 | 10239 | 21294 | 3625 | 20041 | 25161 |
| | 16037 | 29671 | 15602 | 15738 | 13680 | 4919 | 6243 | 23006 | 3034 | 752 | 8677 | 14314 |
| | 13422 | 1619 | 6262 | 6521 | 23305 | 17002 | 18373 | 1173 | 1149 | 11674 | 28125 | 22571 |
| | 22569 | 1752 | 28123 | 21437 | 1073 | 1072 | 5748 | 2955 | 27548 | 8337 | 6584 | 6580 |
| | 4722 | 6764 | 20583 | 706 | 8627 | 3362 | 14034 | 10533 | 10535 | 15608 | 16784 | 6496 |
| | 9194 | 29947 | 16882 | 29432 | 11684 | 1245 | 25870 | 1652 | 28681 | 7191 | 27632 | 29345 |
| | 3908 | 26214 | 18387 | 6769 | 6400 | 20414 | 26269 | 17674 | 16459 | 8262 | 15546 | 9173 |
| | 12354 | 29426 | 15949 | 5362 | 24788 | 8630 | 26833 | 19714 | 1878 | 16103 | 26526 | 14486 |
| | 10208 | 24594 | 20180 | 13753 | 3056 | 6467 | 20070 | 26719 | 13574 | 28110 | 11845 | 29110 |
| | 12541 | 29814 | | | | | | | | | | |
| 427: | 1205 | 1202 | 23043 | 18478 | 21335 | 24048 | 24042 | 12899 | 18378 | 18376 | 20455 | 6551 |
| | 19940 | 19978 | 19981 | 2128 | 18413 | 18415 | 16198 | 16668 | 3185 | 15855 | 9352 | 14616 |
| | 2960 | 2967 | 2966 | 4462 | 25905 | 11227 | 28186 | 984 | 13539 | 20758 | 20789 | 20750 |
| | 20753 | 20749 | 28534 | 25229 | 27701 | 17690 | 22452 | 24103 | 19988 | 21788 | 25087 | 19912 |
| | 21275 | 19982 | 19909 | 24881 | 24899 | 26679 | 18852 | 27639 | 12055 | 16381 | 1897 | 1894 |
| | 1892 | 20060 | 7377 | 10185 | 27612 | 27664 | 3919 | 27641 | 10110 | 28531 | 28470 | 2758 |
| | 4227 | 10669 | 24960 | 23679 | 11153 | 19321 | 30078 | 21051 | 17845 | 17557 | 1936 | 23577 |
| | 27609 | 28429 | 27692 | 20186 | 20188 | 20182 | 20177 | 20222 | 20179 | 20174 | 20216 | 20218 |
| | 27667 | 19872 | 26730 | 18303 | 18438 | 18412 | 22954 | 10396 | 9203 | 29169 | 12043 | 1965 |
| | 24374 | 25660 | 17724 | 29924 | 16729 | 20884 | 2141 | 19907 | 22922 | 27089 | 2063 | 26239 |
| | 19936 | 19119 | 21272 | 19915 | 19985 | 13259 | 19916 | 18368 | 18306 | 18331 | 18333 | 18338 |
| | 17515 | 18481 | 17665 | 16401 | 13021 | 7850 | 570 | | | | | |
| 428: | 9514 | 18208 | 27699 | 24672 | 695 | 1581 | 17502 | 19870 | 19688 | 17787 | 10946 | 18811 |
| | 24157 | 19726 | 17433 | 18211 | 27587 | 29573 | 574 | 576 | 11124 | 19880 | 5553 | 16146 |
| | 13361 | 825 | 17239 | 5348 | 376 | 9975 | | | | | | |
| 429: | 29272 | 16408 | 24394 | 21534 | 7305 | 25504 | 8552 | 18079 | 18052 | 19030 | 28248 | 16816 |
| | 24060 | 21344 | 372 | 1466 | 29462 | 29423 | 29420 | 29457 | 5650 | 27496 | | |
| 430: | 17468 | 17393 | 17389 | 17390 | 16815 | 13067 | 12931 | 11325 | 16679 | 8328 | 9249 | 3824 |
| | 11932 | 29725 | 21677 | 28810 | 13568 | 16519 | 17018 | 13170 | 24756 | 8004 | 30147 | 28329 |
| | 23718 | 13963 | 27073 | 2452 | 16177 | 27300 | 14029 | 30291 | 19914 | 14387 | 21586 | 30281 |
| | 21049 | 14678 | 4088 | 11967 | | | | | | | | |
| 431: | 6307 | 3233 | 20896 | 9887 | 26622 | 4960 | 4658 | 27322 | 28670 | 6575 | 7676 | 25783 |
| | 1426 | 12035 | 27335 | 14401 | 16385 | 27296 | 16425 | 13199 | 19424 | 11348 | 10680 | |
| 432: | 14667 | 22888 | 17013 | 13915 | 2925 | 12977 | 12675 | 17605 | 26291 | 5000 | 11907 | 1511 |
| | 27830 | 18555 | 7284 | 15187 | 10929 | 24838 | 8371 | 15946 | 8322 | 19594 | 4424 | 21192 |
| | 12206 | 20285 | 16940 | 24995 | 16946 | 29622 | 25643 | 29160 | 2942 | 13884 | 17117 | 20604 |
| | 22279 | 23664 | 10325 | 29846 | 15526 | 4557 | 7795 | 10008 | 23496 | 21495 | 11465 | 8089 |
| | 23533 | 8128 | 22340 | 27131 | 22562 | 2632 | 20012 | 2852 | 2822 | 23026 | 16348 | 10038 |
| | 20496 | 10775 | 21267 | 6404 | 6276 | 11703 | 3535 | 4554 | 5180 | 19347 | 854 | 22228 |
| | 21030 | 18594 | 23540 | 18642 | 16640 | 7007 | 21219 | 12820 | 20795 | 28225 | 12596 | 23093 |
| | 7052 | 10939 | 17912 | 4720 | 7729 | 1132 | 11961 | 16203 | 2290 | 21596 | 8725 | 12481 |
| | 13527 | 24777 | 20996 | 18559 | 1078 | 16928 | 11870 | 24078 | 25941 | 13975 | 13410 | 16065 |
| | 26929 | 28457 | 14649 | 24650 | 10198 | 29393 | 30143 | 20951 | 28853 | 3493 | 21315 | 18940 |
| | 23811 | 12737 | 26959 | 25378 | 5760 | 24588 | 7309 | 27680 | 23118 | 28100 | 26837 | 1288 |
| | 8754 | 16609 | 6974 | 19882 | 950 | 10136 | 13906 | 20299 | 2222 | 6219 | 4225 | 20616 |
| | 10333 | 3582 | 13413 | 28193 | 22074 | 20491 | 25961 | 16797 | 25977 | 12162 | 26811 | 10251 |
| | 21670 | 5907 | 8757 | 15621 | 15814 | 30089 | 18491 | 25493 | 25232 | 28527 | 9940 | 15033 |
| | 6789 | 19362 | 26832 | 29018 | 16333 | 25608 | 18330 | 4363 | 15127 | 13991 | 24467 | 16550 |
| 433: | 13586 | 26653 | 1211 | 21651 | 12022 | 7022 | 19757 | 29569 | 2997 | 3218 | 4850 | 5039 |
| | 28662 | 23364 | 9454 | 21001 | 26643 | 2073 | 2485 | 5532 | 25152 | 2326 | 3026 | 17909 |
| | 12902 | 6337 | 6395 | 25729 | 3630 | 17316 | 20626 | 25864 | 20141 | 8996 | 11264 | 18844 |
| | 2439 | 12006 | 20392 | 19335 | 10528 | 18253 | 29753 | 29029 | 7141 | 12472 | 22829 | 22392 |
| | 24916 | 25044 | 10577 | 25658 | 7656 | 23543 | 19748 | 15439 | 3460 | 16429 | 25244 | 11383 |
| | 3178 | 9684 | 8024 | 13697 | 12969 | 1800 | 17370 | 15570 | 26846 | 15654 | 6727 | 13647 |
| | 18740 | 2031 | 24059 | 15716 | 13114 | 22413 | 11257 | 29809 | 3525 | 26064 | 17001 | 11260 |
| | 5474 | 9100 | 18705 | 7045 | 25582 | 12968 | 13934 | 7045 | 16229 | 8102 | 2539 | 14525 |
| | 12334 | 29021 | 8155 | 27787 | 2430 | 28510 | 23504 | 2444 | 6502 | 19509 | 14681 | 12036 |
| | 21356 | 22862 | 29732 | 7184 | 16331 | 25968 | 1291 | 1269 | 20206 | 10897 | 13715 | 23473 |
| | 27212 | 27582 | 30392 | 7950 | 10490 | 8383 | 28561 | 28767 | 14041 | 7504 | 956 | 28731 |
| | 8392 | 29317 | 15261 | 13079 | 18879 | 18877 | 29327 | 3215 | 11731 | 11640 | 3881 | 3877 |
| | 3873 | 26505 | 18966 | 20107 | 24144 | 10349 | 17179 | 3512 | 3505 | 4812 | 20783 | 4742 |

TABLE 8-continued

| PEP SEQ ID NO: | homolog SEQ ID NOs | | | | | | | | | | |
|---|---|---|---|---|---|---|---|---|---|---|---|
| | 10253 | 12927 | 23474 | 15809 | 11004 | 21372 | 22045 | 9573 | 5245 | 27101 | 12822 | 13675 |
| | 13339 | 29874 | 4348 | 18265 | 25189 | 14287 | 13515 | 5969 | 24595 | 21046 | 2836 | 29639 |
| | 19902 | 18322 | 16979 | 22451 | 22391 | 10157 | 3223 | 17108 | 13403 | 7951 | 28632 | 3890 |
| | 10280 | 13736 | 26628 | 26963 | 14499 | 27812 | 15935 | 5122 | | | | |
| 434: | 14858 | 8871 | 2388 | 29193 | 23611 | 29343 | 15969 | 3408 | 5093 | 26787 | 9002 | 6519 |
| | 9143 | 17653 | 27755 | 29466 | 6232 | 3608 | 11358 | 11361 | 1254 | 15971 | 25586 | 30150 |
| | 28671 | 30162 | 1856 | 6784 | 8680 | 6054 | 12435 | 25468 | 24267 | 6090 | 17810 | 29384 |
| | 25428 | 24820 | 7303 | 19932 | 5951 | 11255 | 18631 | 21360 | 2946 | 21362 | 4654 | 28107 |
| | 6605 | 19931 | 23748 | 28575 | 13516 | 13519 | 1247 | 7513 | 12271 | 5985 | 5453 | 9951 |
| | 23296 | 25872 | 28950 | 20096 | 26412 | 12419 | 22978 | 27642 | 23608 | 28276 | 674 | 11249 |
| | 23350 | 11976 | 12001 | 14156 | 28285 | 29661 | 8658 | 25191 | 6043 | 7432 | 2118 | 3482 |
| | 11935 | 11939 | 28718 | 26871 | | | | | | | | |
| 435: | 15751 | 12169 | 15239 | 15929 | 26189 | 15900 | 23906 | 16887 | 12540 | 20889 | 14441 | 21704 |
| | 21676 | 13545 | 13492 | 27980 | 15688 | 23036 | 4892 | 12295 | 20500 | 3991 | 3945 | 29238 |
| | 2237 | 29105 | 28374 | 17908 | 14292 | 15115 | 15732 | 10955 | 23971 | 7986 | 22459 | 17962 |
| | 20020 | 22328 | 13357 | 3594 | 16689 | 22346 | 21444 | 18354 | 16734 | 6074 | 6816 | 6620 |
| | 8267 | 8178 | 5244 | 25917 | 29414 | 24598 | 824 | 24242 | 11712 | 25712 | 24715 | 22599 |
| | 14137 | 1053 | 4244 | 19514 | 2978 | 10289 | 29087 | 28834 | 9109 | 18405 | 23656 | 2850 |
| | 20632 | 20853 | 14621 | 7225 | 16586 | 4231 | 22270 | 2784 | 20857 | 21716 | 16695 | 28188 |
| | 14495 | 24469 | 16671 | 17896 | 25055 | 1375 | 21390 | 16442 | 8600 | 17234 | 15699 | 18742 |
| | 26263 | 26398 | 28320 | 29127 | 26400 | 21029 | 9971 | 21645 | 27577 | 26419 | 7025 | 10796 |
| | 11992 | 4326 | 10214 | 2221 | 24451 | 9329 | 15797 | 13644 | 16721 | 15943 | 21150 | 27748 |
| | 9850 | 12756 | 26739 | 9013 | 18025 | 9579 | 3723 | 2525 | 7944 | 15545 | 27260 | 762 |
| | 10551 | 11851 | 25402 | 5816 | 5959 | 5963 | 11441 | 7858 | 14233 | 9186 | 19677 | 2108 |
| | 20171 | 25345 | 1008 | 28748 | 28073 | 25902 | 6516 | 5265 | 16835 | 7259 | 27489 | 27484 |
| | 26410 | 2544 | 1668 | 9478 | 28876 | 9416 | 8991 | 15898 | 15807 | 30362 | 18777 | 19596 |
| | 10802 | 27691 | 17911 | 29983 | 1252 | 29903 | 15359 | 17051 | 24096 | 10904 | 4052 | 19449 |
| | 28227 | 24046 | 30332 | 20549 | 5103 | 12103 | 18923 | 22957 | 9111 | 14917 | 24695 | 18894 |
| | 1680 | 19563 | 19709 | 28772 | 17862 | 5036 | 6133 | 19859 | 18950 | 25894 | 22091 | 16880 |
| | 23175 | 6946 | 24953 | 26197 | 16245 | 30312 | 1742 | 21807 | 3593 | 18707 | 10847 | 29922 |
| | 17586 | 22427 | 3131 | 17609 | 4243 | 21802 | 13346 | 17538 | 27169 | 21393 | 21393 | 10263 |
| | 6930 | 11342 | 14500 | 17328 | 14503 | 17326 | 19129 | 8860 | 23051 | 23053 | 19595 | 6899 |
| | 14063 | 9994 | 16599 | 8079 | 9386 | 3626 | 6011 | 1901 | 10005 | 2508 | 3833 | 2727 |
| | 22316 | 22439 | 25992 | 23112 | 4523 | 3865 | 17168 | 28152 | 16258 | 30052 | 14089 | 23833 |
| | 966 | 5414 | 13058 | 16496 | 30350 | 15440 | 6125 | 21778 | 25751 | 7583 | 4067 | 14007 |
| | 23808 | 3291 | 6813 | | | | | | | | | |
| 436: | 28743 | 16580 | 16834 | 8593 | 9933 | 3230 | 27502 | 12572 | 12452 | 7671 | 30301 | 30190 |
| | 20166 | 10222 | 5692 | 9903 | 12874 | 30037 | 20309 | 11529 | 20004 | 21371 | 26141 | 22217 |
| | 21455 | 12017 | 3239 | 4147 | 3374 | 29961 | 10409 | 15819 | 22560 | 909 | 24291 | 27198 |
| | 28843 | 9248 | 15121 | 14344 | 5035 | 21019 | 15096 | 28579 | 7985 | 7631 | 20586 | 6973 |
| | 10171 | 7070 | 26342 | 24979 | 612 | 11600 | 1087 | 28446 | 22111 | 10434 | 27911 | 1686 |
| | 10892 | 15085 | 12829 | 16500 | 7633 | 10962 | 6095 | 27281 | 24640 | 13480 | 6844 | 7181 |
| 437: | 27723 | 4530 | 4561 | 5996 | 6561 | 27265 | 3876 | 5881 | 17755 | 18096 | 8944 | 19900 |
| | 18971 | 18960 | 18994 | 2864 | 2862 | 5061 | 17682 | 14938 | 14940 | 14944 | 26943 | 26861 |
| | 19086 | 4597 | 3083 | 8858 | 14023 | 19466 | 8886 | 17367 | 29465 | 7832 | 19071 | 9894 |
| | 28471 | 20261 | 15954 | 22612 | 22610 | 22653 | | | | | | |
| 438: | 16231 | 8527 | 24427 | 16494 | 23245 | 23271 | 12322 | 14082 | 12321 | 23243 | 6257 | 16309 |
| | 9449 | 4003 | 11697 | 11141 | 1172 | 18278 | 8801 | 28324 | 13460 | 19497 | 18891 | 21306 |
| | 10064 | 3661 | 29176 | 12129 | 28789 | 7632 | 22164 | 30327 | 5170 | 2321 | 23701 | 19543 |
| | 30045 | 9256 | 2894 | | | | | | | | | |
| 439: | 10346 | 18603 | 23885 | 13652 | 9175 | 18536 | 13700 | 6245 | 22789 | 19622 | 14498 | 24408 |
| | 22191 | 14417 | 22910 | 23910 | 2072 | 16138 | 14112 | 25002 | 22454 | 25878 | 8444 | 25302 |
| | 21271 | 4988 | 25900 | 1601 | 24221 | 27057 | 9216 | 10965 | 3383 | 26732 | 27190 | 3116 |
| | 11200 | 27744 | 13335 | 18970 | 12918 | 3012 | 15494 | 22942 | 30223 | 22293 | 28246 | 28244 |
| | 1265 | 17327 | 1421 | 10302 | 14910 | 6065 | 12687 | 17866 | 17957 | 22396 | 27972 | 5764 |
| | 4238 | 6979 | 4468 | 10259 | 23150 | 5405 | 28344 | 19453 | 3581 | 24255 | 8934 | 30181 |
| | 3198 | 22810 | 9827 | 23415 | 4925 | 8386 | 20191 | 1777 | 29750 | 29952 | 5195 | 25155 |
| | 27222 | 25791 | | | | | | | | | | |
| 440: | 12773 | 10744 | 27007 | 24376 | 14280 | 27625 | 17836 | 23138 | 27078 | 14316 | 12218 | 25743 |
| | 18082 | 4788 | 6886 | | | | | | | | | |
| 441: | 4509 | 26259 | 29760 | 23472 | 11198 | 27076 | 3262 | 6507 | 15178 | 16996 | 21932 | 12251 |
| | 8372 | 24476 | 19290 | 5080 | 15711 | 29081 | 25694 | 29597 | 3354 | 23050 | 16758 | 29935 |
| | 6107 | 2900 | 15219 | 1960 | 24898 | 28176 | 22447 | 5585 | 26079 | 16049 | 22377 | 29574 |
| | 24681 | 29289 | 11294 | 14961 | 22642 | 24789 | 15211 | 18091 | 22605 | | | |
| 442: | 8367 | 6864 | 12524 | 20258 | 2547 | 30153 | 14333 | 6312 | 5797 | 14892 | 12811 | 3222 |
| | 4007 | 28352 | 15723 | 8465 | 19840 | 20803 | 24946 | 3331 | 22830 | 4472 | 8957 | 22970 |
| | 26158 | 3251 | 9292 | 10270 | 2480 | 1321 | 18185 | 16968 | 6298 | 19777 | 4959 | 5834 |
| | 18110 | 7965 | 14822 | 18240 | 19154 | 13821 | 16977 | 4206 | 28210 | 15355 | 9517 | 16060 |
| | 26755 | 27815 | 6034 | 23493 | 4200 | 826 | 25552 | 4105 | 27433 | 28392 | 13728 | 18554 |
| | 13734 | 30455 | 30452 | 13731 | 20476 | 20411 | 21515 | 27155 | 9956 | 15002 | 6480 | 6362 |
| | 20227 | 26521 | 28901 | 24447 | 24986 | 13091 | 13072 | 17565 | 14590 | 23862 | 12052 | 2002 |
| | 9380 | 1899 | 11464 | 17311 | 27666 | 3502 | 3880 | 30334 | 29240 | 8511 | 7060 | 18584 |
| | 2755 | 17985 | 10141 | 11821 | 12465 | 10738 | 6254 | 24904 | 2639 | 28985 | 29136 |
| | 25807 | 22711 | 3439 | 10513 | 1250 | 23823 | 26967 | 4299 | 26218 | 30125 | 22784 | 15188 |
| | 6648 | 5359 | 12680 | 12088 | 26702 | 26701 | 26639 | 4221 | 2244 | 3899 | 22988 | 28951 |
| | 23620 | 27540 | 21636 | 27324 | 13874 | 6489 | 24288 | 3333 | 29400 | 9364 | 6638 | 6798 |
| | 5535 | 21283 | 8864 | 11272 | 15682 | 9557 | 8827 | 6223 | 29321 | 15771 | 25975 | 11631 |
| | 21357 | 23503 | 16608 | 25936 | 23575 | 5709 | 8692 | 9082 | 8690 | 11913 | 2726 | 4264 |

TABLE 8-continued

| PEP SEQ ID NO: | homolog SEQ ID NOs | | | | | | | | | | |
|---|---|---|---|---|---|---|---|---|---|---|---|
| | 17585 | 2351 | 676 | 23242 | 12174 | 17019 | 6360 | 10976 | 22461 | 4228 | 17644 | 17751 |
| | 18677 | 5490 | 10327 | 28657 | 22256 | 8143 | 23747 | 1904 | 29771 | 24665 | 8223 | 25399 |
| | 15704 | 27065 | 21382 | 2348 | 29390 | 12948 | 5682 | 22699 | 10408 | 19222 | 24698 | 24885 |
| | 14398 | 8544 | 21707 | 8901 | 18093 | 11520 | 21854 | 15853 | 8974 | 8391 | 23652 | 6637 |
| | 9047 | 28062 | 5315 | 23486 | 26636 | 28105 | 25555 | 26657 | 18509 | 11091 | 7075 | 17996 |
| | 1791 | 3859 | 22197 | 2691 | 15475 | 17854 | 16639 | 30356 | 18798 | 18770 | 18765 | 11805 |
| | 3174 | 11751 | 11406 | 684 | 12736 | 18606 | 10095 | 19895 | 18781 | 5482 | 4410 | 20156 |
| | 27217 | 9641 | 25562 | 29866 | 5145 | 4241 | 18691 | 10393 | 28993 | | | |
| 443: | 15900 | 15751 | 15929 | 26189 | 16887 | 20889 | 7980 | 13017 | 24338 | 24315 | 12585 | 13524 |
| | 23036 | 12295 | 3991 | 2237 | 29105 | 17908 | 11425 | 8460 | 8123 | 9031 | 20801 | 21161 |
| | 4787 | 5900 | 22459 | 17962 | 20020 | 13357 | 3594 | 21444 | 16734 | 6816 | 6620 | 5244 |
| | 8267 | 8178 | 29414 | 24598 | 6965 | 4922 | 29122 | 28155 | 1053 | 14137 | 18085 | 29087 |
| | 14621 | 2784 | 16695 | 20853 | 1260 | 17896 | 25055 | 16442 | 18742 | 15699 | 26263 | 9971 |
| | 26417 | 11992 | 26419 | 24451 | 15797 | 9850 | 16721 | 27748 | 21150 | 9579 | 18025 | 2525 |
| | 3723 | 7944 | 21545 | 27260 | 762 | 10551 | 11851 | 11441 | 6398 | 9186 | 2108 | 5265 |
| | 27489 | 9478 | 15898 | 15807 | 30362 | 18777 | 19596 | 27691 | 1252 | 15359 | 17051 | 4839 |
| | 4842 | 24695 | 1680 | 19563 | 2957 | 2962 | 27985 | 16880 | 6946 | 24953 | 26197 | 16245 |
| | 20502 | 20499 | 20470 | 30312 | 27948 | 12885 | 3379 | 6810 | 5540 | 20456 | 18124 | 5060 |
| | 18003 | 13201 | 7969 | 4342 | 24884 | 30103 | 30082 | 23051 | 23053 | 19595 | 14966 | |
| | 27988 | 5426 | 9422 | 8079 | 29927 | 25173 | 4523 | 27982 | 25080 | 26093 | 23156 | 17194 |
| | 25140 | 24032 | 11230 | 18381 | 23833 | 19925 | 26095 | 3237 | 28206 | 12469 | 7251 | 7059 |
| | 3629 | 25751 | 21778 | 6446 | 16561 | 16775 | 3291 | 10423 | 8415 | 8365 | 16557 | 11016 |
| 444: | 703 | 16986 | 10530 | 24696 | 29631 | 15216 | 19465 | 12205 | 2111 | 13009 | 733 | 3123 |
| | 5782 | 12717 | 22838 | 3301 | 7207 | 3177 | 1650 | 10162 | 12118 | 18359 | 22793 | 12486 |
| | 27776 | 663 | 5452 | 9594 | 21011 | 29500 | 24292 | 10637 | 19035 | 23055 | 9212 | 25016 |
| | 7139 | 24727 | 26715 | 26740 | 17536 | 11580 | 16466 | 28242 | 9045 | 14101 | 16469 | 13665 |
| | 26392 | 7824 | 27393 | 10521 | 20413 | 15589 | 19636 | 23467 | 5187 | 5184 | 27095 | 19483 |
| | 25993 | 3806 | 20544 | 4580 | 3739 | 23095 | 6653 | 9945 | 27764 | 6115 | 18456 | 13215 |
| | 14893 | 4321 | 16612 | 11020 | 25876 | 24618 | 20971 | 30299 | 27399 | 24167 | 24220 | 27674 |
| | 23909 | 29116 | 2454 | 22725 | 10075 | 6722 | 27143 | | | | | |
| 445: | 30054 | 9562 | 9529 | 9525 | 9566 | 9603 | 23232 | 9751 | 11028 | 6117 | 14648 | 4395 |
| | 22884 | 24631 | 21491 | 21653 | 4029 | 13588 | 30436 | 17233 | 11596 | 11194 | 9508 | 8431 |
| | 4484 | 12640 | 25503 | 18864 | 21979 | 11634 | 22280 | 6114 | 27302 | 3729 | 19968 | 20580 |
| | 22038 | 18324 | 18326 | 761 | 9516 | 15020 | 14996 | 17577 | 27784 | 19686 | 20530 | 29949 |
| | 13558 | 13626 | 20254 | 26352 | 20100 | 22776 | 21270 | 2907 | 19221 | 25572 | 29976 | 28066 |
| | 28112 | 28114 | 25506 | 25483 | 8868 | 13129 | 1944 | 25485 | 9569 | 7868 | 21107 | 4955 |
| | 14457 | 15310 | 17238 | 7103 | 21488 | 21487 | 7104 | 7108 | 14471 | 15941 | | |
| 446: | 24743 | 18890 | 20338 | 15579 | 24945 | 3403 | 11390 | 7926 | 3786 | | | |
| 447: | 13827 | 24653 | 2760 | 21851 | 26157 | 25150 | 12111 | 2562 | 20140 | 26647 | 15801 | 2390 |
| | 3532 | 9193 | 23744 | 25253 | 21177 | 3080 | 11263 | 452 | 13134 | 23306 | 9258 | 22014 |
| | 15200 | 15385 | 14210 | 2432 | 1137 | 20189 | 7975 | 21708 | 8011 | 12963 | 29490 | 18633 |
| | 28799 | 1182 | 5174 | 25735 | 25459 | 5789 | 30130 | 15317 | | | | |
| 448: | 2789 | 15523 | 18289 | 30198 | 24495 | 6772 | 654 | 15067 | 13394 | 28473 | 7794 | 12180 |
| | 5835 | 28884 | 3735 | 14624 | 10296 | 15431 | 21816 | 2139 | 13105 | | | |
| 449: | 20866 | 29212 | 14854 | 9418 | 29467 | 18050 | 11000 | 15581 | 6435 | 25384 | 19947 | 27875 |
| | 18498 | 13045 | | | | | | | | | | |
| 450: | 26090 | 24906 | 7328 | 16079 | 13640 | 1998 | 3987 | 14369 | 24547 | 10118 | 10168 | 19534 |
| | 14201 | 4351 | 29751 | 23972 | 19048 | 19124 | 19518 | 16929 | 12836 | 10980 | 5385 | 12514 |
| | 8603 | 21615 | 14006 | 11639 | 9621 | 29755 | 3278 | 9131 | 13564 | 783 | 18177 | 14122 |
| | 16367 | 23248 | 18197 | 16067 | 10484 | 27976 | 27790 | 10726 | 28360 | 7845 | 8361 | 7214 |
| | 7541 | 3978 | 10445 | 26641 | 12573 | 11417 | 1937 | 8810 | 18305 | 17353 | 26604 | 11764 |
| | 14422 | 27199 | 26491 | 13341 | 8502 | 7149 | 22354 | 27631 | 850 | 24218 | 22409 | |
| | 8455 | 30360 | 3313 | 24294 | 14091 | 12152 | 30220 | 23301 | 604 | 12792 | 28356 | 12273 |
| | 17439 | 5642 | 24682 | 2394 | 781 | 21304 | 19627 | 7391 | 21743 | 5612 | 2420 | 8426 |
| | 27392 | 19043 | 22515 | 29067 | 5266 | 8170 | 5679 | 6456 | 11093 | 8388 | 22771 | 8450 |
| | 17154 | 17655 | 21229 | 10695 | 22850 | 20714 | 3703 | 17981 | 27996 | 24666 | 29419 | 13898 |
| | 25251 | 2927 | 968 | 25866 | 11823 | 11437 | 11556 | 29559 | 28036 | 22558 | 28576 | 18030 |
| | 644 | 20487 | 13123 | 6229 | 21755 | 4019 | 11073 | 14826 | 8138 | 4868 | 5476 | 13751 |
| | 26764 | 24215 | 21989 | 8521 | 23457 | 22084 | 15037 | 29764 | 12464 | 14383 | 27005 | 11776 |
| | 28824 | 9025 | 18016 | 15103 | 18931 | 28602 | 8158 | 17472 | 1453 | 3416 | 1990 | 16594 |
| | 2573 | 20483 | 22565 | 23359 | 4684 | 14747 | 21853 | 24807 | 9107 | 9108 | 22028 | 22025 |
| | 22021 | 24031 | 21991 | 26569 | 29011 | 5830 | 3328 | 15130 | 15099 | 21719 | 26251 | 26252 |
| | 13720 | 2076 | 22740 | 24231 | 19986 | 21220 | 18601 | 2781 | 11918 | 4664 | 8250 | 28676 |
| | 18541 | 28331 | 28337 | 339 | 4767 | 28342 | 28339 | 5219 | 26295 | 4537 | 1807 | 15313 |
| | 11247 | 25153 | 12268 | 2308 | 4168 | 2771 | 29692 | 26107 | 29685 | 28833 | 9328 | 2456 |
| | 2455 | 2459 | 27366 | 2459 | 27370 | 13267 | 19730 | 9757 | 9762 | 1804 | 588 | |
| | 10917 | 27732 | 21183 | 2693 | 16543 | 21668 | 16222 | 29162 | 22592 | 7464 | 26199 | 15576 |
| | 6058 | 2248 | 16943 | 6613 | 18400 | 6406 | 28875 | 30169 | 21426 | 14657 | 11572 | 11571 |
| | 10874 | 15508 | 22276 | 22496 | 21391 | 21149 | 20099 | 21996 | 21999 | 14338 | 14342 | 14140 |
| | 14363 | 14341 | 15131 | 6669 | 995 | 21986 | 5549 | 14372 | 14890 | 14882 | 14886 | 14908 |
| | 30442 | 10627 | 13868 | 14633 | 10628 | 10603 | 9996 | 18761 | 17083 | 26475 | 9727 | 16415 |
| | 17048 | 28330 | 24234 | 25184 | 7849 | 29233 | 12077 | 18458 | 16866 | 6253 | 15009 | 21468 |
| | 22604 | 21893 | 16765 | 21349 | 10996 | 2998 | 16618 | 22757 | 11069 | 29828 | 10308 | 16323 |
| | 20432 | 26608 | 11347 | 18818 | 2720 | 22764 | 341 | 3311 | 28703 | 1361 | 548 | 8249 |
| | 30246 | 14879 | 25683 | 1195 | 26838 | 21940 | 16856 | 12346 | 24829 | 21523 | 8831 | 29982 |
| | 18688 | 11159 | 10760 | 21202 | 8264 | 28303 | 22043 | 25091 | 21992 | 8269 | 28346 | 13382 |
| | 24297 | 24316 | 13140 | 2970 | 22223 | 16540 | 763 | 16890 | 3910 | 16235 | 4535 | 4961 |

TABLE 8-continued

| PEP SEQ ID NO: | homolog SEQ ID NOs | | | | | | | | | | |
|---|---|---|---|---|---|---|---|---|---|---|---|
| | 11545 | 28378 | 28077 | 2792 | 23797 | 2309 | 14104 | 7723 | 27167 | 10108 | 12589 | 10780 |
| | 13561 | 10432 | 24018 | 30465 | 23985 | 23865 | 12964 | 15841 | 26552 | 12280 | | |
| 451: | 26090 | 24906 | 7328 | 16079 | 13640 | 1998 | 3987 | 14369 | 24547 | 10118 | 10168 | 19534 |
| | 14201 | 4351 | 29751 | 23972 | 19048 | 19124 | 19518 | 16929 | 12836 | 10980 | 5385 | 12514 |
| | 8603 | 21615 | 14006 | 11639 | 9621 | 29755 | 3278 | 9131 | 13564 | 783 | 18177 | 14122 |
| | 16367 | 23248 | 18197 | 16067 | 10484 | 27976 | 27790 | 10726 | 28360 | 7845 | 8361 | 7214 |
| | 7541 | 3978 | 10445 | 26641 | 12573 | 11417 | 1937 | 8810 | 18305 | 17353 | 26604 | 11764 |
| | 14422 | 27199 | 26491 | 13341 | 8502 | 7149 | 14121 | 22354 | 27631 | 850 | 24218 | 22409 |
| | 8455 | 30360 | 3313 | 24294 | 14091 | 12152 | 30220 | 23301 | 604 | 12792 | 28356 | 12273 |
| | 17439 | 5642 | 24682 | 2394 | 781 | 21304 | 19627 | 7391 | 21743 | 5612 | 2420 | 8426 |
| | 27392 | 19043 | 22515 | 29067 | 5266 | 8170 | 5679 | 6456 | 11093 | 8388 | 22771 | 8450 |
| | 17154 | 17655 | 21229 | 10695 | 22850 | 20714 | 3703 | 17981 | 27996 | 24666 | 29419 | 13898 |
| | 25251 | 2927 | 968 | 25866 | 11823 | 11437 | 11556 | 29559 | 28036 | 22558 | 28576 | 18030 |
| | 644 | 20487 | 13123 | 6229 | 21755 | 4019 | 11073 | 14826 | 8138 | 4868 | 5476 | 13751 |
| | 26764 | 24215 | 21989 | 8521 | 23457 | 22084 | 15037 | 29764 | 12464 | 14383 | 27005 | 11776 |
| | 28824 | 9025 | 18016 | 15103 | 18931 | 28602 | 8158 | 17472 | 1453 | 3416 | 1990 | 16594 |
| | 2573 | 20483 | 22565 | 23359 | 4684 | 14747 | 21853 | 24807 | 9107 | 9108 | 22028 | 22025 |
| | 22021 | 24031 | 21991 | 26569 | 29011 | 5830 | 3328 | 15130 | 15099 | 21719 | 26251 | 26252 |
| | 13720 | 2076 | 22740 | 24231 | 19986 | 21220 | 18601 | 2781 | 11918 | 4664 | 8250 | 28676 |
| | 18541 | 28331 | 28337 | 339 | 4767 | 28342 | 28339 | 5219 | 26295 | 4537 | 1807 | 15313 |
| | 11247 | 25153 | 12268 | 2308 | 4168 | 2771 | 29692 | 26107 | 29685 | 28833 | 9328 | 2456 |
| | 2455 | 2459 | 27366 | 27372 | 27370 | 13267 | 13269 | 9730 | 9757 | 9762 | 1804 | 588 |
| | 10917 | 27732 | 21183 | 2693 | 16543 | 21668 | 16222 | 29162 | 22592 | 7464 | 26199 | 15576 |
| | 6058 | 2248 | 16943 | 6613 | 18400 | 6406 | 28875 | 30169 | 21426 | 14657 | 11572 | 11571 |
| | 10874 | 15508 | 22276 | 22496 | 21391 | 21149 | 20099 | 21996 | 21999 | 14338 | 14342 | 14140 |
| | 14363 | 14341 | 15131 | 6669 | 995 | 21986 | 5549 | 14372 | 14890 | 14882 | 14886 | 14908 |
| | 30442 | 10627 | 13868 | 14633 | 10628 | 10603 | 9996 | 18761 | 17083 | 26475 | 9727 | 16415 |
| | 17048 | 28330 | 24234 | 25184 | 7849 | 29233 | 12077 | 18458 | 16866 | 6253 | 15009 | 21468 |
| | 22604 | 21893 | 16765 | 21349 | 10996 | 2998 | 16618 | 22757 | 11069 | 29828 | 10308 | 16323 |
| | 20432 | 26608 | 11347 | 18818 | 2720 | 22764 | 341 | 3311 | 28703 | 1361 | 548 | 8249 |
| | 30426 | 14879 | 25683 | 1195 | 26838 | 21940 | 16856 | 12346 | 24829 | 21523 | 8831 | 29982 |
| | 18688 | 11159 | 10760 | 21202 | 8264 | 28303 | 22043 | 25091 | 21992 | 8269 | 28346 | 13382 |
| | 24297 | 24316 | 13140 | 2970 | 22223 | 16540 | 763 | 16890 | 3910 | 16235 | 4535 | 4961 |
| | 11545 | 28378 | 28077 | 2792 | 23797 | 2309 | 14104 | 7723 | 27167 | 10108 | 12589 | 10780 |
| | 13561 | 10432 | 24018 | 30465 | 23985 | 23865 | 12964 | 15841 | 26552 | 12280 | | |
| 452: | 13827 | 24794 | 24653 | 2760 | 21851 | 26157 | 12111 | 25150 | 2562 | 16927 | 20140 | 2390 |
| | 15801 | 26647 | 11245 | 3532 | 9193 | 23744 | 25253 | 21177 | 3080 | 11263 | 15317 | 447 |
| | 21560 | 23306 | 9258 | 17954 | 22014 | 15200 | 25970 | 12414 | 8034 | 19378 | 21298 | 15385 |
| | 15384 | 14210 | 26968 | 8346 | 2432 | 1137 | 20189 | 7975 | 25141 | 8011 | 18633 | 28799 |
| | 12963 | 29490 | 1182 | 5174 | 25735 | 22547 | 13204 | 6963 | 18646 | 25459 | 5789 | 23252 |
| | 30130 | | | | | | | | | | | |
| 453: | 22309 | 16508 | | | | | | | | | | |
| 454: | 20066 | 8631 | 6983 | 6988 | 7348 | 17302 | 7353 | 2347 | 9889 | 23658 | 24193 | 16953 |
| | 19830 | 25103 | 21473 | 26882 | 28832 | 22567 | 14661 | 23064 | 4384 | 2368 | 20595 | 27093 |
| | 5979 | 23062 | 6031 | 14031 | 21060 | 15345 | 17493 | 13555 | 16552 | 6038 | 22502 | 19406 |
| | 11005 | 29928 | 13879 | 6299 | 9551 | 30298 | 12283 | 13468 | | | | |
| 455: | 12197 | 5083 | 22748 | 25233 | 21145 | 4018 | 2633 | 16102 | 12779 | 29833 | 11193 | 8821 |
| | 8822 | 5591 | 5978 | 7241 | 27069 | 19493 | 10625 | 6544 | 21805 | 23685 | 23663 |
| | 27510 | 27513 | 27515 | 25379 | 29072 | 846 | 1262 | 16659 | 23446 | 23314 | 2834 | 25292 |
| | 22709 | 8169 | 20003 | 21182 | 18200 | 2067 | 28820 | 18356 | 27543 | 19791 | 7792 | 12744 |
| | 4194 | 18884 | 2842 | 29496 | 8027 | 18247 | 19024 | 4805 | 8531 | 18422 | 20244 | 20210 |
| | 19630 | 27242 | 25821 | 6050 | 20022 | 17852 | 21434 | 19090 | | | | |
| 456: | 5713 | 5731 | 7666 | 23694 | 22911 | 18150 | 26649 | 2034 | 8001 | 30006 | 10177 | 4692 |
| | 14395 | 29033 | 29544 | 15443 | 10544 | 24797 | 10873 | 7935 | 29003 | 15255 | 4236 | 3050 |
| | 13865 | 21949 | 14356 | 1329 | 28334 | 11607 | 21180 | 26293 | 21077 | 16585 | 5701 | 3709 |
| | 27462 | 13332 | 14583 | 25043 | | | | | | | | |
| 457: | 21969 | 407 | 6567 | 2642 | 681 | 24237 | 27172 | 24706 | 5892 | 8105 | 22041 | 16218 |
| | 2316 | 4924 | 22112 | 26146 | 19293 | 8274 | 19356 | 14025 | 379 | 10900 | 18809 | 3477 |
| | 753 | 18266 | 26407 | 25408 | 380 | 21926 | 9209 | 19607 | 25045 | 14021 | | |
| 458: | 16744 | 4407 | 25100 | 21084 | 25750 | 22690 | 20467 | 9787 | 22694 | 20474 | 19088 | 14913 |
| | 14914 | 24851 | 21000 | 1213 | 16158 | 30234 | 4889 | 30041 | 30040 | 18311 | 6589 | 2008 |
| | 2276 | 29636 | 10560 | 16082 | 12880 | 12882 | 27184 | 3985 | 10180 | 12256 | 15752 | 3953 |
| | 22588 | 2670 | 5009 | 17129 | 8599 | 3657 | 11624 | 14128 | 727 | 11869 | 18500 | 14209 |
| | 19819 | 22815 | 20307 | 17323 | 25048 | 18179 | 1414 | 24660 | 24638 | 22963 | 17432 | 26842 |
| | 22880 | 2592 | 19847 | 20451 | 3055 | 10336 | 2910 | 22753 | 22754 | 13718 | 24605 | 2358 |
| | 4981 | 1851 | 12081 | 25037 | 17222 | 17221 | 19195 | 21936 | 16573 | 7414 | 9623 | 23310 |
| | 5178 | 29027 | 16016 | 25544 | 10442 | 21658 | 21659 | 28729 | 7026 | 26969 | 29301 | 26753 |
| | 12164 | 18602 | 1243 | 29091 | 3701 | 15406 | 8344 | 28267 | 6135 | 3561 | 10671 | 15878 |
| | 10750 | 10970 | 6970 | 23035 | 8118 | 17491 | 5018 | 12726 | 12942 | 14767 | 29257 | 27629 |
| | 25172 | 25170 | 7283 | 12727 | 24619 | 27552 | 16255 | 29256 | 28279 | 25594 | 876 | 27774 |
| | 17636 | 30055 | 4952 | 6912 | 6914 | 4950 | 26688 | 3371 | 3356 | 27012 | 15203 | 12615 |
| | 21483 | 11271 | 20441 | 29061 | 23791 | 1564 | 16732 | 8867 | 6163 | 28544 | 26455 | 17744 |
| | 12012 | 2253 | 26349 | 4803 | 4804 | 27446 | 17956 | 17091 | 17955 | 26563 | 25681 | 5047 |
| | 2835 | 16537 | 6565 | 7807 | 7176 | 6483 | 18151 | 3560 | 28942 | 27493 | 668 | 14152 |
| | 8834 | 29598 | 29340 | 6273 | 4878 | 1909 | 11746 | 11745 | 14903 | 26071 | 26700 | 13493 |
| | 27961 | 11683 | 21235 | 28009 | 11760 | 13876 | 17809 | 12752 | 10315 | 8005 | 12860 | 16240 |
| | 24121 | 19108 | 14075 | 27793 | 1494 | 30050 | 22237 | 732 | 6109 | 27507 | 16471 | 15948 |
| | 13484 | 9708 | 10477 | 19339 | 22137 | 18287 | 14289 | 25145 | 14303 | 22047 | 19644 | 2391 |

TABLE 8-continued

| PEP SEQ ID NO: | homolog SEQ ID NOs | | | | | | | | | | |
|---|---|---|---|---|---|---|---|---|---|---|---|
| | 23284 | 26180 | 1201 | 17522 | 7880 | 15095 | 23874 | 16577 | 2294 | 20130 | 14936 | 14915 |
| | 8994 | 25135 | 21336 | 29920 | 10839 | 11346 | 2350 | 14108 | 13633 | 15851 | 24552 | 27770 |
| | 27149 | 13108 | 25406 | 30425 | 27387 | 19343 | 18819 | 7131 | 24769 | 19476 | 21522 | 17365 |
| | 12929 | 12621 | 7081 | 19263 | 14881 | 9813 | 7973 | 9239 | 25883 | 11769 | 28879 | 27072 |
| 459: | 1392 | 27440 | 952 | 11231 | 20435 | 16441 | 9264 | 8684 | 20316 | 3765 | 21565 | 22449 |
| | 14297 | 27098 | 21009 | 26075 | 13940 | 15745 | 18825 | 24720 | 3267 | 20672 | 20701 | 3772 |
| | 29912 | 5984 | 21895 | 18957 | 22067 | 1830 | 18410 | 17473 | 3764 | 21358 | 24490 | 16843 |
| | 3480 | 8815 | 4317 | 10147 | 28888 | 21736 | 16935 | 17136 | 10010 | 13924 | 3604 | 23429 |
| | 14793 | 20512 | 13262 | 12013 | 12007 | 3937 | 11715 | 9034 | 24957 | 20209 | 23672 | 21633 |
| | 29710 | 10153 | 10301 | 1298 | 30398 | 1600 | 17050 | 23327 | 25040 | 4042 | 3785 | 6154 |
| | 9882 | 4288 | 17796 | 14231 | 23134 | 15162 | 22444 | 19275 | 11523 | 11779 | 9051 | 2667 |
| | 4649 | 4648 | 1499 | 20517 | 19837 | 12567 | 16221 | 6806 | 6472 | 773 | 27635 | 11542 |
| | 6829 | 29280 | 22140 | 11949 | 11952 | | | | | | | |
| 460: | 23201 | 17383 | 23224 | 26008 | 26005 | 9941 | 5941 | 17348 | 25254 | 25230 | 4414 | 5687 |
| | 10674 | 1801 | 2767 | 19184 | 19713 | 8809 | 601 | 25137 | 10779 | 26745 | 24818 | 8897 |
| | 1368 | 27623 | 30093 | 19413 | 28690 | 18037 | | | | | | |
| 461: | 2488 | 2490 | 2492 | 16114 | 16109 | 1842 | 2374 | 7721 | 16119 | 1863 | 25039 | 2379 |
| | 2376 | 16118 | 1861 | 2372 | 1843 | 1868 | 16155 | 16157 | 16159 | 2457 | 2461 | 28195 |
| | 28216 | 24571 | 24556 | 11512 | 9497 | 9502 | 9278 | 21661 | 10042 | 13872 | 1959 | 5069 |
| | 30433 | 3795 | 24649 | 23526 | 17615 | 13518 | 29873 | 26193 | 6169 | 7274 | 4943 | 9750 |
| | 17943 | 27097 | 11513 | 11965 | 11516 | 18895 | 12284 | 10013 | 10941 | 615 | 26596 | 24685 |
| | 3883 | 16089 | 27100 | 5943 | 21917 | 20253 | 13576 | 7539 | 20582 | 698 | 16187 | 2401 |
| | 2400 | 4092 | 16152 | 2337 | 2340 | 1866 | 16149 | 2342 | 2345 | 11604 | 19568 | 22680 |
| | 2889 | 21674 | | | | | | | | | | |
| 462: | 28452 | 28384 | 7106 | 11134 | 20318 | 6599 | 18866 | 24932 | 26345 | 16954 | 25858 | 26047 |
| | 6501 | 8305 | 13871 | 28850 | 25122 | 24370 | 8396 | 30331 | 28333 | 25796 | 6640 | 12891 |
| | 17285 | 6631 | 9286 | 5090 | 29297 | 1218 | 18883 | 1344 | 5464 | | | |
| 463: | 26045 | 30127 | 29320 | 26289 | 12924 | 11235 | 5935 | 10527 | 17821 | 630 | 29473 | 12869 |
| | 11451 | 5618 | 10027 | 14888 | 11990 | 24259 | 5720 | 780 | 9122 | 27531 | 18352 | 14061 |
| | 14010 | 13206 | 17734 | 13867 | 14560 | 17261 | 17144 | 11790 | 29913 | 9244 | 11170 | 24312 |
| | 4819 | 23638 | 12648 | 26815 | 19921 | 17384 | 7194 | 1019 | 1017 | 25228 | 25224 | 17767 |
| | 29602 | 5818 | 13327 | 1950 | 21814 | 6787 | 25734 | 26586 | 14652 | 25785 | 27175 | 14530 |
| | 30381 | 7252 | 14959 | 30282 | 4979 | 23724 | 6001 | 11024 | 7290 | | | |
| 464: | 15367 | 24282 | 29815 | 8366 | 819 | 4826 | 9906 | 8903 | 15845 | 24726 | 12243 | 13433 |
| | 2043 | 20438 | 18051 | 3857 | 2660 | 8084 | 15539 | 17178 | 14718 | 2092 | 3558 | 9493 |
| | 24848 | 7892 | 15086 | 25526 | 23930 | 30058 | | | | | | |
| 465: | 20805 | 12922 | 14821 | 25099 | 16808 | 23561 | 25115 | 19924 | 19858 | 30036 | 10807 | 17562 |
| | 17559 | 13375 | 13378 | 19173 | 19143 | 19138 | 19170 | 13380 | 19109 | 16611 | 28475 | 16515 |
| | 11072 | 13792 | 4888 | 7308 | 7306 | 7339 | 7337 | 6325 | 6321 | 7239 | 9620 | 5776 |
| | 18454 | 8853 | 18492 | 13237 | 6359 | 27246 | 5222 | 17478 | 16250 | 14573 | 14576 | 14602 |
| | 14599 | 14607 | 14614 | 14611 | 16303 | 7130 | 3624 | 2938 | 24066 | 1364 | 10344 | 8055 |
| | 11763 | 12901 | 26566 | 22412 | 19923 | 4023 | 25159 | 4893 | 3213 | 23466 | 27085 | 14216 |
| | 14507 | 25168 | 8796 | 5832 | 8091 | 27991 | 26781 | 17266 | 10209 | 1347 | 7032 | 27523 |
| | 19861 | 19863 | 19926 | 25579 | 15446 | 30369 | 2973 | 18544 | 24922 | 21575 | 30296 | 11175 |
| | 11752 | 28465 | 6888 | 11296 | 18715 | 27288 | 16176 | 29939 | 2236 | 27166 | 20256 | 1533 |
| | 29617 | 8182 | 4467 | 1441 | 28304 | 1107 | 10964 | 10352 | 19316 | 15371 | 25916 | 17254 |
| | 13035 | 15081 | 12315 | 25001 | 26950 | 25641 | 18276 | 3069 | 21746 | 27359 | 13083 | 25323 |
| | 8988 | 17953 | 705 | 17263 | 29051 | 25622 | 30273 | 21798 | 9886 | 18577 | 29842 | 29346 |
| | 9571 | 16738 | 8098 | 13661 | 23941 | 28640 | 8842 | 5528 | 1458 | 15064 | 2712 | 8598 |
| | 12718 | 22843 | 3848 | 19776 | 19901 | 19899 | 25119 | 18720 | 14060 | 21819 | 1461 | 24111 |
| | 8925 | 19891 | 19894 | 16276 | 1446 | 6854 | 21398 | 24699 | 24222 | 23460 | 20936 | 4995 |
| | 14002 | 26439 | 19176 | 17864 | 9545 | 7929 | 4591 | 14774 | 25731 | 17634 | 7345 | 7350 |
| | 26023 | 26027 | 15925 | 9411 | 14829 | 10453 | 29997 | 14801 | 5479 | 5477 | 14857 | 25218 |
| | 9564 | 12476 | 20797 | 5125 | 6667 | 28570 | 22388 | 16525 | 25779 | 12682 | 17030 | 26024 |
| | 25988 | 26019 | 17486 | 25989 | 25990 | 26021 | 26056 | 25986 | 18092 | 13750 | 1705 | 30145 |
| | 9421 | 28825 | 13043 | 10654 | 25972 | 13240 | 22075 | 27963 | 12518 | 2179 | 29108 | 27888 |
| | 17849 | 17820 | 17851 | 17816 | 17844 | 11955 | 17848 | 17814 | 4789 | 15859 | 4784 | 4753 |
| | 4783 | 4785 | 28898 | 11378 | 9600 | 13882 | 15012 | 14989 | 14987 | 15013 | 14983 | 10193 |
| | 9453 | 9409 | 8209 | 23604 | 15400 | 10184 | 18398 | 10206 | 17942 | 13948 | 26377 | 6187 |
| | 6664 | 6574 | 10958 | | | | | | | | | |
| 466: | 9833 | 10948 | 27731 | 11438 | 8716 | 8587 | 20505 | 29173 | 12404 | 17922 | 9506 | 8836 |
| | 26632 | 12107 | 26223 | 1941 | | | | | | | | |
| 467: | 3744 | 2450 | 26907 | 24268 | 6387 | 21543 | 27201 | 3273 | 475 | 25458 | 8487 | 4208 |
| | 17673 | 26773 | 23524 | 5099 | 1386 | 5956 | 3486 | 23059 | 30021 | 20480 | 18160 | 18918 |
| | 18033 | 25273 | | | | | | | | | | |
| 468: | 29430 | 14714 | 28230 | 1782 | 14011 | 27396 | 5339 | | | | | |
| 469: | 16873 | 25672 | 15458 | 2920 | 2728 | 1220 | 8483 | 17024 | 20028 | 11789 | 14581 | 6962 |
| | 14566 | 6780 | 10497 | 18752 | 15596 | 7590 | 14877 | 24206 | 3031 | 9852 | 8813 | 25593 |
| | 2133 | 21408 | 5993 | 7816 | 1485 | 23125 | 17967 | 19580 | 11617 | 29950 | 1964 | 13535 |
| | 7873 | 1700 | 25906 | 27047 | 3109 | 21870 | 22860 | 3951 | 13040 | 16584 | 14426 | 18304 |
| | 13505 | 14575 | 3047 | 26072 | 13607 | 6818 | 2339 | 15046 | 13231 | 11155 | 8634 | 21648 |
| | 19697 | 14033 | 3695 | 19659 | 7790 | 10350 | 30202 | 30173 | 15759 | 21307 | 16088 | 15050 |
| | 29904 | 4276 | 14093 | 11685 | 9214 | 857 | 10093 | 8047 | 11053 | 1895 | 4951 | 9337 |
| | 25914 | 11817 | 11203 | 24772 | 24834 | 20533 | 6853 | 14954 | 19965 | 25009 | 20267 | 7919 |
| | 6720 | 28669 | 10416 | 4564 | 4548 | 22203 | 22633 | 22630 | 14275 | 15521 | 9359 | 14354 |
| | 5860 | 11606 | 5856 | 12897 | 999 | 24729 | 12418 | 27660 | 5646 | 4764 | 18470 | 30417 |
| | 1189 | 1688 | 9661 | 30170 | 24583 | 24527 | 20152 | 8115 | 16262 | 25419 | 26123 | 15518 |
| | 22544 | 16437 | 12809 | 6172 | 10896 | 29571 | 5756 | 15816 | 10947 | 13903 | 25047 | 12762 |

TABLE 8-continued

| PEP SEQ ID NO: | homolog SEQ ID NOs | | | | | | | | | | |
|---|---|---|---|---|---|---|---|---|---|---|---|
| | 1419 | 8259 | 18553 | 16718 | 29881 | 12446 | 14386 | 18195 | 9265 | 15463 | 14948 | 19151 |
| | 26404 | 26568 | 5361 | 8368 | 26541 | 8689 | 5994 | 10932 | 16196 | 7218 | 22411 | 7126 |
| | 4340 | 16226 | 15830 | 17244 | 18927 | 11252 | 4651 | 1527 | 29455 | 29211 | 1718 | 29888 |
| | 23402 | 27203 | 1140 | 17025 | 29313 | 25203 | 27384 | 11267 | 14067 | 15004 | 18433 | 28130 |
| | 21635 | 1457 | 19207 | 10986 | 14070 | 13770 | 19606 | 27889 | 29378 | 29163 | 30302 | 17445 |
| | 3879 | 6439 | 5119 | 25676 | 2554 | 9067 | 6426 | 3320 | 858 | 19522 | 23558 | 25517 |
| | 25543 | 3398 | 17672 | 17588 | 18395 | 18393 | 17554 | 17622 | 17659 | 17551 | 28516 | 8929 |
| | 11986 | 20844 | 28512 | 3782 | 24943 | 10076 | 1249 | 30461 | 5451 | 25647 | 16875 | 4259 |
| | 1156 | 9135 | 15348 | 29495 | 21381 | 30038 | 30133 | 26467 | 2180 | 3897 | 8197 | 9243 |
| | 12254 | 23856 | 3634 | 10356 | 13042 | 10165 | 5990 | 11909 | 22525 | 5883 | 12983 | 24350 |
| | 19164 | 4224 | 7398 | 6610 | 7726 | 29557 | 20165 | 1257 | 1221 | 22579 | 9510 | 6560 |
| | 27739 | 10111 | 20005 | 11991 | 9437 | 16683 | 9431 | 701 | 7408 | 18332 | 19698 | 19474 |
| | 22934 | 23815 | 24314 | 19083 | 24047 | 13962 | 16440 | 17202 | 17175 | 16541 | 9468 | 27887 |
| | 988 | 29910 | 22209 | 13074 | 4047 | 6656 | 13329 | 22189 | 26333 | 13077 | 5151 | 8562 |
| | 11947 | 12765 | 13008 | 1045 | 29454 | 21234 | 27837 | 25093 | 22281 | 5399 | 24382 | 25352 |
| | 23626 | 16851 | 3427 | 7600 | 3518 | 2777 | 10977 | 23551 | 15202 | 27262 | 18511 | 20454 |
| | 26958 | 2990 | 25620 | 8561 | 17718 | 17761 | 8331 | 29962 | 7603 | 8538 | 25241 | 18032 |
| | 18042 | 2329 | 19041 | 11662 | 29586 | 28661 | 18523 | 18497 | 18056 | 7497 | 758 | 6311 |
| | 3195 | 16630 | 15553 | 21809 | 28814 | 11392 | 28345 | 17873 | 22891 | 3413 | 5446 | 21187 |
| | 21059 | 17392 | 13230 | 14310 | 25442 | 17453 | 29069 | 6194 | 18181 | 24627 | 24597 | 12030 |
| | 27412 | 10536 | 6692 | 22997 | 5101 | 29651 | 16078 | 21617 | 14348 | 9403 | 25722 | 25013 |
| | 24988 | 6236 | 28169 | 29641 | 4623 | 25258 | 26524 | 8968 | 14651 | 18839 | 5130 | 5690 |
| | 24709 | 10506 | 11668 | 19887 | 14443 | 18623 | 19994 | 9066 | 11064 | 28970 | 10838 | 27657 |
| | 29353 | 8576 | 4060 | 12604 | 9332 | 14088 | 15142 | 23625 | 13684 | 29167 | 14208 | 17255 |
| | 16837 | 23853 | 22395 | 22373 | 8621 | 1194 | 16942 | 20696 | 23619 | 9410 | 17440 | 22288 |
| | 24562 | 15990 | 2435 | 27045 | 19807 | 21524 | 25176 | 25597 | 26483 | 19055 | 26599 | 29954 |
| | 1733 | 3453 | 8942 | 19139 | 25262 | 28205 | 13959 | 2466 | 23563 | 23535 | 23938 | 1106 |
| | 26394 | 27432 | 15335 | 23743 | 30073 | 25540 | 25509 | 788 | 16908 | 22285 | 4058 | 23356 |
| | 16019 | 9448 | 13342 | 13320 | 4398 | 5838 | 808 | 16813 | 11977 | 30287 | 2318 | 29144 |
| | 25946 | 26119 | 29817 | 21184 | 22289 | 18170 | 4310 | 5324 | 17550 | 1349 | 12618 | 11468 |
| | 11595 | 8061 | 15325 | 9505 | 22350 | 16335 | 20449 | 2163 | 852 | 2733 | 18301 | 17686 |
| | 13850 | 12974 | 4897 | 5048 | 15813 | 10685 | 15928 | 12455 | 29570 | 20665 | 15052 | 26244 |
| 470: | 12633 | 22272 | 6939 | 5436 | 6903 | 19289 | 12073 | 4246 | 11239 | 11220 | 5207 | 17109 |
| | 24162 | 21590 | 19286 | 5425 | 5430 | 28756 | 5610 | 28547 | 30375 | 21508 | 15517 | 23879 |
| | 24168 | 15269 | 22766 | 30444 | 5774 | 2159 | 22995 | 14625 | 22961 | 27546 | 16625 | 25748 |
| | 3774 | 23778 | 18896 | 29115 | 22848 | 6662 | 15338 | 18141 | 14813 | 4311 | 12188 | 4186 |
| | 17651 | 16654 | 22596 | 24543 | 24139 | 24171 | 13070 | 14145 | 15047 | 9867 | 22339 | 6261 |
| | 7342 | 29017 | 8122 | 25903 | 12863 | 29221 | 7811 | 21016 | 20259 | 12960 | 24163 | 23831 |
| | 24134 | 3722 | 25962 | 3343 | 17871 | 18224 | 24138 | 13856 | 9840 | 17246 | 18426 | 5864 |
| | 29945 | 28973 | 9848 | 5133 | 10174 | 26116 | 16948 | 21378 | 855 | 19993 | 30218 | 11003 |
| | 8090 | 28428 | 12644 | 14159 | 4657 | 7703 | 7704 | 24137 | 16308 | 14049 | 13022 | 13027 |
| | 12177 | 2556 | 7496 | 13569 | 884 | 18847 | 16724 | 13023 | 2419 | 28613 | 14144 | 3276 |
| | 26725 | 23143 | 23690 | 23691 | 10724 | 2410 | 20847 | 6017 | 26851 | 16062 | 19848 | 10284 |
| | 16302 | 7117 | 15902 | 16224 | 27646 | 13245 | 16310 | 5202 | 15607 | 19751 | 10030 | 16301 |
| | 16282 | 5225 | 7893 | 7921 | 7923 | 1983 | 17040 | 12399 | 12402 | 12401 | 12397 | 12398 |
| | 9089 | 9591 | 11778 | 30113 | 13024 | 16120 | 6482 | 13019 | 13004 | 26633 | 6479 | 26162 |
| | 20447 | 21352 | 23855 | 993 | 14542 | 2101 | 992 | 13020 | 5205 | 6181 | 11536 | 13905 |
| | 14825 | 24913 | 24331 | 16312 | 9484 | 20036 | 24913 | 14812 | 20073 | 1039 | 2389 | 2274 |
| | 16607 | 29034 | 16307 | 21350 | 29213 | 7738 | 9401 | 30222 | 7652 | 19703 | 24790 | 21351 |
| | 1082 | 3958 | 5534 | 20602 | 16304 | 4223 | 29001 | 16931 | 24164 | 9476 | 19512 | 19513 |
| | 5233 | 8163 | 28865 | 27974 | 13483 | 9874 | 13645 | 27614 | 15344 | 28778 | 10055 | 10085 |
| | 908 | 23139 | 26856 | 14272 | 27905 | 28728 | 13538 | 5203 | 5175 | 9222 | | |
| 471: | 22195 | 30152 | 6215 | 18310 | 30176 | 15008 | 9053 | 20909 | 11090 | 13937 | 29492 | 23498 |
| | 9540 | 22473 | 7063 | 15879 | 22002 | 1784 | 26042 | 21862 | 22104 | 20425 | 18226 | 17435 |
| | 17496 | 6569 | 19294 | 13823 | 4369 | 21849 | 9672 | 23557 | 13834 | 9321 | 5013 | 17783 |
| | 23639 | 30253 | 21258 | 18100 | 18203 | 23366 | 1867 | 29161 | 7090 | 8065 | 5912 | 21906 |
| | 27553 | 20415 | 22173 | 9336 | 3393 | 597 | 2428 | 19220 | 28235 | 23451 | 8008 | 20477 |
| | 8963 | 4593 | 10304 | 28707 | 16373 | 1451 | 1649 | 24524 | 23177 | 2929 | 27941 | 19444 |
| | 18785 | 19253 | 16493 | 19416 | 20332 | 6876 | 13131 | 10202 | 8699 | 24504 | 10090 | 15533 |
| | 7826 | 16346 | 22825 | 3442 | 12372 | 6892 | 7068 | 29938 | 13101 | 29032 | 15744 | 24108 |
| | 24491 | 8940 | 20067 | 7670 | 16960 | 6558 | 20509 | 5537 | 30330 | 16325 | 11892 | 900 |
| | 24379 | 18788 | 18563 | 29104 | 4890 | 9327 | 8618 | 3255 | 16033 | 25747 | 3633 | 17301 |
| | 28400 | 8097 | 24192 | 2272 | 5220 | 7448 | 24170 | 6248 | 1783 | 10060 | 22564 | 5407 |
| | 16030 | 6997 | 2224 | 12460 | 21439 | 23198 | 2414 | 18351 | 30061 | 3603 | 21954 | 26188 |
| | 2015 | 4725 | 18641 | 6042 | 26953 | 16528 | 1292 | 23424 | 30419 | 915 | 14133 | 16667 |
| | 13532 | 9233 | 23431 | 14659 | 29349 | 13674 | 998 | 3220 | 29610 | 22704 | 21923 | 27232 |
| | 16230 | 17364 | 14469 | 28827 | 26985 | 7838 | 20249 | 13966 | 13272 | 7911 | 4800 | 22133 |
| | 26192 | 24647 | 27313 | 13818 | 25557 | 13638 | 17495 | 15507 | 26227 | 19646 | 24766 | 8950 |
| | 16865 | 27760 | 28258 | 26805 | 25529 | 25465 | 22945 | 6063 | 6587 | 28808 | 6247 | 16538 |
| | 6524 | 12656 | 2663 | 25855 | 21840 | 29993 | 27653 | 21451 | 28266 | 8983 | 1299 | 10274 |
| | 4886 | 11987 | 3436 | 18214 | 29516 | 7231 | 24843 | 19829 | 21657 | 20943 | 2763 | 28674 |
| | 29403 | 8032 | 20989 | 7748 | 19920 | 4818 | 1439 | 13349 | 10552 | 13489 | 26254 | 19708 |
| | 15937 | 19611 | 18759 | 19661 | 30448 | 2504 | 1855 | 14304 | 16161 | 14794 | 27687 | 918 | 22692 |
| | 20085 | 5459 | 10458 | 18793 | 7582 | 4992 | 7411 | 12999 | 20450 | 1903 | 23661 | 23637 |
| | 9363 | 26777 | 4504 | 9414 | 19764 | 12316 | 24423 | 20929 | 26737 | 6860 | 29546 | 9742 |
| | 8220 | 4128 | 28979 | 28018 | 17279 | 19419 | 8050 | 6749 | 26314 | 23455 | 21876 | 22644 |
| | 20424 | 23606 | 8564 | 23299 | 23267 | 23362 | 23336 | 10269 | 22675 | 23589 | 26780 | 23610 |
| | 26749 | 26752 | 19407 | 26778 | 16533 | 18291 | 3340 | 22005 | 20418 | 29511 | 16025 | 26731 |

TABLE 8-continued

| PEP SEQ ID NO: | homolog SEQ ID NOs | | | | | | | | | | |
|---|---|---|---|---|---|---|---|---|---|---|---|
| | 28962 | 20199 | 29688 | 8236 | 27950 | 27465 | 11943 | 11493 | 28696 | 9754 | 13165 | 25873 |
| | 28209 | 835 | 24845 | 3447 | 5559 | 10898 | 9504 | 7751 | 5357 | 26525 | 29818 | 13252 |
| | 13804 | 25753 | 16100 | 4034 | 12595 | 24263 | 14146 | 18949 | 7005 | 7898 | 25294 | 6499 |
| 472: | 27556 | 7298 | 2699 | 2702 | 21764 | 26703 | 28272 | 933 | 25223 | 20176 | 2115 | 8738 |
| | 7560 | 22098 | 12859 | 26875 | 27530 | 30084 | 12326 | | | | | |
| 473: | 1966 | 1962 | 19645 | 2659 | 22951 | 7955 | 17023 | 3046 | 15490 | 23268 | 7909 | 10931 |
| | 9358 | 24015 | 7511 | 24796 | 28896 | 3334 | 20294 | 29399 | 9729 | 1315 | 12080 | 12690 |
| | 18145 | 6120 | 14300 | 5798 | 24062 | 15082 | 18474 | 10392 | 20038 | 28782 | 27211 | 27210 |
| | 16534 | 23675 | 25578 | 25574 | 11754 | 11501 | 13393 | 5742 | 6310 | 17106 | 2424 | 22017 |
| | 6611 | 28211 | 17544 | 28373 | 1932 | 8904 | 28621 | 9362 | 8894 | 18421 | 2186 | 8390 |
| | 11593 | 23976 | | | | | | | | | | |
| 474: | 7357 | 21359 | 8847 | 14322 | 27450 | 6412 | 18367 | 3895 | 23298 | 1735 | 9395 | 790 |
| | 1632 | 5157 | 10982 | 7522 | 5934 | 6755 | 15043 | 702 | 5707 | 16981 | | |
| 475: | 3744 | 2450 | 26907 | 24268 | 6387 | 21543 | 27201 | 25458 | 8487 | 4208 | 17673 | 6162 |
| | 467 | 21400 | 10103 | 26773 | 23524 | 1386 | 5099 | 3486 | 23059 | 30021 | 20480 | 18160 |
| | 18918 | 18033 | 25273 | 3273 | | | | | | | | |
| 476: | 27272 | 12345 | 3614 | 29499 | 10273 | 17627 | 27894 | 21679 | 19957 | 25636 | 14105 | 23973 |
| | 22438 | 23520 | 3033 | 29083 | 24228 | 7931 | 2119 | 28793 | 7454 | 666 | 13512 | 16877 |
| | 29640 | 24014 | 15267 | 17919 | 18018 | 8307 | 1348 | 5027 | 7278 | 26242 | 27881 | 17269 |
| | 10091 | 15877 | 20047 | 3998 | 11519 | 27820 | 11364 | 9296 | 30371 | 28924 | 7745 | 28515 |
| | 16257 | 6234 | 4854 | 23517 | 4861 | 4858 | 27270 | 27266 | 9307 | 27264 | 12149 | |
| 477: | 21573 | 6136 | 6726 | 1002 | 14014 | 24915 | 6875 | 17885 | 17296 | 1780 | 14580 | 21574 |
| | 5809 | 23106 | 15893 | 28179 | 28204 | 28200 | 23235 | 28239 | 8085 | | | |
| 478: | 19911 | 2933 | 12176 | 5732 | 5566 | 22181 | 894 | 19342 | 4738 | 27202 | 8172 | 20527 |
| | 20835 | 13886 | 18863 | 10895 | 30148 | 6550 | 16993 | 17604 | 10705 | 12703 | 25457 | 26504 |
| | 20609 | 14506 | 16453 | 25435 | 22687 | 22745 | 15565 | 28365 | 8246 | 26226 | 22781 | 22609 |
| | 28074 | 10378 | 25187 | 20593 | 10975 | 29843 | 28154 | 30166 | 25360 | 29090 | 25810 | 24964 |
| | 7645 | 29316 | 7379 | 11901 | 25060 | 20120 | 25382 | 22811 | 19983 | 25469 | 12906 | 16564 |
| | 16601 | 15729 | 5105 | 13643 | 8303 | 25194 | 9769 | 15291 | 17892 | 16383 | 3415 | 22356 |
| | 21682 | 4193 | 18106 | 7989 | 22804 | 19305 | 28115 | 25199 | 13138 | 27283 | 26870 | 12445 |
| | 2451 | 14975 | 12959 | 23717 | | | | | | | | |
| 479: | 23860 | 12429 | 3776 | 14164 | 24870 | 10068 | 13531 | 9524 | 10508 | 16691 | 13768 | 10861 |
| | 26460 | 17256 | 27208 | 13814 | 16726 | 26667 | 10023 | 10054 | 9078 | 18969 | 9074 | 18965 |
| | 9043 | 18963 | 9039 | 19494 | 13757 | 17613 | 13758 | 13798 | 13763 | 27205 | 27206 | 26682 |
| | 10233 | 13810 | 27848 | 15447 | 13806 | 6552 | 17603 | 16684 | 15856 | 15986 | 11356 | 9077 |
| | 1929 | 7466 | 1069 | 28585 | 29621 | 740 | 12011 | 14644 | 14666 | 12083 | 3261 | 14690 |
| | 10918 | 24952 | 9964 | 11423 | 4560 | 6851 | 4501 | 17463 | 28611 | 657 | 10879 | 2083 |
| | 26235 | 1171 | 10878 | 29468 | 10910 | 20924 | 10909 | 25250 | 2827 | 6201 | 26981 | 1290 |
| | 16544 | 12724 | 4260 | 8092 | 15444 | 11269 | 23635 | 18854 | 21138 | 8537 | 7555 | 9139 |
| | 27937 | 11964 | 10614 | 1006 | 8279 | 2557 | 19791 | 18694 | 27789 | 11132 | 15363 | 4333 |
| | 13764 | 13803 | 7681 | 9512 | 10355 | 15473 | 27183 | 13848 | 28837 | 15511 | 13229 | 13417 |
| | 22242 | 10321 | 15312 | 12102 | 1589 | 28737 | 10288 | 15365 | 15293 | 24826 | 17630 | 23146 |
| | 26660 | 10361 | 15509 | 27350 | 10295 | 22669 | 6293 | 5558 | 15294 | 15366 | 15296 | 15370 |
| | 10291 | 12562 | 28309 | 17928 | 17925 | 13679 | 15321 | 17966 | 15397 | 20092 | 15324 | 15399 |
| | 26662 | 15332 | 24590 | 15405 | 28957 | 13849 | 3248 | 13812 | 13809 | 15413 | 13105 | 25405 |
| | 19835 | 20576 | 2226 | 10293 | 10298 | 2149 | 18471 | 15318 | 16277 | 10882 | 18022 | 11840 |
| | 23758 | 23761 | 28953 | 12536 | 12537 | 12207 | 26681 | 12204 | 2922 | 4891 | 22854 | 10880 |
| | 10886 | 25924 | 16591 | 25423 | 1729 | 1732 | 12857 | 28984 | 10359 | 15481 | 1536 | 15118 |
| | 8737 | 8735 | 29936 | 15551 | 10859 | 3924 | 23016 | 3459 | 10911 | 30283 | 10363 | 15256 |
| | 18628 | 3841 | 28560 | 19197 | 17400 | 7515 | 18058 | 16349 | 19235 | 30238 | 30024 | 26335 |
| | 2069 | 29915 | 1134 | 13811 | 13802 | 13797 | 25698 | 3007 | 8289 | 30023 | 18238 | 15388 |
| | 16397 | 9379 | 8995 | 12328 | 18477 | 10491 | 6603 | 12468 | 4769 | 5317 | 10602 | 18836 |
| | 10482 | 7711 | 6508 | 11646 | 24479 | 2203 | 3075 | | | | | |
| 480: | 6859 | 12279 | 15737 | 28496 | 21769 | 14969 | 27180 | 9733 | 24403 | 11636 | 10570 | 1070 |
| | 2798 | 9970 | 10415 | 11236 | 8470 | 8345 | 19642 | 22539 | 22512 | 25445 | 29247 | 26768 |
| | 20252 | 21978 | 15292 | 30404 | 30111 | 29999 | 11284 | 13291 | 16756 | 1193 | 1646 | 19831 |
| | 14916 | 19300 | 9340 | 30226 | 5046 | 13014 | 22101 | 14185 | 12066 | 2705 | 7024 | 24882 |
| | 9683 | 27483 | 29883 | 11174 | 19960 | 14502 | 13090 | 12155 | 15071 | 23104 | 19917 | 10129 |
| | 12646 | 6199 | 13887 | 20888 | 21538 | 29787 | 23970 | 23967 | 21684 | 21683 | 21688 | 30159 |
| | 30185 | 24444 | 2588 | 2255 | 12746 | 23378 | 3834 | 3815 | 3819 | 25318 | 18870 | 3821 |
| | 20089 | 19266 | 20090 | 20084 | 6102 | 4127 | 6128 | 20093 | 12645 | 6092 | 14127 | |
| | 12905 | 23180 | 12647 | 12611 | 10868 | 26743 | 29974 | 6070 | 15868 | 8589 | 29181 | 20707 |
| | 18074 | 18072 | 20031 | 9895 | 9891 | 9893 | 19280 | 22865 | 17827 | 21935 | 20386 | 22156 |
| | 17976 | 18076 | 23593 | 11032 | 3679 | 9611 | 9614 | 26018 | 25179 | 25756 | | |
| 481: | 5332 | 23342 | 24029 | 27571 | 23765 | 18921 | 3620 | 17462 | 13455 | 17803 | 24364 | 6672 |
| | 2289 | 23193 | 5356 | 10089 | 21592 | 28489 | 26479 | 29205 | 21994 | 22730 | 22035 | 22858 |
| | 25290 | 17216 | 12721 | 9211 | 5605 | 20033 | 20032 | 9069 | 11834 | 29638 | 22246 | 11158 |
| | 26998 | 13971 | 11387 | 21456 | 5539 | 11547 | 9354 | 13365 | 19987 | 17274 | 25427 | 24426 |
| | 20383 | 27342 | 22310 | 29745 | 25026 | 23952 | 26499 | 9378 | 5368 | 12997 | | |
| 482: | 23286 | 1274 | 8225 | 27981 | 25684 | 25757 | 16457 | 16452 | 1391 | 12214 | 23260 | 23289 |
| | 1744 | 11105 | 11360 | 5199 | 25720 | 25688 | 14705 | 6709 | 6649 | 16261 | 22979 | 22977 |
| | 16994 | 16270 | 2059 | 2009 | 16265 | 20642 | 23803 | 20644 | 15180 | 15175 | 4941 | 4914 |
| | 3758 | 4703 | 4713 | 16785 | 10080 | 16509 | 12093 | 6582 | 12093 | 3831 | 1155 | 9438 |
| | 17429 | 4505 | 9638 | 12510 | 11369 | 12332 | 11407 | 12298 | 12366 | 12270 | 11488 | 11530 |
| | 12277 | 12432 | 12339 | 12269 | 17458 | 17460 | 19786 | 19822 | 21082 | 19790 | 19696 | 19761 |
| | 19793 | 19758 | 19719 | 19935 | 19903 | 19827 | 19930 | 19868 | 21151 | 21148 | 19763 | 19928 |
| | 3788 | 4668 | 4665 | 4699 | 4673 | 16783 | 4824 | 16782 | 6878 | 6991 | 6910 | 6932 |
| | 6936 | 6940 | 5992 | 4628 | 3791 | 4740 | 4743 | 26710 | 23228 | 28484 | 14653 | 14703 |

TABLE 8-continued

| PEP SEQ ID NO: | homolog SEQ ID NOs | | | | | | | | | | |
|---|---|---|---|---|---|---|---|---|---|---|---|
| | 17093 | 15617 | 15646 | 15668 | 15641 | 15642 | 15670 | 15639 | 22762 | 13093 | 20149 | 2079 |
| | 4751 | 4775 | 4982 | 6024 | 6061 | 6868 | 16810 | 6837 | 5982 | 6907 | 26794 | 25144 |
| | 24355 | 5247 | 3727 | 3754 | 16757 | 3755 | 3784 | 3787 | 4632 | 4659 | 4662 | 4707 |
| | 4746 | 4749 | 4830 | 4034 | 4079 | 4909 | 4907 | 4912 | 4944 | 4945 | 4980 | 5768 |
| | 5792 | 5862 | 5899 | 5938 | 5942 | 5975 | 5986 | 6059 | 6091 | 6093 | 6099 | 6869 |
| | 6897 | 6902 | 6942 | 6961 | 6964 | 6969 | 3748 | 25626 | 18897 | 18900 | 11659 | 3110 |
| | 1332 | 23097 | 27977 | 1190 | 15240 | 5284 | 5204 | 5307 | 5306 | 5310 | 5201 | 5331 |
| | 5329 | 5234 | 5232 | 5226 | 5278 | 5236 | 5239 | 5277 | 10149 | 2306 | 12349 | 27947 |
| | 19479 | 19484 | 25020 | 24994 | 14113 | 14253 | 14109 | 14251 | 14282 | 15069 | 14138 | 30160 |
| | 14321 | 14278 | 19566 | 14326 | 14195 | 19682 | 14068 | 14161 | 29739 | 10181 | 17666 | 10210 |
| | 17706 | 17711 | 17670 | 17681 | 23292 | 16447 | 28736 | 13813 | 4269 | 8971 | 24172 | 10784 |
| | 6581 | 21799 | 28030 | 14647 | 5282 | 27990 | 28015 | 16419 | 5909 | 5945 | 6619 | 14800 |
| | 17524 | 28146 | 21825 | 21826 | 8124 | 8126 | 8159 | 8214 | 28025 | 28023 | 28020 | 8218 |
| | 8196 | 30192 | 4794 | 15242 | 14452 | 2511 | 25359 | 13419 | 1836 | 2576 | 16666 | 1428 |
| | 1423 | 19836 | 1910 | 7820 | 10218 | 20683 | 29045 | 6026 | 6025 | 16449 | 4481 | 14869 |
| | 10745 | 11813 | 20059 | 22400 | 11648 | 7691 | 16414 | 8183 | 16455 | 16412 | 16460 | 13181 |
| | 2994 | 2965 | 26527 | 16462 | 11863 | 7168 | 20675 | 16443 | 20678 | 967 | 17461 | 2509 |
| | 11502 | 7375 | 17492 | 28280 | 6553 | 17455 | 2264 | 16409 | 16416 | 16418 | 16407 | 16444 |
| | 4844 | 14779 | 20794 | 12379 | 7963 | 19990 | 15714 | 670 | 11705 | 25327 | 26672 | 28323 |
| | 23256 | 17560 | 18542 | 22080 | 13354 | 13352 | 21460 | 21463 | 14532 | 29577 | 29581 | 29580 |
| | 29552 | 29576 | 29541 | 8329 | 6616 | 6645 | 6642 | 16406 | 5279 | 20860 | 3939 | 8558 |
| | 3973 | 4297 | 17449 | 19743 | 8597 | 25495 | 25466 | 23522 | 22778 | 809 | 27528 | 1300 |
| | 23760 | 29578 | 25760 | 25761 | 20932 | 11894 | 20864 | 9396 | 3800 | 15568 | 9826 | 11866 |
| | 20815 | 26007 | 7525 | 8113 | 8080 | 19979 | 20833 | 20882 | 19973 | 20991 | 20988 | 21040 |
| | 20992 | 20962 | 20958 | 20922 | 20875 | 7061 | 20135 | 14531 | 6555 | 21597 | 21821 | 7008 |
| | 19716 | 7001 | 19725 | 13816 | 19729 | 19765 | 25693 | 21823 | 15215 | 5081 | 20680 | 8119 |
| | 12128 | 7002 | 5206 | 25110 | 5305 | 16506 | 4866 | 4872 | 4875 | 4869 | 1977 | 15074 |
| | 15072 | 15105 | 23221 | 23227 | 18915 | 6585 | 4781 | 15238 | 28000 | 27811 | 27816 | 27832 |
| | 27962 | 27900 | 27901 | 27903 | 27966 | 27969 | 27994 | 27907 | 27909 | 27835 | 27840 | 27842 |
| | 27865 | 27870 | 27873 | 27877 | 27808 | 27809 | 27810 | 27999 | 27925 | 27926 | 27879 | 27930 |
| | 28002 | 27935 | 27938 | 27998 | 27958 | 27959 | 9095 | 3804 | 417 | 416 | 22867 | 17450 |
| | 4731 | | | | | | | | | | | |
| 483: | 23286 | 11758 | 1274 | 8225 | 27981 | 25684 | 25757 | 16457 | 16452 | 1391 | 12214 | 23260 |
| | 23289 | 1744 | 11105 | 11360 | 5199 | 25720 | 25688 | 14705 | 6709 | 6649 | 16261 | 22979 |
| | 22977 | 16994 | 16270 | 2059 | 2009 | 16265 | 20642 | 23803 | 20644 | 15180 | 15175 | 4941 |
| | 4914 | 3758 | 4703 | 4713 | 16785 | 10080 | 16509 | 27451 | 6582 | 12093 | 3831 | 1155 |
| | 9438 | 17429 | 4505 | 9638 | 12510 | 11369 | 12332 | 11407 | 12298 | 12366 | 12270 | 11488 |
| | 11530 | 12277 | 12432 | 12339 | 12269 | 17458 | 17460 | 19786 | 19822 | 21082 | 19790 | 19696 |
| | 19761 | 19793 | 19758 | 19719 | 19935 | 19903 | 19827 | 19930 | 19868 | 21151 | 21148 | 21112 |
| | 19763 | 21144 | 19928 | 3788 | 4668 | 4665 | 4699 | 4673 | 16783 | 4824 | 16782 | 6878 |
| | 6991 | 6910 | 6932 | 6936 | 6940 | 5992 | 4628 | 3791 | 4740 | 4743 | 26710 | 23228 |
| | 28484 | 14653 | 14703 | 17093 | 15617 | 15646 | 15668 | 15641 | 15642 | 15670 | 15639 | 22762 |
| | 13093 | 20149 | 2079 | 4751 | 4775 | 4982 | 6024 | 6061 | 6868 | 16810 | 4978 | 6837 |
| | 5982 | 6907 | 26794 | 25144 | 24355 | 5247 | 3727 | 3754 | 16757 | 3755 | 3784 | 3787 |
| | 4632 | 4659 | 4662 | 4707 | 4746 | 4749 | 4830 | 4834 | 4879 | 4909 | 4907 | 4912 |
| | 4944 | 4945 | 4980 | 5768 | 5792 | 5829 | 5862 | 5899 | 5895 | 5938 | 5942 | 5975 |
| | 5986 | 6059 | 6091 | 6093 | 6099 | 6869 | 6897 | 6902 | 6942 | 6961 | 6964 | 6969 |
| | 3748 | 3751 | 25626 | 18897 | 18900 | 11659 | 3110 | 1332 | 23097 | 27977 | 1190 | 15240 |
| | 5284 | 5204 | 5307 | 5306 | 5310 | 5201 | 5331 | 5329 | 5234 | 5232 | 5226 | 5278 |
| | 5236 | 5239 | 5277 | 10149 | 2306 | 12349 | 27947 | 19479 | 19484 | 25020 | 24994 | 14113 |
| | 14253 | 14109 | 14251 | 14282 | 15069 | 14138 | 30160 | 14321 | 14278 | 19566 | 14326 | 14195 |
| | 19682 | 14068 | 14161 | 29739 | 10181 | 17666 | 10210 | 17706 | 17711 | 17670 | 17681 | 23292 |
| | 16447 | 13249 | 28736 | 13813 | 4269 | 8971 | 24172 | 10784 | 6621 | 6581 | 21799 | 28030 |
| | 14647 | 5282 | 27990 | 28015 | 16419 | 5909 | 5945 | 6619 | 6614 | 14800 | 17524 | 28146 |
| | 21825 | 21826 | 8124 | 8126 | 8159 | 8214 | 28025 | 28023 | 28020 | 8218 | 8196 | 30192 |
| | 4794 | 15242 | 14452 | 2511 | 25359 | 13419 | 1836 | 2576 | 16666 | 1428 | 1423 | 19836 |
| | 1910 | 7820 | 10218 | 20683 | 29045 | 6026 | 6025 | 16449 | 4481 | 14869 | 10745 | 11813 |
| | 20059 | 22400 | 11648 | 7691 | 16414 | 8183 | 16455 | 16412 | 16460 | 13181 | 2994 | 2965 |
| | 26527 | 16462 | 11863 | 7168 | 20675 | 16443 | 20678 | 967 | 17461 | 2509 | 11502 | 7375 |
| | 17492 | 28280 | 6553 | 17455 | 2264 | 16409 | 16416 | 16418 | 16407 | 16444 | 4844 | 14779 |
| | 20794 | 12379 | 7963 | 19990 | 15714 | 670 | 11705 | 25327 | 26672 | 28323 | 23256 | 17560 |
| | 18542 | 22080 | 13354 | 13352 | 21460 | 21463 | 3023 | 16390 | 14532 | 29577 | 29581 | 29580 |
| | 29552 | 29576 | 29541 | 8329 | 6616 | 6645 | 6642 | 16406 | 5279 | 20860 | 3939 | 8558 |
| | 3973 | 4297 | 17449 | 19743 | 8597 | 25495 | 25466 | 23522 | 22778 | 809 | 27528 | 1300 |
| | 23760 | 29578 | 25760 | 25761 | 20932 | 11894 | 20864 | 9396 | 3800 | 15568 | 9826 | 11866 |
| | 20815 | 26007 | 7525 | 8113 | 8080 | 19979 | 20833 | 20882 | 19973 | 20991 | 20988 | 21040 |
| | 20992 | 20962 | 20958 | 20922 | 20875 | 7061 | 20135 | 14531 | 6555 | 3548 | 3465 | 3461 |
| | 21597 | 21821 | 7008 | 19716 | 7001 | 19725 | 13816 | 19729 | 19765 | 25693 | 21823 | 15215 |
| | 4827 | 5081 | 20680 | 8119 | 12128 | 7002 | 5206 | 25110 | 5305 | 16506 | 4866 | 4872 |
| | 4875 | 4869 | 1977 | 15074 | 15072 | 15105 | 23221 | 23227 | 18915 | 6585 | 4781 | 15238 |
| | 28000 | 27811 | 27816 | 27832 | 27962 | 27900 | 27901 | 27903 | 27966 | 27969 | 27994 | 27907 |
| | 27909 | 27835 | 27840 | 27842 | 27865 | 27870 | 27873 | 27877 | 27808 | 27809 | 27810 | 27999 |
| | 27925 | 27926 | 27879 | 27930 | 28002 | 27935 | 27938 | 27998 | 27958 | 27959 | 9095 | 3804 |
| | 417 | 416 | 22867 | 17450 | 4731 | | | | | | | |
| 484: | 12506 | 14885 | 13628 | 27161 | 9283 | 29508 | 5274 | 16688 | 18995 | 18075 | 26869 | 21530 |
| | 18055 | 626 | 4352 | 28798 | 14098 | 8518 | 22602 | 1223 | 14754 | 29635 | 15057 | 13180 |
| | 22594 | 13466 | 12497 | 14620 | 27130 | 5420 | 28117 | 26031 | 821 | 18817 | 2441 | 9541 |
| | 19961 | 17159 | 22190 | 22154 | 28078 | 22441 | | | | | | |

TABLE 8-continued

| PEP SEQ ID NO: | homolog SEQ ID NOs | | | | | | | | | | |
|---|---|---|---|---|---|---|---|---|---|---|---|
| 485: | 14198 | 16733 | 17932 | 870 | 7072 | 866 | 17930 | 7071 | 16069 | 13851 | 13461 | 13464 |
| | 14055 | 12701 | 12702 | 419 | 19755 | 8312 | 13470 | 8308 | 18143 | 19044 | 9845 | 28935 |
| | 12911 | 12908 | 9746 | 12378 | 26844 | 6279 | 3256 | 29096 | 6492 | 6491 | 10340 | 1927 |
| | 1926 | 14725 | 14724 | 5210 | 5182 | 16911 | 19053 | 10053 | 15107 | 10052 | 17902 | 18728 |
| | 15861 | 21008 | 27672 | 14921 | 22004 | 25826 | 27570 | 30385 | 24545 | 7602 | 11773 | 25012 |
| | 2106 | 29882 | 5639 | 8632 | 19341 | 3676 | 5630 | 8591 | 13801 | 17969 | 18455 | 7576 |
| | 12282 | 29080 | 30010 | 25127 | 8356 | 9350 | 10154 | 5237 | 9923 | 12796 | 8187 | 29896 |
| | 5402 | 643 | 678 | 24362 | 24361 | 15888 | 14391 | 3369 | 3240 | 19906 | 26063 | 23740 |
| | 25138 | 23741 | 26062 | 25136 | 12643 | 4304 | 13273 | 13304 | 11196 | 30067 | 3274 | 7355 |
| | 14440 | 5431 | 5433 | 12373 | 26674 | 13025 | 10728 | 19975 | 19976 | 9320 | 6309 | 13989 |
| | 13167 | 13166 | 28931 | 28928 | 27390 | 2736 | 27297 | 28745 | 7015 | 29168 | 3670 | 5562 |
| | 12710 | 21159 | 16719 | 1225 | 28194 | 28348 | 22794 | 9021 | 15530 | 5874 | 9984 | 11413 |
| | 1550 | 422 | 19877 | 19878 | 26951 | 26948 | 17946 | 17941 | 13047 | 2877 | 2996 | 17097 |
| | 17095 | 12242 | 18956 | 15056 | 21779 | 24579 | 15055 | 18335 | 24735 | 18201 | 2127 | 25041 |
| | 1128 | 713 | 5162 | 5181 | 15588 | 15582 | 7479 | 7474 | 15585 | 10639 | 10640 | 7629 |
| | 27675 | 7385 | 23019 | 23020 | 8438 | 25592 | 20405 | 15584 | 15585 | 6639 | 9862 | 19958 |
| 486: | 14551 | 23240 | 12125 | 29926 | 21428 | 10051 | 10049 | 16359 | 17521 | 1303 | 1304 | 14480 |
| | 4855 | 23766 | 21027 | 1673 | 16070 | 3990 | 16377 | 24434 | 2164 | 15264 | 21647 | 7979 |
| | 1576 | 19535 | 6020 | 25742 | 30458 | 26519 | 7968 | 4483 | 5371 | 8892 | 23905 | 10500 |
| | 5400 | 12858 | 16857 | 14546 | 19747 | 11568 | 13536 | 27245 | 19603 | 18653 | 14485 | 25726 |
| | 4041 | 3096 | 24513 | 24510 | 24516 | 11995 | 4870 | 23214 | 5717 | 17916 | 18617 | 18851 |
| | 9961 | 15421 | 22688 | 22691 | 9793 | 23634 | 17356 | 15933 | 29805 | 18191 | 10215 | 3190 |
| | 4287 | 13779 | 22930 | 15197 | 26185 | 23217 | 24874 | 10212 | 12489 | 12493 | 17035 | 3884 |
| | 21643 | 21639 | 2122 | 8139 | 28008 | 30099 | 16747 | 14130 | 7655 | 26274 | 16059 | 2597 |
| | 28325 | 2041 | 3099 | 9480 | 17079 | 24011 | 24010 | 3576 | | | | |
| 487: | 17778 | 10938 | 18908 | 15653 | 17688 | 13066 | 20725 | 13107 | 15112 | 13722 | 27140 | 14271 |
| | 20967 | 11905 | 9749 | 5780 | 24679 | 13585 | 22476 | 9385 | 9674 | 21773 | 28461 | 25983 |
| | 6602 | 18801 | 7941 | 7946 | 1594 | 5716 | 29759 | 26813 | 14884 | 17561 | 22668 | 25577 |
| | 21619 | 12686 | 6466 | 26619 | | | | | | | | |
| 488: | 6934 | 5852 | 24700 | 13371 | 8459 | 3747 | 4220 | 18103 | 30243 | 17039 | 9865 | 20065 |
| | 12317 | 27021 | 27008 | 15166 | 7906 | 9349 | 10894 | 15908 | 16759 | 16761 | 23777 | 15799 |
| | 6271 | 10631 | 13844 | 25051 | 29405 | 26935 | 19945 | 15114 | 8013 | 12127 | 4033 | 17959 |
| | 13939 | 2886 | 14702 | 12707 | 5269 | 9267 | 4958 | 17664 | 1724 | 12344 | 6415 | 6807 |
| | 3257 | 7598 | 10613 | 19411 | 26748 | 1992 | 7040 | 27803 | 16343 | 5065 | 12921 | 10829 |
| | 5021 | 10016 | 17191 | 23742 | 3992 | 27542 | 15109 | 17148 | 2046 | 15557 | 12552 | 11673 |
| | 28667 | 6381 | 11784 | 25877 | 2496 | 3337 | 27363 | 11872 | 9602 | 8203 | 24744 | 5064 |
| | 3835 | 13654 | 17071 | 18386 | 28277 | 16239 | 14763 | 19665 | 7258 | 12051 | 5718 | 22306 |
| | 25102 | 20081 | 29020 | 25347 | 18098 | 27391 | 22157 | 27398 | 19579 | 27053 | 27866 | 9775 |
| | 16206 | 10692 | 25358 | 15063 | 17503 | 29653 | 26785 | 10424 | 3339 | 2406 | 11831 | 10224 |
| | 24533 | 5120 | 13130 | 21595 | 12025 | 3353 | 6405 | 7519 | 9734 | 28998 | 23813 | 19217 |
| | 9783 | 28678 | 1286 | 838 | 5887 | 5691 | 18558 | 15504 | 12079 | 4498 | 7653 | 3528 |
| | 7642 | 28459 | 25809 | 25548 | 19298 | 17459 | 13182 | 26486 | 29795 | 23090 | 17891 | 18954 |
| | 4645 | 18236 | 19204 | 5487 | 8283 | 11812 | 21660 | 1117 | 17055 | 29716 | 14442 | 10496 |
| | 21065 | 5503 | 9298 | 25967 | 1280 | 7920 | 9741 | 13660 | 16199 | 25963 | 6316 | 30277 |
| | 12213 | 27036 | 28375 | 20106 | 2717 | 30214 | 27299 | 24886 | 26991 | 29531 | 29271 | 22861 |
| | 8625 | 7468 | 8255 | 14243 | 6351 | 14811 | 22713 | 29527 | 2919 | 22390 | 8698 | 19330 |
| | 6632 | 19192 | 710 | 3907 | 26984 | 15169 | 12444 | 29263 | 14484 | 28593 | 29506 | 7879 |
| | 13416 | 12267 | 1217 | 9851 | 22900 | 18698 | 26583 | 7958 | 24239 | 9331 | 11515 | 5257 |
| | 13793 | 18597 | 20619 | 29615 | 27843 | 24944 | 20205 | 16174 | 24378 | 8293 | 13370 | 29840 |
| | 17228 | 904 | 26067 | 19551 | 7384 | 25432 | 29810 | 17732 | 21533 | 26359 | 24928 | 4619 |
| | 9825 | 25056 | 14541 | 18499 | 7473 | 11627 | 25774 | 13496 | 30437 | 15774 | 16279 | 1756 |
| | 955 | 29175 | 24856 | 23657 | 21726 | 16327 | 23687 | 25692 | 12364 | 14610 | 10922 | 12781 |
| | 18832 | 4928 | 17112 | 28449 | 23898 | 19296 | 25621 | 24240 | 27574 | 3781 | 21380 | 19463 |
| | 13012 | 11969 | 30407 | 12672 | 10097 | 22219 | 25764 | 22342 | 25852 | 15736 | 2000 | 29637 |
| | 10127 | 30271 | 15993 | 13062 | 22971 | 14468 | 22662 | 10390 | 12082 | 4963 | 3646 | 27034 |
| | 1442 | 9686 | 21140 | 5218 | 24956 | 9764 | 13049 | 17064 | 1760 | 15712 | 24825 | 2363 |
| | 27050 | 11796 | 22872 | 8970 | 2404 | 25310 | 6023 | 11475 | 4253 | 3054 | 8771 | 7930 |
| | 27405 | 28680 | 16015 | 12716 | 3618 | 13826 | 18616 | 12845 | 5865 | 20843 | 1048 | 25315 |
| | 15144 | 13425 | 18780 | 19288 | 28088 | 27434 | 4470 | 29946 | 7863 | 11116 | 10260 | 18709 |
| | 28499 | 822 | 26230 | 23951 | 15108 | 10756 | 23572 | 23571 | 29153 | 13941 | 5801 | 20856 |
| | 7689 | 10398 | 25699 | 28956 | 19040 | 25842 | 22135 | 29606 | 25475 | 23445 | 6495 | 14739 |
| | 2594 | 2600 | 12307 | 12310 | 969 | 18583 | 24045 | 18005 | 7132 | 10960 | 25818 | 24481 |
| | 20581 | 24190 | 27395 | 6275 | 12591 | 23422 | 29543 | 22312 | 7404 | 27708 | 27710 | 11837 |
| | 17583 | 28903 | 20133 | 28862 | 8117 | 10574 | 26353 | 8071 | 22965 | 5897 | 24749 | 25079 |
| | 25069 | 2687 | 10452 | 19679 | 25844 | 15015 | 9439 | 7669 | 9765 | 21477 | 6421 | 24068 |
| | 15381 | 30105 | 30328 | 26862 | 20374 | 4069 | 5424 | 25846 | 13929 | 7370 | 20412 | 1372 |
| | 18112 | 8200 | 12667 | 29930 | 11161 | 27707 | 1440 | | | | | |
| 489: | 20634 | 28717 | 28716 | 21425 | 8439 | 6534 | 2346 | 2341 | 2344 | 2293 | 15778 | 9185 |
| | 23756 | 17947 | 12827 | 25538 | 12433 | 20855 | 29677 | 8406 | 26074 | 21476 | 7021 | 4549 |
| | 29681 | 23174 | 28456 | 25965 | 24156 | 1279 | 27655 | 3825 | 18526 | 21883 | 7426 | 6057 |
| | 23419 | 21753 | 784 | 18605 | 6809 | 6812 | 6814 | 12657 | 22628 | 3324 | 15750 | 21556 |
| | 23728 | 27188 | 24044 | 23711 | 30241 | 21654 | | | | | | |
| 490: | 22876 | 17843 | 24061 | 23547 | 9277 | 1484 | 8780 | 8333 | 20353 | 7228 | 3622 | 21977 |
| | 21710 | 30060 | 29991 | 27220 | 23136 | 4216 | 22981 | 26646 | 27541 | 15497 | 20462 | 3290 |
| | 16144 | 8335 | 24931 | | | | | | | | | |
| 491: | 6855 | 23827 | 6260 | 10531 | 9711 | 3036 | 11396 | 16702 | 22401 | 12385 | 17132 | 25508 |
| 492: | 4073 | 4074 | 23394 | 2844 | 26262 | 26265 | 4274 | 22555 | 4100 | 28493 | 28492 | 18874 |
| | 21520 | 2408 | 2403 | 23481 | 22482 | 5544 | 23403 | 29897 | 28529 | 10837 | 23686 | 10611 |

TABLE 8-continued

| PEP SEQ ID NO: | homolog SEQ ID NOs | | | | | | | | | | |
|---|---|---|---|---|---|---|---|---|---|---|---|
| | | 4063 | 19971 | 20002 | 7073 | 13723 | 13721 | 19412 | 29019 | 23907 | 8695 | 10864 | 10862 |
| | 25433 | 5314 | 29590 | 13618 | 5736 | 15587 | 2366 | 15756 | 18027 | 18644 | 25869 | 13478 |
| | 6691 | 17779 | 8272 | 28495 | 24521 | 28573 | 21337 | 18951 | 18989 | 16902 | 18985 | 18980 |
| | 1933 | 26747 | 29391 | 14309 | 1994 | 8624 | 13325 | 25476 | 12360 | 15080 | 16289 | 9817 |
| 493: | 26288 | 10403 | 17815 | 27594 | 1569 | 20525 | 6783 | 7521 | 15205 | 4292 | 8103 | 8104 |
| | 19076 | 12966 | 10380 | 17314 | 26092 | 23329 | 24319 | 21471 | 27171 | 14184 | 24840 | 10915 |
| | 25210 | 10612 | 26989 | 16694 | 10183 | 24937 | 3284 | 19533 | 14871 | 4215 | 5097 | 6378 |
| | 7437 | | | | | | | | | | | |
| 494: | 8146 | 26918 | 16137 | 14667 | 22888 | 2925 | 12977 | 12675 | 17605 | 11907 | 10816 | 1511 |
| | 8686 | 18555 | 8371 | 15387 | 15980 | 15946 | 19594 | 4424 | 21192 | 12206 | 20285 | 25643 |
| | 16094 | 9631 | 1060 | 29094 | 13890 | 20604 | 9287 | 29846 | 15526 | 23496 | 21495 | 11465 |
| | 12889 | 23533 | 8128 | 27131 | 24321 | 9105 | 2632 | 20012 | 8756 | 24369 | 20496 | 19096 |
| | 10775 | 11703 | 9598 | 3535 | 5180 | 12894 | 11708 | 22228 | 21030 | 18594 | 11453 | 23069 |
| | 2643 | 5685 | 1293 | 12820 | 20795 | 28225 | 12437 | 7052 | 4066 | 10939 | 18748 | 4720 |
| | 19338 | 16483 | 16203 | 5024 | 4488 | 21596 | 1367 | 13527 | 20996 | 1078 | 29159 | 16928 |
| | 24078 | 25941 | 16065 | 14834 | 21133 | 8722 | 28457 | 14649 | 24650 | 23373 | 22767 | 10198 |
| | 26501 | 29393 | 22158 | 27479 | 18609 | 20951 | 3493 | 21315 | 18940 | 12737 | 26959 | 8053 |
| | 26928 | 5760 | 1288 | 16609 | 19882 | 5569 | 950 | 10136 | 14613 | 13906 | 2222 | 10576 |
| | 3452 | 6219 | 4225 | 11561 | 16022 | 22121 | 10333 | 3582 | 19168 | 18619 | 19785 | 432 |
| | 21894 | 16650 | 13413 | 683 | 22074 | 20491 | 28193 | 25961 | 25977 | 15634 | 12162 | 15814 |
| | 18491 | 21190 | 25232 | 28527 | 6789 | 19362 | 26832 | 29018 | 7067 | 22568 | 18361 | 13991 |
| | 15127 | 14165 | | | | | | | | | | |
| 495: | 15510 | 23745 | 869 | 9643 | 25537 | 5240 | 19233 | 21470 | 18859 | 19426 | 13254 | 15595 |
| | 24634 | 19005 | 14331 | 653 | 7732 | 27035 | 14662 | 4170 | 24736 | 5337 | 21591 | 28042 |
| | 22227 | 7428 | 8805 | 8731 | 19101 | 16690 | 4016 | 25800 | 22905 | | | |
| 496: | 19486 | 25309 | 25317 | 22542 | 9999 | 22071 | 883 | 5638 | 3062 | 28160 | 16341 | 15955 |
| | 24747 | 9805 | 14528 | 8069 | 760 | 7165 | 16988 | 8557 | 11439 | 24893 | 22650 | 26721 |
| | 25863 | 1985 | 17347 | 11317 | 23596 | 25314 | 7739 | 25313 | 12725 | 20274 | 6438 | 20401 |
| | 23762 | 15395 | 15054 | 4255 | 27514 | 14867 | 2154 | 26627 | 19008 | 17483 | 7844 | 13878 |
| | 29451 | 26459 | 10762 | 5531 | 26974 | 19145 | 17027 | 8316 | 24676 | 9076 | 9129 | 22796 |
| | 14785 | 28284 | | | | | | | | | | |
| 497: | 30239 | 18561 | 14887 | 24891 | 22826 | 14478 | 18533 | 18532 | 17376 | 17344 | 17582 | 17329 |
| | 25301 | 3737 | 17338 | 23847 | 16831 | 25930 | 14584 | 11924 | 26712 | 20144 | 12700 | 5186 |
| | 26320 | 19185 | 6655 | 21737 | 2191 | 25804 | 6123 | 10800 | 6615 | 17331 | 16315 | 7441 |
| | 12516 | 6706 | 30268 | 14663 | 8306 | 7017 | 3322 | 3317 | 28649 | 17345 | 17343 | 11428 |
| | 11431 | 1923 | 18510 | 24667 | 18508 | 25114 | 28417 | 20343 | 1750 | 13368 | 27910 | 17731 |
| | 24664 | 12147 | 28463 | 15891 | 8025 | 7493 | 27000 | 11916 | 18119 | 18123 | 18069 | 18031 |
| | 18104 | 18062 | 18129 | 17938 | 17907 | 18026 | 11917 | 18065 | 2558 | 20664 | 21108 | 19670 |
| | 19675 | 19668 | 5494 | 21110 | 19727 | 6159 | 9900 | 12046 | 8215 | 14188 | 23583 | 23587 |
| | 23586 | 23588 | 27477 | 10150 | 21536 | 13003 | 23199 | 10146 | 24950 | 12276 | 21852 | 9943 |
| | 10122 | 885 | 7266 | 27079 | 9759 | 12664 | 5851 | 4962 | 25528 | 17777 | 29865 | 26434 |
| | 26431 | 29863 | 22893 | 18572 | 806 | 2260 | 6156 | 21650 | 4130 | 24563 | 6186 | 6185 |
| | 842 | 24330 | 839 | 24694 | 10227 | 6161 | 6164 | 24692 | 21616 | 4132 | 1666 | 6189 |
| | 24281 | 834 | 24659 | 20802 | 24657 | 7550 | 27555 | 27461 | 3566 | 27461 | 7976 | 5684 |
| | 18463 | 22676 | 18830 | 18827 | 18792 | 18826 | 17884 | 5351 | 5132 | 21888 | 14842 | 8107 |
| | 3297 | 26178 | 10161 | 10065 | 6762 | 11095 | 9619 | 3164 | 23438 | 26911 | 23249 | 23411 |
| | 18794 | 17906 | 18803 | 18799 | 18806 | 17905 | 5828 | 26450 | 2627 | 13443 | 4439 | 5581 |
| | 18831 | 22897 | 3640 | 5587 | 27055 | 17059 | 27312 | 11862 | 3882 | 3917 | 3851 | 3886 |
| | 3878 | 3854 | 3893 | 3913 | 3847 | 13402 | 19939 | 21583 | 21322 | 13820 | 1604 | 28218 |
| | 8042 | 17341 | 1207 | 21475 | 30187 | 23361 | | | | | | |
| 498: | 12651 | 27676 | 16874 | 28937 | 28103 | 27096 | 6937 | 8281 | 25899 | 16470 | 20876 | 19505 |
| | 1535 | 20819 | 17014 | 22996 | 13260 | 29855 | 12078 | 29568 | 28910 | 8811 | 12735 | 22292 |
| | 3226 | 14027 | 3224 | 14589 | 14588 | 8393 | 1526 | 1563 | 25703 | 22950 | 21732 | 25276 |
| | 10367 | 14086 | 17499 | 6711 | 27501 | 23532 | 5853 | 7098 | 30157 | 6852 | 10875 | 2857 |
| | 14202 | | | | | | | | | | | |
| 499: | 24678 | 24901 | 2909 | 24878 | 27828 | 10766 | 18202 | 27168 | 24561 | 28398 | 10999 | 19658 |
| | 22042 | 16881 | 5846 | 2027 | 23338 | 27825 | 7667 | 11643 | 22204 | 8174 | 12879 | 19312 |
| | 25910 | 30439 | 29607 | 23632 | 29585 | 29613 | 14738 | 27767 | 23975 | 14683 | 30467 | 17756 |
| | 18041 | 24199 | 12034 | 8930 | 25146 | 23162 | 26992 | 9540 | 22124 | 17337 | 2395 | 1351 |
| | 18222 | 20577 | 2645 | 12926 | 25752 | 14926 | 12719 | 12962 | 8723 | 18964 | 10682 | 16372 |
| | 22803 | 24343 | 13390 | 13190 | 11927 | 10094 | 11981 | 10100 | 10092 | 10018 | 11934 | 18269 |
| | 11087 | 6728 | 5117 | 10021 | 13926 | 19521 | 16790 | 12607 | 16794 | 16795 | 21942 | 16792 |
| | 29599 | 14334 | 22507 | 23021 | 22161 | 18485 | 28919 | 6721 | 28631 | 6308 | 22701 | 25478 |
| | 22553 | 2349 | 22695 | 22663 | 29089 | 1154 | 14925 | 23534 | 1033 | 21547 | 23649 | 17047 |
| | 24711 | 1215 | 11404 | 6106 | 17984 | 856 | 17980 | 6324 | 22985 | 21129 | 820 | 7300 |
| | 23309 | 7042 | 12817 | 8347 | 2271 | 4688 | 12972 | 27652 | 1425 | 19508 | 18569 | 24684 |
| | 29435 | 25489 | 24680 | 23876 | 24655 | 24651 | 6752 | 18482 | 9035 | 13590 | 9523 | 1873 |
| | 6874 | 26068 | 2870 | 25332 | 11743 | 27596 | 9088 | 8428 | 9072 | 9086 | 28298 | 7686 |
| | 2548 | 7575 | 23391 | 28294 | 11150 | 23767 | 10281 | 25353 | 16357 | 7994 | 29948 | 23712 |
| | 24940 | 21067 | 19517 | 25831 | 18925 | 20908 | 28458 | 27573 | 26558 | 26529 | 7690 | 16502 |
| | 16507 | 13795 | 16510 | 25078 | 26294 | 13221 | 28698 | 16026 | 20142 | 15378 | 5345 | 24428 |
| | 24395 | 10286 | 12062 | 12059 | 12063 | 1179 | 13013 | 1176 | 7180 | 2385 | 7154 | |
| 500: | 12633 | 5576 | 26464 | 6939 | 5436 | 6903 | 19289 | 12073 | 11239 | 11220 | 5207 | 17109 |
| | 24162 | 21590 | 19286 | 5425 | 5430 | 27381 | 19320 | 5610 | 30375 | 28547 | 21508 | 15517 |
| | 694 | 24168 | 15269 | 30444 | 22766 | 5774 | 2159 | 22995 | 14625 | 27546 | 16625 | 25748 |
| | 18896 | 29115 | 2211 | 22848 | 6662 | 15338 | 18141 | 14813 | 12188 | 4186 | 17651 | 16654 |
| | 22596 | 24543 | 24139 | 24171 | 13070 | 14145 | 9867 | 22339 | 6261 | 7342 | 29017 | 8122 |
| | 12863 | 7811 | 20259 | 12960 | 24163 | 15890 | 24933 | 16181 | 844 | 23831 | 24134 | 3722 |

TABLE 8-continued

| PEP SEQ ID NO: | homolog SEQ ID NOs | | | | | | | | | | |
|---|---|---|---|---|---|---|---|---|---|---|---|
| | 25962 | 3343 | 17871 | 18224 | 24138 | 13856 | 9840 | 17246 | 5864 | 29945 | 28973 | 9848 |
| | 5133 | 10174 | 26116 | 16948 | 21378 | 855 | 19993 | 11003 | 30218 | 8090 | 28428 | 12644 |
| | 14159 | 4657 | 7704 | 7703 | 24137 | 16308 | 14049 | 13022 | 13027 | 12177 | 2556 | 7496 |
| | 13569 | 884 | 18847 | 16724 | 13023 | 14144 | 26725 | 23143 | 3276 | 2419 | 28613 | 23690 |
| | 23691 | 10724 | 2410 | 20847 | 6017 | 26851 | 16062 | 19848 | 10284 | 16302 | 7117 | 15902 |
| | 16224 | 27646 | 13245 | 16310 | 5202 | 15607 | 19751 | 10030 | 16301 | 16282 | 5225 | 7893 |
| | 7923 | 7921 | 1983 | 12399 | 12402 | 12401 | 12398 | 12397 | 17040 | 9339 | 8652 | 29039 |
| | 11778 | 13024 | 16120 | 6482 | 13004 | 13019 | 26633 | 6479 | 26162 | 20447 | 21352 | 23855 |
| | 993 | 14542 | 2101 | 992 | 25595 | 13001 | 13007 | 5205 | 6181 | 11536 | 13905 | 17769 |
| | 22987 | 26761 | 9483 | 24331 | 16312 | 9484 | 20036 | 20039 | 20073 | 1039 | 2389 | 29034 |
| | 21350 | 7738 | 9401 | 24790 | 21351 | 1082 | 3958 | 5534 | 20602 | 7626 | 18581 | 29001 |
| | 9368 | 24164 | 9476 | 5233 | 28865 | 8163 | 27974 | 13483 | 9874 | 13645 | 27614 | 15344 |
| | 10055 | 28778 | 10085 | 908 | 26856 | 14272 | 27905 | 23139 | 28728 | 13538 | 5203 | 5175 |
| 501: | 22063 | 26045 | 16912 | 30127 | 29320 | 29303 | 3541 | 26289 | 19539 | 21860 | 11235 | 5935 |
| | 12869 | 17821 | 10527 | 11451 | 8244 | 9118 | 1287 | 12226 | 5618 | 25068 | 10889 | |
| | 2056 | 16966 | 10027 | 11990 | 14888 | 18855 | 14742 | 24259 | 5720 | 9122 | 27531 | 18352 |
| | 14061 | 13206 | 17734 | 5040 | 13026 | 12003 | 14560 | 17261 | 17144 | 11790 | 3651 | 17116 |
| | 11170 | 6990 | 5807 | 27796 | 18507 | 16941 | 19250 | 22019 | 2438 | 5374 | 17384 | 7194 |
| | 25109 | 21461 | 5102 | 30370 | 3332 | 5229 | 8370 | 1950 | 21814 | 6787 | 25734 | 26586 |
| | 14652 | 25785 | 14530 | 30381 | 7252 | 27175 | 2028 | 22652 | 29101 | 14959 | 17276 | 4979 |
| | 30282 | 23724 | 8395 | 508 | 22852 | 29157 | | | | | | |
| 502: | 13141 | 24663 | 5432 | 4653 | 22175 | 1044 | 12194 | 7412 | 19489 | 2082 | 25029 | 9904 |
| | 18731 | 18122 | 14783 | 6856 | 4391 | 23499 | 15960 | 18126 | 14229 | 6166 | 17114 | 10579 |
| | 29459 | 23550 | 16448 | 19706 | 25118 | 28479 | 9093 | 14062 | 29804 | 30189 | 13089 | 16932 |
| | 26848 | 29521 | 29522 | 29526 | 11199 | 25321 | 26944 | 19367 | 4460 | 19368 | 26955 | 26979 |
| | 5715 | 8189 | 10936 | 16430 | 10232 | 11989 | 10845 | 30364 | 18875 | 27814 | 19118 | 1717 |
| | 5766 | 19577 | 20055 | 26454 | 13098 | 27931 | 2418 | 5803 | 28217 | 2766 | | |
| 503: | 25958 | 21576 | 13591 | 25389 | 20630 | 3483 | 22382 | 12692 | 10229 | 11434 | 6540 | 15815 |
| | 12873 | 5034 | 17995 | 9790 | 6967 | 28265 | 2830 | 21768 | 9648 | 3858 | 16066 | 18411 |
| | 2300 | 2126 | 18598 | 5073 | 25603 | 24984 | 19699 | 23754 | 29387 | 7972 | 7378 | 27782 |
| | 28686 | 14100 | 20872 | 4178 | 14658 | 25949 | | | | | | |
| 504: | 15660 | 8610 | 3591 | 26937 | 28126 | 14474 | 5858 | 18044 | 14032 | 29395 | 24710 | 9902 |
| | 15749 | 12526 | 3271 | 4975 | 25111 | 27049 | 2193 | 13784 | 29244 | 29594 | 11386 | 1623 |
| | 6768 | 5328 | 13226 | 24129 | 22632 | 2427 | | | | | | |
| 505: | 18237 | 23960 | 23994 | 23991 | 24179 | 24180 | 24076 | 24118 | 24146 | 24149 | 24030 | 24181 |
| | 24184 | 24209 | 24210 | 24213 | 24217 | 24110 | 24232 | 24034 | 24105 | 24236 | 24238 | 23998 |
| | 24071 | 23989 | 24241 | 23996 | 24178 | 24037 | 24027 | 19800 | 29453 | 11999 | 15201 | 18953 |
| | 30110 | 7915 | 24337 | 23241 | 30053 | 20316 | 3763 | 12309 | 2522 | 21405 | 7212 | 5850 |
| | 23549 | 623 | 30338 | 24161 | 22828 | 20729 | 17637 | 3270 | 7313 | 6659 | 5092 | 6952 |
| | 4347 | 26191 | 1042 | 9629 | 19472 | 26754 | 4273 | 13112 | | | | |
| 506: | 26977 | 2097 | 28521 | 6741 | 15677 | 8890 | 26152 | 6354 | 2916 | 26592 | 8078 | 7651 |
| | 2399 | 5735 | 895 | 14151 | 10748 | 1302 | 12141 | 9457 | 10877 | 20297 | 17304 | 30352 |
| | 17639 | 19667 | 21703 | 24800 | 18865 | 30149 | 6282 | 23510 | 25032 | 28508 | 15914 | 21931 |
| | 13957 | 962 | 15356 | 12958 | 4817 | 27144 | 25222 | 26503 | 26593 | 10679 | 30007 | 25456 |
| | 20427 | 14505 | 20490 | 5443 | 18592 | 25401 | 2854 | 22437 | 22685 | 22037 | 21088 | 28656 |
| | 14978 | 26195 | 22751 | 18797 | 6460 | 25369 | 13440 | 19144 | 5499 | 5573 | 26606 | 24983 |
| | 23850 | 21698 | 3319 | 14701 | 21713 | 24422 | 13029 | 22785 | 14283 | 11353 | 21563 | 24006 |
| | 8150 | 1263 | 2765 | 24262 | 16099 | 2029 | 1975 | 7552 | 28441 | 15323 | 10935 | 5160 |
| | 28101 | 5861 | 21800 | 18259 | 24392 | 27733 | 27620 | 8037 | 25834 | 30194 | 25637 | 12199 |
| | 3192 | 2814 | 2314 | 16707 | 24266 | 712 | 5948 | 15772 | 10721 | 25413 | 19780 | 4500 |
| | 10647 | 16680 | 5863 | 16892 | 24799 | 10806 | 18073 | 5725 | 18316 | 7158 | 23032 | 23819 |
| | 21839 | 21691 | 12086 | 27923 | 1875 | 29050 | 24051 | 15808 | 7277 | 18233 | 20830 | 12116 |
| | 6296 | 6757 | 11411 | 23523 | 13225 | 30259 | 24347 | 23380 | 13451 | 15503 | 18219 | 13214 |
| | 12800 | 24183 | 14291 | | | | | | | | | |
| 507: | 20779 | 24939 | 5311 | 15671 | 2296 | 20652 | 29109 | 28620 | 3206 | 3200 | 28629 | 4589 |
| | 24485 | 948 | 15172 | 7128 | 3922 | 17466 | 17990 | 21375 | 3142 | 1846 | 28139 | 7341 |
| | 21244 | 21287 | 21295 | 21297 | 22145 | 22180 | 22178 | 21254 | 21332 | 26081 | 3066 | 3105 |
| | 4117 | 4005 | 3965 | 4002 | 3971 | 4040 | 4079 | 4083 | 4112 | 4037 | 4013 | 4051 |
| | 4085 | 4114 | 4086 | 3968 | 4009 | 4044 | 4048 | 4011 | 4091 | 4118 | 3169 | 26086 |
| | 3101 | 2953 | 16273 | 3143 | 4119 | 4140 | 4179 | 4141 | 4149 | 4176 | 4181 | 4142 |
| | 15489 | 3165 | 4185 | 3130 | 4146 | 2949 | 2980 | 2981 | 2985 | 3203 | 3025 | 3067 |
| | 23283 | 3092 | 3167 | 3028 | 3090 | 3132 | 3172 | 18566 | 5161 | 28978 | 21102 | 15354 |
| | 23047 | 15472 | 18591 | 21291 | 12821 | 21164 | 21198 | 22103 | 22083 | 22143 | 22110 | 3021 |
| | 3020 | 3068 | 21252 | 2690 | 13702 | 21330 | 2517 | 9247 | 19405 | 11833 | 20755 | 12527 |
| | 7417 | 23149 | 3888 | 8162 | 10621 | 27724 | 9473 | 27459 | 2829 | 9059 | 3318 | 14598 |
| | 6399 | 1832 | 14639 | 5075 | 20574 | 7540 | 3254 | 6498 | 15079 | 25237 | 25717 | 18738 |
| | 27099 | 2094 | 14428 | 27712 | 5129 | 8845 | 16967 | 20466 | 19980 | 15767 | 14977 | 23713 |
| | 5820 | 16186 | 9309 | 3216 | 3940 | 24473 | 10630 | 29434 | 849 | 5322 | 17378 | 772 |
| | 28623 | 22245 | 11137 | 3523 | 8751 | 17963 | 24926 | 2367 | 4290 | 21608 | 16227 | 25630 |
| | 3812 | 16692 | 29235 | 14220 | 10781 | 15605 | 15245 | 4837 | 8579 | 13179 | 17910 | 19812 |
| | 3127 | 14425 | 2549 | 17607 | 19705 | 16842 | 23437 | 27174 | 11157 | 20352 | 12148 | 18582 |
| | 13552 | 19628 | 28927 | 11275 | 8650 | 28754 | 21601 | 21605 | 18537 | 12838 | 8054 | 25377 |
| | 20187 | 10814 | 27375 | 21086 | 14376 | 26151 | 2335 | 1920 | 23181 | 3568 | 11054 | |
| | 26826 | 4974 | 4438 | 15277 | 12940 | 1980 | 29047 | 6511 | 6690 | 11979 | 29984 | 24503 |
| | 15358 | 19823 | 22832 | 9415 | 27615 | 21329 | 27853 | 23178 | 28845 | 8706 | 1212 | 19502 |
| | 9820 | 9726 | 10243 | 15903 | 4921 | 24963 | 19457 | 12330 | 28572 | 19685 | 26339 | 29786 |
| | 917 | 21450 | 14732 | 22089 | 923 | 14536 | 6343 | 3663 | 17098 | 10720 | 20472 | 29471 |
| | 8023 | 19291 | 1835 | 1124 | 28988 | 13271 | 21913 | 5017 | 6297 | 12797 | 10767 | 17295 |

TABLE 8-continued

| PEP SEQ ID NO: | homolog SEQ ID NOs | | | | | | | | | | |
|---|---|---|---|---|---|---|---|---|---|---|---|
| | 13111 | 3431 | 21493 | 21247 | 13672 | 29339 | 17698 | 20044 | 4482 | 18358 | 5822 | 21385 |
| | 1709 | 5937 | 1330 | 23764 | 8382 | 3231 | 8583 | 12115 | 19190 | 17480 | 5614 | 8467 |
| | 26165 | 7280 | 14035 | 4957 | 25733 | 2168 | 4261 | 28085 | 19259 | 7793 | 12844 | 19678 |
| | 20592 | 25443 | 28577 | 18775 | 14964 | 12904 | 20324 | 12253 | 11299 | 16242 | 2064 | 21929 |
| | 21544 | 18318 | 25219 | 1545 | 19720 | 24063 | 9881 | 26788 | 15537 | 12998 | 3693 | 7888 |
| | 30188 | 12424 | 12363 | 16914 | 5342 | 8474 | 13659 | 24546 | 960 | 14126 | 1740 | 22524 |
| | 29899 | 24833 | 21975 | 8271 | 1931 | 7069 | 18183 | 19392 | 13338 | 9699 | 18568 | 14080 |
| | 19020 | 20524 | 20974 | 9116 | 24390 | 25530 | 15480 | 4211 | 24148 | 8207 | 21327 | 3097 |
| | 4214 | 4187 | 3928 | 3960 | 3956 | 3932 | 3930 | 3925 | 26618 | 15185 | 27318 | 16698 |
| | 22055 | 28710 | 28706 | 1114 | 25182 | 17940 | 22641 | 10226 | 11018 | 4497 | 22234 | 20826 |
| | 5594 | 29126 | 10805 | 28558 | 26651 | 21427 | 6126 | 9791 | 6278 | 1229 | 21117 | 21155 |
| | 21163 | 20666 | 21321 | 22927 | 11026 | 11741 | 14905 | 9728 | 13522 | 26927 | 21896 | 24147 |
| | 1629 | 14177 | 30195 | 10510 | 18812 | 18546 | 23087 | 30245 | 27802 | 4459 | 1046 | 15919 |
| | 7624 | 5334 | 12548 | 27606 | 3816 | 24969 | 11126 | 16924 | 5632 | 20968 | 22081 | 19036 |
| | 18590 | 11125 | 6110 | 3546 | 1041 | 6377 | 28952 | 29794 | 11921 | 23034 | 12741 | 14655 |
| | 4538 | 21490 | 18565 | 3556 | 5419 | 18579 | 19922 | 2707 | 1491 | 1497 | 21323 | 11154 |
| | 26574 | 29960 | 13760 | 2987 | 23801 | 22077 | 21200 | 21249 | 21122 | 25421 | 19768 | 21836 |
| | 30337 | 22105 | 3030 | 3061 | 942 | 3171 | 9485 | 26196 | 17053 | 23416 | 15062 | 25260 |
| | 22146 | 17950 | 15199 | 23867 | 28735 | 10559 | 23054 | 23147 | 3136 | 3072 | 6566 | 21207 |
| | 9274 | 22079 | 25293 | 11881 | 7338 | 21160 | 21121 | 7420 | 891 | 21201 | 22107 | 22241 |
| | 13174 | 11127 | 3199 | 3197 | 29237 | 18539 | 17286 | 9115 | 1483 | 27826 | 24785 | 15035 |
| | 22974 | 11803 | 12237 | 25289 | 26718 | 26453 | 1870 | 15674 | 11151 | 21791 | 21204 | 937 |
| | 2992 | 24040 | 16384 | | | | | | | | | |
| 508: | 26045 | 16912 | 30127 | 29320 | 29303 | 3541 | 26289 | 19539 | 21860 | 11235 | 5935 | 12869 |
| | 17821 | 10527 | 11451 | 8244 | 9118 | 24250 | 1287 | 12226 | 5618 | 25068 | 10889 | 2056 |
| | 16966 | 10027 | 11990 | 14888 | 18855 | 14742 | 24259 | 5720 | 9122 | 27531 | 18352 | 14061 |
| | 13206 | 17734 | 5040 | 13026 | 12003 | 14560 | 17261 | 17144 | 3651 | 11170 | 6990 | 5807 |
| | 27796 | 18507 | 16941 | 19250 | 22019 | 2438 | 5374 | 17384 | 7194 | 25109 | 21461 | 5102 |
| | 30370 | 3332 | 5229 | 29593 | 8370 | 1950 | 21814 | 6787 | 25734 | 26586 | 14652 | 25785 |
| | 14530 | 30381 | 7252 | 27175 | 2028 | 22652 | 29101 | 14959 | 17276 | 4979 | 30282 | 23724 |
| | 8395 | 22852 | 501 | | | | | | | | | |
| 509: | 24805 | 6339 | 29491 | 7984 | 17081 | 2370 | 13507 | 12097 | 20345 | 20830 | 15927 | 6296 |
| | 26465 | 24548 | 11566 | | | | | | | | | |
| 510: | 23567 | 15328 | 22917 | 10973 | 28600 | 1066 | 18353 | 14143 | 13169 | 18901 | 23209 | 26996 |
| | 6647 | | | | | | | | | | | |
| 511: | 23773 | 16720 | 20388 | 16728 | 12602 | 14397 | 18489 | 25591 | 21502 | 27456 | 7172 | 9936 |
| | 18128 | 1038 | 18270 | 12642 | 29770 | 13323 | 6027 | 2757 | 26790 | 20536 | 15896 | 4247 |
| | 2291 | 1798 | 23805 | 6374 | 24459 | 27464 | 13913 | 23529 | 8440 | 15263 | 9459 | |
| 512: | 27904 | 25431 | 14789 | 14183 | 22929 | 27218 | 4526 | 6673 | 9061 | 23949 | 17881 | 1080 |
| | 25209 | 2770 | 23334 | 20251 | 27328 | 21578 | 12878 | 28058 | 22801 | 17685 | 30119 | |
| | 7443 | 28228 | 28916 | 18235 | 29133 | 19893 | 21663 | 24150 | 2673 | 11043 | 27772 | |
| 513: | 4331 | 23464 | 11950 | 28889 | 3508 | 9715 | 5921 | 5029 | 5212 | 17167 | 6776 | 14171 |
| | 26980 | 4402 | 19061 | 6538 | 19039 | 8820 | 12841 | | | | | |
| 514: | 25583 | 25602 | 25606 | 25629 | 25635 | 25666 | 25668 | 25671 | 25675 | 25704 | 25708 | 30450 |
| | 19353 | 2616 | 2612 | 11581 | 2606 | 3607 | 2652 | 2656 | 4666 | 4562 | 4595 | 10715 |
| | 10757 | 10723 | 15148 | 7011 | 10145 | 10555 | 10562 | 10885 | 4615 | 4614 | 10592 | 11306 |
| | 11308 | 10950 | 11366 | 10981 | 11484 | 11491 | 11061 | 11066 | 11524 | 11067 | 11589 | 11559 |
| | 10940 | 11337 | 17802 | 4867 | 15696 | 4771 | 15762 | 9196 | 16637 | 16636 | 9226 | 9230 |
| | 16803 | 4936 | 17828 | 5784 | 11301 | 10012 | 29367 | 10763 | 11274 | 11399 | 11435 | 10139 |
| | 10137 | 10135 | 11305 | 11363 | 11368 | 11409 | 11440 | 13737 | 22631 | 22635 | 14535 | 22638 |
| | 14593 | 14597 | 22671 | 22673 | 21171 | 21127 | 21028 | 21175 | 20934 | 2618 | 2648 | 10795 |
| | 10798 | 2619 | 2676 | 2675 | 2677 | 2679 | 5524 | 2681 | 2780 | 4637 | 3564 | 3605 |
| | 29322 | 29325 | 4600 | 4598 | 10792 | 10790 | 5599 | 5600 | 29374 | 21064 | 20944 | 20940 |
| | 20937 | 21061 | 20981 | 21126 | 21092 | 11767 | 21020 | 21069 | 22000 | 22029 | 22032 | 24069 |
| | 24083 | 24120 | 24194 | 24086 | 24122 | 24117 | 24119 | 24158 | 24182 | 24186 | 24188 | 24153 |
| | 24216 | 24219 | 24126 | 24244 | 24246 | 24249 | 24251 | 4774 | 4701 | 19529 | 19581 | 19532 |
| | 3151 | 19583 | 19617 | 19573 | 19536 | 19576 | 19621 | 19661 | 19578 | 26326 | 26323 | 5703 |
| | 19524 | 9634 | 14630 | 11338 | 10945 | 10937 | 10933 | 11094 | 11535 | 22003 | 16871 | 23011 |
| | 13888 | 10687 | 10759 | 10725 | 10691 | 10751 | 23322 | 15023 | 16600 | 24154 | 24080 | 30427 |
| | 19348 | 30456 | 25633 | 14773 | 7124 | 7178 | 7157 | 7150 | 7246 | 7182 | 7255 | 7101 |
| | 7245 | 7215 | 7094 | 7118 | 7210 | 7156 | 7286 | 7220 | 7186 | 7293 | 7249 | |
| | 7125 | 7151 | 7288 | 7326 | 7294 | 7296 | 7329 | 7333 | 8052 | 5631 | 3602 | 3600 |
| | 4390 | 4392 | 4393 | 4385 | 4446 | 4452 | 4449 | 4422 | 4491 | 4492 | 4495 | 4517 |
| | 4518 | 4547 | 4559 | 4555 | 4550 | 5523 | 5520 | 4718 | 5529 | 5560 | 5619 | 5626 |
| | 5622 | 5601 | 11610 | 5667 | 5673 | 5669 | 5635 | 4457 | 4454 | 10732 | 5675 | 5678 |
| | 7123 | 4852 | 4693 | 15678 | 4735 | 4821 | 15700 | 4736 | 4737 | 4741 | 4770 | 4773 |
| | 4776 | 4806 | 15757 | 15786 | 15788 | 15791 | 15812 | 15817 | 15840 | 15842 | 4825 | 16603 |
| | 16634 | 4856 | 16647 | 4860 | 16669 | 4863 | 16737 | 4894 | 4899 | 4900 | 4903 | 16778 |
| | 16801 | 16807 | 4929 | 16832 | 4932 | 16867 | 4939 | 17668 | 4969 | 4973 | 4976 | 4977 |
| | 17722 | 17725 | 5746 | 9982 | 10007 | 17788 | 17794 | 17800 | 5753 | 5757 | 5783 | 16703 |
| | 10014 | 17832 | 17757 | 16772 | 16706 | 9973 | 9976 | 16739 | 17708 | 11576 | 11608 | 29646 |
| | 19212 | 29648 | 29650 | 19215 | 29652 | 29668 | 19219 | 29669 | 29673 | 19240 | 29674 | 29676 |
| | 19243 | 29697 | 19247 | 29699 | 19252 | 690 | 20263 | 29702 | 19256 | 29703 | 652 | 19284 |
| | 642 | 20220 | 29734 | 19285 | 19287 | 29736 | 29737 | 30422 | 19322 | 30424 | 30426 | 19329 |
| | 20265 | 19350 | 30446 | 19351 | 19352 | 686 | 20223 | 30453 | 20169 | 30457 | 20173 | 647 |
| | 20228 | 605 | 608 | 16891 | 9952 | 10009 | 17765 | 9177 | 16643 | 9979 | 9983 | 14045 |
| | 14016 | 14039 | 14040 | 13976 | 13974 | 13980 | 14012 | 14993 | 1358 | 4588 | 4584 | 4571 |
| | 4574 | 4578 | 13670 | 13711 | 22598 | 22601 | 14564 | 14562 | 22667 | 16664 | 9182 | 9188 |

TABLE 8-continued

| PEP SEQ ID NO: | homolog SEQ ID NOs | | | | | | | | | | |
|---|---|---|---|---|---|---|---|---|---|---|---|
| | 9223 | 9950 | 9954 | 10004 | 10761 | 10667 | 10688 | 10717 | 11500 | 11507 | 11505 | 14991 |
| | 17532 | 1647 | 14787 | 14781 | 10730 | 13599 | 20410 | 2756 | 4380 | 29364 | 3612 | 29331 |
| | 4522 | 4519 | 11579 | 11601 | 26325 | 4631 | 4630 | 4633 | 10824 | 2657 | 29369 | 29372 |
| | 10693 | 4542 | 4540 | 4690 | 11333 | 11224 | 4733 | 4612 | 1900 | 10729 | 1898 | 1893 |
| | 1896 | 11599 | 2714 | 5565 | 5563 | 5564 | 2721 | 2723 | 2752 | 2747 | 3571 | 3573 |
| | 3569 | 4413 | 4411 | 4416 | 4420 | 4489 | 4485 | 4629 | 4603 | 4605 | 4660 | 4663 |
| | 4702 | 4674 | 4669 | 4710 | 4714 | 11582 | 4704 | 5526 | 5597 | 5567 | 5596 | 13979 |
| | 13987 | 21993 | 13992 | 13996 | 12409 | 13942 | 14015 | 1360 | 21231 | 14017 | 14782 | 14841 |
| | 7853 | 26652 | 26664 | 11552 | 18066 | 18134 | 18070 | 18101 | 18206 | 13236 | 2768 | 20087 |
| | 7036 | 18946 | 18255 | 18945 | 18264 | 13982 | 4581 | 4582 | 4908 | 11244 | 4616 | 4621 |
| | 28178 | 4815 | 9947 | 9192 | 16893 | 18369 | 17217 | 14632 | 29645 | 19209 | 13830 | 14636 |
| | 14637 | 13919 | 13914 | 13920 | 13917 | 13944 | 13945 | 13893 | 10689 | 21093 | 13841 | 13854 |
| | 13847 | 17547 | 17545 | 20904 | 20906 | 20899 | 19127 | 19155 | 19150 | 27482 | 15098 | 726 |
| | 2332 | 10069 | 17569 | 22026 | 14028 | 4404 | 4544 | 2336 | 9373 | 5634 | 19773 | 16355 |
| | 9371 | 12698 | 14876 | 22790 | 2402 | 17017 | 940 | 939 | 10096 | 12386 | 14050 | 14053 |
| | 12408 | 13921 | 750 | 749 | 747 | 782 | 745 | 13889 | 23094 | 1437 | 9150 | 15701 |
| | 15718 | 16604 | 16769 | 4942 | 9955 | 17675 | 17719 | 5750 | 10034 | 15754 | 15676 | 14020 |
| | 14046 | 24075 | 21228 | 13946 | 13951 | 14044 | 14024 | 21225 | 21215 | 21221 | 21178 | 21130 |
| | 14818 | 13135 | 14805 | 14808 | 4966 | 15784 | 1369 | 1366 | 1505 | 1403 | 1475 |
| | 1396 | 1514 | 1389 | 1436 | 20903 | 14048 | 11618 | 10831 | 10827 | 10832 | 11612 | 20983 |
| | 4694 | 11282 | 15719 | 15838 | 16670 | 9229 | 5754 | 8876 | 25306 | 19624 | 11594 | 21987 |
| | 21997 | 14640 | 8051 | 649 | 610 | 20183 | 19318 | 715 | 20268 | 19159 | 10713 | 19358 |
| | 19475 | 2718 | 2719 | 13891 | 23044 | 23072 | 23046 | 23077 | 6817 | 6915 | 6790 | 6774 |
| | 19354 | 19357 | 13705 | 13708 | 13710 | 13714 | 13716 | 13747 | 13739 | 13741 | 13743 | 13745 |
| | 13781 | 13782 | 13785 | 13789 | 14809 | 14784 | 13828 | 13833 | 14817 | 14777 | 13835 | 13840 |
| | 4611 | 7376 | 7096 | 7374 | 7373 | 936 | 934 | 21135 | 20975 | 21169 | 21087 | 20978 |
| | 10586 | 20935 | 21134 | 14270 | 13778 | 17534 | 17537 | 9633 | 20901 | 28711 | 27949 | 21098 |
| | 4832 | 385 | 10134 | | | | | | | | | |
| 515: | 21290 | 5113 | 10834 | 24810 | 4054 | 3176 | 24225 | 12009 | 21368 | 7302 | 8961 | 6157 |
| | 3943 | 9934 | 26831 | 10132 | 15895 | 7282 | 20949 | 16473 | 27284 | 8644 | 5550 | 15133 |
| | 18257 | 24023 | 2317 | 6190 | 8953 | 20344 | 13069 | 2192 | 28175 | 12896 | 13677 | 1143 |
| | 4793 | 10109 | 7604 | 3381 | 18047 | 3245 | 23727 | 30248 | 16113 | 23595 | 7606 | 6573 |
| | 19236 | 21032 | 9806 | 28383 | 19431 | 980 | 16998 | 7275 | 2198 | 1289 | 23562 | 13235 |
| | 720 | 26429 | 1312 | 7580 | 16923 | | | | | | | |
| 516: | 17638 | 29775 | 19546 | 7100 | 21078 | 29472 | 26206 | 14606 | 5866 | 21542 | 10893 | 23028 |
| | 28069 | 9435 | 27011 | 4314 | 20175 | 18297 | 12978 | 2762 | 20143 | 6089 | 27189 | 27017 |
| | 23784 | 23697 | 24689 | 6779 | 23568 | 16806 | 2628 | 19337 | 27084 | 30085 | 8185 | 16480 |
| | 5557 | 1961 | 2421 | 18364 | 24072 | 10205 | 19813 | 12996 | 13094 | 7636 | 29267 | 15739 |
| | 10609 | 16763 | 26659 | 2575 | 17702 | 15594 | 12665 | 29225 | 8278 | 9180 | 28016 | 29556 |
| | 25090 | 24005 | 9907 | 28287 | 21642 | 24941 | 24942 | 5491 | 2270 | 16971 | 5215 | 5062 |
| | 5059 | 5054 | 16969 | 22674 | 10175 | 10170 | 10172 | 10072 | 29929 | 10173 | 14928 | 20423 |
| | 14922 | 8299 | 26409 | 3588 | 7503 | 26584 | 8043 | 28658 | 1029 | 12685 | 17300 | 9165 |
| | 30326 | 7436 | 23962 | 28830 | 25587 | 12369 | 23509 | 9475 | 27204 | 8176 | 29489 | 23188 |
| | 18480 | 2148 | 19133 | 24058 | 4847 | 582 | 800 | 10954 | 11217 | | | |
| 517: | 21770 | 30011 | 30013 | 5855 | 4865 | 5700 | 5706 | 5859 | 5791 | 5752 | 5728 | 5724 |
| | 5658 | 4862 | 4829 | 5824 | 5795 | 4859 | 5786 | 5848 | 5821 | 5698 | 5670 | 5699 |
| | 5664 | 22816 | 29343 | 15969 | 15231 | 3408 | 12434 | 6846 | 18881 | 5093 | 3559 | 26787 |
| | 17007 | 6775 | 6773 | 9005 | 9002 | 8310 | 8317 | 6519 | 19404 | 21689 | 19427 | 7861 |
| | 10335 | 10332 | 6295 | 5905 | 14072 | 9143 | 17653 | 20883 | 27755 | 15198 | 27238 | 27235 |
| | 13829 | 13621 | 15190 | 11997 | 6232 | 3608 | 7261 | 28197 | 1254 | 12545 | 15825 | 15823 |
| | 9461 | 9465 | 24609 | 15683 | 12603 | 29951 | 9133 | 5839 | 6831 | 17073 | 16192 | 11603 |
| | 15973 | 15725 | 11616 | 6056 | 6054 | 18067 | 7608 | 29384 | 25428 | 983 | 9576 | 9578 |
| | 7050 | 9539 | 17232 | 26208 | 6738 | 7303 | 9533 | 28961 | 9530 | 17883 | 15373 | 4706 |
| | 15028 | 26207 | 8829 | 17171 | 6877 | 18002 | 6391 | 6390 | 23748 | 23746 | 23721 | 15226 |
| | 28575 | 13516 | 13519 | 7513 | 1247 | 16864 | 16869 | 16860 | 15236 | 21128 | 21162 | 8369 |
| | 4809 | 15959 | 4813 | 14803 | 23564 | 15975 | 23296 | 25872 | 28950 | 20617 | 20612 | 20585 |
| | 20589 | 20591 | 1955 | 12092 | 29243 | 6887 | 23508 | 24581 | 26412 | 25814 | 25817 | 15223 |
| | 24577 | 17336 | 17342 | 10786 | 10820 | 17335 | 9678 | 12419 | 6805 | 11847 | 11874 | 11868 |
| | 11877 | 25604 | 14313 | 14673 | 25291 | 13488 | 12989 | 14149 | 18651 | 1448 | 21435 | 17469 |
| | 15415 | 1104 | 12544 | 14219 | 6226 | 1162 | 12479 | 527 | 23565 | 8755 | 731 | 17150 |
| | 23607 | 23609 | 1057 | 11976 | 12001 | 14156 | 13164 | 30387 | 15233 | 28285 | 20615 | 29661 |
| | 8658 | 9723 | 22231 | 2124 | 5200 | 6043 | 7432 | 2118 | 3482 | 7434 | 3868 | 11931 |
| | 11939 | 11935 | 23750 | 15806 | 15810 | 19068 | 17420 | 12769 | 12770 | 5300 | 5299 | 5303 |
| | 23770 | 12285 | 25513 | 15834 | 13977 | 25515 | 23648 | 25516 | | | | |
| 518: | 1766 | 25623 | 2634 | 8567 | 8546 | 8035 | 8030 | 28060 | 8033 | 13487 | 12426 | 12425 |
| | 27566 | 16382 | 13471 | 13472 | 27829 | 21056 | 5010 | 7641 | 7722 | 17728 | 13546 | 9391 |
| | 8454 | 11625 | 8039 | 26982 | 28645 | 2216 | 19396 | 12857 | 6428 | 6029 | 8927 | 26241 |
| | 28882 | 2058 | 17137 | 23307 | 23313 | 14163 | 30357 | 1765 | 1758 | 22795 | 1762 | 1007 |
| | 12696 | 20720 | 20722 | 21606 | 21600 | 20724 | 9877 | 8100 | 8623 | 9032 | 26511 | 15887 |
| | 17511 | 19373 | 19998 | 11822 | 25957 | 20063 | 20812 | 20816 | 20818 | 24166 | 23982 | 8056 |
| | 26481 | 24795 | 8640 | 22623 | 30201 | 420 | 14318 | 2731 | | | | |
| 519: | 25197 | 11884 | 10001 | 9801 | 25850 | 3323 | 3196 | 26301 | 11122 | 19333 | 25689 | 27968 |
| | 6238 | 2621 | 26736 | 12639 | 4174 | 23354 | 17388 | 27426 | 27427 | 10406 | 21116 | 23213 |
| | 21243 | 29059 | 8253 | 8171 | 5008 | 4506 | 8673 | 5592 | 22265 | 8826 | 22303 | 618 |
| | 16976 | 29729 | 2320 | 27010 | 3688 | 26173 | 14160 | 3350 | 14293 | 18290 | 15945 | 13015 |
| | 4325 | 17647 | 17610 | 21529 | 27333 | 18279 | 29919 | 12396 | 609 | 6953 | 24793 | 9668 |
| | 30204 | 3889 | 3892 | 18054 | 25062 | 20543 | 23442 | 16638 | 28168 | 28173 | 28174 | 5350 |
| | 1914 | 11930 | 24089 | | | | | | | | | |

TABLE 8-continued

| PEP SEQ ID NO: | homolog SEQ ID NOs | | | | | | | | | | |
|---|---|---|---|---|---|---|---|---|---|---|---|
| 520: | 2689 | 14849 | 20863 | 7612 | 25755 | 3539 | 14404 | 22824 | 4568 | 24464 | 6490 | 16629 |
| | 25849 | 20730 | 17593 | 26509 | 6459 | 5167 | 8574 | 8626 | 19464 | 14601 | 11531 | 8491 |
| | 22866 | 26306 | 21750 | 18256 | 12236 | 11056 | 24205 | 15793 | 2311 | 4917 | 10189 | 18004 |
| | 29165 | 15726 | 29715 | 26447 | 12181 | 13562 | 24328 | 6504 | 6665 | 22011 | 22044 | 20372 |
| | 15347 | 14990 | 11045 | 5260 | 17373 | 20928 | 23859 | 3305 | 1833 | 3152 | 8720 | 1113 |
| | 20291 | 22615 | 15019 | 21326 | 11382 | 11389 | 7281 | 24857 | 12221 | 26840 | 26877 | 26883 |
| | 29907 | 19228 | 2630 | 28574 | 3931 | 22277 | 3011 | 12778 | 10598 | 7566 | 18722 | 20915 |
| | 26581 | 19117 | 5375 | 28215 | 22769 | 1891 | 22538 | 20306 | 11808 | 17633 | 19319 | 9819 |
| | 6884 | 16389 | 30016 | 23358 | 25759 | 5468 | 18990 | 18978 | 18976 | 10902 | 10903 | 4755 |
| | 6211 | 24576 | 10925 | 22835 | 27922 | 1663 | 2816 | 27656 | 10912 | 22920 | 16952 | 15822 |
| | 12193 | 15885 | 3916 | 16481 | 2090 | 5235 | 23752 | 17700 | 22846 | 22648 | 25430 | 15548 |
| | 21672 | 9837 | 16822 | 10843 | 14758 | 23165 | 13578 | 15613 | 29761 | 18686 | 23160 | 24538 |
| | 25011 | 28960 | 26247 | 22287 | 25246 | 3205 | 28109 | 19999 | 6434 | 5183 | 18813 | 25027 |
| | 2793 | 28805 | 7455 | 15092 | 24341 | 24919 | 9394 | 26036 | 17100 | 16104 | 5255 | 17147 |
| | 5620 | 10331 | 26139 | 11859 | 18267 | 20614 | 27524 | 22924 | 15741 | 21386 | 14368 | 18695 |
| | 19625 | 21559 | 22647 | 12356 | 12450 | 10772 | 9946 | 24686 | 23039 | 18741 | 13749 | 19442 |
| | 29388 | 1308 | 8573 | 23890 | 23397 | 25108 | 30435 | 6430 | 23944 | 8419 | 30418 | 29445 |
| | 11313 | 21066 | 4729 | 16658 | 28771 | 17865 | 25008 | 17695 | 26533 | 24074 | 8734 | 12776 |
| | 12772 | 1862 | 22372 | 25624 | 25628 | 21945 | 5561 | 10520 | 11880 | 9565 | 17739 | 24912 |
| | 12352 | 18912 | 8247 | 11192 | 19227 | 1203 | 21625 | 2664 | 15404 | 15372 | 2035 | 30315 |
| | 27995 | 2185 | 1860 | 15792 | 15794 | 28925 | 2471 | 27024 | 3479 | 7806 | 27673 | 10067 |
| | 22566 | 3811 | 1026 | 5138 | 4466 | 4569 | 3659 | 7221 | 6890 | 10684 | 14880 | 11619 |
| | 5480 | 14429 | 26775 | 6239 | 15506 | 11172 | 9263 | 4139 | 15183 | 906 | 23440 | |
| 521: | 24439 | 16617 | 16614 | 24792 | 25067 | 26220 | 22153 | 29830 | 15351 | 4278 | 9607 | 5481 |
| | 8057 | 29705 | 18225 | 15593 | 16311 | 7831 | 20757 | 22578 | 11948 | 16905 | 6302 | 9978 |
| | 21179 | 3762 | 13100 | 1232 | 8659 | 10956 | 10849 | 10707 | 16405 | 22360 | 17386 | 7766 |
| | 29684 | 15545 | 23939 | 17526 | 23477 | 23696 | 26536 | | | | | |
| 522: | 1839 | 30065 | 26828 | 30001 | 23943 | 8081 | 3984 | 18730 | 8542 | 30087 | 20248 | 24377 |
| | 21974 | 14359 | | | | | | | | | | |
| 523: | 10402 | 30128 | 746 | 3584 | 9667 | 18721 | 18723 | 29525 | 27516 | 9370 | 4121 | 10700 |
| | 1296 | 13641 | 9927 | 27125 | 23124 | 19608 | 25386 | 27538 | 9922 | 24112 | 13624 | 10702 |
| | 27797 | 10324 | 23709 | 14911 | 3420 | 7361 | 28407 | 13623 | 26488 | 26461 | 20793 | 11323 |
| | 14423 | 14337 | 25741 | 17677 | 25768 | 17701 | 25702 | 17704 | 17671 | 25775 | 25738 | 25770 |
| | 25739 | 25732 | 25700 | 17713 | 17707 | 25737 | 17667 | 25227 | 11372 | 27567 | 3349 | 17768 |
| | 5190 | 11340 | 12888 | 28511 | 2422 | 22136 | 22168 | 22126 | 22131 | 20529 | 20532 | 20498 |
| | 8436 | 15800 | 27619 | 28163 | 28185 | 28153 | 10420 | 22213 | 22215 | 24436 | 22239 | 22308 |
| | 22331 | 16975 | 18672 | 8807 | 22244 | 6725 | 26424 | 22206 | 22208 | 12134 | 12217 | 975 |
| 524: | 17281 | 10048 | 1061 | 27298 | 12259 | 26864 | 1886 | 23852 | 20315 | 17733 | 7467 | 3875 |
| | 11978 | 9586 | 14416 | 7416 | 28871 | 1882 | 659 | 21549 | 22329 | 25113 | 13687 | 17284 |
| | 1383 | 18299 | 19371 | 21742 | 6152 | 29208 | 15547 | 6139 | 30322 | 19120 | 19782 | 19160 |
| | 14435 | 26456 | 6188 | 25334 | 27145 | 19843 | 905 | 9424 | 3425 | 9195 | 25098 | 6204 |
| | 3146 | 14405 | 28133 | 6982 | 4434 | 21377 | 21342 | 4419 | 20571 | 7344 | 26444 | 21696 |
| | 22269 | 9663 | 17145 | 19473 | 2552 | 2832 | 8430 | 9879 | 14432 | 19683 | 14572 | 15648 |
| | 8334 | 1239 | 13248 | 29497 | 2804 | 6376 | 15258 | 19501 | 13997 | 24414 | 9232 | 23983 |
| | 12654 | 11371 | 22407 | 2084 | 8536 | 23598 | 9561 | 7507 | 4985 | 4409 | 27856 | 28041 |
| | 19409 | 16741 | 21812 | 23098 | 15059 | 24965 | 25063 | 26082 | 21256 | 28959 | 8058 | 26692 |
| | 8578 | 6745 | 14232 | 28084 | 2449 | 12813 | 17676 | 10804 | 27586 | 1953 | 13218 | 8651 |
| | 27647 | 15493 | 6119 | 18920 | 20458 | 11219 | 22417 | 21848 | 13037 | 17669 | 22931 | 13993 |
| | 3104 | 1081 | 14038 | 14557 | 18514 | 2788 | 2704 | 18017 | 19063 | 8770 | 8192 | 29482 |
| | 21347 | 1781 | 10370 | 1138 | 4296 | 12660 | 10550 | 23699 | 12569 | 17901 | 24806 | 4573 |
| | 8965 | 21557 | 24755 | 3840 | 9381 | 4636 | 9065 | 17542 | 9276 | 9017 | 10769 | 17242 |
| | 11297 | 10547 | 24762 | 2961 | 5571 | 1158 | 2242 | 16293 | 23330 | 29902 | 17312 | 15931 |
| | 16322 | 1032 | 17813 | 27249 | 23918 | 7162 | 11373 | 25463 | 7147 | 21268 | 11034 | 25050 |
| | 1242 | 12854 | 13232 | 29259 | 13911 | 15250 | 29143 | 9703 | 22736 | 10087 | 24373 | |
| 525: | 23537 | 16291 | 16296 | 16251 | 2956 | 21230 | 14256 | 8499 | 12509 | 14266 | 16518 | |
| 526: | 17830 | 9810 | 13683 | 16742 | 14698 | 29777 | 8999 | 23264 | 12153 | 2738 | 23387 | 15161 |
| | 23239 | 30139 | 27491 | 23265 | 30221 | 30219 | 30199 | 30167 | 30075 | 30031 | 30000 | 29975 |
| | 30193 | 30081 | 30002 | 30106 | 30071 | 30104 | 2584 | 29675 | 14437 | 3246 | 29708 | 9081 |
| | 3432 | 29413 | 5096 | 22761 | 8240 | 10515 | 10516 | 20479 | 11146 | 19360 | 28594 | 26990 |
| | 5263 | 2477 | 22075 | 3549 | 11113 | 12361 | 14473 | 5884 | 7559 | 16166 | 3517 | 7701 |
| | 16380 | 10828 | 6425 | 3522 | 8180 | 24430 | 2669 | 8851 | 23845 | 27485 | 4613 | 2378 |
| | 3794 | 2741 | 2744 | 9921 | 19795 | 29025 | 28243 | 24346 | 7179 | 18979 | 9251 | 5665 |
| | 29266 | 19614 | 4587 | 24441 | 1055 | 2362 | 2546 | 22856 | 13815 | 17041 | 12019 | 4841 |
| | 24704 | 9885 | 15165 | 28995 | 17535 | 13542 | 11551 | 3234 | 13011 | 757 | 3501 | 12835 |
| | 8633 | 8421 | 18328 | 15210 | 26966 | 24559 | 14125 | 2761 | 27861 | 13155 | 3039 | 7089 |
| | 10430 | 27124 | 8859 | 15486 | 15462 | 14410 | 18061 | 29996 | 28883 | 5867 | 5873 | 5876 |
| | 15484 | 7625 | 17291 | 23716 | 21341 | 25840 | 2881 | 21436 | 27316 | 25822 | 5844 | 25607 |
| | 3550 | 22514 | 27847 | 28918 | 10920 | 5353 | 22284 | 14544 | 26995 | 5837 | 5841 | 25266 |
| | 15457 | 15454 | 5870 | 3471 | 20865 | 15407 | 15412 | 28760 | 9839 | 15450 | 15418 | 15414 |
| | 15420 | 25853 | 25264 | 20594 | 1637 | 13580 | 9812 | 5360 | 3463 | 2013 | 3472 | 23788 |
| | 9748 | | | | | | | | | | | |
| 527: | 24446 | 29343 | 21407 | 1978 | 1970 | 15969 | 15231 | 9802 | 18390 | 18389 | 14680 | 19082 |
| | 18391 | 11540 | 5093 | 3559 | 26787 | 9005 | 9002 | 8310 | 6519 | 20095 | 14072 | 9143 |
| | 17653 | 20883 | 27755 | 15198 | 3721 | 29466 | 13621 | 6232 | 3608 | 11358 | 11361 | 7261 |
| | 14788 | 30358 | 1254 | 2190 | 7520 | 24136 | 7731 | 25586 | 3524 | 17782 | 2201 | 15973 |
| | 19038 | 12628 | 19001 | 2796 | 29384 | 25428 | 7050 | 7303 | 634 | 8672 | 20732 | 28961 |
| | 17883 | 26207 | 15028 | 8829 | 17171 | 18002 | 13614 | 19852 | 15226 | 28575 | 13516 | 13519 |
| | 1247 | 7513 | 15236 | 14803 | 23564 | 15975 | 23296 | 25872 | 28950 | 16711 | 29243 | 20096 |

TABLE 8-continued

| PEP SEQ ID NO: | homolog SEQ ID NOs | | | | | | | | | | |
|---|---|---|---|---|---|---|---|---|---|---|---|
| | 26412 | 18845 | 10786 | 17335 | 9678 | 25604 | 13488 | 14149 | 3283 | 17045 | 21435 | 14219 |
| | 12544 | 1057 | 11976 | 11975 | 12001 | 14156 | 13164 | 15233 | 28285 | 8658 | 14918 | 5200 |
| | 2118 | 7434 | 23750 | 15810 | 28718 | 29857 | 17420 | 25851 | 8755 | | | |
| 528: | 16492 | 6409 | 2252 | 1593 | 19867 | 28929 | 30208 | 13118 | 21413 | 12266 | 21411 | 28238 |
| | 9482 | 6938 | 27956 | 30367 | 4687 | 9664 | 18377 | 6766 | 6719 | 24296 | 17192 | 14935 |
| | 16375 | 3675 | 14099 | 4268 | 530 | | | | | | | |
| 529: | 22898 | 22919 | 4748 | 22980 | 30423 | 15119 | 24626 | 932 | 10860 | 16283 | 12991 | 20127 |
| 530: | 16492 | 6409 | 1593 | 19867 | 2252 | 28929 | 30208 | 13118 | 21413 | 12266 | 21411 | 28238 |
| | 9482 | 6938 | 27956 | 30367 | 4687 | 9664 | 18377 | 6766 | 6719 | 24296 | 17192 | 14935 |
| | 16375 | 3675 | 14099 | 4268 | 528 | 24265 | | | | | | |
| 531: | 1675 | 6747 | 9024 | 20653 | 21604 | 15192 | 16195 | 30132 | 8696 | 9651 | 10734 | 18036 |
| | 10373 | 7230 | 20184 | 7055 | 14708 | 2071 | 16818 | 9305 | 18261 | 10313 | 9104 | 10846 |
| | 15498 | 10811 | 10836 | 6197 | 6676 | 6675 | 6748 | 28327 | 3822 | 25411 | 22070 | 27551 |
| | 26669 | 30270 | 5153 | 20247 | 2823 | 10651 | 21365 | 24415 | 20606 | 13317 | 16566 | 22225 |
| | 18828 | 21467 | 18664 | 6674 | 21325 | 6680 | 18734 | 8153 | 27563 | 25667 | 29627 | 4344 |
| | 29742 | 3648 | 2841 | 26738 | 11273 | 11248 | 15844 | 13246 | 13282 | 22458 | 8466 | 29937 |
| | 19600 | 16194 | 29276 | 21189 | 24558 | 24568 | 23654 | 20112 | 30156 | 26176 | 954 | 18522 |
| | 24967 | 25531 | 16036 | 27834 | 19239 | 6710 | 26317 | 18659 | 13733 | 12973 | 20870 | 19262 |
| | 24907 | 26091 | 27855 | 27872 | 25795 | 15417 | 4882 | 22678 | 14382 | 30339 | 2155 | 18657 |
| | 6681 | 6685 | 17903 | 17894 | 17898 | 28166 | 1755 | 3114 | 30029 | 6714 | 30415 | 30416 |
| | 30136 | 3010 | 14351 | 14347 | 18663 | 3085 | 26884 | 25919 | 25627 | 27129 | 23585 | 16697 |
| | 24254 | 22311 | 1805 | 4618 | 29326 | 12209 | 8145 | 7712 | 13051 | 18626 | 27207 | 15402 |
| | 28900 | 9215 | 17833 | 26035 | 19110 | 8394 | 25682 | 1973 | 17372 | 19332 | 7535 | 9804 |
| | 4896 | 8040 | 10235 | 10407 | 29660 | 22707 | 8266 | 22906 | 23726 | 14107 | 11376 | 5068 |
| | 3753 | 13316 | 13653 | 5032 | 25221 | 2310 | 6694 | 23479 | 23270 | 24930 | 20214 | 20704 |
| | 17506 | 12834 | 7512 | 21667 | 27720 | 2463 | 3970 | 1738 | 18275 | 19022 | 24566 | 18747 |
| | 12306 | 22142 | 15316 | 12971 | 6069 | 9071 | 16992 | 7489 | 3063 | 21740 | 1400 | 29941 |
| | 7403 | 6464 | 11415 | 16092 | 4254 | 1222 | 6822 | 1684 | 1720 | 18021 | 8323 | 22224 |
| 532: | 7364 | 29443 | 860 | 12274 | 4596 | 25725 | 30280 | 12581 | 7597 | 26675 | 12353 | 16673 |
| | 13436 | 1092 | 5023 | 22887 | 1097 | 24622 | 7524 | 3315 | 14207 | 8563 | 22909 | 9610 |
| | 25598 | 14994 | 3885 | 19801 | 9273 | 11933 | 12775 | 20422 | | | | |
| 533: | 28376 | 13430 | 9755 | 29312 | 6924 | 16479 | 18829 | 21115 | 11828 | 13457 | 24688 | 16663 |
| | 22717 | 10343 | 15684 | 28381 | 23673 | 17085 | 21309 | 24356 | 28514 | 25283 | 4923 | 22990 |
| | 8490 | 8880 | 10422 | 12749 | 18007 | 5763 | 8581 | 21433 | 5689 | 21120 | 16299 | 26580 |
| | 1685 | 20921 | 29093 | | | | | | | | | |
| 534: | 11865 | 5762 | 26893 | 29386 | 28054 | 28057 | 28051 | 28053 | 19402 | 18298 | 18321 | 20379 |
| | 30260 | 20170 | 26373 | 28700 | 28701 | 18746 | 11370 | 11286 | 11412 | 16021 | 15038 | 9660 |
| | 9697 | 9721 | 9693 | 12599 | 24997 | 21866 | 21417 | 2876 | 21418 | 15790 | 21869 | 30165 |
| | 12850 | 12849 | 12856 | 12848 | 12853 | 10934 | 18040 | 12715 | 8243 | 1096 | 18754 | 11923 |
| | 5388 | 6595 | 21842 | 14955 | 12331 | 20861 | 14547 | 23644 | 26004 | 2001 | 11490 | 14934 |
| | 6066 | 6208 | 3375 | 6663 | 15126 | 15715 | 28092 | 14463 | 17166 | 2313 | 20148 | |
| 535: | 14286 | 3849 | 11781 | 26893 | 29386 | 28054 | 28057 | 28053 | 28051 | 19402 | 18298 | 18321 |
| | 21864 | 1838 | 23932 | 30158 | 20379 | 30260 | 20170 | 26373 | 28700 | 28701 | 18746 | 11370 |
| | 11412 | 11286 | 9721 | 9697 | 9693 | 12599 | 21866 | 21417 | 2876 | 21418 | | |
| | 15790 | 21869 | 3120 | 30165 | 12850 | 12849 | 12856 | 12848 | 12853 | 8243 | 1096 | 18754 |
| | 12715 | 5388 | 18040 | 11923 | 10934 | 6595 | 21842 | 21109 | 14955 | 12331 | 20861 | 14547 |
| | 23644 | 26004 | 2001 | 11490 | 14934 | 6066 | 6208 | 3375 | 6663 | | | |
| 536: | 11584 | 13724 | 9554 | 16616 | 11861 | 29446 | 2685 | 2666 | 2692 | 1388 | 2697 | 1585 |
| | 14288 | 1255 | 23869 | 7127 | 24502 | 19874 | 27071 | 12831 | 23261 | 4734 | 874 | 23045 |
| | 23769 | 7502 | 28061 | 18457 | 15556 | 15559 | 15561 | 15555 | 15529 | 21912 | 15390 | 8535 |
| | 8958 | 22252 | 24498 | 13117 | 25178 | 30459 | 15583 | 4752 | 23038 | 18254 | 7244 | 10345 |
| | 20327 | 23212 | 5007 | 30091 | 7554 | 22684 | 5719 | 606 | 20333 | 15301 | 14483 | 792 |
| | 29861 | 15027 | 18648 | 7016 | 13651 | 1770 | 16899 | 16855 | 28048 | 662 | 18404 | 15455 |
| | 14827 | 22321 | 11701 | 24050 | 10538 | 15416 | 15419 | 15425 | 15460 | 15427 | 15380 | 15459 |
| | 2809 | 13727 | 17094 | 9390 | 1327 | 6658 | 9556 | 6697 | 577 | | | |
| 537: | 27487 | 26588 | 15322 | 6441 | 22352 | 19102 | 27509 | 1210 | 26463 | 25898 | 5441 | 27945 |
| 538: | 25121 | 21384 | 7121 | 8414 | 12357 | 27953 | 13398 | 29440 | 4857 | 16974 | 11487 | 18184 |
| | 3613 | 539 | | | | | | | | | | |
| 539: | 25121 | 21384 | 7121 | 8414 | 12357 | 27953 | 13398 | 29440 | 4857 | 16974 | 11487 | 18184 |
| | 3613 | 538 | 11807 | | | | | | | | | |
| 540: | 26182 | 23506 | 4721 | 3407 | 5510 | 28141 | 20289 | 2375 | 19707 | 8478 | 20026 | 20281 |
| | 24204 | 25568 | 13565 | 7885 | 9747 | 12804 | 30409 | 27044 | 26268 | 3082 | 26845 | 25021 |
| | 13039 | 21422 | 20711 | 14460 | 28379 | 6369 | 22171 | 9400 | 14912 | 802 | 24802 | 24771 |
| | 8224 | 1502 | 13255 | 9710 | 8498 | 15184 | 15051 | 4279 | 14087 | 11687 | 5051 | 14366 |
| | 16922 | 10833 | 5999 | 9792 | 11044 | 25909 | 13239 | 13275 | 30135 | 20448 | 13220 | 26919 |
| | 4711 | 23144 | 24827 | 20648 | 21039 | 13567 | 26113 | 26111 | 28444 | 1311 | 29092 | 4556 |
| | 15492 | 23079 | 2536 | 5889 | 23731 | 14554 | 14550 | 17606 | 16023 | 2106 | 26804 | 29756 |
| | 4313 | 8632 | 7678 | 5806 | 20421 | 2398 | 2397 | 27397 | 23276 | 27338 | 4768 | 5609 |
| | 3677 | 11920 | 4686 | 13177 | 8526 | 24531 | 24738 | 13805 | 8112 | 21930 | 11695 | |
| | 22198 | 26120 | 22534 | 6274 | 29542 | 11876 | 14833 | 10972 | 22036 | 12767 | 3160 | 19374 |
| | 20342 | 23781 | 23785 | 20993 | 27499 | 15470 | 9818 | 18102 | 9948 | 9496 | 26547 | 4383 |
| | 10770 | 14240 | 9152 | 7152 | 7188 | 9925 | 6382 | 23444 | 17250 | 21693 | 8186 | 13000 |
| | 11279 | 5403 | 10662 | 27406 | 30083 | 10558 | 28370 | 25205 | 7637 | 14097 | 14998 | 13965 |
| | 21638 | 22371 | 1454 | 29332 | 16216 | 10914 | 19058 | 10891 | 21898 | 21990 | 7195 | 23665 |
| | 28500 | 30320 | 29260 | 2161 | 28836 | 28872 | 18217 | 7183 | 21782 | 4672 | 7865 | 2807 |
| | 6422 | 11110 | 17642 | 19531 | 8184 | 6205 | 26438 | 28401 | 5989 | 22023 | 25740 | 30012 |
| | 7495 | 20566 | 6287 | 29783 | 25646 | 28764 | 28507 | 28368 | 12876 | 28396 | 26416 | 4190 |
| | 28307 | 12312 | 29953 | 26577 | 23693 | 8130 | 24972 | 23063 | 26305 | 26248 | 30064 | 12578 |

TABLE 8-continued

| PEP SEQ ID NO: | homolog SEQ ID NOs | | | | | | | | | | |
|---|---|---|---|---|---|---|---|---|---|---|---|
| | 4576 | 2528 | 24869 | 15032 | 27371 | 12697 | 11650 | 26296 | 12987 | 1871 | 19446 | 25420 |
| | 2484 | 29690 | 19648 | 14582 | 23482 | 17442 | 23413 | 23216 | 3489 | 16477 | 3378 | 10348 |
| | 6138 | 26364 | 4192 | 8154 | 11757 | 7232 | 23920 | 1542 | 22099 | 5372 | 5373 | 12265 |
| | 1068 | 4102 | 21878 | 21348 | 19892 | 19977 | 21412 | 16436 | 16433 | 20230 | 8918 | 8920 |
| | 22210 | 5330 | 9026 | 10213 | 8952 | 9259 | 29706 | 13303 | 21389 | 10071 | 13931 | 8560 |
| | 14982 | 10498 | 10495 | 17994 | 5401 | 16858 | 8768 | 9509 | 20814 | 17937 | 7058 | 22326 |
| | 29480 | 21749 | 14578 | 14549 | 29370 | 27230 | 24836 | 18516 | 2993 | 23324 | 5787 | 22836 |
| | 5723 | 8582 | 7719 | 27248 | 1568 | 19599 | 2387 | 23790 | 26678 | 22983 | 7013 | 29168 |
| | 15058 | 1150 | 27458 | 4374 | 29230 | 29228 | 6520 | 21564 | 9671 | 11335 | 11057 | 11637 |
| | 24752 | 23041 | 3411 | 29513 | 21057 | 21024 | 17434 | 19365 | 16579 | 10330 | 29074 | 24593 |
| | 6689 | 17303 | 25838 | 22875 | 14716 | 13596 | 19206 | 14325 | 21526 | 28194 | 1382 | 2941 |
| | 1109 | 23948 | 7856 | 7884 | 7993 | 5686 | 5875 | 12179 | 10478 | 23287 | 18636 | 18621 |
| | 14476 | 14438 | 11410 | 22059 | 5037 | 18708 | 6815 | 6411 | 4820 | 17808 | 4072 | 23969 |
| | 27659 | 1547 | 12788 | 29619 | 26791 | 9760 | 4675 | 23624 | 23629 | 14213 | 22376 | 21266 |
| | 8617 | 8615 | 2769 | 4406 | 29450 | 23238 | 27234 | 17190 | 19530 | 29629 | 19814 | 18473 |
| | 19369 | 28542 | 4823 | 19881 | 20715 | 19875 | 16404 | 15253 | 14816 | 14131 | 7741 | 23111 |
| | 16329 | 26383 | 5163 | 5886 | 12961 | 15592 | 27761 | 19879 | 22640 | 7217 | 14628 | 1248 |
| | 18929 | 16814 | 26863 | 24767 | 2595 | 2583 | 6079 | 22291 | 22294 | 25697 | 765 | 1356 |
| | 15204 | 12895 | 28219 | 11277 | 18540 | 28892 | 5125 | 2158 | 1919 | 2932 | 12172 | 23725 |
| | 22155 | 5485 | 9908 | 10329 | 7268 | 7386 | 5378 | 11875 | 20489 | 16154 | 26344 | 1991 |
| | 15586 | 12459 | 9866 | 5442 | 12096 | 26240 | 19959 | 20139 | | | | |
| 541: | 22243 | 22240 | 26949 | 26774 | 29683 | 23772 | 17552 | 29740 | 9778 | 2873 | 22325 | 7529 |
| | 19007 | 11351 | 13667 | 14798 | 14772 | 16896 | 17729 | 8513 | 7501 | 26528 | 25615 | 24929 |
| | 15979 | 15977 | 26249 | 6954 | 14735 | 22375 | 2091 | 2095 | 27749 | 12131 | 24367 | 23704 |
| | 17863 | 19615 | 20629 | 12939 | 17501 | 16781 | 19684 | 21815 | 12638 | 12466 | 17498 | 21314 |
| | 7505 | 7500 | 7482 | 7478 | 7472 | 7509 | 21278 | 20224 | 9137 | 4082 | 20639 | 18719 |
| | 18718 | 18716 | 9036 | 3732 | 10733 | 18116 | 2287 | 8712 | 24065 | 21209 | 12250 | 19361 |
| | 1405 | 7693 | 3342 | 8585 | 14052 | 18176 | 13379 | 26334 | 17183 | 27452 | 21264 | 25368 |
| | 26540 | 22791 | 18496 | 7202 | 16662 | 7709 | 8412 | 4184 | 3904 | 7099 | 24703 | 16027 |
| | 27455 | 27486 | 27374 | 26793 | 22065 | 27056 | 29553 | 10267 | 28673 | 4312 | 28128 | 23355 |
| | 25487 | 22549 | 30363 | 3300 | 16696 | 8688 | 7382 | 16950 | 1795 | 4152 | 22188 | 2790 |
| | 3302 | 23083 | 18446 | 1610 | 19171 | 10417 | 14619 | 1067 | 10645 | 10299 | 22958 | 16083 |
| | 16622 | 22863 | 27719 | 29767 | 19818 | 20006 | 27261 | 27241 | 11614 | 11588 | 11647 | 27762 |
| | 22120 | 14245 | 1071 | 12970 | 18409 | 27276 | 6326 | 2447 | 14057 | 17251 | 23173 | 5268 |
| | 5272 | 7657 | 8298 | 7780 | 3599 | 15364 | 29591 | 29503 | 17641 | 22582 | 18858 | 28395 |
| | 20159 | 12662 | 19081 | 16368 | 23618 | 11114 | 15437 | 1679 | 4012 | 6344 | 23108 | 23085 |
| | 23082 | 23080 | 23103 | 14066 | 7803 | 24918 | 15433 | 9008 | 6879 | 19641 | 15435 | 19032 |
| | 11136 | 3314 | 19051 | 25287 | 18258 | 1814 | 15532 | 15536 | 15802 | 23603 | 24372 | 24211 |
| | 15438 | 15430 | 11291 | 1865 | 7570 | 28732 | 632 | 15426 | 14712 | 14711 | 14713 | 11429 |
| | 18952 | 24537 | 12400 | 12462 | 9297 | 9294 | 798 | 30272 | 30269 | 15758 | 28047 | 3077 |
| | 22570 | 27250 | 6443 | 8290 | 2926 | 11586 | 20772 | 20776 | 20775 | 25367 | 7673 | 7659 |
| | 11307 | 7710 | 7715 | 7708 | 6014 | 5973 | 5970 | 5967 | 5964 | 20151 | 6021 | 5977 |
| | 14752 | 9944 | 29498 | 23222 | 23211 | 23254 | 22474 | 23367 | 16955 | 16753 | 6873 | 28254 |
| | 20645 | 22646 | 25158 | 23132 | 23135 | 5694 | 27562 | 12106 | 21555 | 5221 | 27356 | 27354 |
| | 27358 | 27360 | 27383 | 9917 | 2241 | 11710 | 15476 | | | | | |
| 542: | 20858 | 10809 | 26142 | 14612 | 16454 | 19545 | 19537 | 19540 | 8482 | 24371 | 4160 | 20283 |
| | 14553 | 6799 | 25202 | 9659 | 14445 | 24224 | 27194 | 8364 | 19737 | 19738 | 8866 | 7937 |
| | 25944 | 25059 | 10155 | 21478 | 7852 | 7102 | 14451 | 6950 | 5026 | 14406 | 28090 | 5094 |
| | 21421 | 13411 | 27424 | 6366 | 14790 | 22169 | 26988 | 24801 | 2483 | 13224 | 14147 | 14409 |
| | 14494 | 14517 | 14518 | 14520 | 14521 | 7173 | 19631 | 19633 | 29864 | 19669 | 19674 | 22743 |
| | 4381 | 12661 | 8374 | 12058 | 12037 | 27740 | 24959 | 11750 | 14092 | 11686 | 12278 | 12798 |
| | 4989 | 7115 | 11906 | 25912 | 26228 | 24830 | 26620 | 20613 | 23068 | 23086 | 1638 | 4563 |
| | 4496 | 15519 | 1197 | 14710 | 5891 | 26941 | 26940 | 26894 | 26897 | 26904 | 26938 | 26888 |
| | 26891 | 4320 | 28614 | 2396 | 15349 | 5649 | 3734 | 19586 | 7900 | 2208 | 22821 | 15320 |
| | 29934 | 11345 | 22535 | 1531 | 21396 | 14482 | 8469 | 29548 | 28635 | 9987 | 2543 | 21166 |
| | 10952 | 12764 | 20540 | 23787 | 21038 | 27498 | 15465 | 17855 | 5288 | 27678 | 14444 | 14239 |
| | 19778 | 7222 | 9980 | 3241 | 6735 | 17248 | 8355 | 5396 | 7572 | 4642 | 26594 | 30266 |
| | 12513 | 15663 | 1676 | 1570 | 13712 | 25028 | 25204 | 15030 | 8967 | 9847 | 17346 | 22369 |
| | 24433 | 3228 | 1492 | 21919 | 16560 | 18490 | 3457 | 29822 | 16356 | 20957 | 8669 | 27349 |
| | 8556 | 22593 | 19181 | 14071 | 2338 | 26913 | 23223 | 19740 | 19741 | 19702 | 6424 | 12427 |
| | 19528 | 28651 | 26436 | 23695 | 9106 | 18680 | 25651 | 29778 | 3385 | 25547 | 23653 | 16465 |
| | 29957 | 23660 | 28119 | 25123 | 23161 | 10341 | 10337 | 17877 | 16926 | 6313 | 5335 | 27126 |
| | 12985 | 8913 | 19166 | 26170 | 15524 | 3225 | 17431 | 25803 | 19232 | 22221 | 21808 | 25987 |
| | 3306 | 21033 | 12951 | 5949 | 12101 | 11207 | 26677 | 5377 | 3154 | 10277 | 4237 | 10464 |
| | 21397 | 26222 | 24026 | 22976 | 16432 | 14172 | 24505 | 8923 | 20766 | 7372 | 30063 | 22214 |
| | 27929 | 8234 | 29711 | 2824 | 2892 | 13307 | 1027 | 2055 | 10073 | 17104 | 8541 | 15113 |
| | 10000 | 24419 | 9110 | 10493 | 28628 | 22247 | 5404 | 29270 | 16863 | 3428 | 28997 | 21506 |
| | 14549 | 25281 | 28269 | 28867 | 11006 | 17838 | 27771 | 12933 | 20692 | 19733 | 19704 | 27251 |
| | 2386 | 19598 | 10663 | 23428 | 2637 | 27711 | 19997 | 18774 | 25727 | 27718 | 9402 | 6666 |
| | 24817 | 13556 | 9647 | 5248 | 11562 | 13064 | 16054 | 20698 | 15992 | 23836 | 26766 | 12367 |
| | 9376 | 25609 | 21567 | 12837 | 15575 | 19584 | 14844 | 25156 | 21026 | 3140 | 24917 | 25275 |
| | 17394 | 24748 | 18515 | 8565 | 28120 | 13593 | 4610 | 26924 | 13573 | 23412 | 6478 | 10079 |
| | 7860 | 12653 | 7702 | 19415 | 11774 | 6562 | 10481 | 11804 | 6051 | 18624 | 18909 | 8442 |
| | 12311 | 22061 | 17975 | 11180 | 17334 | 3404 | 6618 | 3733 | 12950 | 9766 | 5493 | 3980 |
| | 23627 | 23968 | 14205 | 26388 | 16017 | 19226 | 30230 | 22394 | 8620 | 15956 | 19582 | 19549 |
| | 19585 | 29807 | 19635 | 19638 | 19666 | 29483 | 23233 | 375 | 21589 | 4151 | 18853 | 16248 |
| | 21296 | 24366 | 16526 | 10967 | 7110 | 2896 | 26390 | 27580 | 28419 | 16446 | 16451 | 17612 |
| | 28143 | 14479 | 8885 | 17298 | 5845 | 14415 | 14487 | 14465 | 14491 | 13609 | 14489 | 14378 |

TABLE 8-continued

| PEP SEQ ID NO: | homolog SEQ ID NOs | | | | | | | | | | |
|---|---|---|---|---|---|---|---|---|---|---|---|
| | 13581 | 14371 | 13583 | 14374 | 13616 | 13608 | 13572 | 14389 | 13612 | 14384 | 13577 | 13619 |
| | 14449 | 13570 | 14523 | 21910 | 14411 | 16057 | 19767 | 23470 | 15894 | 16817 | 25786 | 2582 |
| | 28328 | 20366 | 22975 | 16439 | 22295 | 21402 | 19862 | 28494 | 14459 | 1199 | 24733 | 4349 |
| | 14073 | 5733 | 23439 | 4372 | 13627 | 8409 | 28221 | 27151 | 26080 | 26055 | 25984 | 25982 |
| | 26010 | 25976 | 26083 | 26822 | 26852 | 25978 | 26017 | 25959 | 26132 | 26133 | 26850 | 26859 |
| | 26820 | 26825 | 26106 | 26109 | 26105 | 26022 | 26026 | 26827 | 25956 | 26085 | 25981 | 26135 |
| | 26131 | 26104 | 26102 | 26076 | 26057 | 26015 | 26159 | 26818 | 26156 | 26053 | 26054 | 26161 |
| | 26060 | 26136 | 26163 | 26160 | 20849 | 20846 | 25951 | 25955 | 20885 | 20842 | 26078 | 20891 |
| | 20886 | 20850 | 20808 | 20838 | 20718 | 19833 | 20686 | 21980 | 19803 | 19799 | 20687 | 19794 |
| | 19772 | 19797 | 21983 | 19770 | 21981 | 19842 | 19839 | 21960 | 20689 | 20719 | 19832 | 19805 |
| | 21976 | 16489 | 16456 | 21012 | 20804 | 20767 | 20754 | 16486 | 20973 | 20970 | 21908 | 20969 |
| | 21880 | 21010 | 20759 | 20930 | 20895 | 20923 | 21879 | 20966 | 21847 | 21911 | 21044 | 21948 |
| | 21838 | 21004 | 20972 | 21882 | 21844 | 21050 | 21055 | 21014 | 21003 | 21843 | 21916 | 16491 |
| | 21957 | 21915 | 20893 | 20723 | 20796 | 21845 | 21953 | 21877 | 21946 | 20721 | 21048 | 20927 |
| | 20925 | 26854 | 20926 | 21884 | 26858 | 21828 | 21803 | 2162 | 1916 | 5079 | 2116 | 14186 |
| | 4604 | 4553 | 4521 | 13195 | 24012 | 20562 | 18518 | 6546 | 957 | 13095 | 2878 | 25070 |
| | 5498 | 20329 | 27871 | 15849 | | | | | | | | |
| 543: | 15285 | 20482 | 26613 | 13010 | 14587 | 23348 | 17517 | 1915 | 30335 | 17540 | 18023 | 13902 |
| | 2215 | 19384 | 5020 | 18425 | 13592 | 17005 | 27801 | 12620 | 13102 | 14308 | 12370 | 25212 |
| | 18833 | 13754 | 16338 | 24536 | 17029 | 28412 | 23157 | 6821 | 12613 | 5346 | 28829 | 3443 |
| | 14707 | 14529 | 24381 | 10928 | 26280 | 16516 | | | | | | |
| 544: | 4536 | 25496 | 28709 | 6661 | 25923 | 19605 | 8730 | 26387 | 24734 | 27819 | 26391 | 24458 |
| | 1276 | 27415 | 13295 | 21712 | 2654 | 9901 | 28582 | 3974 | 9593 | 12761 | 5972 | 17010 |
| | 17012 | 18764 | 18766 | 26843 | 11762 | 5896 | 25057 | 22202 | 7424 | 8694 | 18683 | 12734 |
| | 28761 | 13476 | 15235 | 18427 | 27902 | 26887 | | | | | | |
| 545: | 12056 | 13356 | 8152 | 11079 | 6304 | 8906 | 15970 | 12431 | 25131 | 7138 | 7325 | 29624 |
| | 4272 | 19148 | 22274 | 20301 | 11681 | 23992 | 20167 | 12503 | 12758 | 20453 | 21517 |
| | 9990 | 20365 | 8227 | 12406 | 24019 | 2884 | 1943 | 26426 | 21282 | 16574 | 10447 | 28071 |
| | 23258 | 25792 | 23010 | 4308 | 8045 | 16351 | 6883 | 6696 | 15209 | 3194 | 8198 | 15469 |
| | 16547 | 30383 | 5262 | 29564 | 30255 | 25461 | 17243 | 27291 | 13943 | 23751 | 21208 | 26238 |
| | 8332 | 27345 | 22817 | 17321 | 27526 | 25049 | 23169 | 8088 | 22673 | 28856 | 8990 |
| | 22046 | 4267 | 8099 | 8700 | 6867 | 3156 | 17467 | 29726 | 11140 | 24478 | 14750 | 625 |
| | 6451 | 8709 | 28679 | 28038 | 28001 | 24064 | 14675 | 20054 | 7000 | 3451 | 6116 | 6082 |
| | 6076 | 22932 | 15566 | 15563 | 21665 | 21666 | 11642 | 12287 | 6557 | 3864 | 2918 | 21850 |
| | 3189 | 20742 | 3187 | 19334 | 26824 | 996 | 19103 | 19430 | 8381 | 12625 | 16081 | 16825 |
| | 6972 | 12801 | 26676 | 22290 | 12917 | 21013 | 9589 | 24625 | 29608 | 6071 | 23377 | 23980 |
| | 12412 | 1989 | 27630 | 28363 | 11724 | 4814 | 23346 | 25177 | 831 | 16951 | | |
| 546: | 16231 | 8527 | 24427 | 23271 | 23243 | 25551 | 18288 | 7869 | 11697 | 11141 | 13630 | 14901 |
| | 28300 | 12403 | 15034 | 2921 | 27414 | 5640 | 3475 | 28127 | 22446 | 21874 | 21875 | 26216 |
| | 17530 | 27795 | 8524 | 2321 | 8493 | 8530 | 28494 | 23701 | 30045 | 30432 | 27595 |
| 547: | 22240 | 22243 | 26774 | 29683 | 26949 | 9732 | 16548 | 17552 | 29740 | 24038 | 7529 | 11351 |
| | 19007 | 14772 | 14798 | 27139 | 30265 | 17691 | 26528 | 25615 | 1769 | 7501 | 15977 | 24929 |
| | 15979 | 26249 | 6954 | 6081 | 4811 | 22375 | 2091 | 2095 | 17501 | 19593 | 16053 | 9137 |
| | 4082 | 10703 | 20639 | 18719 | 18718 | 3732 | 10733 | 9036 | 8712 | 2287 | 26795 | 21209 |
| | 3361 | 19361 | 7693 | 3342 | 18176 | 13379 | 23433 | 27452 | 16662 | 9601 | 4184 | 28719 |
| | 14891 | 23285 | 27401 | 27056 | 21680 | 28083 | 30363 | 3300 | 20716 | 10231 | 17069 | 29023 |
| | 1610 | 19171 | 10417 | 14619 | 27669 | 29767 | 27261 | 27241 | 27762 | 22120 | 12970 | 1071 |
| | 14245 | 2874 | 6019 | 5268 | 5272 | 7545 | 27088 | 28278 | 14365 | 12561 | 28395 | 20159 |
| | 12662 | 19081 | 20880 | 16368 | 23618 | 11114 | 8208 | 29667 | 18517 | 21904 | 4520 | 18090 |
| | 20800 | 5908 | 4172 | 16285 | 6944 | 14066 | 25462 | 6898 | 5734 | 5737 | 19034 | 15089 |
| | 6828 | 14820 | 10334 | 5790 | 5254 | 5014 | 6836 | 6840 | 10524 | 11295 | 28438 | 6345 |
| | 11461 | 12400 | 12462 | 9297 | 9294 | 798 | 30276 | 30279 | 3639 | 10399 | 2937 | 20776 |
| | 20775 | 25367 | 20772 | 7673 | 7659 | 14752 | 29498 | 23222 | 23211 | 23254 | 22474 | 16955 |
| | 28254 | 25158 | 23132 | 23135 | 5694 | 12106 | 27356 | 27354 | 27358 | 27383 | 27360 | 7564 |
| | 2258 | | | | | | | | | | | |
| 548: | 26090 | 24906 | 7328 | 16079 | 13640 | 1998 | 3987 | 24547 | 10118 | 10168 | 19534 | 29751 |
| | 23972 | 19048 | 19518 | 16929 | 12836 | 10980 | 5385 | 12514 | 8603 | 21615 | 14006 | 9621 |
| | 29755 | 3278 | 9131 | 13564 | 783 | 18177 | 14122 | 16367 | 18197 | 10484 | 27976 | 27790 |
| | 10726 | 28360 | 7845 | 8361 | 7214 | 3978 | 10445 | 26641 | 12573 | 11417 | 1937 | 8810 |
| | 18305 | 17353 | 26604 | 11764 | 14422 | 27199 | 13341 | 7149 | 27631 | 850 | 24218 | 22409 |
| | 8455 | 30360 | 3313 | 24294 | 14091 | 12152 | 23301 | 604 | 28356 | 12273 | 17439 | 5642 |
| | 24682 | 21304 | 19627 | 21743 | 5612 | 8426 | 27392 | 19043 | 29067 | 5266 | 8170 | 5679 |
| | 6456 | 10383 | 22771 | 8450 | 17154 | 17655 | 21229 | 10695 | 22850 | 20714 | 3703 | 17981 |
| | 27996 | 24666 | 29419 | 13898 | 25251 | 2927 | 968 | 25866 | 11823 | 11437 | 11556 | 29559 |
| | 28036 | 22558 | 28576 | 18030 | 644 | 20487 | 13123 | 6229 | 21755 | 4019 | 11073 | 14826 |
| | 8138 | 4868 | 5476 | 13751 | 26764 | 24215 | 21989 | 8521 | 23457 | 22775 | 15037 | 29764 |
| | 12464 | 17472 | 1453 | 3416 | 1990 | 16594 | 2573 | 20483 | 23359 | 4684 | 14747 | 21853 |
| | 9108 | 9107 | 22028 | 22025 | 22021 | 24031 | 21991 | 26569 | 29011 | 5830 | 3328 | 15099 |
| | 15130 | 21719 | 26252 | 13720 | 2076 | 11918 | 4664 | 8250 | 28676 | 18541 | 9328 | 2455 |
| | 2456 | 2459 | 27366 | 27372 | 27370 | 13269 | 13267 | 9730 | 9757 | 9762 | 21183 | 21426 |
| | 14657 | 11572 | 11571 | 15508 | 22496 | 21996 | 21999 | 995 | 14372 | 14890 | 14882 | 14886 |
| | 14908 | 30442 | 13868 | 14633 | 10627 | 10628 | 10603 | 9996 | 18761 | 17083 | 26475 | 9727 |
| | 28330 | 16618 | 2998 | 21992 | 24297 | 24316 | 2970 | 22223 | 16540 | 763 | 16890 |
| | 3910 | 16235 | 11545 | 28378 | 28077 | 2792 | 23797 | 2309 | 14104 | 7723 | 27167 | 10108 |
| | 12589 | 10780 | 13561 | 10432 | 24018 | 30465 | 23865 | 12964 | 15841 | 26552 | 1195 | 25683 |
| | 8249 | 30246 | 26838 | | | | | | | | | |
| 549: | 1877 | 11478 | 12729 | 25130 | 1968 | 1905 | 22481 | 10656 | 10659 | 29731 | 29801 | 27643 |
| | 17021 | 714 | 21585 | 8258 | 9099 | 4230 | 29698 | 29696 | 26561 | 4191 | 1099 | 29827 |

TABLE 8-continued

| PEP SEQ ID NO: | homolog SEQ ID NOs | | | | | | | | | | |
|---|---|---|---|---|---|---|---|---|---|---|---|
| | 29854 | 7534 | 3244 | 29821 | 29850 | 29824 | 29852 | 10968 | 10966 | 631 | 13526 | 5890 |
| | 3446 | 6703 | 13508 | 3492 | 3495 | 10876 | 13337 | 6008 | 6006 | 6013 | 6015 | 6041 |
| | 6018 | 25925 | 29829 | 29800 | 29831 | 8497 | 7953 | 26401 | 1095 | 1969 | 5740 | 11097 |
| | 11671 | 12568 | 11672 | 13453 | 24895 | 12520 | 11494 | 11458 | 11498 | 15061 | 27293 | 7843 |
| | 6148 | 6153 | 26487 | 878 | 9774 | 22442 | 22471 | 22472 | 22445 | 23110 | 22479 | 3053 |
| | 3019 | 25794 | 3527 | 11473 | 25486 | 25512 | 10716 | 10694 | 10719 | 1101 | 21420 | 20389 |
| 550: | 1877 | 11478 | 12729 | 25130 | 1968 | 1905 | 22481 | 10656 | 10659 | 29731 | 29801 | 27643 |
| | 21585 | 8258 | 9099 | 4230 | 29698 | 29696 | 26561 | 4191 | 1099 | 29827 | 29854 | 7534 |
| | 3244 | 29821 | 29850 | 29824 | 29852 | 10968 | 10966 | 631 | 13526 | 5890 | 3492 | 3446 |
| | 6703 | 13508 | 3495 | 10876 | 13337 | 6008 | 6006 | 6015 | 6013 | 6041 | 6018 | 25925 |
| | 29829 | 29800 | 29831 | 8497 | 7953 | 26401 | 1095 | 1969 | 5740 | 11097 | 11671 | 12568 |
| | 11672 | 13453 | 24895 | 12520 | 11494 | 11458 | 11498 | 15061 | 27293 | 7843 | 6148 | 6153 |
| | 26487 | 878 | 9774 | 22442 | 22471 | 22472 | 22445 | 23110 | 22479 | 3019 | 3053 | 25794 |
| | 3527 | 11473 | 25486 | 25512 | 10716 | 10694 | 10719 | 1101 | 21420 | 20389 | | |
| 551: | 12056 | 13356 | 8152 | 11079 | 24868 | 11081 | 6304 | 8906 | 15970 | 7699 | 12431 | 25131 |
| | 7138 | 7325 | 29624 | 4272 | 19148 | 22274 | 20301 | 11681 | 9560 | 23992 | 21196 | 20167 |
| | 12503 | 12758 | 12507 | 20453 | 21517 | 9990 | 20365 | 12406 | 8227 | 2884 | 1943 | 24019 |
| | 26426 | 21282 | 16574 | 10447 | 28071 | 23258 | 23010 | 25792 | 4308 | 8045 | 6696 | 15209 |
| | 3194 | 8198 | 15469 | 16547 | 30383 | 5262 | 29564 | 17243 | 25461 | 27291 | 13943 |
| | 23751 | 21208 | 12723 | 8360 | 27345 | 22817 | 17321 | 4145 | 27526 | 25049 | 23169 | 28856 |
| | 8990 | 22046 | 4267 | 8099 | 17467 | 14750 | 24478 | 28679 | 8709 | 6451 | 625 | 14675 |
| | 17465 | 17089 | 7006 | 14679 | 3759 | 24990 | 3451 | 6082 | 6116 | 10676 | 6078 | 22932 |
| | 9844 | 15564 | 21687 | 23511 | 12287 | 2918 | 21850 | 3189 | 4533 | 9356 | 12014 | 7981 |
| | 19327 | 26824 | 996 | 19103 | 7585 | 8381 | 12625 | 16081 | 25374 | 6972 | 12801 | 12917 |
| | 9377 | 25188 | 1307 | 879 | 25200 | 17548 | 9926 | 21013 | 9589 | 24625 | 29608 | 6071 |
| | 22139 | 25295 | 25185 | 25344 | 23377 | 23980 | 12412 | 1989 | 27630 | 28363 | 11724 | 4814 |
| | 23346 | 25177 | 1342 | 27275 | 16879 | 6418 | 9242 | 4795 | 1399 | 12175 | 8327 | 8296 |
| 552: | 19781 | 24742 | 27550 | 17602 | 13205 | 15958 | 18307 | 16764 | 3929 | 17477 | 21928 | 14400 |
| | 21933 | 27006 | 916 | 18115 | 6993 | 25331 | 4503 | 4507 | 15940 | 682 | 25053 | 14192 |
| | 24761 | 23031 | 20685 | 11089 | 7209 | 9758 | 10534 | 11206 | 4427 | 9159 | 17658 | 11938 |
| | 3124 | 10347 | 12049 | 9558 | 15502 | 3366 | 27361 | 27355 | 6040 | 3911 | 9985 | 2893 |
| | 9207 | 9103 | 9995 | 26691 | 14148 | 20147 | 20181 | 29859 | 27613 | 12782 | 12786 | 26910 |
| | 16035 | 28693 | 10485 | 28340 | 27984 | 17004 | 14462 | 16386 | 17597 | 29867 | 27179 | 14346 |
| | 18593 | 18567 | 11888 | 9191 | 6960 | 12451 | 28617 | 24925 | 1350 | 30251 | 12302 | 22551 |
| | 22548 | 18216 | 21525 | 9960 | 28505 | 26680 | 18460 | 19054 | 26420 | 2184 | 28630 | 28660 |
| | 15705 | 15724 | 8893 | 14296 | 27310 | 24443 | 15659 | 4093 | 6389 | 2478 | 26983 | 25010 |
| | 13132 | 4295 | 2529 | 2495 | 25236 | 20124 | 2507 | 1152 | 28282 | 645 | 2825 | 1005 |
| | 28518 | 19167 | 21466 | 7537 | 599 | 18087 | 16298 | 18089 | 24852 | 11775 | 11749 | 26204 |
| | 22018 | 27920 | 16003 | 9786 | 18867 | 17703 | 19448 | 25939 | 21338 | 28627 | 2171 | 3726 |
| | 12641 | 16435 | 11830 | 18711 | 9190 | 20376 | 16247 | 3938 | 12903 | 9822 | 2412 |
| | 23436 | 29142 | 28502 | 6323 | 13150 | 28551 | 27425 | 27016 | 2853 | 26310 | 23414 | 19425 |
| | 9079 | 16055 | 5625 | 16085 | 16999 | 15000 | 23468 | 3658 | 3655 | 22468 | 11497 | 11504 |
| | 2129 | 30286 | 25392 | 30355 | 10317 | 10421 | 15053 | 25299 | 16571 | 16554 | 12626 | 11521 |
| | 27936 | 4845 | 9201 | 3312 | 6579 | 9500 | 17290 | 12355 | 10927 | 17798 | 16824 | 14684 |
| | 20018 | 20105 | 26393 | 17519 | 16804 | 21988 | 16061 | 14242 | 29971 | 4816 | 23345 | 3015 |
| | 2322 | 14182 | 7352 | 9049 | 9052 | 9075 | 28540 | 20892 | 24955 | 22823 | 27287 | 11526 |
| | 4828 | 925 | 1159 | 1462 | 20485 | 29252 | 20515 | 28349 | 21472 | 10456 | 24784 | 20662 |
| | 20700 | 17775 | 21939 | 7768 | 1374 | 1120 | 25719 | 29293 | 23096 | 22813 | 8592 | 15249 |
| | 5391 | 1354 | 24887 | 10031 | 11029 | 20019 | 18824 | 18337 | 5546 | 7498 | 8616 | 28777 |
| | 22506 | 24617 | 16583 | 24760 | 3188 | 7237 | 29337 | 23884 | 21937 | 21938 | 27713 | 23133 |
| | 29373 | 3013 | 19023 | 25645 | 29183 | 5089 | 28861 | 8217 | 8794 | 29210 | 10457 | 6835 |
| | 27792 | 1774 | 13788 | 18773 | 27759 | 22960 | 7483 | 3513 | 5800 | 28583 | 11996 | 8087 |
| | 15913 | 4796 | 11215 | 8205 | 23783 | 24712 | 20834 | 22914 | 26209 | 15278 | 29766 | 5769 |
| | 9871 | 11801 | 14191 | 4161 | 21690 | 21721 | 21725 | 9665 | 27460 | 17474 | 25268 | 22523 |
| | 17600 | 21528 | 19363 | 8212 | 27682 | 14221 | 23190 | 24326 | 24128 | 9189 | 8795 | 23067 |
| | 23908 | 23822 | 23843 | 23947 | 23882 | 23846 | 23838 | 23817 | 23878 | 24021 | 23818 |
| | 29053 | 27160 | 7596 | 30008 | 16281 | 24613 | 22747 | 24572 | 28587 | 20237 | 21376 | 7451 |
| | 4727 | 6917 | 4763 | 21170 | 25724 | 9343 | 29782 | 6155 | 29792 | 598 | 3247 | 10391 |
| | 3122 | 3052 | 9087 | 30207 | 16468 | 9873 | 20241 | 10159 | 16271 | 3867 | 13217 | 14330 |
| | 15999 | 1849 | 28546 | 18193 | 6959 | 2022 | 2861 | 4341 | 4298 | 4336 | 12393 | 2559 |
| | 7213 | 6281 | 6306 |
| 553: | 26182 | 26171 | 26138 | 9717 | 23506 | 4721 | 3407 | 5510 | 28141 | 20289 | 2375 | 19707 |
| | 8478 | 20026 | 20281 | 24204 | 25568 | 29196 | 28839 | 29900 | 5917 | 13565 | 7885 | 9747 |
| | 12804 | 30409 | 27044 | 26268 | 3082 | 26845 | 25021 | 13039 | 21422 | 20711 | 14460 | 28379 |
| | 6369 | 22171 | 9400 | 14912 | 8666 | 9592 | 9670 | 802 | 24802 | 24771 | 8224 | 1502 |
| | 13255 | 9710 | 8498 | 15184 | 15051 | 4279 | 14087 | 11687 | 5051 | 14366 | 16922 | 10833 |
| | 5999 | 9792 | 11044 | 25909 | 13239 | 12371 | 13275 | 30135 | 20448 | 13220 | 26919 | 4711 |
| | 23144 | 24827 | 20648 | 21039 | 13567 | 26113 | 26111 | 28444 | 1311 | 29092 | 4556 | 15492 |
| | 26276 | 23079 | 2536 | 5889 | 23731 | 14554 | 14550 | 17606 | 16023 | 2106 | 26804 | 29756 |
| | 4313 | 8632 | 7678 | 5806 | 20421 | 2398 | 2397 | 27397 | 23276 | 27338 | 24306 | 4768 |
| | 5609 | 3677 | 11920 | 4686 | 13177 | 8526 | 24531 | 24738 | 13805 | 8112 | 29518 | 21930 |
| | 11695 | 22198 | 26120 | 22534 | 6274 | 29542 | 11876 | 14833 | 10972 | 22036 | 12767 | 3160 |
| | 19374 | 20342 | 23781 | 23785 | 20993 | 27499 | 15470 | 18102 | 9818 | 29948 | 9496 | 26547 |
| | 4383 | 10770 | 14240 | 9152 | 7152 | 7188 | 9925 | 6382 | 23444 | 17250 | 21693 | 8186 |
| | 13000 | 11279 | 5403 | 10662 | 27406 | 30083 | 10558 | 28370 | 25205 | 7637 | 14097 | 14998 |
| | 13965 | 21638 | 22371 | 1454 | 29332 | 16216 | 10914 | 19058 | 10891 | 21898 | 21990 | 7195 |
| | 23665 | 28500 | 30320 | 29260 | 2161 | 28836 | 28872 | 18217 | 7183 | 21782 | 4672 | 7865 |
| | 2807 | 6422 | 11110 | 17642 | 19531 | 8184 | 6205 | 26438 | 28401 | 5989 | 22023 | 25740 |

TABLE 8-continued

| PEP SEQ ID NO: | homolog SEQ ID NOs | | | | | | | | | | |
|---|---|---|---|---|---|---|---|---|---|---|---|
| | 30012 | 7495 | 20566 | 6287 | 29783 | 25646 | 28764 | 28507 | 28368 | 12876 | 28396 | 26416 |
| | 4190 | 28307 | 12312 | 29953 | 26577 | 23693 | 8130 | 24972 | 23063 | 26305 | 26248 | 30064 |
| | 12578 | 12560 | 4324 | 4576 | 2528 | 24869 | 15032 | 27371 | 12697 | 11650 | 26296 | 12987 |
| | 1871 | 19180 | 23167 | 27165 | 19446 | 25420 | 2484 | 29690 | 19648 | 14582 | 23482 | 17442 |
| | 23413 | 23216 | 3489 | 16477 | 3378 | 10348 | 13228 | 6138 | 26364 | 4192 | 8154 | 11757 |
| | 7232 | 23920 | 1542 | 22099 | 5372 | 5373 | 12265 | 1068 | 4102 | 21878 | 26956 | 30275 |
| | 21348 | 19892 | 19977 | 21412 | 16436 | 16433 | 20230 | 8918 | 8920 | 22210 | 5330 | 9026 |
| | 10213 | 8952 | 9259 | 29706 | 13303 | 21389 | 10071 | 13931 | 18857 | 8560 | 14982 | 10498 |
| | 10495 | 17994 | 5401 | 16858 | 8768 | 9509 | 20814 | 17937 | 7058 | 22326 | 29480 | 21749 |
| | 14578 | 14549 | 29370 | 27230 | 24836 | 18516 | 2993 | 23324 | 5787 | 22836 | 5723 | 8582 |
| | 7719 | 27248 | 1568 | 19599 | 2387 | 23790 | 26678 | 22983 | 7013 | 29168 | 15058 | 1150 |
| | 22530 | 17837 | 26771 | 27458 | 4374 | 29230 | 29228 | 6520 | 21564 | 9671 | 11335 | 11057 |
| | 11637 | 23873 | 24752 | 23041 | 3411 | 29513 | 21057 | 21024 | 17434 | 19365 | 16579 | 10330 |
| | 29074 | 24593 | 6689 | 17303 | 25838 | 22875 | 14716 | 13596 | 19206 | 14325 | 21526 | 28194 |
| | 1382 | 2941 | 1109 | 23948 | 7856 | 7884 | 7993 | 5686 | 5875 | 12179 | 10478 | 23287 |
| | 18636 | 18621 | 14476 | 14438 | 11410 | 22059 | 5037 | 18708 | 6815 | 6411 | 4820 | 17808 |
| | 4072 | 23969 | 27659 | 1547 | 12788 | 29619 | 26791 | 9760 | 4675 | 23624 | 23629 | 14213 |
| | 22376 | 21266 | 8617 | 8615 | 2769 | 25811 | 4406 | 29450 | 23238 | 23234 | 17190 | 19530 |
| | 29629 | 19814 | 18473 | 19369 | 28542 | 4823 | 29640 | 19981 | 20715 | 19875 | 16404 | 15253 |
| | 14816 | 14131 | 7741 | 23111 | 16329 | 26383 | 5163 | 5886 | 12961 | 15592 | 27761 | 19879 |
| | 22640 | 7217 | 14628 | 1248 | 18929 | 16814 | 26863 | 24767 | 2595 | 2583 | 6079 | 22291 |
| | 22294 | 25697 | 765 | 1356 | 15204 | 4401 | 20610 | 17157 | 7629 | 14311 | 9146 | 12895 |
| | 28219 | 11277 | 18540 | 28892 | 11025 | 2158 | 1919 | 2932 | 12172 | 23725 | 22155 | 5485 |
| | 9908 | 10329 | 7268 | 7386 | 5378 | 11875 | 20489 | 16154 | 26344 | 1991 | 15586 | 12459 |
| | 9866 | 5442 | 12096 | 26240 | 19959 | 20139 | | | | | | |
| 554: | 26708 | 26727 | 26707 | 12532 | 13832 | 28786 | 23554 | 3996 | 3961 | 3964 | 3949 | 23584 |
| | 3950 | 23553 | 23574 | 23581 | 23573 | 23582 | 23580 | 3952 | 3994 | 3959 | 3946 | 3955 |
| | 3948 | 28010 | 8799 | 18294 | 5808 | 17684 | 10249 | 768 | | | | |
| 555: | 16550 | 16134 | 23003 | 20840 | 13449 | 2662 | 23631 | 14173 | 12029 | 1116 | 19485 | 27743 |
| | 13656 | 7996 | 8349 | 6481 | 10989 | 9388 | 26088 | 12925 | 21513 | 2843 | 27683 | 5410 |
| | 16798 | 26686 | 23450 | 6237 | 6341 | 27505 | 15031 | 5944 | 17208 | 21831 | 21831 | 7433 |
| | 25746 | 23877 | 23430 | 16379 | 27758 | 4871 | 27605 | 4946 | 7706 | 24786 | 6179 | 23013 |
| | 23502 | 22094 | 7336 | 9048 | 26957 | 2202 | 1754 | 29911 | 5726 | 3468 | 6786 | 24530 |
| | 8257 | 3382 | 5016 | 21265 | 13625 | 4394 | 26084 | 27833 | 718 | 25361 | 27506 | 7591 |
| | 3942 | 6693 | 10984 | 15234 | 25994 | 13459 | 27404 | 12200 | 17174 | 557 | 25015 | |
| 556: | 18237 | 23960 | 23994 | 23991 | 24179 | 24180 | 24076 | 24118 | 24146 | 24149 | 24030 | 24181 |
| | 24184 | 24209 | 24210 | 24213 | 24217 | 24110 | 24232 | 24034 | 24105 | 24236 | 24238 | 23998 |
| | 24071 | 23989 | 24241 | 23996 | 24178 | 24037 | 24027 | 19800 | 29453 | 11999 | 10858 | 12309 |
| | 3763 | 5918 | 20729 | 17637 | 6952 | 6641 | 26191 | 9629 | 19472 | 26754 | 505 | 13319 |
| | 6060 | 4273 | 7915 | 30110 | 23241 | 24337 | | | | | | |
| 557: | 16550 | 16134 | 23003 | 20840 | 13449 | 2662 | 23631 | 14173 | 12029 | 1116 | 19485 | 27743 |
| | 13656 | 7996 | 8349 | 6481 | 10989 | 9388 | 26088 | 12925 | 21513 | 2843 | 27683 | 5410 |
| | 16798 | 26686 | 23450 | 6237 | 6341 | 27505 | 15031 | 5944 | 17208 | 3129 | 21831 | 7433 |
| | 25746 | 23877 | 23430 | 16379 | 27758 | 4871 | 27605 | 4946 | 7706 | 24786 | 6179 | 23013 |
| | 23502 | 22094 | 7336 | 9048 | 26957 | 2202 | 1754 | 29911 | 5726 | 3468 | 6786 | 24530 |
| | 8257 | 3382 | 5016 | 21265 | 13625 | 4394 | 26084 | 27833 | 718 | 25361 | 27506 | 7591 |
| | 3942 | 6693 | 10984 | 15234 | 25994 | 13459 | 27404 | 12200 | 17174 | 555 | 10258 | 25015 |
| 558: | 11865 | 14286 | 1773 | 14694 | 9046 | 10926 | 2603 | 9799 | 5762 | 22591 | 8702 | 14134 |
| | 19345 | 3849 | 11781 | 26893 | 29386 | 28051 | 28057 | 28054 | 28053 | 19402 | 18298 | 18321 |
| | 21864 | 4487 | 11071 | 1036 | 30260 | 5652 | 6536 | 28700 | 28701 | 18746 | 11412 | 11370 |
| | 11286 | 9697 | 9721 | 9693 | 24997 | 9660 | 15038 | 12599 | 22363 | 19623 | 21866 | 21417 |
| | 21418 | 2876 | 15790 | 21869 | 3120 | 30165 | 7567 | 12850 | 12849 | 12856 | 12848 | 11923 |
| | 1096 | 8243 | 12715 | 18754 | 5388 | 18040 | 6595 | 11983 | 21842 | 10934 | 26685 | 14329 |
| | 26134 | 7114 | 6547 | 13437 | 14955 | 12331 | 20861 | 2706 | 14547 | 15411 | 22324 | 19562 |
| | 21801 | 7211 | 20912 | 23644 | 19326 | 26004 | 2001 | 11490 | 14934 | 6208 | 3375 | 6663 |
| | 12294 | | | | | | | | | | | |
| 559: | 21053 | 5637 | 13367 | 30097 | 30098 | 1714 | 4293 | 13481 | 14355 | 1206 | 1181 | 7897 |
| | 14745 | 9179 | 2803 | 2806 | 19460 | 10635 | 28838 | 25830 | 16687 | 19459 | 23427 | 9319 |
| | 15848 | 15846 | 12390 | 12391 | 10033 | 21274 | 8353 | 18944 | 2176 | 14748 | 9271 | 11074 |
| | 12439 | 7936 | 20697 | 13928 | 20737 | 15591 | 1381 | 1363 | 5045 | 5043 | 23810 | 15873 |
| | 18769 | 26971 | 26972 | 9219 | 3214 | 3212 | 2831 | 2833 | 16064 | 6039 | 24993 | 24991 |
| | 27439 | 27438 | 29207 | 1634 | 19383 | 24416 | 24418 | 16903 | 11802 | 13429 | 2494 | 28555 |
| | 28557 | 4328 | 3269 | 3272 | 14997 | 1597 | 27111 | 25193 | 9655 | 13046 | 13048 | 6270 |
| | 7198 | 27215 | 1146 | 26515 | 26517 | 21921 | 15283 | 27402 | 27868 | 9639 | 16209 | 8679 |
| | 15709 | 27332 | 20494 | 13930 | 5116 | 6353 | 7756 | 7601 | 8986 | 9515 | 1362 | 1365 |
| | 685 | 24332 | 25918 | 25928 | 20497 | 12076 | 973 | 974 | 7589 | 1314 | 2849 | 7200 |
| | 21813 | 9155 | 9156 | 10841 | 19587 | 19589 | 6171 | 8235 | 16570 | 3531 | 3526 | 8286 |
| | 3377 | 5657 | 22868 | 22870 | 1551 | 1553 | 26201 | 26375 | 6394 | 14686 | 14687 | 26817 |
| | 2903 | 10287 | 16363 | 11145 | 5246 | 5250 | 14737 | 23734 | 23730 | 21861 | 21859 | 26687 |
| | 29894 | 30434 | 30431 | 2899 | 2902 | 16334 | 5302 | 5298 | 9888 | 4303 | 10265 | 22367 |
| | 18580 | 14695 | 27846 | 17626 | 2109 | 6052 | 16127 | 30216 | 4367 | 6687 | 26267 | 24728 |
| | 24730 | 14722 | 14720 | 1445 | 27700 | 27697 | 1322 | 18938 | 17173 | 17172 | 14492 | 24191 |
| | 26309 | 26311 | 18431 | 18429 | 22637 | 22639 | 841 | 19542 | 25007 | 23073 | 921 | |
| | 8727 | 22508 | 11259 | 2295 | 28478 | 17819 | 26866 | 29146 | 1507 | 7960 | 7961 | 11492 |
| | 26369 | 26371 | 18436 | 5241 | 24911 | 10101 | 10102 | 7319 | 7323 | 10634 | 18983 | 29268 |
| | 29265 | 26149 | 26150 | 21925 | 21927 | 17972 | 18001 | 20748 | 20747 | 23042 | 30325 | 19845 |
| | 24599 | 4808 | 29229 | 14641 | 14643 | 6370 | 15708 | 15710 | 29633 | 29632 | 21113 | 21114 |
| | 11209 | 11213 | 22426 | 22424 | 29203 | 29204 | 29502 | 29488 | 4378 | 26546 | 26549 | 4062 |

TABLE 8-continued

| PEP SEQ ID NO: | homolog SEQ ID NOs | | | | | | | | | |
|---|---|---|---|---|---|---|---|---|---|---|
| | 18589 | 26724 | 6332 | 23821 | 27135 | 22196 | 16034 | 11065 | 11709 | 23015 | 18600 | 2580 |
| | 29261 | 27119 | 27964 | 27971 | 11480 | 11481 | 9572 | 17430 | 17428 | 9575 | 7945 | 14729 |
| | 8825 | 26717 | 26720 | 9302 | 9326 | 18620 | 924 | 27200 | 20233 | 10699 | 27257 | 26880 |
| | 26881 | 12995 | 17825 | 17823 | 24741 | 22069 | 19432 | 19359 | 13970 | 3496 | 1711 | 23383 |
| | 21158 | 12866 | 30263 | 18787 | 26538 | 14868 | 4035 | 4388 | 10801 | 10632 | 25632 | 23963 |
| | 28612 | 23253 | 27927 | 1178 | 29132 | 20213 | 1016 | 14461 | 24758 | 23386 | 21388 | 5313 |
| | 5058 | 28289 | 4759 | 4761 | 4762 | 2437 | 12185 | 12187 | 18988 | 1713 | 28792 | 18380 |
| | 15839 | 14194 | 18840 | 4330 | 4864 | 8121 | 9335 | 10310 | 10638 | 18392 | 21281 | 20942 |
| | 20443 | 26148 | 20072 | 21300 | 12484 | 2275 | 25950 | 3671 | 29507 | 16628 | 10059 | 2250 |
| | 1723 | 882 | 29614 | 22890 | 7292 | 3148 | 16143 | 24227 | 8787 | 10741 | 1326 | 5613 |
| | 9289 | 9306 | 865 | 6419 | 4798 | 13777 | 13774 | 17747 | 17712 | 708 | 16833 | 3004 |
| | 17056 | 6800 | 2653 | 20042 | 17162 | 26198 | 26200 | 27852 | 24966 | 24968 | 11426 | 30306 |
| | 30308 | 5191 | 6541 | 20215 | 20217 | 1772 | 3268 | 4046 | 4053 | 4050 | 3207 | 3027 |
| | 3022 | 4057 | 3074 | 3029 | 3173 | 3168 | 12543 | 10664 | 21634 | 17128 | 6401 | 12365 |
| | 8519 | 13988 | 13986 | 30242 | 15429 | 9261 | 23736 | 7773 | 12871 | 20211 | 20212 | 2210 |
| | 10272 | 16332 | 16353 | 5091 | 25709 | 22283 | 592 | 2498 | 2518 | 3861 | 19815 | 28848 |
| | 16627 | 1790 | 20457 | | | | | | | | | |
| 560: | 16185 | 25895 | 4001 | 30373 | 8413 | 24865 | 7113 | 11532 | 12890 | 18385 | 12053 | 4807 |
| | 8506 | 17850 | 16626 | 27185 | 8569 | 12416 | 19408 | | | | | |
| 561: | 23793 | 18790 | 29098 | 21734 | 13819 | 24140 | 18727 | 8559 | 785 | 19511 | 16337 | 27278 |
| | 1226 | 20337 | 1398 | 2189 | 29255 | 9913 | 972 | 8849 | 20168 | 11234 | 17738 | 9477 |
| | 28987 | 15076 | 25762 | 8410 | 23602 | 11310 | 9650 | 4780 | 13397 | 24565 | 16656 | 23229 |
| | 26118 | 24815 | 15206 | 19896 | 6288 | 13671 | 896 | 30168 | 26836 | 24841 | 24102 | 16849 |
| | 3941 | 562 | 13157 | 14350 | 16990 | 10451 | 11525 | 26264 | 29121 | 8019 | 18656 | 20809 |
| | 26496 | 13454 | 15045 | 4528 | 20271 | 17831 | 600 | 24452 | 12828 | 6707 | 26769 | 638 |
| | 13386 | 29429 | 20627 | 20839 | 28624 | 12407 | 3134 | 16709 | 563 | 637 | 24275 | 24542 |
| | 7836 | 27684 | 13611 | 18144 | 29774 | 12757 | 29174 | 5497 | 7397 | 25897 | 19074 | 5958 |
| | 4432 | 4647 | 10526 | 5714 | 20064 | 13499 | 9446 | 27604 | 19261 | 27314 | 23489 | 15876 |
| | 20588 | 1701 | 10200 | 26101 | 8656 | 7051 | 11891 | 7136 | 5827 | 18060 | 8242 | 12109 |
| | 21489 | 8385 | 29785 | 8389 | 3731 | 29847 | 20504 | 29916 | 16445 | 11086 | 24284 | 14179 |
| | 24668 | 24107 | 24106 | 9456 | 4469 | 9743 | 3153 | 4103 | 1313 | 24756 | 26756 | 18494 |
| | 14533 | 16275 | 15083 | 17043 | 3645 | 28897 | 6403 | 7837 | 23029 | 11293 | 20956 | 12145 |
| | 14434 | 25871 | 5971 | 19784 | 17500 | 22386 | 28165 | 13955 | 8924 | 16793 | 22370 | 12281 |
| | 24468 | 2821 | 3905 | 17904 | 9915 | 22744 | 26446 | 14856 | 11630 | 21379 | 24611 | 13726 |
| | 20506 | 3830 | 25891 | 29537 | 9372 | 11185 | 18947 | 18702 | 19469 | 6365 | 1988 | 28035 |
| | 1228 | 7358 | 3014 | 1690 | 2393 | 26723 | 26830 | 22513 | 775 | 2282 | 13540 | 770 |
| | 23142 | 15615 | 27092 | 23883 | 922 | 24454 | 20351 | 2725 | 12230 | 11676 | 2815 | 9204 |
| | 18941 | 4116 | 27727 | 16147 | 15624 | 24212 | 6251 | 4480 | 13344 | 23040 | 24055 | 19070 |
| | 21441 | 5663 | 25714 | 30134 | 1184 | 24989 | 4728 | 29452 | 22470 | 26402 | 11398 | 11262 |
| | 12130 | 2044 | 12505 | 11829 | 8671 | 20459 | 14527 | 7871 | 2587 | 26994 | 15300 | 18248 |
| | 2979 | 14490 | 1808 | 8094 | 9346 | 22495 | 17804 | 2722 | 4594 | 27317 | 27593 | 23670 |
| | 28675 | 12119 | 15392 | 17875 | 7057 | 13063 | 23126 | 23579 | 20651 | 27745 | 27584 | 26925 |
| | 20778 | 1598 | 14158 | 14079 | | | | | | | | |
| 562: | 23793 | 18790 | 29098 | 29530 | 21734 | 13819 | 24140 | 18727 | 8559 | 785 | 19511 | 16337 |
| | 27278 | 1226 | 20337 | 1398 | 2189 | 29255 | 9913 | 972 | 8849 | 20168 | 11234 | 17738 |
| | 9477 | 28987 | 15076 | 25762 | 8410 | 23602 | 11310 | 9650 | 4780 | 13397 | 24565 | 16656 |
| | 23229 | 26118 | 24815 | 15206 | 19896 | 13671 | 6288 | 896 | 30168 | 26836 | 24841 | 24102 |
| | 16849 | 26769 | 12828 | 638 | 16709 | 24275 | 637 | 563 | 27684 | 7836 | 24542 | 18144 |
| | 12757 | 18060 | 8242 | 12109 | 21489 | 8385 | 8389 | 29785 | 29847 | 3731 | 20504 | 29916 |
| | 16445 | 11086 | 24284 | 14179 | 24668 | 24107 | 24106 | 9456 | 4469 | 9743 | 26756 | 18494 |
| | 14533 | 16275 | 17500 | 13955 | 28165 | 8924 | 22386 | 22370 | 2821 | 16793 | 19784 | 17904 |
| | 26446 | 9915 | 14856 | 15615 | 27092 | 922 | 23883 | 24454 | 20351 | 18941 | 12230 | 2725 |
| | 9204 | 11676 | 4116 | 27727 | 16147 | 15624 | 24212 | 23579 | 20651 | 561 | 28151 | 9630 |
| | 27745 | 27584 | 26925 | 20778 | 1598 | 14158 | 14079 | 14350 | | | | |
| 563: | 23793 | 18790 | 29530 | 13819 | 24140 | 18727 | 8559 | 785 | 19511 | 27278 | 1226 | 20337 |
| | 1398 | 2189 | 29255 | 9913 | 972 | 8849 | 11234 | 9477 | 28987 | 15076 | 25762 | 8410 |
| | 23602 | 11310 | 9650 | 4780 | 13397 | 24565 | 16656 | 23229 | 26118 | 15206 | 19896 | 896 |
| | 30168 | 26836 | 24841 | 24102 | 16849 | 16990 | 10451 | 11525 | 562 | 13157 | 14350 | 26264 |
| | 3941 | 29121 | 18656 | 26496 | 29429 | 13386 | 6707 | 20627 | 12828 | 26769 | 638 | 20839 |
| | 28624 | 18060 | 12109 | 21489 | 8385 | 8389 | 29785 | 3731 | 29847 | 20504 | 29916 | 11086 |
| | 16445 | 24284 | 14179 | 24668 | 24107 | 24106 | 4469 | 9743 | 9456 | 26756 | 18494 | 14533 |
| | 16275 | 1313 | 20351 | 23579 | 561 | 28151 | 27584 | 26925 | 20778 | 1598 | 14158 | 14079 |
| | 24275 | 637 | 16709 | | | | | | | | | |
| 564: | 25129 | 27368 | 25249 | 29970 | 4685 | 4766 | 10275 | 29055 | 21313 | 10701 | 19680 | 9935 |
| | 16488 | 8177 | 4015 | 27951 | 25825 | 21512 | 20368 | 27128 | 9690 | 12146 | 27413 | 15195 |
| | 23828 | 11841 | 5189 | 14776 | 9064 | 21233 | 26231 | 12002 | 11133 | 9018 | 15501 | 26127 |
| | 12008 | 11129 | 7116 | 16009 | 27954 | 10924 | 12108 | 21081 | 12026 | 22330 | 27916 | 24283 |
| | 7140 | 27779 | 24073 | 4136 | 30112 | 11168 | 1115 | 22933 | 22672 | 19676 | 21195 | 1111 |
| | 11985 | 28917 | 22696 | 16189 | 13287 | 3293 | 12420 | 30163 | 6141 | 3686 | 20573 | 16193 |
| | 23458 | 4617 | 4625 | 24189 | 11578 | 9003 | 13450 | 11577 | 11574 | 12862 | 21165 | 16191 |
| | 11772 | 16870 | 29589 | 7318 | 7287 | 7322 | 27518 | 12423 | 6771 | 29765 | 18959 | 18928 |
| | 6767 | 18139 | 771 | 6718 | 10234 | 14176 | 7640 | 29596 | 7371 | 15272 | 14212 | 10238 |
| | 5355 | 23723 | 23465 | 10565 | 7485 | 1227 | 16546 | 24889 | 29958 | 25556 | 5655 |
| | 8828 | 28823 | 28380 | 2635 | 12575 | 21856 | 6971 | 17870 | 15410 | 13234 | 11015 | 22504 |
| | 8340 | 8342 | 9158 | 18685 | 29258 | 8072 | 29470 | 19267 | 18350 | 2117 | 14539 | 725 |
| | 3730 | 13289 | 14559 | 10188 | 15006 | 7581 | 22282 | 5390 | 2261 | 10220 | 2021 | 22170 |
| | 22174 | 22172 | 16620 | 6756 | 12246 | 18575 | 17265 | 21720 | 17791 | 3742 | 25238 | 7440 |
| | 19956 | 1764 | 19482 | 23779 | | | | | | | | |

TABLE 8-continued

| PEP SEQ ID NO: | homolog SEQ ID NOs | | | | | | | | | | |
|---|---|---|---|---|---|---|---|---|---|---|---|
| 565: | 13444 | 29969 | 14565 | 8761 | 4609 | 27488 | 15129 | 21484 | 10063 | 3692 | 15266 | 13584 |
|  | 9606 | 3133 | 29198 | 12289 | 29118 | 4198 | 3469 | 1246 | 9029 | 22236 |  |  |
| 566: | 12946 | 14206 | 6593 | 6591 | 25758 | 19731 | 19754 | 23642 |  |  |  |  |
| 567: | 13038 | 4724 | 16883 | 8660 | 7271 | 2574 | 7312 | 7307 | 19099 | 16463 | 22752 | 16786 |
|  | 24534 | 1935 | 18448 | 8772 | 9405 | 12044 | 16340 | 27473 |  |  |  |  |
| 568: | 20417 | 27886 | 19619 | 7800 | 1272 | 3823 | 7082 | 27564 | 15616 | 24116 | 14223 | 27721 |
|  | 8014 | 22783 | 8325 | 24621 | 17123 | 20009 | 29665 | 28581 | 24641 | 24616 | 24828 | 13057 |
|  | 16913 | 9997 | 29744 | 10107 | 29748 | 29746 | 22723 | 14234 | 2110 | 8575 | 10591 | 9773 |
|  | 9777 | 8670 | 11915 | 18424 | 9511 | 18564 | 20764 | 13787 | 18423 | 11187 | 18604 | 3516 |
|  | 20154 | 14600 | 14603 | 19437 | 26638 | 27689 | 27696 | 27693 | 22261 | 12113 | 10921 | 9824 |
|  | 7009 | 7004 | 8973 | 8978 | 6447 | 1337 | 1352 | 16043 | 21920 | 21961 | 8161 | 8211 |
|  | 26300 | 13172 | 13843 | 20552 | 12458 | 14142 | 9797 | 19787 | 3606 | 25773 | 16317 | 23816 |
|  | 3673 | 899 | 13278 | 22264 | 22235 | 22260 | 22267 | 17224 | 14236 | 10840 | 11111 | 11109 |
|  | 11107 | 19732 | 3976 | 5933 | 6842 | 28949 | 20695 | 9231 | 2267 | 22271 | 9587 | 27307 |
|  | 19107 | 21070 | 15001 | 21236 | 14427 | 27038 | 20250 | 12766 | 12763 | 6036 | 12377 | 9763 |
|  | 12793 | 507 | 14396 |  |  |  |  |  |  |  |  |  |
| 569: | 1581 | 16146 | 11925 | 5139 | 11665 | 14692 | 30172 |  |  |  |  |  |
| 570: | 1205 | 1202 | 23043 | 18478 | 21335 | 24048 | 24042 | 12899 | 18378 | 18376 | 6551 | 9413 |
|  | 9412 | 19940 | 19978 | 19981 | 2128 | 18413 | 16198 | 16668 | 3185 | 15855 | 9352 |
|  | 14616 | 2960 | 2967 | 2966 | 4462 | 25905 | 11227 | 28186 | 984 | 13539 | 20758 | 20789 |
|  | 20750 | 20753 | 20749 | 25229 | 28534 | 17690 | 22452 | 24103 | 19988 | 21788 | 25087 | 19912 |
|  | 21275 | 19982 | 19909 | 24881 | 24899 | 26679 | 18852 | 27639 | 12055 | 16381 | 1897 | 1894 |
|  | 1892 | 20060 | 7377 | 10185 | 12191 | 13610 | 6686 | 27612 | 27664 | 3919 | 27641 | 10110 |
|  | 28531 | 28470 | 2758 | 4227 | 10669 | 8133 | 24960 | 23679 | 11153 | 19321 | 30078 | 21051 |
|  | 17845 | 17557 | 1936 | 23577 | 27609 | 28429 | 27692 | 28464 | 27698 | 27667 | 28432 | 28424 |
|  | 27637 | 19872 | 26730 | 18303 | 18438 | 18412 | 10396 | 9203 | 29169 | 12043 | 1965 | 24374 |
|  | 25660 | 17724 | 16729 | 20884 | 2141 | 19907 | 22922 | 27089 | 2063 | 26239 | 19936 | 19119 |
|  | 21272 | 19915 | 19985 | 19916 | 18368 | 18306 | 18331 | 18333 | 18338 | 17515 | 18481 | 17665 |
|  | 16401 | 13021 | 427 | 23518 | 7850 |  |  |  |  |  |  |  |
| 571: | 15818 | 24500 | 6249 | 24365 | 21416 | 9058 | 5044 | 3647 | 14963 | 14493 | 20694 | 7254 |
|  | 20765 |  |  |  |  |  |  |  |  |  |  |  |
| 572: | 28807 | 27051 | 3150 | 20358 | 5777 | 13209 | 5111 | 9645 | 17113 | 16565 | 22552 | 16503 |
|  | 25832 | 29107 | 1460 | 14728 | 21817 | 17382 | 20312 | 10501 | 20673 | 3346 | 1922 | 10077 |
|  | 6744 | 26143 | 7881 | 8571 | 364 | 26287 | 15280 | 26997 | 9989 | 27429 | 4294 | 26013 |
|  | 754 | 22726 | 25117 |  |  |  |  |  |  |  |  |  |
| 573: | 8315 | 18414 | 30224 | 15804 | 2638 | 19500 | 17309 | 12992 | 30378 | 9019 | 1704 | 6981 |
|  | 7658 | 9420 | 23401 |  |  |  |  |  |  |  |  |  |
| 574: | 19688 | 10946 | 17787 | 18811 | 24157 | 19726 | 16146 | 16140 | 13361 | 26217 | 825 | 17239 |
|  | 11925 | 5139 | 1815 | 428 | 13932 | 5348 | 14692 | 376 | 9975 | 30172 | 569 | 19165 |
|  | 576 | 29573 |  |  |  |  |  |  |  |  |  |  |
| 575: | 4786 | 9635 | 22533 | 22517 | 6361 | 6393 | 742 | 9918 | 3287 | 10618 | 13765 | 22118 |
|  | 15728 | 12502 | 26571 | 17426 | 25481 | 6770 | 9626 | 2081 | 11885 | 24724 | 2078 | 13738 |
|  | 28822 | 8819 |  |  |  |  |  |  |  |  |  |  |
| 576: | 19688 | 10946 | 17787 | 18811 | 24157 | 19726 | 16146 | 16140 | 13361 | 26217 | 825 | 17239 |
|  | 11925 | 5139 | 1815 | 428 | 13932 | 5348 | 14692 | 376 | 9975 | 30172 | 569 | 19165 |
|  | 574 | 29573 |  |  |  |  |  |  |  |  |  |  |
| 577: | 11584 | 13724 | 29524 | 9554 | 16616 | 11861 | 29446 | 29504 | 29601 | 2685 | 2666 | 2692 |
|  | 1388 | 2697 | 1585 | 14288 | 1255 | 23869 | 7127 | 24502 | 19874 | 27071 | 12831 | 23261 |
|  | 4734 | 874 | 23045 | 23769 | 7502 | 28061 | 18457 | 15556 | 15559 | 15561 | 15555 | 15529 |
|  | 21912 | 15390 | 8535 | 8958 | 22252 | 24498 | 13117 | 25178 | 30459 | 15583 | 4752 | 23038 |
|  | 18254 | 7244 | 10345 | 20327 | 23212 | 5007 | 30091 | 7554 | 22684 | 5719 | 606 | 15301 |
|  | 14483 | 792 | 29861 | 15027 | 18648 | 7016 | 13651 | 1770 | 16899 | 16855 | 28048 | 662 |
|  | 18404 | 15455 | 14827 | 22321 | 11701 | 24050 | 10538 | 15416 | 15419 | 15425 | 15460 | 15427 |
|  | 15380 | 15459 | 2809 | 13727 | 17094 | 9390 | 1327 | 6658 | 9556 | 6697 |  |  |
| 578: | 11761 | 19089 | 16165 | 8711 | 2759 | 12674 | 13415 | 29879 | 7066 |  |  |  |
| 579: | 22555 | 27884 | 11448 | 8273 | 27880 | 8275 | 11446 | 27878 | 27874 | 3478 | 15805 | 11443 |
|  | 23102 | 23280 | 14976 | 1219 | 13309 | 22763 |  |  |  |  |  |  |
| 580: | 7938 | 7964 | 1841 | 14824 | 14760 | 24052 | 3138 | 28102 | 21222 | 21218 | 21226 | 13120 |
|  | 4265 | 5711 | 11048 | 27430 | 17350 | 25395 | 9698 | 14345 | 25391 | 19114 | 11354 | 25539 |
|  | 2802 | 28086 | 19052 | 1394 | 4583 | 3706 | 3705 | 5387 | 4585 | 14414 | 5998 | 1847 |
|  | 27344 | 16676 | 16678 | 22469 | 24958 | 7905 | 7870 | 3660 | 12098 | 9513 | 6150 |  |
| 581: | 12041 | 23443 | 2888 | 28895 | 11471 | 11483 | 11474 | 21745 | 12751 | 8116 | 16160 | 16162 |
|  | 17998 | 4000 | 27970 | 9384 | 5381 | 3441 | 24737 | 859 | 26362 | 24708 | 6811 | 6754 |
|  | 18178 | 22419 | 15989 | 15143 | 14642 | 1282 | 27419 | 18937 | 18587 | 23984 | 7343 | 15826 |
|  | 15863 | 17425 | 1009 | 8802 | 9588 | 17485 | 1240 | 10670 | 10668 | 20548 | 27277 |
|  | 9613 | 19477 | 15631 | 11051 | 11046 | 11023 | 10988 | 10990 | 11021 | 11017 | 10994 | 10992 |
|  | 11019 | 11052 | 11014 | 9124 | 29772 | 24903 | 30361 | 12677 | 12681 | 17414 | 12679 | 21760 |
|  | 22304 | 26366 | 7605 | 27534 | 6568 |  |  |  |  |  |  |  |
| 582: | 19546 | 7100 | 21078 | 29472 | 26206 | 14606 | 8808 | 9347 | 21542 | 10893 | 23028 | 28069 |
|  | 9435 | 27011 | 4314 | 15686 | 20175 | 18297 | 20143 | 6089 | 6122 | 27189 | 27017 | 26037 |
|  | 25820 | 24689 | 6779 | 23568 | 2628 | 19337 | 27084 | 30085 | 8185 | 3032 | 16480 | 5557 |
|  | 2421 | 18364 | 24072 | 19813 | 12996 | 10951 | 13094 | 7636 | 15739 | 29267 | 10609 | 16613 |
|  | 16763 | 26659 | 2575 | 17702 | 15594 | 12665 | 29225 | 8278 | 9180 | 28016 | 29556 | 25090 |
|  | 24005 | 9907 | 28287 | 24942 | 24941 | 5491 | 2270 | 16971 | 5215 | 5054 | 5062 | 5059 |
|  | 16969 | 22674 | 10175 | 10170 | 10172 | 10072 | 29929 | 10173 | 20423 | 14928 | 14922 | 8299 |
|  | 8043 | 26409 | 7503 | 3588 | 26584 | 28658 | 1029 | 12685 | 28830 | 25587 | 9165 | 17300 |
|  | 30326 | 23962 | 7436 | 12369 | 23509 | 16214 | 8176 | 29489 | 18480 | 2148 | 4847 | 19133 |
|  | 516 | 24058 | 10954 | 800 | 11217 |  |  |  |  |  |  |  |

TABLE 8-continued

| PEP SEQ ID NO: | homolog SEQ ID NOs | | | | | | | | | | |
|---|---|---|---|---|---|---|---|---|---|---|---|
| 583: | 25129 | 27368 | 25249 | 29970 | 4685 | 30235 | 4766 | 10275 | 29055 | 24740 | 20607 | 21313 |
| | 10701 | 19680 | 16488 | 9935 | 4015 | 8177 | 27951 | 25825 | 21512 | 20368 | 27128 | 9690 |
| | 4877 | 27413 | 15195 | 23828 | 20916 | 28202 | 14776 | 9064 | 21233 | 26231 | 20077 | 25077 |
| | 12008 | 9018 | 15501 | 12108 | 12002 | 11133 | 16009 | 26127 | 12026 | 11129 | 28917 | 7116 |
| | 30112 | 24073 | 16189 | 22672 | 22330 | 10924 | 27779 | 27954 | 1115 | 22933 | 1111 | 21195 |
| | 27916 | 24283 | 21081 | 30163 | 11168 | 19676 | 11985 | 4136 | 22696 | 7140 | 13287 | 24189 |
| | 3293 | 11578 | 16193 | 20573 | 23458 | 4617 | 4625 | 9003 | 3686 | 12420 | 6141 | 13450 |
| | 11577 | 11574 | 12862 | 11772 | 16870 | 29589 | 7287 | 7318 | 7322 | 27518 | 12423 | 6771 |
| | 29765 | 18959 | 771 | 6718 | 10234 | 29596 | 14176 | 7371 | 7640 | 14212 | 15272 | 23723 |
| | 10238 | 23465 | 1227 | 22251 | 16546 | 24889 | 29958 | 28823 | 8828 | 5655 | 25556 | 28380 |
| | 2635 | 12575 | 6971 | 15410 | 21856 | 22504 | 8340 | 18685 | 29258 | 9158 | 8072 | 29470 |
| | 18350 | 19267 | 2117 | 14539 | 725 | 3730 | 14559 | 10188 | 13289 | 15006 | 7581 | 5390 |
| | 22282 | 2261 | 10220 | 2021 | 22170 | 22172 | 22174 | 16620 | 13494 | 14407 | 21902 | 17265 |
| | 6756 | 12246 | 18575 | 21720 | 17791 | 3742 | 25238 | 7440 | 19956 | 4913 | 1764 | 19482 |
| | 23676 | 564 | 28187 | 21453 | 11680 | | | | | | | |
| 584: | 2555 | 25500 | 14030 | 22659 | 25613 | 8260 | 27377 | 29793 | 1177 | 23381 | 14036 | 15968 |
| | 21609 | 6826 | 5584 | 2182 | 28639 | 5929 | 1090 | 9967 | 16653 | 19423 | 6909 | 27061 |
| | 805 | 16595 | 11380 | 27033 | | | | | | | | |
| 585: | 16495 | 15818 | 18613 | 27890 | 10799 | 11700 | 27624 | 27254 | 9740 | 5044 | 6485 | 14963 |
| | 14493 | 4453 | 8639 | 8663 | 8638 | 8637 | 9491 | 30129 | 23337 | 20765 | 19015 | 16487 |
| 586: | 7759 | 1528 | 23333 | 853 | 16894 | 13376 | 11592 | 18242 | 15920 | 8992 | | |
| 587: | 20417 | 27886 | 19619 | 7800 | 1272 | 3823 | 7082 | 27564 | 15616 | 24116 | 14223 | 27721 |
| | 8014 | 22783 | 8325 | 24621 | 17123 | 20009 | 29665 | 28581 | 24641 | 24616 | 24828 | 13057 |
| | 16913 | 9997 | 29744 | 10107 | 29748 | 29746 | 22723 | 14234 | 2110 | 8575 | 10591 | 9773 |
| | 9777 | 8670 | 11915 | 18424 | 9511 | 18564 | 20764 | 13787 | 18423 | 11187 | 18604 | 3516 |
| | 20154 | 14600 | 14603 | 19437 | 26638 | 27689 | 27696 | 27693 | 22261 | 12113 | 10921 | 9824 |
| | 7009 | 7004 | 8973 | 8978 | 6447 | 1337 | 1352 | 16043 | 21920 | 21961 | 8161 | 8211 |
| | 26300 | 13172 | 13843 | 20552 | 12458 | 14142 | 9797 | 19787 | 3606 | 25773 | 16317 | 23816 |
| | 3673 | 899 | 13278 | 22264 | 22235 | 22260 | 22267 | 17224 | 14236 | 10840 | 11111 | 11109 |
| | 11107 | 19732 | 3976 | 5933 | 6842 | 28949 | 20695 | 9231 | 2267 | 22271 | 9587 | 27307 |
| | 19107 | 21070 | 15001 | 21236 | 14427 | 27038 | 20250 | 12766 | 12763 | 6036 | 12377 | 27914 |
| | 9763 | 12793 | 568 | | | | | | | | | |
| 588: | 26090 | 24906 | 7328 | 16079 | 13640 | 1998 | 3987 | 14369 | 10118 | 24547 | 10168 | 19534 |
| | 14201 | 4351 | 29751 | 23972 | 19048 | 19518 | 16929 | 12836 | 10980 | 5385 | 12514 | 8603 |
| | 21615 | 14006 | 9621 | 29755 | 3278 | 9131 | 13564 | 783 | 18177 | 14122 | 16367 | 23240 |
| | 18197 | 10484 | 27976 | 27790 | 10726 | 28360 | 7845 | 8361 | 7541 | 3978 | 10445 | 26641 |
| | 1937 | 8810 | 18305 | 17353 | 26604 | 14422 | 26491 | 13341 | 8502 | 7149 | 14121 | 22354 |
| | 27631 | 850 | 24218 | 22409 | 8455 | 30360 | 24294 | 14091 | 30220 | 23301 | 12792 | 17439 |
| | 5642 | 24682 | 2394 | 781 | 21304 | 19627 | 7391 | 21743 | 2420 | 8426 | 27392 | 19043 |
| | 22515 | 29067 | 5266 | 5679 | 8170 | 6456 | 10383 | 8388 | 22771 | 8450 | 17154 | 17655 |
| | 21229 | 10695 | 22850 | 20714 | 3703 | 27996 | 24666 | 29419 | 13898 | 25251 | 2927 | 968 |
| | 25866 | 11823 | 11437 | 11556 | 29559 | 28036 | 22558 | 28576 | 18030 | 644 | 20487 | 13123 |
| | 21755 | 11073 | 8138 | 4868 | 5476 | 24215 | 8521 | 23457 | 22084 | 29764 | 12464 | 14383 |
| | 27005 | 11776 | 28824 | 9025 | 18016 | 15103 | 18931 | 28602 | 8158 | 17472 | 1453 | 1990 |
| | 16594 | 2573 | 20483 | 22565 | 23359 | 4684 | 14747 | 21853 | 24807 | 9107 | 9108 | 22028 |
| | 24031 | 21991 | 26569 | 29011 | 5830 | 3328 | 15099 | 15130 | 21719 | 26251 | 13720 | 2076 |
| | 22740 | 19986 | 24231 | 21220 | 18601 | 2781 | 26295 | 4537 | 1807 | 15313 | 11247 | 9328 |
| | 2456 | 2455 | 2459 | 13267 | 13269 | 451 | 4730 | 9730 | 9757 | 9762 | 21426 | 14657 |
| | 11571 | 10874 | 15508 | 22276 | 22496 | 21391 | 21149 | 21996 | 21999 | 14338 | 14342 | 14140 |
| | 14341 | 14363 | 15131 | 6669 | 14372 | 14890 | 14882 | 14886 | 14908 | 30442 | 13868 | 10627 |
| | 14633 | 10628 | 10603 | 9996 | 18761 | 17083 | 26475 | 9727 | 16415 | 22604 | 16765 | 21893 |
| | 21349 | 22764 | 341 | 3311 | 21992 | 8269 | 18346 | 13382 | 24297 | 24316 | 13140 | 2970 |
| | 22223 | 763 | 16890 | 3910 | 16235 | 11545 | 28077 | 2792 | 23797 | 2309 | 7723 | 10108 |
| | 12589 | 10780 | 13561 | 10432 | 24018 | 30465 | 23985 | 23865 | 12964 | 15841 | 26552 | 12280 |
| | 10917 | | | | | | | | | | | |
| 589: | 21641 | 11914 | 23866 | 8645 | 13613 | 9312 | 23237 | 9134 | 23388 | 20043 | 2701 | 16767 |
| | 28224 | 13756 | 18982 | 19274 | 23559 | 11811 | 2974 | 2235 | 28082 | 19162 | 8555 | 18862 |
| | 24954 | 8256 | 20898 | 18136 | 10706 | 4529 | 15333 | 26671 | 4930 | 16619 | 29659 | 25935 |
| | 24554 | 12329 | 15453 | 22322 | 9282 | 7014 | 23385 | 24862 | 14339 | 14577 | 13104 | 29724 |
| | 6660 | | | | | | | | | | | |
| 590: | 1370 | 1803 | 10479 | 6604 | 11379 | 22320 | 2150 | 19084 | 8835 | 21367 | 3715 | 27142 |
| | 28468 | 16052 | 29977 | 20304 | 15104 | 17160 | 22606 | 11506 | 10642 | 20938 | 19470 | 5997 |
| | 2431 | 12142 | 10998 | 8140 | 2012 | 692 | | | | | | |
| 591: | 20634 | 29046 | 27023 | 27018 | 27020 | 15445 | 17319 | 8384 | 8435 | 8439 | 4475 | 26372 |
| | 26378 | 20484 | 17008 | 21911 | 1826 | 2381 | 27301 | 16213 | 17011 | 3572 | 27818 |
| | 17652 | 27668 | 7815 | 11633 | 10323 | 7206 | 6849 | 28423 | 21614 | 28759 | 10404 | 11171 |
| | 1722 | 14717 | 6437 | 5521 | 13143 | 26232 | 22628 | 28738 | 15781 | 15775 | 15777 | 23480 |
| | 13052 | 16215 | 17016 | 22902 | 27289 | 27188 | 24044 | 24290 | | | | |
| 592: | 21053 | 5637 | 13367 | 30097 | 30098 | 1714 | 4293 | 13481 | 14355 | 1206 | 1181 | 7897 |
| | 14745 | 9179 | 2803 | 2806 | 19460 | 10635 | 28838 | 25830 | 16687 | 19459 | 23427 | 9319 |
| | 15848 | 15846 | 12390 | 12391 | 10033 | 21274 | 8353 | 18944 | 2176 | 14748 | 9271 | 11074 |
| | 12439 | 7936 | 20697 | 13928 | 20737 | 15591 | 1381 | 1363 | 5045 | 5043 | 23810 | 15873 |
| | 18769 | 26971 | 26972 | 2831 | 9219 | 3214 | 3212 | 2833 | 16064 | 6039 | 24993 | 24991 |
| | 27439 | 27438 | 29207 | 1634 | 19383 | 24416 | 24418 | 16903 | 11802 | 13429 | 2494 | 28555 |
| | 28557 | 4328 | 3269 | 3272 | 14997 | 1597 | 27111 | 25193 | 9655 | 13046 | 13048 | 6270 |
| | 7198 | 27215 | 1146 | 26515 | 26517 | 21921 | 15283 | 27402 | 27868 | 9639 | 16209 | 8679 |
| | 15709 | 27332 | 20494 | 13930 | 5116 | 6353 | 7756 | 7601 | 8986 | 9515 | 1362 | 1365 |
| | 685 | 24332 | 25918 | 25928 | 20497 | 12076 | 973 | 974 | 7589 | 1314 | 2849 | 7200 |

TABLE 8-continued

| PEP SEQ ID NO: | homolog SEQ ID NOs | | | | | | | | | | |
|---|---|---|---|---|---|---|---|---|---|---|---|
| | 21813 | 9155 | 9156 | 10841 | 19587 | 19589 | 6171 | 8235 | 16570 | 3531 | 3526 | 8286 |
| | 3377 | 5657 | 22868 | 22870 | 1551 | 1553 | 26201 | 26375 | 6394 | 14686 | 14687 | 26817 |
| | 2903 | 10287 | 16363 | 11145 | 5246 | 5250 | 14737 | 23734 | 23730 | 21861 | 21859 | 26687 |
| | 29894 | 30434 | 30431 | 2899 | 2902 | 16334 | 5302 | 5298 | 9888 | 4303 | 10265 | 22367 |
| | 18580 | 14695 | 27846 | 17626 | 2109 | 6052 | 16127 | 30216 | 4367 | 6687 | 26267 | 24728 |
| | 24730 | 14722 | 14720 | 1445 | 27700 | 27697 | 1322 | 18938 | 17173 | 17172 | 14492 | 24191 |
| | 26309 | 26311 | 18431 | 18429 | 22637 | 22639 | 1746 | 841 | 19542 | 25007 | 23073 | 921 |
| | 8727 | 22508 | 11259 | 2295 | 28478 | 17819 | 26866 | 29146 | 1507 | 7960 | 7961 | 11492 |
| | 26369 | 26371 | 18436 | 5241 | 24911 | 10101 | 10102 | 7319 | 7323 | 10634 | 18983 | 29268 |
| | 29265 | 26149 | 26150 | 21925 | 21927 | 17972 | 18001 | 20748 | 20747 | 23042 | 30325 | 19845 |
| | 24599 | 4808 | 29229 | 14641 | 14643 | 6370 | 15708 | 15710 | 29633 | 29632 | 21113 | 21114 |
| | 11209 | 11213 | 22426 | 22424 | 29203 | 29204 | 29502 | 29488 | 4378 | 26546 | 26549 | 4062 |
| | 18589 | 26724 | 6332 | 23821 | 27135 | 22196 | 16034 | 11065 | 11709 | 23015 | 18600 | 2580 |
| | 29261 | 27119 | 27964 | 27971 | 11480 | 11481 | 9572 | 17430 | 17428 | 9575 | 7945 | 14729 |
| | 8825 | 26717 | 26720 | 9302 | 9326 | 18620 | 924 | 27200 | 20233 | 10699 | 27257 | 26880 |
| | 26881 | 12995 | 17825 | 17823 | 24741 | 22069 | 19432 | 19359 | 13970 | 3496 | 1711 | 23383 |
| | 21158 | 12866 | 30263 | 18787 | 26538 | 14868 | 4035 | 4388 | 10801 | 10632 | 25632 | 23963 |
| | 28612 | 23253 | 27927 | 1178 | 29132 | 20213 | 1016 | 14461 | 24758 | 23386 | 21388 | 5313 |
| | 5058 | 28289 | 4759 | 4761 | 4762 | 2437 | 12185 | 12187 | 18988 | 1713 | 28792 | 18380 |
| | 15839 | 14194 | 18840 | 4330 | 4864 | 8121 | 9335 | 10310 | 10638 | 18392 | 21281 | 20942 |
| | 20443 | 26148 | 20072 | 21300 | 12484 | 2275 | 25950 | 3671 | 29507 | 16628 | 10059 | 2250 |
| | 1723 | 882 | 29614 | 22890 | 7292 | 3148 | 16143 | 24227 | 8787 | 10741 | 1326 | 5613 |
| | 9289 | 9306 | 865 | 6419 | 4798 | 13774 | 17747 | 17712 | 708 | 16833 | 3004 | |
| | 17056 | 6800 | 2653 | 20042 | 17162 | 26198 | 26200 | 27852 | 24966 | 24968 | 11426 | 30306 |
| | 30308 | 5191 | 6541 | 20215 | 20217 | 1772 | 3268 | 4046 | 4053 | 4050 | 3207 | 3027 |
| | 3022 | 4057 | 3074 | 3029 | 3173 | 3168 | 12543 | 10664 | 21634 | 17128 | 6401 | 12365 |
| | 8519 | 13988 | 13986 | 30242 | 15429 | 9261 | 23736 | 7773 | 12871 | 20211 | 20212 | 2210 |
| | 10272 | 16332 | 16353 | 5091 | 25709 | 22283 | 2518 | 559 | 3861 | 19815 | 28848 | 16627 |
| | 1790 | 20457 | | | | | | | | | | |
| 593: | 23100 | 8437 | 16789 | 9184 | 9170 | 14972 | 26126 | 2782 | 2808 | 8912 | 12593 | 5659 |
| | 27751 | 17249 | 847 | 16077 | 17003 | 17564 | 19748 | 9675 | 16458 | 25308 | 11810 | 6462 |
| | 19004 | 23303 | 25333 | 8046 | 1432 | 22200 | 23141 | 1516 | 3596 | 26032 | 1858 | 3259 |
| | 28746 | 25829 | 23426 | 25373 | 17115 | 18882 | 24257 | 4938 | 22448 | 11228 | 22286 | 22389 |
| | 18549 | 21796 | 28404 | 16829 | 23612 | 23617 | 23616 | 23645 | 23590 | 25680 | 25614 | 3975 |
| | 18943 | 21410 | 15360 | 23410 | 8549 | 26330 | 4056 | 30346 | 24472 | 24445 | 15829 | 27029 |
| | 27626 | 7896 | 28162 | 7743 | 11962 | 15101 | 26380 | 30303 | 26492 | 1890 | 15003 | 15005 |
| | 17406 | 17853 | 5309 | 7867 | 3683 | 23220 | 12178 | 1817 | 12021 | 3159 | 5110 | 21308 |
| | 29714 | 30354 | 28815 | 2223 | 12072 | 23205 | 2188 | 19401 | 16746 | 23172 | 5164 | 19927 |
| | 20771 | 7518 | 23417 | 13391 | 12324 | 29494 | 4043 | 27813 | 29038 | 29780 | 28610 | 19153 |
| | 7533 | 13762 | 4157 | 16421 | 4895 | 27867 | 17568 | 17567 | 21063 | 16780 | 13258 | |
| | 11850 | 1334 | 24652 | 24325 | 18753 | 5836 | 16750 | 11824 | 20390 | 3170 | 13418 | 12249 |
| | 20037 | 15769 | 5466 | 11682 | 25338 | 15918 | 9169 | 14001 | 3135 | 16677 | 18384 | 2213 |
| | 9831 | 9001 | 2847 | 20465 | 14307 | 20286 | 10381 | 14305 | 30233 | 20568 | 24612 | 28359 |
| | 13523 | 11725 | 13899 | 677 | 3809 | 24421 | 12358 | 12047 | 11941 | 29944 | 10425 | 20270 |
| | 7425 | 12223 | 22959 | 25148 | 9300 | 8277 | 29986 | 21518 | 16545 | 25208 | 26145 | |
| 594: | 14081 | 8646 | 19510 | 3201 | 2969 | 21123 | 15598 | 14545 | 3412 | 24368 | 6958 | 8607 |
| | 10353 | | | | | | | | | | | |
| 595: | 3687 | 13637 | 6857 | 13434 | 15892 | 15230 | 25954 | 18782 | 18783 | 18779 | 26319 | 3515 |
| | 1014 | 21404 | 29758 | 1644 | 27147 | 15850 | 24399 | 9128 | 9154 | 16774 | 3773 | 27893 |
| | 20486 | 12084 | 13600 | 29024 | 13597 | 29026 | 12676 | 4516 | 12392 | 10606 | 3631 | 16048 |
| | 10151 | 20647 | 7798 | 14866 | 22177 | 6793 | 19027 | 4906 | 27511 | 7809 | 25075 | 26399 |
| | 26044 | 1108 | 21212 | 3720 | 19569 | 14929 | 10537 | 11077 | 24782 | 21269 | 13233 | 23192 |
| | 10539 | 24375 | 28382 | 7724 | 29220 | 7674 | 24131 | 28806 | 6795 | 28135 | 6830 | 26699 |
| | 14196 | 28182 | 7465 | 6291 | 15138 | 29628 | 1123 | 15229 | 14863 | 15755 | 2030 | 14862 |
| | 14269 | 17078 | 9228 | 4792 | 13137 | 8362 | 6931 | 8252 | 3767 | 14734 | 2995 | 13859 |
| | 1957 | 3616 | 12222 | 2724 | 8691 | 15141 | 20150 | 4991 | 22712 | 22160 | 13892 | 14933 |
| | 18671 | 18647 | 3672 | 8714 | 21442 | 25038 | 11854 | 6682 | 26742 | 6623 | 12833 | 1237 |
| | 10466 | 10469 | 886 | 26275 | 17293 | 25839 | 20091 | 13855 | 18348 | 5981 | 13646 | 12691 |
| | 10633 | 15139 | | | | | | | | | | |
| 596: | 11135 | 17513 | 29853 | 2950 | 5458 | 29779 | 20336 | 13241 | 4799 | 29016 | 17076 | 11780 |
| | 4104 | 12952 | 11732 | 12095 | 4999 | 16170 | 5457 | 3045 | 25718 | 6165 | 16051 | 8403 |
| | 18273 | 6347 | 3040 | 24142 | 6392 | 3814 | 4226 | 20621 | 13649 | 27722 | 19640 | 9479 |
| | 26129 | 15632 | 8041 | 25934 | 21263 | 12094 | 3514 | 30043 | 15134 | 24774 | 25723 | 29058 |
| | 14294 | 10387 | 22923 | 13706 | 8226 | 14883 | 18231 | | | | | |

Example 7. Selection of Transgenic Plants with Enhanced Agronomic Trait(s)

This example illustrates identification of plant cells of the invention by screening derived plants and seeds for enhanced trait. Transgenic seed and plants in corn, soybean, cotton or canola with recombinant DNA constructs identified in Table 2 are prepared by plant cells transformed with DNA that is stably integrated into the genome of the corn cell. Progeny transgenic plants and seed of the transformed plant cells are screened for enhanced water use efficiency, enhanced cold tolerance, increased yield, enhanced nitrogen use efficiency, enhanced seed protein and enhanced seed oil as compared to control plants A. Selection for Enhanced Nitrogen Use Efficiency Transgenic corn seeds provided by the present invention are planted in fields with three levels of nitrogen (N) fertilizer being applied, i.e. low level (0 N), medium level (80 lb/ac) and high level (180 lb/ac). A variety of physiological traits are monitored. Plants with enhanced NUE provide higher yield as compared to control plants.

B. Selection for Increased Yield

Effective selection of enhanced yielding transgenic plants uses hybrid progeny of the transgenic plants for corn, cotton, and canola, or inbred progeny of transgenic plants for soybeanplants plant such as corn, cotton, canola, or inbred plant such as soy, canola and cottoncotton over multiple locations with plants grown under optimal production management practices, and maximum pest control. A useful target for improved yield is a 5% to 10% increase in yield as compared to yield produced by plants grown from seed for a control plant. Selection methods may be applied in multiple and diverse geographic locations, for example up to 16 or more locations, over one or more planting seasons, for example at least two planting seasons, to statistically distinguish yield improvement from natural environmental effects.

In one field trial, transgenic corn plants comprising corn G1543 like 2 transgene as set forth in NUC SEQ ID NO: 74 under a tissue preferred promoter, such as green tissue promoter, have been shown to have an increased yield.

C. Selection for Enhanced Water Use Efficiency (WUE)

The selection process imposes a water withholding period to induce stress drought followed by watering. For example, for corn, a useful selection process imposes 3 drought/rewater cycles on plants over a total period of 15 days after an initial stress free growth period of 11 days. Each cycle consists of 5 days, with no water being applied for the first four days and a water quenching on the 5th day of the cycle. The primary phenotypes analyzed by the selection method are the changes in plant growth rate as determined by height and biomass during a vegetative drought treatment.

D. Selection for Growth Under Cold Stress (1) Cold germination assay—Trays of transgenic and control seeds are placed in a growth chamber at 9.7° C. for 24 days (no light). Seeds having higher germination rates as compared to the control are identified.

(2) Cold field efficacy trial—A cold field efficacy trial is used to identify gene constructs that confer enhanced cold vigor at germination and early seedling growth under early spring planting field conditions in conventional-till and simulated no-till environments. Seeds are planted into the ground around two weeks before local farmers begin to plant corn so that a significant cold stress is exerted onto the crop, named as cold treatment. Seeds also are planted under local optimal planting conditions such that the crop has little or no exposure to cold condition, named as normal treatment. At each location, seeds are planted under both cold and normal conditions with 3 repetitions per treatment. Two temperature monitors are set up at each location to monitor both air and soil temperature daily.

Seed emergence is defined as the point when the growing shoot breaks the soil surface. The number of emerged seedlings in each plot is counted everyday from the day the earliest plot begins to emerge until no significant changes in emergence occur. In addition, for each planting date, the latest date when emergence is 0 in all plots is also recorded. Seedling vigor is also rated at V3-V4 stage before the average of corn plant height reaches 10 inches, with 1=excellent early growth, 5=Average growth and 9=poor growth. Days to 50% emergence, maximum percent emergence and seedling vigor are used to determine plants with enhanced cold tolerance.

E. Screens for Transgenic Plant Seeds with Increased Protein and/or Oil Levels

This example sets forth a high-throughput selection for identifying plant seeds with improvement in seed composition using the Infratec 1200 series Grain Analyzer, which is a near-infrared transmittance spectrometer used to determine the composition of a bulk seed sample (Table 9). Near infrared analysis is a non-destructive, high-throughput method that can analyze multiple traits in a single sample scan. An NIR calibration for the analytes of interest is used to predict the values of an unknown sample. The NIR spectrum is obtained for the sample and compared to the calibration using a complex chemometric software package that provides predicted values as well as information on how well the sample fits in the calibration.

Infratec Model 1221, 1225, or 1227 with transport module by Foss North America is used with cuvette, item #1000-4033, Foss North America or for small samples with small cell cuvette, Foss standard cuvette modified by Leon Girard Co. Corn and soy check samples of varying composition maintained in check cell cuvettes are supplied by Leon Girard Co. NIT collection software is provided by Maximum Consulting Inc. Software. Calculations are performed automatically by the software. Seed samples are received in packets or containers with barcode labels from the customer. The seed is poured into the cuvettes and analyzed as received.

TABLE 9

| | |
|---|---|
| Typical sample(s): | Whole grain corn and soybean seeds |
| Analytical time to run method: | Less than 0.75 min per sample |
| Total elapsed time per run: | 1.5 minute per sample |
| Typical and minimum sample size: | Corn typical: 50 cc; minimum 30 cc<br>Soybean typical: 50 cc; minimum 5 cc |
| Typical analytical range: | Determined in part by the specific calibration.<br>Corn - moisture 5-15%, oil 5-20%, protein 5-30%, starch 50-75%, and density 1.0-1.3%.<br>Soybean - moisture 5-15%, oil 15-25%, and protein 35-50%. |

Example 8. Consensus Sequence

This example illustrates the identification of consensus amino acid sequence for the proteins and homologs encoded by DNA that is used to prepare the transgenic seed and plants of this invention having enhanced agronomic traits.

ClustalW program was selected for multiple sequence alignments of the amino acid sequence of SEQ ID NO: 301 and its 20 homologs. Three major factors affecting the sequence alignments dramatically are (1) protein weight matrices; (2) gap open penalty; (3) gap extension penalty. Protein weight matrices available for ClustalW program include Blosum, Pam and Gonnet series. Those parameters with gap open penalty and gap extension penalty were extensively tested. On the basis of the test results, Blosum weight matrix, gap open penalty of 10 and gap extension penalty of 1 were chosen for multiple sequence alignment. FIG. 1 shows the sequences of SEQ ID NO: 301, its homologs and the consensus sequence (SEQ ID NO: 30526) at the end. The symbols for consensus sequence are (1) uppercase letters for 100% identity in all positions of multiple sequence alignment output; (2) lowercase letters for >=70% identity; symbol; (3) "X" indicated <70% identity; (4) dashes "-" meaning that gaps were in >=70% sequences.

The consensus amino acid sequence can be used to identify DNA corresponding to the full scope of this invention that is useful in providing transgenic plants, for example corn and soybean plants with enhanced agronomic traits, for example improved nitrogen use efficiency, improved yield, improved water use efficiency and/or improved growth under cold stress, due to the expression in the plants of DNA encoding a protein with amino acid sequence identical to the consensus amino acid sequence.

Example 9. Identification of Amino Acid Domain by Pfam Analysis

This example illustrates the identification of domain and domain module by Pfam analysis.

The amino acid sequence of the expressed proteins that are shown to be associated with an enhanced trait are analyzed for Pfam protein family against the current Pfam collection of multiple sequence alignments and hidden Markov models using the HMMER software in the appended computer listing. The Pfam protein domains and modules for the proteins of SEQ ID NO: 299 through 596 are shown in Tables 10, 11 and 12. The Hidden Markov model databases for the identified patent families are also in the appended computer listing allowing identification of other homologous proteins and their cognate encoding DNA to enable the full breadth of the invention for a person of ordinary skill in the art. Certain proteins are identified by a single Pfam domain and others by multiple Pfam domains. For instance, the protein with amino acids of SEQ ID NO: 299 is characterized by three Pfam domains, i.e. KNOX1, KNOX2 and ELK.

TABLE 10

Pfam annotation

| PEP SEQ ID NO | Gene ID | Pfam domain name | Begin | Stop | Score | E-value |
|---|---|---|---|---|---|---|
| 299 | PHE0007721__18998.pep | KNOX1 | 102 | 146 | 90.4 | 5.50E−24 |
| 299 | PHE0007721__18998.pep | KNOX2 | 153 | 204 | 101.2 | 3.10E−27 |
| 299 | PHE0007721__18998.pep | ELK | 242 | 263 | 37 | 6.50E−08 |
| 300 | PHE0007756__18009.pep | RPE65 | 105 | 591 | 864 | 7.30E−257 |
| 302 | PHE0004988__15925.pep | F-box | 4 | 52 | 23.7 | 0.00064 |
| 302 | PHE0004988__15925.pep | LRR_1 | 157 | 179 | 9.7 | 4.4 |
| 302 | PHE0004988__15925.pep | LRR_2 | 290 | 314 | 14.1 | 0.19 |
| 303 | PHE0007140__21771.pep | MtN3_slv | 9 | 98 | 98.2 | 2.50E−26 |
| 303 | PHE0007140__21771.pep | MtN3_slv | 134 | 221 | 73.6 | 6.20E−19 |
| 304 | PHE0006823__16403.pep | Globin | 10 | 149 | 102.6 | 1.10E−27 |
| 305 | PHE0007440__22555.pep | Miro | 14 | 128 | 88.4 | 2.20E−23 |
| 305 | PHE0007440__22555.pep | Ras | 14 | 175 | 332.3 | 8.40E−97 |
| 306 | PHE0000206__22432.pep | Pkinase | 79 | 337 | 342.2 | 8.80E−100 |
| 306 | PHE0000206__22432.pep | efhand | 384 | 412 | 25 | 0.00026 |
| 306 | PHE0000206__22432.pep | efhand | 456 | 484 | 24.9 | 0.00028 |
| 306 | PHE0000206__22432.pep | efhand | 490 | 518 | 35.1 | 2.40E−07 |
| 307 | PHE0000598__16824.pep | HLH | 385 | 434 | 54.6 | 3.30E−13 |
| 308 | PHE0007590__17883.pep | S1 | 2 | 70 | 92.7 | 1.10E−24 |
| 309 | PHE0007588__17881.pep | S1 | 2 | 86 | 73.5 | 6.50E−19 |
| 310 | PHE0007592__17885.pep | S1 | 1 | 75 | 48 | 3.20E−11 |
| 311 | PHE0007587__17880.pep | S1 | 3 | 75 | 106.6 | 7.10E−29 |
| 312 | PHE0007624__17923.pep | S1 | 2 | 72 | 45.6 | 1.70E−10 |
| 312 | PHE0007624__17923.pep | eIf-1a | 5 | 70 | 134.9 | 2.20E−37 |
| 313 | PHE0007591__17884.pep | S1 | 2 | 68 | 63.9 | 5.20E−16 |
| 314 | PHE0007623__17922.pep | CN_hydrolase | 11 | 184 | 166.3 | 7.50E−47 |
| 315 | PHE0007583__17871.pep | MtN3_slv | 9 | 98 | 102.2 | 1.50E−27 |
| 315 | PHE0007583__17871.pep | MtN3_slv | 132 | 218 | 112.8 | 1.00E−30 |
| 316 | PHE0006618__16146.pep | S10_plectin | 3 | 98 | 240.6 | 3.40E−69 |
| 317 | PHE0006791__16374.pep | GUN4 | 84 | 227 | 308.7 | 1.00E−89 |
| 318 | PHE0007620__17918.pep | peroxidase | 89 | 321 | 192.4 | 1.10E−54 |
| 319 | PHE0006659__16195.pep | MFS_1 | 10 | 391 | 111.5 | 2.50E−30 |
| 321 | PHE0006274__15867.pep | E2F_TDP | 130 | 195 | 135.8 | 1.10E−37 |
| 322 | PHE0006637__16166.pep | PP2C | 7 | 305 | 255.6 | 1.00E−73 |
| 323 | PHE0006926__16815.pep | VPS28 | 18 | 209 | 281.8 | 1.40E−81 |
| 324 | PHE0006821__16402.pep | PALP | 49 | 358 | −65.8 | 0.00015 |
| 325 | PHE0007687__18057.pep | p450 | 35 | 462 | 124 | 4.20E−34 |
| 326 | PHE0007642__17999.pep | PAS | 186 | 300 | 15.6 | 0.014 |
| 326 | PHE0007642__17999.pep | PAS_3 | 211 | 303 | 25.3 | 0.00022 |
| 326 | PHE0007642__17999.pep | PAS | 464 | 578 | 17.8 | 0.0089 |
| 326 | PHE0007642__17999.pep | PAS_3 | 489 | 581 | 23.5 | 0.00052 |
| 326 | PHE0007642__17999.pep | Pkinase | 663 | 952 | 269.7 | 5.80E−78 |
| 327 | PHE0007677__18052.pep | FAD_binding_3 | 5 | 372 | −96.1 | 4.10E−05 |
| 328 | PHE0007644__18001.pep | LRRNT_2 | 23 | 64 | 49.2 | 1.40E−11 |
| 328 | PHE0007644__18001.pep | LRR_1 | 97 | 119 | 10.5 | 3.1 |
| 328 | PHE0007644__18001.pep | LRR_1 | 121 | 143 | 14.4 | 0.42 |
| 328 | PHE0007644__18001.pep | LRR_1 | 145 | 167 | 12.1 | 1.5 |
| 328 | PHE0007644__18001.pep | LRR_1 | 169 | 192 | 13 | 1.1 |
| 328 | PHE0007644__18001.pep | LRR_1 | 194 | 216 | 14.1 | 0.52 |
| 328 | PHE0007644__18001.pep | Pkinase | 414 | 716 | 57.1 | 5.60E−14 |
| 329 | PHE0007640__17992.pep | CorA | 66 | 448 | 438.4 | 9.30E−129 |
| 330 | PHE0007678__18053.pep | 4HBT | 66 | 151 | 56.4 | 9.40E−14 |
| 331 | PHE0007649__18006.pep | Ank | 108 | 140 | 50.4 | 6.20E−12 |
| 331 | PHE0007649__18006.pep | Pkinase | 196 | 455 | 113 | 8.80E−31 |

TABLE 10-continued

Pfam annotation

| PEP SEQ ID NO | Gene ID | Pfam domain name | Begin | Stop | Score | E-value |
|---|---|---|---|---|---|---|
| 331 | PHE0007649__18006.pep | Pkinase_Tyr | 196 | 455 | 94.9 | 2.40E−25 |
| 332 | PHE0006726__16298.pep | WD40 | 45 | 83 | 30.2 | 7.30E−06 |
| 332 | PHE0006726__16298.pep | WD40 | 135 | 173 | 38.6 | 2.10E−08 |
| 333 | PHE0006218__8776.pep | Pyr_redox_2 | 85 | 370 | 163.7 | 4.70E−46 |
| 333 | PHE0006218__8776.pep | Pyr_redox | 231 | 325 | 93.9 | 4.80E−25 |
| 333 | PHE0006218__8776.pep | Thioredoxin | 423 | 528 | 25 | 1.50E−06 |
| 333 | PHE0006218__8776.pep | Glutaredoxin | 446 | 508 | 27.6 | 4.30E−05 |
| 335 | PHE0002554__17876.pep | Chloroa_b-bind | 63 | 261 | 263.3 | 5.00E−76 |
| 336 | PHE0006807__16388.pep | CCT | 352 | 390 | 76 | 1.20E−19 |
| 337 | PHE0003359__8487.pep | p450 | 51 | 489 | 120.5 | 4.90E−33 |
| 338 | PHE0006542__15765.pep | PMSR | 92 | 245 | 271 | 2.30E−78 |
| 339 | PHE0007622__17921.pep | Spermine_synth | 34 | 279 | 249.7 | 6.10E−72 |
| 340 | PHE0007630__17956.pep | 2OG-FeII_Oxy | 190 | 291 | 149.7 | 7.90E−42 |
| 341 | PHE0007593__17886.pep | Spermine_synth | 28 | 273 | 503.6 | 2.20E−148 |
| 342 | PHE0006475__15588.pep | PsbQ | 3 | 162 | 209.5 | 7.60E−60 |
| 343 | PHE0007619__17915.pep | MBD | 11 | 84 | 65.4 | 1.80E−16 |
| 344 | PHE0006846__16447.pep | Sterol_desat | 1 | 186 | 76.3 | 9.30E−20 |
| 345 | PHE0007584__17874.pep | MBD | 4 | 77 | 81.3 | 3.00E−21 |
| 346 | PHE0003695__17913.pep | LRRNT_2 | 23 | 64 | 41.6 | 2.80E−09 |
| 346 | PHE0003695__17913.pep | LRR_1 | 93 | 115 | 14.3 | 0.45 |
| 346 | PHE0003695__17913.pep | LRR_1 | 117 | 139 | 18.3 | 0.028 |
| 346 | PHE0003695__17913.pep | LRR_1 | 141 | 163 | 9.2 | 5.5 |
| 346 | PHE0003695__17913.pep | LRR_1 | 165 | 186 | 12.7 | 1.2 |
| 346 | PHE0003695__17913.pep | LRR_1 | 189 | 211 | 10.1 | 3.6 |
| 346 | PHE0003695__17913.pep | LRR_1 | 213 | 235 | 9.8 | 4.3 |
| 346 | PHE0003695__17913.pep | LRR_1 | 237 | 259 | 14.8 | 0.32 |
| 346 | PHE0003695__17913.pep | LRR_1 | 260 | 281 | 10.6 | 2.9 |
| 346 | PHE0003695__17913.pep | LRR_1 | 284 | 306 | 17.4 | 0.053 |
| 346 | PHE0003695__17913.pep | LRR_1 | 308 | 330 | 13.8 | 0.65 |
| 346 | PHE0003695__17913.pep | LRR_1 | 332 | 354 | 19.3 | 0.014 |
| 346 | PHE0003695__17913.pep | LRR_1 | 356 | 378 | 9 | 5.8 |
| 346 | PHE0003695__17913.pep | LRR_1 | 380 | 402 | 15.7 | 0.17 |
| 346 | PHE0003695__17913.pep | LRR_1 | 404 | 426 | 11.8 | 1.8 |
| 346 | PHE0003695__17913.pep | LRR_1 | 428 | 450 | 18.8 | 0.02 |
| 346 | PHE0003695__17913.pep | LRR_1 | 452 | 474 | 13.2 | 0.93 |
| 346 | PHE0003695__17913.pep | LRR_1 | 476 | 498 | 13.1 | 1 |
| 346 | PHE0003695__17913.pep | LRR_1 | 500 | 521 | 10.4 | 3.3 |
| 346 | PHE0003695__17913.pep | LRR_1 | 523 | 542 | 14.4 | 0.42 |
| 346 | PHE0003695__17913.pep | Pkinase | 648 | 917 | 111.8 | 2.00E−30 |
| 346 | PHE0003695__17913.pep | Pkinase_Tyr | 648 | 914 | 90.4 | 5.40E−24 |
| 347 | PHE0003695__17879.pep | LRRNT_2 | 23 | 64 | 41.6 | 2.80E−09 |
| 347 | PHE0003695__17879.pep | LRR_1 | 93 | 115 | 14.3 | 0.45 |
| 347 | PHE0003695__17879.pep | LRR_1 | 117 | 139 | 18.3 | 0.028 |
| 347 | PHE0003695__17879.pep | LRR_1 | 141 | 163 | 9.2 | 5.5 |
| 347 | PHE0003695__17879.pep | LRR_1 | 165 | 186 | 12.7 | 1.2 |
| 347 | PHE0003695__17879.pep | LRR_1 | 189 | 211 | 10.1 | 3.6 |
| 347 | PHE0003695__17879.pep | LRR_1 | 213 | 235 | 9.8 | 4.3 |
| 347 | PHE0003695__17879.pep | LRR_1 | 237 | 259 | 14.8 | 0.32 |
| 347 | PHE0003695__17879.pep | LRR_1 | 260 | 281 | 10.6 | 2.9 |
| 347 | PHE0003695__17879.pep | LRR_1 | 284 | 306 | 17.4 | 0.053 |
| 347 | PHE0003695__17879.pep | LRR_1 | 308 | 330 | 13.8 | 0.65 |
| 347 | PHE0003695__17879.pep | LRR_1 | 332 | 354 | 19.3 | 0.014 |
| 347 | PHE0003695__17879.pep | LRR_1 | 356 | 378 | 9 | 5.8 |
| 347 | PHE0003695__17879.pep | LRR_1 | 380 | 402 | 15.7 | 0.17 |
| 347 | PHE0003695__17879.pep | LRR_1 | 404 | 426 | 11.8 | 1.8 |
| 347 | PHE0003695__17879.pep | LRR_1 | 428 | 450 | 18.8 | 0.02 |
| 347 | PHE0003695__17879.pep | LRR_1 | 452 | 474 | 13.2 | 0.93 |
| 347 | PHE0003695__17879.pep | LRR_1 | 476 | 498 | 13.1 | 1 |
| 347 | PHE0003695__17879.pep | LRR_1 | 500 | 521 | 10.4 | 3.3 |
| 347 | PHE0003695__17879.pep | LRR_1 | 523 | 542 | 14.4 | 0.42 |
| 347 | PHE0003695__17879.pep | Pkinase | 648 | 917 | 111.8 | 2.00E−30 |
| 347 | PHE0003695__17879.pep | Pkinase_Tyr | 648 | 914 | 90.4 | 5.40E−24 |
| 349 | PHE0007645__18002.pep | AP2 | 115 | 180 | 156.4 | 7.20E−44 |
| 350 | PHE0006784__16366.pep | PALP | 12 | 301 | 453.6 | 2.50E−133 |
| 351 | PHE0006171__16491.pep | Glyoxalase | 70 | 214 | 136.8 | 5.90E−38 |
| 353 | PHE0006906__16796.pep | Proteasome | 10 | 206 | 145.9 | 1.00E−40 |
| 354 | PHE0006649__16180.pep | AP2 | 46 | 110 | 149.5 | 8.60E−42 |
| 355 | PHE0006809__16390.pep | Prismane | 1 | 548 | 886.8 | 9.80E−264 |
| 356 | PHE0006918__16808.pep | SWIM | 321 | 353 | 42.8 | 1.10E−09 |
| 357 | PHE0007813__18219.pep | MtN3_slv | 9 | 98 | 79.8 | 8.50E−21 |
| 357 | PHE0007813__18219.pep | MtN3_slv | 132 | 218 | 125.3 | 1.80E−34 |
| 359 | PHE0006825__16405.pep | Cytochrom_C552 | 27 | 476 | 1333.6 | 0 |
| 360 | PHE0006964__16864.pep | tRNA_anti | 43 | 122 | 55.2 | 2.10E−13 |
| 360 | PHE0006964__16864.pep | tRNA-synt_2 | 140 | 557 | 208.2 | 1.90E−59 |

TABLE 10-continued

Pfam annotation

| PEP SEQ ID NO | Gene ID | Pfam domain name | Begin | Stop | Score | E-value |
|---|---|---|---|---|---|---|
| 361 | PHE0008105_18407.pep | Histone | 152 | 225 | 69.9 | 8.40E−18 |
| 361 | PHE0008105_18407.pep | CBFD_NFYB_HMF | 158 | 222 | 77.9 | 3.10E−20 |
| 362 | PHE0006630_16159.pep | Ldh_1_N | 90 | 239 | 202 | 1.30E−57 |
| 362 | PHE0006630_16159.pep | Ldh_1_C | 241 | 413 | 258.1 | 1.80E−74 |
| 363 | PHE0006966_16868.pep | DNA_photolyase | 12 | 183 | 298.7 | 1.10E−86 |
| 363 | PHE0006966_16868.pep | FAD_binding_7 | 214 | 492 | 536.3 | 3.30E−158 |
| 365 | PHE0006608_16123.pep | GSHPx | 42 | 150 | 237.8 | 2.30E−68 |
| 366 | PHE0010462_21459.pep | NUDIX | 17 | 159 | 111.7 | 2.20E−30 |
| 366 | PHE0010462_21459.pep | NUDIX | 190 | 322 | 100.5 | 4.90E−27 |
| 367 | PHE0009211_21774.pep | Auxin_inducible | 1 | 106 | 149.5 | 8.80E−42 |
| 368 | PHE0006256_8775.pep | RPE65 | 105 | 591 | 864.5 | 5.10E−257 |
| 369 | PHE0006989_16918.pep | Pkinase | 88 | 396 | 224.8 | 1.90E−64 |
| 370 | PHE0007649_18166.pep | Ank | 108 | 140 | 50.4 | 6.20E−12 |
| 370 | PHE0007649_18166.pep | Pkinase | 196 | 455 | 115.1 | 2.00E−31 |
| 370 | PHE0007649_18166.pep | Pkinase_Tyr | 196 | 455 | 98.9 | 1.50E−26 |
| 371 | PHE0006708_16264.pep | DEAD | 57 | 223 | 202.7 | 8.40E−58 |
| 371 | PHE0006708_16264.pep | Helicase_C | 291 | 367 | 127.8 | 3.10E−35 |
| 372 | PHE0001117_19094.pep | Homeobox | 79 | 133 | 68.2 | 2.70E−17 |
| 372 | PHE0001117_19094.pep | HALZ | 134 | 178 | 66.7 | 7.20E−17 |
| 373 | PHE0006266_8814.pep | Fe_bilin_red | 16 | 244 | 209.5 | 7.50E−60 |
| 374 | PHE0006795_16378.pep | Na_H_antiport_1 | 4 | 380 | 875.9 | 1.90E−260 |
| 375 | PHE0006956_16853.pep | Molybdop_Fe4S4 | 2 | 56 | 92 | 1.90E−24 |
| 375 | PHE0006956_16853.pep | Molybdopterin | 59 | 482 | 377.8 | 1.60E−110 |
| 375 | PHE0006956_16853.pep | Molydop_binding | 578 | 689 | 159.8 | 7.10E−45 |
| 375 | PHE0006956_16853.pep | Fer2_BFD | 825 | 877 | 62 | 2.00E−15 |
| 377 | PHE0006824_16404.pep | Globin | 14 | 154 | 93.4 | 7.00E−25 |
| 378 | PHE0006812_16393.pep | Bac_globin | 3 | 118 | 188.4 | 1.70E−53 |
| 379 | PHE0006815_16396.pep | Bac_globin | 26 | 146 | 191.4 | 2.10E−54 |
| 380 | PHE0006806_16387.pep | Bac_globin | 26 | 146 | 196.8 | 5.10E−56 |
| 381 | PHE0006624_16153.pep | NAD_binding_2 | 3 | 178 | 282.5 | 7.90E−82 |
| 381 | PHE0006624_16153.pep | 6PGD | 182 | 473 | 713.8 | 1.20E−211 |
| 382 | PHE0005006_15823.pep | Chloroa_b-bind | 63 | 242 | 241.4 | 1.90E−69 |
| 384 | PHE0006683_16229.pep | Response_reg | 10 | 151 | 73.8 | 5.40E−19 |
| 385 | PHE0006884_16703.pep | Glyco_transf_5 | 83 | 344 | 462.7 | 4.80E−136 |
| 385 | PHE0006884_16703.pep | Glycos_transf_1 | 384 | 567 | 40.2 | 7.10E−09 |
| 386 | PHE0006691_16237.pep | NAD_Gly3P_dh_N | 6 | 165 | 285 | 1.40E−82 |
| 386 | PHE0006691_16237.pep | ApbA | 8 | 169 | 6.6 | 0.00011 |
| 386 | PHE0006691_16237.pep | NAD_Gly3P_dh_C | 183 | 327 | 289.1 | 8.20E−84 |
| 387 | PHE0006790_16372.pep | Rieske | 220 | 317 | 96.7 | 7.10E−26 |
| 387 | PHE0006790_16372.pep | PaO | 408 | 507 | 180.7 | 3.60E−51 |
| 388 | PHE0009143_19932.pep | Histone_HNS | 21 | 129 | 170.1 | 5.70E−48 |
| 389 | PHE0008406_18830.pep | AA_permease | 57 | 511 | 619.8 | 2.40E−183 |
| 390 | PHE0008279_18708.pep | Mit_rib_S27 | 14 | 93 | 135.3 | 1.70E−37 |
| 391 | PHE0009142_19931.pep | Histone_HNS | 21 | 130 | 175.1 | 1.70E−49 |
| 393 | PHE0007639_17991.pep | ELFV_dehydrog_N | 84 | 214 | 298.9 | 9.20E−87 |
| 393 | PHE0007639_17991.pep | ELFV_dehydrog | 229 | 474 | 469.7 | 3.60E−138 |
| 394 | PHE0007646_18170.pep | F-box | 36 | 83 | 51.8 | 2.20E−12 |
| 394 | PHE0007646_18170.pep | Kelch_1 | 131 | 185 | 25.1 | 0.00026 |
| 394 | PHE0007646_18170.pep | Kelch_1 | 187 | 233 | 44.2 | 4.40E−10 |
| 394 | PHE0007646_18170.pep | Kelch_2 | 187 | 233 | 26.1 | 0.00012 |
| 395 | PHE0007765_18182.pep | GST_N | 5 | 79 | 69.6 | 1.00E−17 |
| 395 | PHE0007765_18182.pep | GST_C | 101 | 204 | 28.8 | 1.90E−05 |
| 396 | PHE0008167_18465.pep | Pkinase | 8 | 262 | 210 | 5.60E−60 |
| 396 | PHE0008167_18465.pep | Pkinase_Tyr | 8 | 262 | 247.9 | 2.10E−71 |
| 398 | PHE0008183_18479.pep | LRRNT_2 | 23 | 66 | 49.3 | 1.30E−11 |
| 398 | PHE0008183_18479.pep | LRR_1 | 71 | 93 | 12.1 | 1.6 |
| 398 | PHE0008183_18479.pep | LRR_1 | 95 | 117 | 10.3 | 3.3 |
| 398 | PHE0008183_18479.pep | LRR_1 | 119 | 142 | 13 | 1 |
| 398 | PHE0008183_18479.pep | LRR_1 | 144 | 166 | 19.5 | 0.012 |
| 398 | PHE0008183_18479.pep | LRR_1 | 168 | 190 | 10.6 | 3 |
| 398 | PHE0008183_18479.pep | LRR_1 | 192 | 214 | 8.8 | 6.4 |
| 398 | PHE0008183_18479.pep | LRR_1 | 289 | 311 | 17.3 | 0.055 |
| 398 | PHE0008183_18479.pep | LRR_1 | 313 | 335 | 10.6 | 2.9 |
| 398 | PHE0008183_18479.pep | LRR_1 | 337 | 359 | 10.8 | 2.8 |
| 398 | PHE0008183_18479.pep | LRR_1 | 361 | 384 | 12 | 1.6 |
| 398 | PHE0008183_18479.pep | LRR_1 | 409 | 431 | 10.4 | 3.2 |
| 398 | PHE0008183_18479.pep | LRR_1 | 457 | 479 | 11.9 | 1.7 |
| 398 | PHE0008183_18479.pep | LRR_1 | 481 | 503 | 10.2 | 3.4 |
| 398 | PHE0008183_18479.pep | LRR_1 | 505 | 527 | 10.4 | 3.3 |
| 398 | PHE0008183_18479.pep | LRR_1 | 529 | 551 | 10.9 | 2.6 |
| 398 | PHE0008183_18479.pep | LRR_1 | 553 | 575 | 9.3 | 5.2 |
| 398 | PHE0008183_18479.pep | LRR_1 | 577 | 598 | 11 | 2.4 |
| 398 | PHE0008183_18479.pep | Pkinase | 695 | 966 | 133.8 | 4.80E−37 |
| 398 | PHE0008183_18479.pep | Pkinase_Tyr | 695 | 966 | 134.8 | 2.30E−37 |

TABLE 10-continued

| PEP SEQ ID NO | Gene ID | Pfam domain name | Begin | Stop | Score | E-value |
|---|---|---|---|---|---|---|
| 399 | PHE0007585__17875.pep | LEA_3 | 2 | 98 | 138.9 | 1.30E−38 |
| 400 | PHE0006804__16385.pep | zf-CCCH | 13 | 39 | 35.4 | 1.90E−07 |
| 400 | PHE0006804__16385.pep | zf-CCCH | 149 | 174 | 24.3 | 0.00045 |
| 401 | PHE0006703__15751.pep | PFK | 72 | 347 | 650.2 | 1.70E−192 |
| 402 | PHE0007410__17653.pep | Acyltransferase | 27 | 249 | 29.2 | 1.00E−05 |
| 403 | PHE0006854__16456.pep | YABBY | 40 | 278 | 249.1 | 9.30E−72 |
| 404 | PHE0007721__21293.pep | KNOX1 | 102 | 146 | 90.4 | 5.50E−24 |
| 404 | PHE0007721__21293.pep | KNOX2 | 153 | 204 | 101.2 | 3.10E−27 |
| 404 | PHE0007721__21293.pep | ELK | 242 | 263 | 37 | 6.50E−08 |
| 405 | PHE0006563__15990.pep | GATase_2 | 2 | 161 | 103.9 | 4.70E−28 |
| 405 | PHE0006563__15990.pep | Asn_synthase | 209 | 450 | 328.7 | 9.80E−96 |
| 406 | PHE0006619__16147.pep | AA_kinase | 15 | 261 | 192.3 | 1.20E−54 |
| 407 | PHE0006813__16394.pep | Bac_globin | 7 | 124 | 123 | 8.50E−34 |
| 408 | PHE0006688__16234.pep | Ribosomal_S2 | 13 | 229 | 448.6 | 8.00E−132 |
| 409 | PHE0006635__16164.pep | MGS | 28 | 121 | 99.4 | 1.10E−26 |
| 411 | PHE0008416__18838.pep | PTR2 | 115 | 504 | 350.4 | 3.00E−102 |
| 413 | PHE0008599__19166.pep | Isoamylase_N | 24 | 115 | 93.4 | 6.60E−25 |
| 413 | PHE0008599__19166.pep | Alpha-amylase | 164 | 578 | 75.8 | 1.40E−19 |
| 414 | PHE0008375__18732.pep | Pribosyltran | 93 | 237 | 141.8 | 1.80E−39 |
| 416 | PHE0008394__18763.pep | Gln-synt_N | 68 | 148 | 147.3 | 4.20E−41 |
| 416 | PHE0008394__18763.pep | Gln-synt_C | 154 | 406 | 287.7 | 2.20E−83 |
| 417 | PHE0008395__18764.pep | Gln-synt_N | 68 | 148 | 147.3 | 4.20E−41 |
| 417 | PHE0008395__18764.pep | Gln-synt_C | 154 | 406 | 285 | 1.50E−82 |
| 418 | PHE0008444__18846.pep | Gln-synt_N | 17 | 97 | 150.4 | 4.70E−42 |
| 418 | PHE0008444__18846.pep | Gln-synt_C | 103 | 355 | 283.9 | 3.00E−82 |
| 419 | PHE0006819__16400.pep | Lactamase_B | 47 | 236 | 77.1 | 5.60E−20 |
| 419 | PHE0006819__16400.pep | Flavodoxin_1 | 267 | 397 | 8.1 | 0.0041 |
| 419 | PHE0006819__16400.pep | Flavin_Reduct | 424 | 573 | 254.7 | 1.90E−73 |
| 420 | PHE0007417__17663.pep | EIN3 | 60 | 467 | 777.5 | 7.80E−231 |
| 421 | PHE0008443__18845.pep | GATase_2 | 2 | 161 | 98.7 | 1.70E−26 |
| 421 | PHE0008443__18845.pep | Asn_synthase | 209 | 450 | 331 | 2.00E−96 |
| 422 | PHE0006818__16399.pep | Lactamase_B | 34 | 227 | 105.3 | 1.80E−28 |
| 422 | PHE0006818__16399.pep | Flavodoxin_1 | 256 | 389 | 86.4 | 8.80E−23 |
| 422 | PHE0006818__16399.pep | Rubredoxin | 423 | 471 | 89.8 | 8.10E−24 |
| 423 | PHE0006579__16031.pep | Thi4 | 63 | 306 | 552.2 | 5.40E−163 |
| 423 | PHE0006579__16031.pep | DAO | 91 | 319 | −9 | 1.90E−05 |
| 424 | PHE0006808__16389.pep | CCT | 354 | 392 | 75.3 | 1.90E−19 |
| 425 | PHE0008160__18460.pep | TPP_enzyme_N | 45 | 221 | 286.5 | 5.20E−83 |
| 425 | PHE0008160__18460.pep | TPP_enzyme_M | 243 | 376 | 82.1 | 1.70E−21 |
| 425 | PHE0008160__18460.pep | TPP_enzyme_C | 431 | 578 | 34.8 | 2.80E−09 |
| 426 | PHE0007571__17834.pep | GSH_synth_ATP | 29 | 499 | 836.5 | 1.30E−248 |
| 426 | PHE0007571__17834.pep | GSH_synthase | 229 | 331 | 200 | 5.50E−57 |
| 427 | PHE0007586__17877.pep | Chloroa_b-bind | 64 | 261 | 255.3 | 1.20E−73 |
| 429 | PHE0009729__21717.pep | Homeobox | 67 | 123 | 68.9 | 1.60E−17 |
| 429 | PHE0009729__21717.pep | HALZ | 124 | 168 | 53.4 | 7.60E−13 |
| 430 | PHE0006424__15520.pep | PsbW_2 | 1 | 133 | 382.1 | 8.60E−112 |
| 431 | PHE0006392__15480.pep | PsbP | 106 | 322 | 252.9 | 6.50E−73 |
| 432 | PHE0006589__16093.pep | Thioredoxin | 64 | 167 | 130.3 | 5.20E−36 |
| 433 | PHE0009258__21487.pep | Na_H_Exchanger | 22 | 441 | 181.7 | 1.70E−51 |
| 434 | PHE0006680__16226.pep | 2OG-FeII_Oxy | 187 | 287 | 158 | 2.40E−44 |
| 435 | PHE0006481__16072.pep | adh_short | 33 | 181 | 28.8 | 7.00E−08 |
| 436 | PHE0006269__8820.pep | TPR_1 | 74 | 107 | 21.3 | 0.0035 |
| 436 | PHE0006269__8820.pep | TPR_2 | 74 | 107 | 24.7 | 0.00034 |
| 436 | PHE0006269__8820.pep | TPR_1 | 108 | 141 | 37.4 | 4.80E−08 |
| 436 | PHE0006269__8820.pep | TPR_2 | 108 | 141 | 35.3 | 2.10E−07 |
| 436 | PHE0006269__8820.pep | TPR_1 | 142 | 175 | 15 | 0.086 |
| 436 | PHE0006269__8820.pep | TPR_2 | 142 | 175 | 23.8 | 0.00063 |
| 436 | PHE0006269__8820.pep | TPR_1 | 179 | 212 | 7.9 | 0.61 |
| 436 | PHE0006269__8820.pep | TPR_4 | 247 | 272 | 23.6 | 0.00069 |
| 436 | PHE0006269__8820.pep | TPR_1 | 281 | 314 | 16.2 | 0.063 |
| 436 | PHE0006269__8820.pep | TPR_2 | 281 | 314 | 26 | 0.00014 |
| 436 | PHE0006269__8820.pep | TPR_1 | 349 | 382 | 13.6 | 0.13 |
| 437 | PHE0006783__16365.pep | Aa_trans | 32 | 469 | 574.9 | 7.90E−170 |
| 438 | PHE0003151__18392.pep | AP2 | 318 | 391 | 149.5 | 8.70E−42 |
| 438 | PHE0003151__18392.pep | AP2 | 420 | 485 | 125.8 | 1.20E−34 |
| 439 | PHE0008272__18723.pep | HSF_DNA-bind | 18 | 188 | 213.9 | 3.50E−61 |
| 440 | PHE0008277__18706.pep | SNF5 | 172 | 400 | 471.8 | 8.60E−139 |
| 441 | PHE0008109__18411.pep | Sad1_UNC | 203 | 330 | 195.6 | 1.10E−55 |
| 442 | PHE0008280__18826.pep | Alpha-amylase | 14 | 452 | 198.9 | 1.20E−56 |
| 443 | PHE0002424__15825.pep | adh_short | 43 | 215 | 24.9 | 1.30E−07 |
| 443 | PHE0002424__15825.pep | KR | 43 | 200 | −69.1 | 0.0024 |
| 444 | PHE0006914__16804.pep | AAA | 204 | 391 | 298.6 | 1.10E−86 |
| 445 | PHE0006642__16172.pep | p450 | 42 | 496 | 213.5 | 4.80E−61 |
| 447 | PHE0009926__21079.pep | DSPc | 24 | 152 | 137.5 | 3.60E−38 |

TABLE 10-continued

Pfam annotation

| PEP SEQ ID NO | Gene ID | Pfam domain name | Begin | Stop | Score | E-value |
|---|---|---|---|---|---|---|
| 448 | PHE0006206_19159.pep | Sina | 106 | 305 | 426.4 | 4.00E−125 |
| 449 | PHE0008274_18705.pep | BURP | 56 | 280 | 380 | 3.60E−111 |
| 450 | PHE0009510_20526.pep | Spermine_synth | 38 | 283 | 500.4 | 2.10E−147 |
| 451 | PHE0009937_21097.pep | Spermine_synth | 38 | 283 | 500.4 | 2.10E−147 |
| 452 | PHE0009927_21080.pep | DSPc | 24 | 162 | 146.6 | 6.60E−41 |
| 454 | PHE0006445_15956.pep | Allene_ox_cyc | 74 | 253 | 401.6 | 1.20E−117 |
| 455 | PHE0006987_16893.pep | efhand | 86 | 114 | 25 | 0.00026 |
| 455 | PHE0006987_16893.pep | efhand | 167 | 195 | 27.6 | 4.30E−05 |
| 456 | PHE0004230_15865.pep | E2F_TDP | 146 | 211 | 133.8 | 4.60E−37 |
| 457 | PHE0006814_16395.pep | Bac_globin | 26 | 144 | 206 | 8.80E−59 |
| 458 | PHE0002773_15881.pep | NTP_transferase | 88 | 366 | 415.4 | 8.30E−122 |
| 459 | PHE0006060_15842.pep | ubiquitin | 5 | 73 | 138 | 2.50E−38 |
| 459 | PHE0006060_15842.pep | ubiquitin | 81 | 149 | 138 | 2.50E−38 |
| 459 | PHE0006060_15842.pep | ubiquitin | 157 | 225 | 138 | 2.50E−38 |
| 459 | PHE0006060_15842.pep | ubiquitin | 233 | 301 | 138 | 2.50E−38 |
| 460 | PHE0006850_16451.pep | YABBY | 6 | 166 | 342.9 | 5.20E−100 |
| 461 | PHE0008043_18199.pep | Homeobox | 25 | 85 | 64.6 | 3.20E−16 |
| 461 | PHE0008043_18199.pep | START | 164 | 374 | 198.3 | 1.80E−56 |
| 461 | PHE0008043_18199.pep | MEKHLA | 693 | 840 | 296.7 | 4.40E−86 |
| 462 | PHE0000125_18852.pep | Response_reg | 28 | 153 | 25.4 | 3.80E−05 |
| 462 | PHE0000125_18852.pep | CCT | 457 | 495 | 70.6 | 5.10E−18 |
| 463 | PHE0008269_18720.pep | Pkinase | 23 | 279 | 234 | 3.30E−67 |
| 464 | PHE0008264_18712.pep | zf-UBR | 40 | 109 | 73.4 | 7.10E−19 |
| 465 | PHE0002782_20059.pep | PGI | 2 | 457 | 172.8 | 8.80E−49 |
| 466 | PHE0009438_20404.pep | GATA | 191 | 226 | 72.7 | 1.10E−18 |
| 467 | PHE0009429_20392.pep | ParBc | 70 | 151 | 47.5 | 4.50E−11 |
| 468 | PHE0009440_20406.pep | ParBc | 11 | 126 | 55.3 | 2.00E−13 |
| 469 | PHE0008543_18945.pep | TP_methylase | 222 | 435 | 272.6 | 7.70E−79 |
| 470 | PHE0006960_16857.pep | Oxidored_molyb | 116 | 301 | 289.2 | 7.70E−84 |
| 470 | PHE0006960_16857.pep | Mo-co_dimer | 326 | 459 | 300.9 | 2.30E−87 |
| 470 | PHE0006960_16857.pep | Cyt-b5 | 515 | 588 | 93.3 | 7.20E−25 |
| 470 | PHE0006960_16857.pep | FAD_binding_6 | 633 | 740 | 212.6 | 9.20E−61 |
| 470 | PHE0006960_16857.pep | NAD_binding_1 | 759 | 872 | 169.6 | 8.00E−48 |
| 471 | PHE0009427_20389.pep | IGPD | 103 | 247 | 372.6 | 6.20E−109 |
| 472 | PHE0006437_15906.pep | Pkinase | 39 | 307 | 15.8 | 1.70E−09 |
| 473 | PHE0007409_17652.pep | DAGAT | 64 | 340 | 278.2 | 1.60E−80 |
| 474 | PHE0009426_20387.pep | PHP | 2 | 281 | 104.4 | 3.30E−28 |
| 475 | PHE0009430_20393.pep | ParBc | 44 | 128 | 45.7 | 1.60E−10 |
| 476 | PHE0007003_16906.pep | PTPA | 96 | 396 | 524 | 1.60E−154 |
| 477 | PHE0008378_18741.pep | bZIP_1 | 223 | 280 | 76.5 | 8.20E−20 |
| 477 | PHE0008378_18741.pep | bZIP_2 | 224 | 277 | 47.5 | 4.40E−11 |
| 478 | PHE0008273_18725.pep | zf-CCCH | 80 | 106 | 39.3 | 1.30E−08 |
| 479 | PHE0008547_18953.pep | Fer2 | 20 | 95 | 95 | 2.20E−25 |
| 480 | PHE0006922_16812.pep | Hexokinase_1 | 44 | 251 | 260.7 | 2.90E−75 |
| 480 | PHE0006922_16812.pep | Hexokinase_2 | 258 | 501 | 261.2 | 2.10E−75 |
| 481 | PHE0006920_16810.pep | AAA | 267 | 458 | 270 | 4.60E−78 |
| 481 | PHE0006920_16810.pep | Vps4_C | 464 | 514 | 4.5 | 0.00031 |
| 482 | PHE0008396_18765.pep | Gln-synt_N | 68 | 148 | 147.3 | 4.20E−41 |
| 482 | PHE0008396_18765.pep | Gln-synt_C | 154 | 406 | 285.4 | 1.10E−82 |
| 483 | PHE0006957_16854.pep | Gln-synt_N | 68 | 148 | 147.3 | 4.20E−41 |
| 483 | PHE0006957_16854.pep | Gln-synt_C | 154 | 406 | 285.4 | 1.10E−82 |
| 484 | PHE0006404_15936.pep | RRM_1 | 8 | 77 | 81.4 | 2.80E−21 |
| 484 | PHE0006404_15936.pep | RRM_1 | 112 | 182 | 81.8 | 2.10E−21 |
| 485 | PHE0006820_16401.pep | Lactamase_B | 47 | 236 | 82.8 | 1.10E−21 |
| 485 | PHE0006820_16401.pep | Flavin_Reduct | 423 | 572 | 222.8 | 7.90E−64 |
| 486 | PHE0006690_16236.pep | MFS_1 | 57 | 421 | 44.3 | 4.30E−10 |
| 487 | PHE0006395_15932.pep | LRR_1 | 185 | 206 | 11.9 | 1.7 |
| 487 | PHE0006395_15932.pep | LRR_1 | 208 | 229 | 17.1 | 0.065 |
| 487 | PHE0006395_15932.pep | LRR_1 | 231 | 252 | 13.5 | 0.77 |
| 487 | PHE0006395_15932.pep | LRR_1 | 254 | 272 | 12.6 | 1.2 |
| 487 | PHE0006395_15932.pep | LRR_1 | 278 | 299 | 8.4 | 7.8 |
| 487 | PHE0006395_15932.pep | LRR_1 | 349 | 370 | 20.8 | 0.0049 |
| 487 | PHE0006395_15932.pep | LRR_1 | 372 | 394 | 7.8 | 9.8 |
| 488 | PHE0006759_16384.pep | SHMT | 55 | 453 | 1032.6 | 0 |
| 489 | PHE0006576_16028.pep | Myb_DNA-binding | 11 | 57 | 59.3 | 1.30E−14 |
| 489 | PHE0006576_16028.pep | Myb_DNA-binding | 63 | 108 | 48.9 | 1.70E−11 |
| 490 | PHE0006979_16885.pep | Tryp_alpha_amyl | 33 | 111 | 55.3 | 2.00E−13 |
| 491 | PHE0009786_21754.pep | HLH | 33 | 80 | 30 | 8.20E−06 |
| 492 | PHE0006572_16007.pep | Pkinase | 11 | 269 | 317 | 3.30E−92 |
| 494 | PHE0006588_16092.pep | Thioredoxin | 56 | 161 | 128.8 | 1.50E−35 |
| 495 | PHE0006985_16891.pep | DUF1716 | 13 | 118 | 159.3 | 1.00E−44 |
| 496 | PHE0006875_16688.pep | PSI_PSAK | 44 | 138 | 191.6 | 1.90E−54 |
| 497 | PHE0006626_16155.pep | Glyco_hydro_17 | 30 | 335 | 587.5 | 1.20E−173 |
| 498 | PHE0006689_16235.pep | Aa_trans | 165 | 548 | 224.1 | 3.20E−64 |

TABLE 10-continued

| Pfam annotation | | | | | | |
|---|---|---|---|---|---|---|
| PEP SEQ ID NO | Gene ID | Pfam domain name | Begin | Stop | Score | E-value |
| 499 | PHE0006799__16382.pep | B12-binding | 10 | 135 | 104.3 | 3.70E−28 |
| 499 | PHE0006799__16382.pep | Radical_SAM | 202 | 368 | 91.2 | 3.10E−24 |
| 500 | PHE0006959__16856.pep | Oxidored_molyb | 143 | 328 | 286.7 | 4.40E−83 |
| 500 | PHE0006959__16856.pep | Mo-co_dimer | 353 | 486 | 297.6 | 2.40E−86 |
| 500 | PHE0006959__16856.pep | Cyt-b5 | 543 | 616 | 90.4 | 5.60E−24 |
| 500 | PHE0006959__16856.pep | FAD_binding_6 | 660 | 767 | 231.6 | 1.70E−66 |
| 500 | PHE0006959__16856.pep | NAD_binding_1 | 786 | 899 | 186.4 | 7.00E−53 |
| 501 | PHE0011615__23861.pep | Pkinase | 267 | 523 | 297.5 | 2.50E−86 |
| 501 | PHE0011615__23861.pep | Pkinase_Tyr | 267 | 523 | 127.5 | 3.70E−35 |
| 502 | PHE0006925__16814.pep | Tim17 | 4 | 133 | 198.1 | 2.10E−56 |
| 503 | PHE0006713__16274.pep | APC8 | 1 | 161 | 401.5 | 1.20E−117 |
| 503 | PHE0006713__16274.pep | TPR_1 | 339 | 372 | 34.7 | 3.20E−07 |
| 503 | PHE0006713__16274.pep | TPR_2 | 339 | 372 | 23.7 | 0.00066 |
| 503 | PHE0006713__16274.pep | TPR_2 | 373 | 406 | 23.7 | 0.00068 |
| 503 | PHE0006713__16274.pep | TPR_1 | 373 | 406 | 34.1 | 4.80E−07 |
| 503 | PHE0006713__16274.pep | TPR_2 | 407 | 440 | 22.1 | 0.002 |
| 503 | PHE0006713__16274.pep | TPR_1 | 407 | 440 | 24.3 | 0.00043 |
| 504 | PHE0008447__18848.pep | Lir1 | 1 | 126 | 178.6 | 1.60E−50 |
| 505 | PHE0006674__16221.pep | PTR2 | 96 | 505 | 222.7 | 8.20E−64 |
| 506 | PHE0010613__22398.pep | DAGK_cat | 43 | 184 | 106.4 | 8.50E−29 |
| 507 | PHE0002720__22558.pep | DnaJ | 90 | 151 | 137.6 | 3.40E−38 |
| 507 | PHE0002720__22558.pep | DnaJ_CXXCXGXG | 218 | 301 | 100.5 | 5.20E−27 |
| 507 | PHE0002720__22558.pep | DnaJ_C | 314 | 436 | 210.6 | 3.60E−60 |
| 508 | PHE0011760__24005.pep | Pkinase | 400 | 656 | 297.5 | 2.50E−86 |
| 508 | PHE0011760__24005.pep | Pkinase_Tyr | 400 | 656 | 127.5 | 3.70E−35 |
| 509 | PHE0010612__22397.pep | G-patch | 15 | 59 | 62 | 1.90E−15 |
| 511 | PHE0007411__17654.pep | Acyltransferase | 136 | 283 | 86.4 | 8.50E−23 |
| 512 | PHE0010617__22402.pep | Isochorismatase | 27 | 210 | −41 | 0.0027 |
| 513 | PHE0010610__22395.pep | zf-C3HC4 | 103 | 144 | 36.3 | 1.10E−07 |
| 514 | PHE0006883__16702.pep | Glyco_transf_5 | 78 | 339 | 461.4 | 1.10E−135 |
| 514 | PHE0006883__16702.pep | Glycos_transf_1 | 379 | 562 | 40.5 | 5.80E−09 |
| 515 | PHE0010636__22408.pep | UAA | 96 | 387 | −125.2 | 0.00037 |
| 515 | PHE0010636__22408.pep | DUF6 | 105 | 230 | 32.1 | 2.00E−06 |
| 515 | PHE0010636__22408.pep | TPT | 239 | 384 | 188.8 | 1.30E−53 |
| 516 | PHE0011082__23038.pep | adh_short | 19 | 187 | 111.5 | 2.50E−30 |
| 516 | PHE0011082__23038.pep | KR | 19 | 202 | −67.5 | 0.0019 |
| 517 | PHE0009475__20462.pep | 2OG-FeII_Oxy | 223 | 322 | 166.9 | 5.20E−47 |
| 518 | PHE0007415__17661.pep | EIN3 | 60 | 467 | 781.6 | 4.80E−232 |
| 519 | PHE0006614__16129.pep | Cellulase | 19 | 358 | −25.9 | 1.00E−05 |
| 520 | PHE0010611__22396.pep | FMO-like | 25 | 424 | −364.7 | 5.40E−07 |
| 521 | PHE0011719__23946.pep | Acyltransferase | 69 | 222 | 30 | 8.30E−06 |
| 522 | PHE0006861__16463.pep | NPH3 | 166 | 409 | 387.6 | 1.80E−113 |
| 523 | PHE0006568__16005.pep | DUF26 | 80 | 134 | 56.9 | 6.70E−14 |
| 523 | PHE0006568__16005.pep | DUF26 | 199 | 253 | 62.1 | 1.80E−15 |
| 523 | PHE0006568__16005.pep | Pkinase_Tyr | 346 | 615 | 114 | 4.20E−31 |
| 523 | PHE0006568__16005.pep | Pkinase | 346 | 615 | 163.2 | 6.70E−46 |
| 524 | PHE0010652__22429.pep | FtsJ | 21 | 211 | 282.4 | 8.80E−82 |
| 525 | PHE0008158__18448.pep | PLATZ | 22 | 144 | 232.3 | 1.00E−66 |
| 526 | PHE0003316__20755.pep | Glyco_hydro_2_N | 9 | 180 | 238.7 | 1.30E−68 |
| 526 | PHE0003316__20755.pep | Glyco_hydro_2 | 182 | 272 | 129.9 | 7.00E−36 |
| 526 | PHE0003316__20755.pep | Glyco_hydro_2_C | 274 | 593 | 612.1 | 5.00E−181 |
| 527 | PHE0009478__20470.pep | 2OG-FeII_Oxy | 229 | 328 | 171.2 | 2.50E−48 |
| 528 | PHE0010395__21760.pep | DUF716 | 109 | 266 | 180.5 | 4.10E−51 |
| 529 | PHE0010391__21753.pep | DUF640 | 28 | 160 | 296.6 | 4.70E−86 |
| 530 | PHE0010396__21761.pep | DUF716 | 109 | 265 | 175.2 | 1.60E−49 |
| 531 | PHE0009511__22422.pep | SAM_decarbox | 5 | 337 | 710.3 | 1.30E−210 |
| 532 | PHE0010614__22399.pep | SOUL | 28 | 211 | 330.7 | 2.50E−96 |
| 534 | PHE0011454__23667.pep | Histone | 56 | 126 | 103.3 | 7.20E−28 |
| 535 | PHE0011443__24001.pep | Histone | 61 | 131 | 103.3 | 7.20E−28 |
| 536 | PHE0011452__23665.pep | Histone | 58 | 132 | 142.7 | 9.80E−40 |
| 537 | PHE0010394__21758.pep | SAP18 | 29 | 150 | 260.5 | 3.30E−75 |
| 540 | PHE0010100__21467.pep | Pyr_redox_2 | 5 | 285 | 134.4 | 3.10E−37 |
| 540 | PHE0010100__21467.pep | Pyr_redox | 147 | 240 | 91 | 3.50E−24 |
| 540 | PHE0010100__21467.pep | Fer2_BFD | 420 | 472 | 81.5 | 2.60E−21 |
| 540 | PHE0010100__21467.pep | NIR_SIR_ferr | 554 | 621 | 89.9 | 7.80E−24 |
| 540 | PHE0010100__21467.pep | NIR_SIR | 629 | 775 | 176.5 | 6.70E−50 |
| 541 | PHE0011503__23734.pep | GAF | 158 | 307 | 91.9 | 1.90E−24 |
| 541 | PHE0011503__23734.pep | HisKA | 343 | 408 | 87.5 | 4.10E−23 |
| 541 | PHE0011503__23734.pep | HATPase_c | 455 | 586 | 123.9 | 4.50E−34 |
| 542 | PHE0010099__21319.pep | Molybdop_Fe4S4 | 1 | 55 | 91.2 | 3.30E−24 |
| 542 | PHE0010099__21319.pep | Molybdopterin | 58 | 475 | 479.9 | 3.00E−141 |
| 542 | PHE0010099__21319.pep | Molydop_binding | 570 | 681 | 140 | 6.60E−39 |
| 542 | PHE0010099__21319.pep | Fer2_BFD | 811 | 863 | 74.8 | 2.70E−19 |
| 543 | PHE0011269__23400.pep | Homeobox | 21 | 78 | 70.4 | 5.80E−18 |

TABLE 10-continued

Pfam annotation

| PEP SEQ ID NO | Gene ID | Pfam domain name | Begin | Stop | Score | E-value |
|---|---|---|---|---|---|---|
| 543 | PHE0011269__23400.pep | START | 215 | 437 | 167.3 | 3.90E−47 |
| 546 | PHE0011613__23858.pep | AP2 | 62 | 136 | 129.6 | 8.70E−36 |
| 546 | PHE0011613__23858.pep | AP2 | 165 | 230 | 109.9 | 7.50E−30 |
| 547 | PHE0001582__22064.pep | GAF | 195 | 344 | 57.2 | 5.30E−14 |
| 547 | PHE0001582__22064.pep | HisKA | 380 | 445 | 22.2 | 0.00068 |
| 547 | PHE0001582__22064.pep | Response_reg | 645 | 761 | 69.4 | 1.20E−17 |
| 548 | PHE0007444__22314.pep | Spermine_synth | 90 | 349 | 414.5 | 1.50E−121 |
| 549 | PHE0010543__22298.pep | PBP | 19 | 165 | 216.7 | 5.30E−62 |
| 550 | PHE0010543__22323.pep | PBP | 19 | 157 | 186 | 9.30E−53 |
| 551 | PHE0011081__23033.pep | Sugar_tr | 33 | 465 | −7.2 | 1.20E−06 |
| 552 | PHE0011075__23026.pep | P-II | 73 | 175 | 181.5 | 2.10E−51 |
| 553 | PHE0010100__21462.pep | Pyr_redox_2 | 5 | 285 | 134.4 | 3.10E−37 |
| 553 | PHE0010100__21462.pep | Pyr_redox | 147 | 240 | 91 | 3.50E−24 |
| 553 | PHE0010100__21462.pep | Fer2_BFD | 420 | 472 | 81.5 | 2.60E−21 |
| 553 | PHE0010100__21462.pep | NIR_SIR_ferr | 554 | 621 | 89.9 | 7.80E−24 |
| 553 | PHE0010100__21462.pep | NIR_SIR | 629 | 775 | 176.5 | 6.70E−50 |
| 554 | PHE0009640__21775.pep | Auxin_inducible | 1 | 102 | 151.5 | 2.10E−42 |
| 555 | PHE0010092__21307.pep | S1 | 13 | 88 | 51.4 | 3.00E−12 |
| 555 | PHE0010092__21307.pep | EIF_2_alpha | 125 | 256 | 217.3 | 3.50E−62 |
| 556 | PHE0004611__24123.pep | PTR2 | 13 | 406 | 283.1 | 5.40E−82 |
| 557 | PHE0010093__21308.pep | S1 | 13 | 88 | 50 | 8.10E−12 |
| 557 | PHE0010093__21308.pep | EIF_2_alpha | 125 | 256 | 217.3 | 3.50E−62 |
| 558 | PHE0008605__23084.pep | Histone | 58 | 128 | 105.5 | 1.60E−28 |
| 559 | PHE0009939__21100.pep | GDC-P | 81 | 508 | 1024.4 | 0 |
| 560 | PHE0009941__21105.pep | mTERF | 2 | 262 | 117.5 | 3.70E−32 |
| 561 | PHE0009951__21135.pep | Ribosomal_L10e | 1 | 176 | 487.9 | 1.20E−143 |
| 562 | PHE0009943__21127.pep | Ribosomal_L10e | 1 | 176 | 460.5 | 2.20E−135 |
| 563 | PHE0009948__21132.pep | Ribosomal_L10e | 1 | 176 | 476.4 | 3.40E−140 |
| 564 | PHE0011084__23040.pep | Peptidase_S10 | 54 | 482 | 561 | 1.20E−165 |
| 565 | PHE0008233__23042.pep | Phi_1 | 40 | 314 | 616.9 | 1.80E−182 |
| 566 | PHE0010854__22730.pep | RGS | 294 | 412 | 23.2 | 2.80E−06 |
| 567 | PHE0003797__23051.pep | zf-Dof | 34 | 96 | 127 | 5.20E−35 |
| 568 | PHE0010194__21769.pep | Glyco_hydro_9 | 52 | 509 | 1007.2 | 5.70E−300 |
| 570 | PHE0011665__23899.pep | Chloroa_b-bind | 63 | 260 | 255.3 | 1.20E−73 |
| 571 | PHE0012178__24443.pep | Whirly | 53 | 191 | 263.2 | 5.30E−76 |
| 573 | PHE0011064__22994.pep | TPR_1 | 73 | 106 | 33.7 | 6.50E−07 |
| 573 | PHE0011064__22994.pep | TPR_2 | 73 | 106 | 33.4 | 7.80E−07 |
| 577 | PHE0011446__23659.pep | Histone | 58 | 132 | 142.9 | 8.50E−40 |
| 578 | PHE0001424__22077.pep | Agglutinin | 55 | 193 | 46.9 | 6.30E−12 |
| 579 | PHE0011445__23658.pep | C2 | 6 | 87 | 74.9 | 2.50E−19 |
| 580 | PHE0010090__21297.pep | LRRNT_2 | 33 | 73 | 34.2 | 4.60E−07 |
| 580 | PHE0010090__21297.pep | LRR_1 | 78 | 101 | 11.5 | 2 |
| 580 | PHE0010090__21297.pep | LRR_1 | 103 | 127 | 11.2 | 2.3 |
| 580 | PHE0010090__21297.pep | LRR_1 | 129 | 151 | 21.9 | 0.0024 |
| 580 | PHE0010090__21297.pep | LRR_1 | 177 | 199 | 16 | 0.14 |
| 580 | PHE0010090__21297.pep | LRR_1 | 226 | 248 | 10.3 | 3.3 |
| 580 | PHE0010090__21297.pep | LRR_1 | 274 | 296 | 18.9 | 0.018 |
| 580 | PHE0010090__21297.pep | LRR_1 | 298 | 320 | 12.1 | 1.6 |
| 580 | PHE0010090__21297.pep | LRR_1 | 322 | 341 | 11.2 | 2.3 |
| 580 | PHE0010090__21297.pep | LRR_1 | 395 | 417 | 9.8 | 4.1 |
| 580 | PHE0010090__21297.pep | LRR_1 | 444 | 466 | 8.2 | 8.3 |
| 580 | PHE0010090__21297.pep | LRR_1 | 468 | 490 | 12.8 | 1.1 |
| 580 | PHE0010090__21297.pep | LRR_1 | 492 | 514 | 7.7 | 10 |
| 580 | PHE0010090__21297.pep | LRR_1 | 516 | 538 | 15.7 | 0.17 |
| 580 | PHE0010090__21297.pep | LRR_1 | 540 | 562 | 7.8 | 10 |
| 580 | PHE0010090__21297.pep | LRR_1 | 564 | 585 | 8.5 | 7.4 |
| 580 | PHE0010090__21297.pep | Pkinase | 678 | 952 | 107.9 | 3.00E−29 |
| 580 | PHE0010090__21297.pep | Pkinase_Tyr | 678 | 952 | 110.4 | 5.10E−30 |
| 581 | PHE0012180__24445.pep | B3 | 516 | 619 | 90.3 | 6.00E−24 |
| 582 | PHE0011083__23039.pep | adh_short | 44 | 200 | 46.7 | 7.60E−11 |
| 583 | PHE0011085__23041.pep | Peptidase_S10 | 31 | 459 | 551.6 | 8.20E−163 |
| 584 | PHE0012175__24440.pep | CXC | 457 | 498 | 80.2 | 6.60E−21 |
| 584 | PHE0012175__24440.pep | CXC | 543 | 584 | 83.5 | 6.40E−22 |
| 585 | PHE0012177__24442.pep | Whirly | 91 | 229 | 325.2 | 1.10E−94 |
| 587 | PHE0010194__21426.pep | Glyco_hydro_9 | 52 | 509 | 1013.8 | 5.70E−302 |
| 588 | PHE0011666__23900.pep | Spermine_synth | 46 | 291 | 503.1 | 3.20E−148 |
| 589 | PHE0011448__24160.pep | Histone | 25 | 90 | 35.4 | 1.90E−07 |
| 590 | PHE0008324__18636.pep | DUF1005 | 256 | 460 | 524.8 | 9.30E−155 |
| 591 | PHE0006971__16875.pep | Myb_DNA-binding | 14 | 61 | 44.2 | 4.40E−10 |
| 591 | PHE0006971__16875.pep | Myb_DNA-binding | 67 | 112 | 51.3 | 3.20E−12 |
| 592 | PHE0009939__21147.pep | GDC-P | 81 | 508 | 1024.4 | 0 |
| 593 | PHE0009953__21137.pep | Na_sulph_symp | 110 | 578 | 831.2 | 5.40E−247 |
| 595 | PHE0008557__18970.pep | NAD_binding_1 | 234 | 350 | 138.6 | 1.60E−38 |
| 596 | PHE0006443__15955.pep | YDG_SRA | 360 | 519 | 403.5 | 3.00E−118 |

TABLE 10-continued

Pfam annotation

| PEP SEQ ID NO | Gene ID | Pfam domain name | Begin | Stop | Score | E-value |
|---|---|---|---|---|---|---|
| 596 | PHE0006443__15955.pep | Pre-SET | 543 | 639 | 156.7 | 6.00E−44 |
| 596 | PHE0006443__15955.pep | SET | 641 | 771 | 181.7 | 1.80E−51 |

TABLE 11 pfam module annotation

| PEP SEQ ID NO | Gene ID | Pfam domain module | Position |
|---|---|---|---|
| 299 | PHE0007721__18998.pep | KNOX1::KNOX2::ELK | 102-146::153-204::242-263 |
| 300 | PHE0007756__18009.pep | RPE65 | 105-591 |
| 302 | PHE0004988__15925.pep | F-box::LRR_1::LRR_2 | 4-52::157-179::290-314 |
| 303 | PHE0007140__21771.pep | MtN3_slv::MtN3_slv | 9-98::134-221 |
| 304 | PHE0006823__16403.pep | Globin | 10-149 |
| 305 | PHE0007440__22555.pep | Ras | 14-175 |
| 306 | PHE0000206__22432.pep | Pkinase::efhand::efhand::efhand | 79-337::384-412::456-484::490-518 |
| 307 | PHE0000598__16824.pep | HLH | 385-434 |
| 308 | PHE0007590__17883.pep | S1 | 2-70 |
| 309 | PHE0007588__17881.pep | S1 | 2-86 |
| 310 | PHE0007592__17885.pep | S1 | 1-75 |
| 311 | PHE0007587__17880.pep | S1 | 3-75 |
| 312 | PHE0007624__17923.pep | eIF-1a | 5-70 |
| 313 | PHE0007591__17884.pep | S1 | 2-68 |
| 314 | PHE0007623__17922.pep | CN_hydrolase | 11-184 |
| 315 | PHE0007583__17871.pep | MtN3_slv::MtN3_slv | 9-98::132-218 |
| 316 | PHE0006618__16146.pep | S10_plectin | 3-98 |
| 317 | PHE0006791__16374.pep | GUN4 | 84-227 |
| 318 | PHE0007620__17918.pep | peroxidase | 89-321 |
| 319 | PHE0006659__16195.pep | MFS_1 | 10-391 |
| 321 | PHE0006274__15867.pep | E2F_TDP | 130-195 |
| 322 | PHE0006637__16166.pep | PP2C | 7-305 |
| 323 | PHE0006926__16815.pep | VPS28 | 18-209 |
| 324 | PHE0006821__16402.pep | PALP | 49-358 |
| 325 | PHE0007687__18057.pep | p450 | 35-462 |
| 326 | PHE0007642__17999.pep | PAS_3::PAS_3::Pkinase | 211-303::489-581::663-952 |
| 327 | PHE0007677__18052.pep | FAD_binding_3 | 5-372 |
| 328 | PHE0007644__18001.pep | LRRNT_2::LRR_1::LRR_1::LRR_1::LRR_1::LRR_1::Pkinase | 23-64::97-119::121-143::145-167::169-192::194-216::414-716 |
| 329 | PHE0007640__17992.pep | CorA | 66-448 |
| 330 | PHE0007678__18053.pep | 4HBT | 66-151 |
| 331 | PHE0007649__18006.pep | Ank::Pkinase | 108-140::196-455 |
| 332 | PHE0006726__16298.pep | WD40::WD40 | 45-83::135-173 |
| 333 | PHE0006218__8776.pep | Pyr_redox_2::Thioredoxin | 85-370::423-528 |
| 335 | PHE0002554__17876.pep | Chloroa_b-bind | 63-261 |
| 336 | PHE0006807__16388.pep | CCT | 352-390 |
| 337 | PHE0003359__8487.pep | p450 | 51-489 |
| 338 | PHE0006542__15765.pep | PMSR | 92-245 |
| 339 | PHE0007622__17921.pep | Spermine_synth | 34-279 |
| 340 | PHE0007630__17956.pep | 2OG-FeII_Oxy | 190-291 |
| 341 | PHE0007593__17886.pep | Spermine_synth | 28-273 |
| 342 | PHE0006475__15588.pep | PsbQ | 3-162 |
| 343 | PHE0007619__17915.pep | MBD | 11-84 |
| 344 | PHE0006846__16447.pep | Sterol_desat | 1-186 |
| 345 | PHE0007584__17874.pep | MBD | 4-77 |
| 346 | PHE0003695__17913.pep | LRRNT_2::LRR_1::LRR_1::LRR_1::LRR_1::LRR_1::LRR_1::LRR_1::LRR_1::LRR_1::LRR_1::LRR_1::LRR_1::LRR_1::LRR_1::LRR_1::LRR_1::LRR_1::Pkinase | 23-64::93-115::117-139::141-163::165-186::189-211::213-235::237-259::260-281::284-306::308-330::332-354::356-378::380-402::404-426::428-450::452-474::476-498::500-521::523-542::648-917 |
| 347 | PHE0003695__17879.pep | LRRNT_2::LRR_1::LRR_1::LRR_1::LRR_1::LRR_1::LRR_1::LRR_1::LRR_1::LRR_1::LRR_1::LRR_1::LRR_1::LRR_1::LRR_1::LRR_1::LRR_1::LRR_1::Pkinase | 23-64::93-115::117-139::141-163::165-186::189-211::213-235::237-259::260-281::284-306::308-330::332-354::356-378::380-402::404-426::428-450::452-474::476-498::500-521::523-542::648-917 |

TABLE 11-continued pfam module annotation

| PEP SEQ ID NO | Gene ID | Pfam domain module | Position |
|---|---|---|---|
| 349 | PHE0007645__18002.pep | AP2 | 115-180 |
| 350 | PHE0006784__16366.pep | PALP | 12-301 |
| 351 | PHE0006171__16491.pep | Glyoxalase | 70-214 |
| 353 | PHE0006906__16796.pep | Proteasome | 10-206 |
| 354 | PHE0006649__16180.pep | AP2 | 46-110 |
| 355 | PHE0006809__16390.pep | Prismane | 1-548 |
| 356 | PHE0006918__16808.pep | SWIM | 321-353 |
| 357 | PHE0007813__18219.pep | MtN3_slv::MtN3_slv | 9-98::132-218 |
| 359 | PHE0006825__16405.pep | Cytochrom_C552 | 27-476 |
| 360 | PHE0006964__16864.pep | tRNA_anti::tRNA-synt_2 | 43-122::140-557 |
| 361 | PHE0008105__18407.pep | CBFD_NFYB_HMF | 158-222 |
| 362 | PHE0006630__16159.pep | Ldh_1_N::Ldh_1_C | 90-239::241-413 |
| 363 | PHE0006966__16868.pep | DNA_photolyase::FAD_binding_7 | 12-183::214-492 |
| 365 | PHE0006608__16123.pep | GSHPx | 42-150 |
| 366 | PHE0010462__21459.pep | NUDIX::NUDIX | 17-159::190-322 |
| 367 | PHE0009211__21774.pep | Auxin_inducible | 1-106 |
| 368 | PHE0006256__8775.pep | RPE65 | 105-591 |
| 369 | PHE0006989__16918.pep | Pkinase | 88-396 |
| 370 | PHE0007649__18166.pep | Ank::Pkinase | 108-140::196-455 |
| 371 | PHE0006708__16264.pep | DEAD::Helicase_C | 57-223::291-367 |
| 372 | PHE0001117__19094.pep | Homeobox::HALZ | 79-133::134-178 |
| 373 | PHE0006266__8814.pep | Fe_bilin_red | 16-244 |
| 374 | PHE0006795__16378.pep | Na_H_antiport_1 | 4-380 |
| 375 | PHE0006956__16853.pep | Molybdop_Fe4S4::Molybdopterin::Molydop_binding::Fer2_BFD | 2-56::59-482::578-689::825-877 |
| 377 | PHE0006824__16404.pep | Globin | 14-154 |
| 378 | PHE0006812__16393.pep | Bac_globin | 3-118 |
| 379 | PHE0006815__16396.pep | Bac_globin | 26-146 |
| 380 | PHE0006806__16387.pep | Bac_globin | 26-146 |
| 381 | PHE0006624__16153.pep | NAD_binding_2::6PGD | 3-178::182-473 |
| 382 | PHE0005006__15823.pep | Chloroa_b-bind | 63-242 |
| 384 | PHE0006683__16229.pep | Response_reg | 10-151 |
| 385 | PHE0006884__16703.pep | Glyco_transf_5::Glycos_transf_1 | 83-344::384-567 |
| 386 | PHE0006691__16237.pep | NAD_Gly3P_dh_N::NAD_Gly3P_dh_C | 6-165::183-327 |
| 387 | PHE0006790__16372.pep | Rieske::PaO | 220-317::408-507 |
| 388 | PHE0009143__19932.pep | Histone_HNS | 21-129 |
| 389 | PHE0008406__18830.pep | AA_permease | 57-511 |
| 390 | PHE0008279__18708.pep | Mit_rib_S27 | 14-93 |
| 391 | PHE0009142__19931.pep | Histone_HNS | 21-130 |
| 393 | PHE0007639__17991.pep | ELFV_dehydrog_N::ELFV_dehydrog | 84-214::229-474 |
| 394 | PHE0007646__18170.pep | F-box::Kelch_1::Kelch_1 | 36-83::131-185::187-233 |
| 395 | PHE0007765__18182.pep | GST_N::GST_C | 5-79::101-204 |
| 396 | PHE0008167__18465.pep | Pkinase_Tyr | 8-262 |
| 398 | PHE0008183__18479.pep | LRRNT_2::LRR_1::LRR_1::LRR_1::LRR_1::LRR_1::LRR_1::LRR_1::LRR_1::LRR_1::LRR_1::LRR_1::LRR_1::LRR_1::LRR_1::LRR_1::LRR_1::LRR_1::LRR_1::LRR_1::Pkinase_Tyr | 23-66::71-93::95-117::119-142::144-166::168-190::192-214::289-311::313-335::337-359::361-384::409-431::457-479::481-503::505-527::529-551::553-575::577-598::695-966 |
| 399 | PHE0007585__17875.pep | LEA_3 | 35827 |
| 400 | PHE0006804__16385.pep | zf-CCCH::zf-CCCH | 13-39::149-174 |
| 401 | PHE0006703__15751.pep | PFK | 72-347 |
| 402 | PHE0007410__17653.pep | Acyltransferase | 27-249 |
| 403 | PHE0006854__16456.pep | YABBY | 40-278 |
| 404 | PHE0007721__21293.pep | KNOX1::KNOX2::ELK | 102-146::153-204::242-263 |
| 405 | PHE0006563__15990.pep | GATase_2::Asn_synthase | 2-161::209-450 |
| 406 | PHE0006619__16147.pep | AA_kinase | 15-261 |
| 407 | PHE0006813__16394.pep | Bac_globin | 7-124 |
| 408 | PHE0006688__16234.pep | Ribosomal_S2 | 13-229 |
| 409 | PHE0006635__16164.pep | MGS | 28-121 |
| 411 | PHE0008416__18838.pep | PTR2 | 115-504 |
| 413 | PHE0008599__19166.pep | Isoamylase_N::Alpha-amylase | 24-115::164-578 |
| 414 | PHE0008375__18732.pep | Pribosyltran | 93-237 |
| 416 | PHE0008394__18763.pep | Gln-synt_N::Gln-synt_C | 68-148::154-406 |
| 417 | PHE0008395__18764.pep | Gln-synt_N::Gln-synt_C | 68-148::154-406 |
| 418 | PHE0008444__18846.pep | Gln-synt_N::Gln-synt_C | 17-97::103-355 |

TABLE 11-continued pfam module annotation

| PEP SEQ ID NO | Gene ID | Pfam domain module | Position |
|---|---|---|---|
| 419 | PHE0006819__16400.pep | Lactamase_B::Flavodoxin_1::Flavin_Reduct | 47-236::267-397::424-573 |
| 420 | PHE0007417__17663.pep | EIN3 | 60-467 |
| 421 | PHE0008443__18845.pep | GATase_2::Asn_synthase | 2-161::209-450 |
| 422 | PHE0006818__16399.pep | Lactamase_B::Flavodoxin_1::Rubredoxin | 34-227::256-389::423-471 |
| 423 | PHE0006579__16031.pep | Thi4 | 63-306 |
| 424 | PHE0006808__16389.pep | CCT | 354-392 |
| 425 | PHE0008160__18460.pep | TPP_enzyme_N::TPP_enzyme_M::TPP_enzyme_C | 45-221::243-376::431-578 |
| 426 | PHE0007571__17834.pep | GSH_synth_ATP | 29-499 |
| 427 | PHE0007586__17877.pep | Chloroa_b-bind | 64-261 |
| 429 | PHE0009729__21717.pep | Homeobox::HALZ | 67-123::124-168 |
| 430 | PHE0006424__15520.pep | PsbW_2 | 1-133 |
| 431 | PHE0006392__15480.pep | PsbP | 106-322 |
| 432 | PHE0006589__16093.pep | Thioredoxin | 64-167 |
| 433 | PHE0009258__21487.pep | Na_H_Exchanger | 22-441 |
| 434 | PHE0006680__16226.pep | 2OG-FeII_Oxy | 187-287 |
| 435 | PHE0006481__16072.pep | adh_short | 33-181 |
| 436 | PHE0006269__8820.pep | TPR_2::TPR_1::TPR_2::TPR_1::TPR_4::TPR_2::TPR_1 | 74-107::108-141::142-175::179-212::247-272::281-314::349-382 |
| 437 | PHE0006783__16365.pep | Aa_trans | 32-469 |
| 438 | PHE0003151__18392.pep | AP2::AP2 | 318-391::420-485 |
| 439 | PHE0008272__18723.pep | HSF_DNA-bind | 18-188 |
| 440 | PHE0008277__18706.pep | SNF5 | 172-400 |
| 441 | PHE0008109__18411.pep | Sad1_UNC | 203-330 |
| 442 | PHE0008280__18826.pep | Alpha-amylase | 14-452 |
| 443 | PHE0002424__15825.pep | adh_short | 43-215 |
| 444 | PHE0006914__16804.pep | AAA | 204-391 |
| 445 | PHE0006642__16172.pep | p450 | 42-496 |
| 447 | PHE0009926__21079.pep | DSPc | 24-152 |
| 448 | PHE0006206__19159.pep | Sina | 106-305 |
| 449 | PHE0008274__18705.pep | BURP | 56-280 |
| 450 | PHE0009510__20526.pep | Spermine_synth | 38-283 |
| 451 | PHE0009937__21097.pep | Spermine_synth | 38-283 |
| 452 | PHE0009927__21080.pep | DSPc | 24-162 |
| 454 | PHE0006445__15956.pep | Allene_ox_cyc | 74-253 |
| 455 | PHE0006987__16893.pep | efhand::efhand | 86-114::167-195 |
| 456 | PHE0004230__15865.pep | E2F_TDP | 146-211 |
| 457 | PHE0006814__16395.pep | Bac_globin | 26-144 |
| 458 | PHE0002773__15881.pep | NTP_transferase | 88-366 |
| 459 | PHE0006060__15842.pep | ubiquitin::ubiquitin::ubiquitin::ubiquitin | 5-73::81-149::157-225::233-301 |
| 460 | PHE0006850__16451.pep | YABBY | 6-166 |
| 461 | PHE0008043__18199.pep | Homeobox::START::MEKHLA | 25-85::164-374::693-840 |
| 462 | PHE0000125__18852.pep | Response_reg::CCT | 28-153::457-495 |
| 463 | PHE0008269__18720.pep | Pkinase | 23-279 |
| 464 | PHE0008264__18712.pep | zf-UBR | 40-109 |
| 465 | PHE0002782__20059.pep | PGI | 2-457 |
| 466 | PHE0009438__20404.pep | GATA | 191-226 |
| 467 | PHE0009429__20392.pep | ParBc | 70-151 |
| 468 | PHE0009440__20406.pep | ParBc | 11-126 |
| 469 | PHE0008543__18945.pep | TP_methylase | 222-435 |
| 470 | PHE0006960__16857.pep | Oxidored_molyb::Mo-co_dimer::Cyt-b5::FAD_binding_6::NAD_binding_1 | 116-301::326-459::515-588::633-740::759-872 |
| 471 | PHE0009427__20389.pep | IGPD | 103-247 |
| 472 | PHE0006437__15906.pep | Pkinase | 39-307 |
| 473 | PHE0007409__17652.pep | DAGAT | 64-340 |
| 474 | PHE0009426__20387.pep | PHP | 2-281 |
| 475 | PHE0009430__20393.pep | ParBc | 44-128 |
| 476 | PHE0007003__16906.pep | PTPA | 96-396 |
| 477 | PHE0008378__18741.pep | bZIP_1 | 223-280 |
| 478 | PHE0008273__18725.pep | zf-CCCH | 80-106 |
| 479 | PHE0008547__18953.pep | Fer2 | 20-95 |
| 480 | PHE0006922__16812.pep | Hexokinase_1::Hexokinase_2 | 44-251::258-501 |
| 481 | PHE0006920__16810.pep | AAA::Vps4_C | 267-458::464-514 |
| 482 | PHE0008396__18765.pep | Gln-synt_N::Gln-synt_C | 68-148::154-406 |
| 483 | PHE0006957__16854.pep | Gln-synt_N::Gln-synt_C | 68-148::154-406 |
| 484 | PHE0006404__15936.pep | RRM_1::RRM_1 | 8-77::112-182 |

TABLE 11-continued

| | | pfam module annotation | |
|---|---|---|---|
| PEP SEQ ID NO | Gene ID | Pfam domain module | Position |
| 485 | PHE0006820__16401.pep | Lactamase_B::Flavin_Reduct | 47-236::423-572 |
| 486 | PHE0006690__16236.pep | MFS_1 | 57-421 |
| 487 | PHE0006395__15932.pep | LRR_1::LRR_1::LRR_1::LRR_1::LRR_1::LRR_1::LRR_1 | 185-206::208-229::231-252::254-272::278-299::349-370::372-394 |
| 488 | PHE0006759__16384.pep | SHMT | 55-453 |
| 489 | PHE0006576__16028.pep | Myb_DNA-binding::Myb_DNA-binding | 11-57::63-108 |
| 490 | PHE0006979__16885.pep | Tryp_alpha_amyl | 33-111 |
| 491 | PHE0009786__21754.pep | HLH | 33-80 |
| 492 | PHE0006572__16007.pep | Pkinase | 11-269 |
| 494 | PHE0006588__16092.pep | Thioredoxin | 56-161 |
| 495 | PHE0006985__16891.pep | DUF1716 | 13-118 |
| 496 | PHE0006875__16688.pep | PSI_PSAK | 44-138 |
| 497 | PHE0006626__16155.pep | Glyco_hydro_17 | 30-335 |
| 498 | PHE0006689__16235.pep | Aa_trans | 165-548 |
| 499 | PHE0006799__16382.pep | B12-binding::Radical_SAM | 10-135::202-368 |
| 500 | PHE0006959__16856.pep | Oxidored_molyb::Mo-co_dimer::Cyt-b5::FAD_binding_6::NAD_binding_1 | 143-328::353-486::543-616::660-767::786-899 |
| 501 | PHE0011615__23861.pep | Pkinase | 267-523 |
| 502 | PHE0006925__16814.pep | Tim17 | 4-133 |
| 503 | PHE0006713__16274.pep | APC8::TPR_1::TPR_1::TPR_1 | 1-161::339-372::373-406::407-440 |
| 504 | PHE0008447__18848.pep | Lir1 | 1-126 |
| 505 | PHE0006674__16221.pep | PTR2 | 96-505 |
| 506 | PHE0010613__22398.pep | DAGK_cat | 43-184 |
| 507 | PHE0002720__22558.pep | DnaJ::DnaJ_CXXCXGXG::DnaJ_C | 90-151::218-301::314-436 |
| 508 | PHE0011760__24005.pep | Pkinase | 400-656 |
| 509 | PHE0010612__22397.pep | G-patch | 15-59 |
| 511 | PHE0007411__17654.pep | Acyltransferase | 136-283 |
| 512 | PHE0010617__22402.pep | Isochorismatase | 27-210 |
| 513 | PHE0010610__22395.pep | zf-C3HC4 | 103-144 |
| 514 | PHE0006883__16702.pep | Glyco_transf_5::Glycos_transf_1 | 78-339::379-562 |
| 515 | PHE0010636__22408.pep | DUF6::TPT | 105-230::239-384 |
| 516 | PHE0011082__23038.pep | adh_short | 19-187 |
| 517 | PHE0009475__20462.pep | 2OG-FeII_Oxy | 223-322 |
| 518 | PHE0007415__17661.pep | EIN3 | 60-467 |
| 519 | PHE0006614__16129.pep | Cellulase | 19-358 |
| 520 | PHE0010611__22396.pep | FMO-like | 25-424 |
| 521 | PHE0011719__23946.pep | Acyltransferase | 69-222 |
| 522 | PHE0006861__16463.pep | NPH3 | 166-409 |
| 523 | PHE0006568__16005.pep | DUF26::DUF26::Pkinase | 80-134::199-253::346-615 |
| 524 | PHE0010652__22429.pep | FtsJ | 21-211 |
| 525 | PHE0008158__18448.pep | PLATZ | 22-144 |
| 526 | PHE0003316__20755.pep | Glyco_hydro_2_N::Glyco_hydro_2::Glyco_hydro_2_C | 9-180::182-272::274-593 |
| 527 | PHE0009478__20470.pep | 2OG-FeII_Oxy | 229-328 |
| 528 | PHE0010395__21760.pep | DUF716 | 109-266 |
| 529 | PHE0010391__21753.pep | DUF640 | 28-160 |
| 530 | PHE0010396__21761.pep | DUF716 | 109-265 |
| 531 | PHE0009511__22422.pep | SAM_decarbox | 5-337 |
| 532 | PHE0010614__22399.pep | SOUL | 28-211 |
| 534 | PHE0011454__23667.pep | Histone | 56-126 |
| 535 | PHE0011443__24001.pep | Histone | 61-131 |
| 536 | PHE0011452__23665.pep | Histone | 58-132 |
| 537 | PHE0010394__21758.pep | SAP18 | 29-150 |
| 540 | PHE0010100__21467.pep | Pyr_redox_2::Fer2_BFD::NIR_SIR_ferr::NIR_SIR | 5-285::420-472::554-621::629-775 |
| 541 | PHE0011503__23734.pep | GAF::HisKA::HATPase_c | 158-307::343-408::455-586 |
| 542 | PHE0010099__21319.pep | Molybdop_Fe4S4::Molybdopterin::Molydop_binding::Fer2_BFD | 1-55::58-475::570-681::811-863 |
| 543 | PHE0011269__23400.pep | Homeobox::START | 21-78::215-437 |
| 546 | PHE0011613__23858.pep | AP2::AP2 | 62-136::165-230 |
| 547 | PHE0001582__22064.pep | GAF::HisKA::Response_reg | 195-344::380-445::645-761 |
| 548 | PHE0007444__22314.pep | Spermine_synth | 90-349 |
| 549 | PHE0010543__22298.pep | PBP | 19-165 |
| 550 | PHE0010543__22323.pep | PBP | 19-157 |

TABLE 11-continued pfam module annotation

| PEP SEQ ID NO | Gene ID | Pfam domain module | Position |
|---|---|---|---|
| 551 | PHE0011081__23033.pep | Sugar_tr | 33-465 |
| 552 | PHE0011075__23026.pep | P-II | 73-175 |
| 553 | PHE0010100__21462.pep | Pyr_redox_2::Fer2_BFD::NIR_SIR_ferr::NIR_SIR | 5-285::420-472::554-621::629-775 |
| 554 | PHE0009640__21775.pep | Auxin_inducible | 1-102 |
| 555 | PHE0010092__21307.pep | S1::EIF_2_alpha | 13-88::125-256 |
| 556 | PHE0004611__24123.pep | PTR2 | 13-406 |
| 557 | PHE0010093__21308.pep | S1::EIF_2_alpha | 13-88::125-256 |
| 558 | PHE0008605__23084.pep | Histone | 58-128 |
| 559 | PHE0009939__21100.pep | GDC-P | 81-508 |
| 560 | PHE0009941__21105.pep | mTERF | 2-262 |
| 561 | PHE0009951__21135.pep | Ribosomal_L10e | 1-176 |
| 562 | PHE0009943__21127.pep | Ribosomal_L10e | 1-176 |
| 563 | PHE0009948__21132.pep | Ribosomal_L10e | 1-176 |
| 564 | PHE0011084__23040.pep | Peptidase_S10 | 54-482 |
| 565 | PHE0008233__23042.pep | Phi_1 | 40-314 |
| 566 | PHE0010854__22730.pep | RGS | 294-412 |
| 567 | PHE0003797__23051.pep | zf-Dof | 34-96 |
| 568 | PHE0010194__21769.pep | Glyco_hydro_9 | 52-509 |
| 570 | PHE0011665__23899.pep | Chloroa_b-bind | 63-260 |
| 571 | PHE0012178__24443.pep | Whirly | 53-191 |
| 573 | PHE0011064__22994.pep | TPR_1 | 73-106 |
| 577 | PHE0011446__23659.pep | Histone | 58-132 |
| 578 | PHE0001424__22077.pep | Agglutinin | 55-193 |
| 579 | PHE0011445__23658.pep | C2 | 6-87 |
| 580 | PHE0010090__21297.pep | LRRNT_2::LRR_1::LRR_1::LRR_1::LRR_1::LRR_1::LRR_1::LRR_1::LRR_1::LRR_1::LRR_1::LRR_1::LRR_1::LRR_1::LRR_1::LRR_1::LRR_1::LRR_1::LRR_1::Pkinase_Tyr | 33-73::78-101::103-127::129-151::177-199::226-248::274-296::298-320::322-341::395-417::444-466::468-490::492-514::516-538::540-562::564-585::678-952 |
| 581 | PHE0012180__24445.pep | B3 | 516-619 |
| 582 | PHE0011083__23039.pep | adh_short | 44-200 |
| 583 | PHE0011085__23041.pep | Peptidase_S10 | 31-459 |
| 584 | PHE0012175__24440.pep | CXC::CXC | 457-498::543-584 |
| 585 | PHE0012177__24442.pep | Whirly | 91-229 |
| 587 | PHE0010194__21426.pep | Glyco_hydro_9 | 52-509 |
| 588 | PHE0011666__23900.pep | Spermine_synth | 46-291 |
| 589 | PHE0011448__24160.pep | Histone | 25-90 |
| 590 | PHE0008324__18636.pep | DUF1005 | 256-460 |
| 591 | PHE0006971__16875.pep | Myb_DNA-binding::Myb_DNA-binding | 14-61::67-112 |
| 592 | PHE0009939__21147.pep | GDC-P | 81-508 |
| 593 | PHE0009953__21137.pep | Na_sulph_symp | 110-578 |
| 595 | PHE0008557__18970.pep | NAD_binding_1 | 234-350 |
| 596 | PHE0006443__15955.pep | YDG_SRA::Pre-SET::SET | 360-519::543-639::641-771 |

TABLE 12

Description of pfam domains

| Pfam domain name | Accession number | Gathering cutoff | Domain description |
|---|---|---|---|
| 2OG-FeII_Oxy | PF03171.10 | 11.5 | 2OG-Fe(II) oxygenase superfamily |
| 4HBT | PF03061.12 | 20.6 | Thioesterase superfamily |
| 6PGD | PF00393.9 | −232.3 | 6-phosphogluconate dehydrogenase, C-terminal domain |
| AAA | PF00004.19 | 12.3 | ATPase family associated with various cellular activities (AAA) |
| AA_kinase | PF00696.18 | −40 | Amino acid kinase family |
| AA_permease | PF00324.11 | −120.8 | Amino acid permease |
| AP2 | PF00847.10 | 0 | AP2 domain |
| APC8 | PF04049.4 | −19.8 | Anaphase promoting complex subunit 8/Cdc23 |
| Aa_trans | PF01490.8 | −128.4 | Transmembrane amino acid transporter protein |
| Acyltransferase | PF01553.11 | −0.4 | Acyltransferase |
| Agglutinin | PF07468.2 | 25 | Agglutinin |
| Allene_ox_cyc | PF06351.2 | 25 | Allene oxide cyclase |
| Alpha-amylase | PF00128.14 | −92.6 | Alpha amylase, catalytic domain |

TABLE 12-continued

Description of pfam domains

| Pfam domain name | Accession number | Gathering cutoff | Domain description |
|---|---|---|---|
| Ank | PF00023.20 | 0 | Ankyrin repeat |
| ApbA | PF02558.6 | −16.2 | Ketopantoate reductase PanE/ApbA |
| Asn_synthase | PF00733.11 | −52.8 | Asparagine synthase |
| Auxin_inducible | PF02519.5 | −15 | Auxin responsive protein |
| B12-binding | PF02310.9 | 19.6 | B12 binding domain |
| B3 | PF02362.12 | 26.5 | B3 DNA binding domain |
| BURP | PF03181.6 | −52 | BURP domain |
| Bac_globin | PF01152.11 | −12.7 | Bacterial-like globin |
| C2 | PF00168.20 | 3.7 | C2 domain |
| CBFD_NFYB_HMF | PF00808.13 | 18.4 | Histone-like transcription factor (CBF/NF-Y) and archaeal histone |
| CCT | PF06203.4 | 25 | CCT motif |
| CN_hydrolase | PF00795.12 | −13.9 | Carbon-nitrogen hydrolase |
| CXC | PF03638.5 | 25 | Tesmin/TSO1-like CXC domain |
| Cellulase | PF00150.8 | −49.3 | Cellulase (glycosyl hydrolase family 5) |
| Chloroa_b-bind | PF00504.12 | −31.9 | Chlorophyll A-B binding protein |
| CorA | PF01544.9 | −61.3 | CorA-like Mg2+ transporter protein |
| Cyt-b5 | PF00173.18 | 4 | Cytochrome b5-like Heme/Steroid binding domain |
| Cytochrom_C552 | PF02335.6 | −166 | Cytochrome c552 |
| DAGAT | PF03982.3 | −151.7 | Diacylglycerol acyltransferase |
| DAGK_cat | PF00781.14 | −5.7 | Diacylglycerol kinase catalytic domain (presumed) |
| DAO | PF01266.14 | −35 | FAD dependent oxidoreductase |
| DEAD | PF00270.19 | 7.2 | DEAD/DEAH box helicase |
| DNA_photolyase | PF00875.8 | 26.1 | DNA photolyase |
| DSPc | PF00782.11 | −21.8 | Dual specificity phosphatase, catalytic domain |
| DUF1005 | PF06219.3 | 25 | Protein of unknown function (DUF1005) |
| DUF1716 | PF08216.2 | 25 | Eukaryotic domain of unknown function (DUF1716) |
| DUF26 | PF01657.8 | 0 | Domain of unknown function DUF26 |
| DUF6 | PF00892.11 | 20.8 | Integral membrane protein DUF6 |
| DUF640 | PF04852.3 | 2.4 | Protein of unknown function (DUF640) |
| DUF716 | PF04819.3 | −18.4 | Family of unknown function (DUF716) |
| DnaJ | PF00226.21 | −8 | DnaJ domain |
| DnaJ_C | PF01556.9 | −24 | DnaJ C terminal region |
| DnaJ_CXXCXGXG | PF00684.9 | 1 | DnaJ central domain (4 repeats) |
| E2F_TDP | PF02319.11 | 17 | E2F/DP family winged-helix DNA-binding domain |
| EIF_2_alpha | PF07541.2 | −4.2 | Eukaryotic translation initiation factor 2 alpha subunit |
| EIN3 | PF04873.4 | −137.6 | Ethylene insensitive 3 |
| ELFV_dehydrog | PF00208.11 | −27 | Glutamate/Leucine/Phenylalanine/Valine dehydrogenase |
| ELFV_dehydrog_N | PF02812.8 | 31.8 | Glu/Leu/Phe/Val dehydrogenase, dimerisation domain |
| ELK | PF03789.4 | 25 | ELK domain |
| F-box | PF00646.23 | 13.9 | F-box domain |
| FAD_binding_3 | PF01494.9 | −136.6 | FAD binding domain |
| FAD_binding_6 | PF00970.14 | −11.4 | Oxidoreductase FAD-binding domain |
| FAD_binding_7 | PF03441.4 | 25 | FAD binding domain of DNA photolyase |
| FMO-like | PF00743.9 | −381.6 | Flavin-binding monooxygenase-like |
| Fe_bilin_red | PF05996.3 | 25 | Ferredoxin-dependent bilin reductase |
| Fer2 | PF00111.17 | 7 | 2Fe—2S iron-sulfur cluster binding domain |
| Fer2_BFD | PF04324.5 | 25 | BFD-like [2Fe—2S] binding domain |
| Flavin_Reduct | PF01613.8 | −18 | Flavin reductase like domain |
| Flavodoxin_1 | PF00258.15 | 6.3 | Flavodoxin |
| FtsJ | PF01728.9 | −50.2 | FtsJ-like methyltransferase |
| G-patch | PF01585.13 | 18.3 | G-patch domain |
| GAF | PF01590.16 | 23 | GAF domain |
| GATA | PF00320.17 | 28.5 | GATA zinc finger |
| GATase_2 | PF00310.11 | −95.1 | Glutamine amidotransferases class-II |
| GDC-P | PF02347.6 | −306.2 | Glycine cleavage system P-protein |
| GSHPx | PF00255.10 | −16 | Glutathione peroxidase |
| GSH_synth_ATP | PF03917.8 | −129.9 | Eukaryotic glutathione synthase, ATP binding domain |
| GSH_synthase | PF03199.6 | 25 | Eukaryotic glutathione synthase |
| GST_C | PF00043.15 | 22.3 | Glutathione S-transferase, C-terminal domain |
| GST_N | PF02798.10 | 14.6 | Glutathione S-transferase, N-terminal domain |
| GUN4 | PF05419.3 | 25 | GUN4-like |
| Gln-synt_C | PF00120.14 | −124 | Glutamine synthetase, catalytic domain |

TABLE 12-continued

Description of pfam domains

| Pfam domain name | Accession number | Gathering cutoff | Domain description |
|---|---|---|---|
| Gln-synt_N | PF03951.9 | 9 | Glutamine synthetase, beta-Grasp domain |
| Globin | PF00042.12 | −8.8 | Globin |
| Glutaredoxin | PF00462.14 | 17.2 | Glutaredoxin |
| Glyco_hydro_17 | PF00332.9 | −152.3 | Glycosyl hydrolases family 17 |
| Glyco_hydro_2 | PF00703.11 | −19.3 | Glycosyl hydrolases family 2, immunoglobulin-like beta-sandwich domain |
| Glyco_hydro_2_C | PF02836.7 | −127.7 | Glycosyl hydrolases family 2, TIM barrel domain |
| Glyco_hydro_2_N | PF02837.8 | −46.9 | Glycosyl hydrolases family 2, sugar binding domain |
| Glyco_hydro_9 | PF00759.9 | −246.7 | Glycosyl hydrolase family 9 |
| Glyco_transf_5 | PF08323.2 | −114.9 | Starch synthase catalytic domain |
| Glycos_transf_1 | PF00534.10 | −7.3 | Glycosyl transferases group 1 |
| Glyoxalase | PF00903.15 | 12.1 | Glyoxalase/Bleomycin resistance protein/Dioxygenase superfamily |
| HALZ | PF02183.8 | 17 | Homeobox associated leucine zipper |
| HATPase_c | PF02518.16 | 22.4 | Histidine kinase-, DNA gyrase B-, and HSP90-like ATPase |
| HLH | PF00010.16 | 8.3 | Helix-loop-helix DNA-binding domain |
| HSF_DNA-bind | PF00447.8 | −70 | HSF-type DNA-binding |
| Helicase_C | PF00271.21 | 2.1 | Helicase conserved C-terminal domain |
| Hexokinase_1 | PF00349.11 | −110.3 | Hexokinase |
| Hexokinase_2 | PF03727.6 | −131.3 | Hexokinase |
| HisKA | PF00512.15 | 10.3 | His Kinase A (phosphoacceptor) domain |
| Histone | PF00125.14 | 17.4 | Core histone H2A/H2B/H3/H4 |
| Histone_HNS | PF00816.11 | 25 | H-NS histone family |
| Homeobox | PF00046.19 | −4.1 | Homeobox domain |
| IGPD | PF00475.9 | 25 | Imidazoleglycerol-phosphate dehydratase |
| Isoamylase_N | PF02922.8 | −6.5 | Isoamylase N-terminal domain |
| Isochorismatase | PF00857.11 | −46 | Isochorismatase family |
| KNOX1 | PF03790.4 | 25 | KNOX1 domain |
| KNOX2 | PF03791.4 | 25 | KNOX2 domain |
| KR | PF08659.1 | −74.3 | KR domain |
| Kelch_1 | PF01344.15 | 7.8 | Kelch motif |
| Kelch_2 | PF07646.5 | 14 | Kelch motif |
| LEA_3 | PF03242.4 | 25 | Late embryogenesis abundant protein |
| LRRNT_2 | PF08263.3 | 18.6 | Leucine rich repeat N-terminal domain |
| LRR_1 | PF00560.23 | 7.7 | Leucine Rich Repeat |
| LRR_2 | PF07723.3 | 6 | Leucine Rich Repeat |
| Lactamase_B | PF00753.17 | 24.6 | Metallo-beta-lactamase superfamily |
| Ldh_1_C | PF02866.8 | −13 | lactate/malate dehydrogenase, alpha/beta C-terminal domain |
| Ldh_1_N | PF00056.13 | −31.3 | lactate/malate dehydrogenase, NAD binding domain |
| Lir1 | PF07207.2 | 25 | Light regulated protein Lir1 |
| MBD | PF01429.10 | 12.9 | Methyl-CpG binding domain |
| MEKHLA | PF08670.1 | −59.7 | MEKHLA domain |
| MFS_1 | PF07690.6 | 23.5 | Major Facilitator Superfamily |
| MGS | PF02142.12 | 3 | MGS-like domain |
| Miro | PF08477.3 | 10.8 | Miro-like protein |
| Mit_rib_S27 | PF08293.2 | 25 | Mitochondrial ribosomal subunit S27 |
| Mo-co_dimer | PF03404.6 | 25 | Mo-co oxidoreductase dimerisation domain |
| Molybdop_Fe4S4 | PF04879.6 | 13.6 | Molybdopterin oxidoreductase Fe4S4 domain |
| Molybdopterin | PF00384.12 | −50 | Molybdopterin oxidoreductase |
| Molydop_binding | PF01568.11 | 1.1 | Molydopterin dinucleotide binding domain |
| MtN3_slv | PF03083.6 | 9.7 | MtN3/saliva family |
| Myb_DNA-binding | PF00249.21 | 14 | Myb-like DNA-binding domain |
| NAD_Gly3P_dh_C | PF07479.4 | −50.8 | NAD-dependent glycerol-3-phosphate dehydrogenase C-terminus |
| NAD_Gly3P_dh_N | PF01210.13 | −44 | NAD-dependent glycerol-3-phosphate dehydrogenase N-terminus |
| NAD_binding_1 | PF00175.11 | −3.9 | Oxidoreductase NAD-binding domain |
| NAD_binding_2 | PF03446.5 | −63.5 | NAD binding domain of 6-phosphogluconate dehydrogenase |
| NIR_SIR | PF01077.12 | −19.6 | Nitrite and sulphite reductase 4Fe—4S domain |
| NIR_SIR_ferr | PF03460.7 | 2.4 | Nitrite/Sulfite reductase ferredoxin-like half domain |
| NPH3 | PF03000.5 | 25 | NPH3 family |
| NTP_transferase | PF00483.13 | −90.5 | Nucleotidyl transferase |
| NUDIX | PF00293.18 | 0.2 | NUDIX domain |

TABLE 12-continued

Description of pfam domains

| Pfam domain name | Accession number | Gathering cutoff | Domain description |
|---|---|---|---|
| Na_H_Exchanger | PF00999.11 | −67.9 | Sodium/hydrogen exchanger family |
| Na_H_antiport_1 | PF06965.2 | −270.8 | Na+/H+ antiporter 1 |
| Na_sulph_symp | PF00939.9 | −259 | Sodium:sulfate symporter transmembrane region |
| Oxidored_molyb | PF00174.9 | −39.6 | Oxidoreductase molybdopterin binding domain |
| P-II | PF00543.12 | −29 | Nitrogen regulatory protein P-II |
| PALP | PF00291.15 | −70 | Pyridoxal-phosphate dependent enzyme |
| PAS | PF00989.14 | 0 | PAS fold |
| PAS_3 | PF08447.1 | 13.4 | PAS fold |
| PBP | PF01161.10 | −20.6 | Phosphatidylethanolamine-binding protein |
| PFK | PF00365.10 | −132 | Phosphofructokinase |
| PGI | PF00342.9 | −168.9 | Phosphoglucose isomerase |
| PHP | PF02811.9 | 13.8 | PHP domain |
| PLATZ | PF04640.4 | 20 | PLATZ transcription factor |
| PMSR | PF01625.11 | −62 | Peptide methionine sulfoxide reductase |
| PP2C | PF00481.12 | −44 | Protein phosphatase 2C |
| PSI_PSAK | PF01241.9 | 25 | Photosystem I psaG/psaK |
| PTPA | PF03095.5 | −106 | Phosphotyrosyl phosphate activator (PTPA) protein |
| PTR2 | PF00854.12 | −50 | POT family |
| PaO | PF08417.2 | 25 | Pheophorbide a oxygenase |
| ParBc | PF02195.8 | 25 | ParB-like nuclease domain |
| Peptidase_S10 | PF00450.12 | −198 | Serine carboxypeptidase |
| Phi_1 | PF04674.3 | 25 | Phosphate-induced protein 1 conserved region |
| Pkinase | PF00069.15 | −70.3 | Protein kinase domain |
| Pkinase_Tyr | PF07714.7 | 65 | Protein tyrosine kinase |
| Pre-SET | PF05033.6 | 3.9 | Pre-SET motif |
| Pribosyltran | PF00156.17 | 2 | Phosphoribosyl transferase domain |
| Prismane | PF03063.10 | −169.3 | Prismane/CO dehydrogenase family |
| Proteasome | PF00227.16 | −36.7 | Proteasome A-type and B-type |
| PsbP | PF01789.7 | 25 | PsbP |
| PsbQ | PF05757.2 | 25 | Oxygen evolving enhancer protein 3 (PsbQ) |
| PsbW_2 | PF07123.2 | −25.8 | Photosystem II reaction centre W protein (PsbW) |
| Pyr_redox | PF00070.17 | 5 | Pyridine nucleotide-disulphide oxidoreductase |
| Pyr_redox_2 | PF07992.4 | −20 | Pyridine nucleotide-disulphide oxidoreductase |
| RGS | PF00615.9 | 10 | Regulator of G protein signaling domain |
| RPE65 | PF03055.6 | −156.5 | Retinal pigment epithelial membrane protein |
| RRM_1 | PF00076.12 | 17.7 | RNA recognition motif. (a.k.a. RRM, RBD, or RNP domain) |
| Radical_SAM | PF04055.11 | 8.5 | Radical SAM superfamily |
| Ras | PF00071.12 | −69.9 | Ras family |
| Response_reg | PF00072.14 | 4 | Response regulator receiver domain |
| Ribosomal_L10e | PF00826.8 | 25 | Ribosomal L10 |
| Ribosomal_S2 | PF00318.10 | −22 | Ribosomal protein S2 |
| Rieske | PF00355.16 | −7 | Rieske [2Fe—2S] domain |
| Rubredoxin | PF00301.10 | 12.1 | Rubredoxin |
| S1 | PF00575.13 | 16.8 | S1 RNA binding domain |
| S10_plectin | PF03501.5 | 25 | Plectin/S10 domain |
| SAM_decarbox | PF01536.7 | −154 | Adenosylmethionine decarboxylase |
| SAP18 | PF06487.3 | −49.7 | Sin3 associated polypeptide p18 (SAP18) |
| SET | PF00856.18 | 23.5 | SET domain |
| SHMT | PF00464.10 | −238.5 | Serine hydroxymethyltransferase |
| SNF5 | PF04855.3 | 25 | SNF5/SMARCB1/INI1 |
| SOUL | PF04832.3 | 25 | SOUL heme-binding protein |
| START | PF01852.10 | −20.7 | START domain |
| SWIM | PF04434.8 | 11 | SWIM zinc finger |
| Sad1_UNC | PF07738.3 | −20.4 | Sad1/UNC-like C-terminal |
| Sina | PF03145.7 | −48.4 | Seven in absentia protein family |
| Spermine_synth | PF01564.7 | −93.8 | Spermine/spermidine synthase |
| Sterol_desat | PF01598.8 | −13 | Sterol desaturase |
| Sugar_tr | PF00083.14 | −85 | Sugar (and other) transporter |
| TPP_enzyme_C | PF02775.11 | 19.7 | Thiamine pyrophosphate enzyme, C-terminal TPP binding domain |
| TPP_enzyme_M | PF00205.12 | −8.1 | Thiamine pyrophosphate enzyme, central domain |
| TPP_enzyme_N | PF02776.8 | −70 | Thiamine pyrophosphate enzyme, N-terminal TPP binding domain |

TABLE 12-continued

Description of pfam domains

| Pfam domain name | Accession number | Gathering cutoff | Domain description |
| --- | --- | --- | --- |
| TPR_1 | PF00515.18 | 7.7 | Tetratricopeptide repeat |
| TPR_2 | PF07719.7 | 20.1 | Tetratricopeptide repeat |
| TPR_4 | PF07721.5 | 15 | Tetratricopeptide repeat |
| TPT | PF03151.7 | −15.3 | Triose-phosphate Transporter family |
| TP_methylase | PF00590.10 | −38 | Tetrapyrrole (Corrin/Porphyrin) Methylases |
| Thi4 | PF01946.7 | −65.1 | Thi4 family |
| Thioredoxin | PF00085.10 | −25.7 | Thioredoxin |
| Tim17 | PF02466.9 | 2.7 | Tim17/Tim22/Tim23 family |
| Tryp_alpha_amyl | PF00234.12 | −4 | Protease inhibitor/seed storage/LTP family |
| UAA | PF08449.2 | −146.2 | UAA transporter family |
| VPS28 | PF03997.3 | 25 | VPS28 protein |
| Vps4_C | PF09336.1 | −4.6 | Vps4 C terminal oligomerisation domain |
| WD40 | PF00400.22 | 21.5 | WD domain, G-beta repeat |
| Whirly | PF08536.2 | 25 | Whirly transcription factor |
| YABBY | PF04690.4 | 25 | YABBY protein |
| YDG_SRA | PF02182.8 | 25 | YDG/SRA domain |
| adh_short | PF00106.15 | −40.2 | short chain dehydrogenase |
| bZIP_1 | PF00170.11 | 24.5 | bZIP transcription factor |
| bZIP_2 | PF07716.5 | 15 | Basic region leucine zipper |
| eIF-1a | PF01176.9 | 20 | Translation initiation factor 1A/IF-1 |
| efhand | PF00036.22 | 21.7 | EF hand |
| mTERF | PF02536.5 | −60 | mTERF |
| p450 | PF00067.12 | −105 | Cytochrome P450 |
| peroxidase | PF00141.13 | −10 | Peroxidase |
| tRNA-synt_2 | PF00152.11 | −168.2 | tRNA synthetases class II (D, K and N) |
| tRNA_anti | PF01336.15 | 8 | OB-fold nucleic acid binding domain |
| ubiquitin | PF00240.13 | 19.4 | Ubiquitin family |
| zf-C3HC4 | PF00097.15 | 16 | Zinc finger, C3HC4 type (RING finger) |
| zf-CCCH | PF00642.15 | 0 | Zinc finger C-x8-C-x5-C-x3-H type (and similar) |
| zf-Dof | PF02701.6 | 25 | Dof domain, zinc finger |
| zf-UBR | PF02207.10 | 25 | Putative zinc finger in N-recognin (UBR box) |

Example 9. Selection of Transgenic Plants with Enhanced Agronomic Trait(s)

This example illustrates the preparation and identification by selection of transgenic seeds and plants derived from transgenic plant cells of this invention where the plants and seed are identified by screening for a transgenic plant having an enhanced agronomic trait imparted by expression of a protein selected from the group including the homologous proteins identified in Example 6. Transgenic plant cells of corn, soybean, cotton, canola, alfalfa, wheat and rice are transformed with recombinant DNA for expressing each of the homologs identified in Example 6. Plants are regenerated from the transformed plant cells and used to produce progeny plants and seed that are screened for enhanced water use efficiency, enhanced cold tolerance, increased yield, enhanced nitrogen use efficiency, enhanced seed protein and enhanced seed oil. Plants are identified exhibiting enhanced traits imparted by expression of the homologous proteins.

SEQUENCE LISTING (30550 sequences)

SEQ ID NO: 1 - DNA, 1080 bp, Zea mays
atggaggagatcacccaacactttggagttggcgcaagcagccacggccatggccacggccagcaccaccatcatcaccaccaccaccacccgtgggcatcctccctcagcgccgtcgtagcgccgctgccgccgcaaccgccaagcgcaggcctgccgctgaccctgaacacggtggcggccactgggaacagcggcggtagcggcaacccggtgctgcagcttgccaacggtggcggcctcctcgacacatgcgtcaaggcgaaggagccctcgtcgtcgtctccctacgcaggcgacgtcgaggccatcaaggccaagatcatctcgcacccacactactactcgctcctcactgcctacctcgagtgcaacaaggtgggggcaccaccggaggtgtcggcgaggctgacggagatagcgcaggaggtggaggcgcggcagcgcacggcgctcggcggcctggccgctgcgacggagccggagctggaccagttcatggaggcgtaccacgagatgctggtgaagttcagggaggagctgacgaggccgctgcaggaggcgatggagttcatgcgaagggtggagtcgcagctgaactcgctttccatctccggaaggtcgctgcgcaacatcctttcatctggctcttctgaggaggatcaagaaggtagcggaggagagaccgagctccctgaagttgatgcacatggtgtggaccaagagctgaagcaccatctcctgaagaaatacagtggctatctaagctcgctcaagcaagaactgtcaaagaagaagaagaaagggaagctccctaaggaggctcgccagcagccccttagctggtgggatcagcactacaaatggccttacccctcagagactcagaaagtggcactggctgaatctaccgggcttgacctgaagcagatcaacaactggttcatcaaccagcggaagcggcactggaagccatccgaggagatgcaccacctgatgatggatgggtaccacaccaccaatgccttctacatggacggccacttcatcaacgacggcgggctgtaccggctcggctag

SEQ ID NO: 2 - DNA, 1800 bp, Arabidopsis thaliana
atggcttctttcacggcaacggctgcggtttctgggagatggcttggtggcgatcatactcagccgccattatcgtcttctcaaagctccgacttgagttattgtagctccttacctatggccggtcgtgtcacacgtaagctcaatgtttcatctgcgcttcacactcctccagctcttcatttccctaagcaatcatcaaactctcccgccattgttgttaagcccaaagccaaagaatccaacaataaacagatgaatttgttccagagagcggcggcggcagcgttggacgcggcggagggtttccttgtcagccacgagaagctacacccgcttcctaaaacggctgatcctagtgttcagatcgccggaaattttgctccggtgaatgaacagcccgtccggcgtaatcttccggtggtcggaaaaattcccgattccatcaaaggagtgtatgtgcgcaacggagctaacccacttcacgagccggtgacaggtcaccacttcttcgacggagacggtatggttcacgccgtcaaattcgaagacggttcagctagctacgcttgccggttcactcagactaaccggtttgttcaggaacgtcaattgggtcgaccggttttccccaaagccatcggtgagcttcacggacacaccggtattgcccggctcatgctattctacgccagagctgcagccggtatagtcggcccggcacacggaaccggtgtggccaacgccggtttggtctatttcaacggccggttattggctatgtcggaggatgatttaccttaccaagttcggatcactcccaatggagatttaaaaaccgttggtcggttcaattttgatggacaattagaatccacaatgattgcccacccgaaagtcgacccggaatccggtgaactcttcgctttaagctacgacgtcgtttcaaagccttacctaaaatacttccgattctcaccggacggaactaaatcaccggacgtcgagattcagcttgatcagccaacgatgatgcacgatttcgcgattacagagaacttcgtcgtcgtacctgaccagcaagtcgttttcaagctgccggagatgatccgcggtgggtctccggtggtttacgacaagaacaaggtcgcaagattcgggattttagacaaatacgccgaagattcatcgaacattaagtggattgatgctccagattgcttctgcttccatctctggaacgcttgggaagagccagaaacagatgaagtcgtcgtgatagggtcctgtatgactccaccagactcaattttcaacgagtctgacgagaatctcaagggtgtcctgtctgaaatccgcctgaatctcaaaaccggtgaatcaactcgccgtccgatcatctccaacgaagatcaacaagtcaacctcgaagcagggatggtcaacagaaacgtgcttggccgtaaaaccaaattcgcttacttggctttagccgagccgtggcctaaagtctcaggattcgctaaagttgatctcactactggagaagttaagaaacatctttacggcgataaccgttacggaggagagcctctgtttctccccggagaaggaggagaggaagacgaaggatacatcctctgtttcgttcacgacgagaagacatggaaatcggagttacagatagttaacgccgttagcttagaggttgaagcaacggttaaacttccgtcaagggttccgtacggatttcacggtacattcatcggagccgatgatttggcgaagcaggtcgtgtga

SEQ ID NO: 3 - DNA, 693 bp, Arabidopsis thaliana
atggagaaagcatctttcaaagaaaagagtagtgtagccaaaatggttgggacaatagtttcactagttggcgcacttgtggtagttctctaccatggtccacgagtcttcaccccatcttctccaccatttccacaactccgtcagcttcttttgccgttatcatcctcaaactcggattggatcatcggtggttgtcttttagccatcaaagacaccctcgttcctgttgcttttattcttcaagcacatataatgaagttatatccagcaccattcacggtctctttcttctattttctgattgcttcaatcttgacgtcattgatcggaatcgtagcagaaaagaacaatccgagcatatggatcattcattttgacattacattagtttgcatagttgttgggggaatatttaatccaggatattacgcgattcatctgtgggcagtacgtaataaaggacctgtttacttagctatattcagacctttatcgattttaatagcagtgattatgggagcgatttttcttggagattctttttacctaggaagtttggtcggagggattttgatatcgttagggttttacactgtgatgtggggaaaagcaaaagaagggaagactcagttcttgtcgctgtcagaggaaactcctcttctagacgaaaacatagacgaccgaatatag

SEQ ID NO: 4 - DNA, 1785 bp, Arabidopsis thaliana
atgcagaagcgaatagccttgtcgtttccagaagaggtactagagcatgtgttctcgtttattcagctggataaggataggaactcagtctctctggtgtgcaagtcatggtacgagatcgagcggtggtgcaggaggaaagtcttcatcgggaactgctacgccgtgagtccagcgacggtgattaggaggttcccgaaagtgagatccgtggagcttaaaggaaaacctcactttgctgactttaatttggtacctgacggatggggaggttacgtgtatccatggattgaggccatgtcttcgtcttacacgtggcttgaagagataaggctgaagaggatggtggtcaccgacgattgcttggagctcatagccaagtcttttaagaattttaaggttcttgtgctttcttcctgcgaaggcttctccaccgatggtctcgctgctatcgctgccacttgcaggaatctgaaagagcttgacttacgagagagtgatgttgacgacgttagtggccactggcttagccatttcccagatacatacacttctttggtatcactcaatatatcttgcttagcatctgaggtcagtttctctgctctggaaaggctggtgactaggtgtcccaatctcaagtctctcaagcttaaccgagctgttccacttgaaaaattggctactttacttcaaagagcacctcaattggaggaattgggcactggtgggtacactgcagaagtgcgaccagatgtttactctggtttatctgtagcgctctctgggtgcaaggaattgaggtgcttatctggattttgggatgctgttcctgcctatcttccagcagtttattcggtttgcagtcggcttacaactttgaatctgagttatgcaacagtccagagctatgatcttgtcaagcttctttgtcaatgccctaaactgcagcgcctctgggtgcttgactacatcgaggatgctggtcttgaggtgcttgcttcaacctgcaaggacctacgcgagctgagagtgtttccgtccgagccttttgtcatggaaccaaatgtggcattgacggaacaggggcttgtctccgtctccatgggctgtccaaaactcgagtcggttctctacttctgccgtcaaatgaccaatgctgcattgataaccattgctaggaaccgtcccaacatgactcgcttccgtttgtgcatcattgagccaaaagccccagactatctgactctagagccactggatattggatttggagccatagtagagcactgcaaggatctccgtcgcctctctctatctggcctcttgaccgacaaggtttttgaatacattgggacatatgccaagaagatggaaatgctctcagtggcatttgcaggagacagtgacttaggcatgcatcatgttttgtccgggtgcgatagcttgaggaaactagagataagggactgcccgtttggagacaaggcgcttttggccaatgcttcaaagctggagacaatgcgatccctttggatgtcttcttgttccgtgagttttggagcctgcaagttactaggacagaagatgccaaagctgaatgtggaagtcatcgatgaacggggtgcaccggactcgagaccagagagctgccctgttgagagagtcttcatataccgaacagtggctggtcctcgatttgacatgcctggcttcgtctggaacatggaccaagactcaacaatgaggttttccaggcaaatcattactactaacggattatag

SEQ ID NO: 5 - DNA, 720 bp, Arabidopsis thaliana
atggttgatgcaaaacaagttcgtttcatcatcggagttatcggaaatgttatctcctttggtctctttgccgcaccagcgaagactttctggaggatcttcaagaagaaatcagtggaagagttttcgtatgtgccgtacgtagcaacggtgatgaattgtatgttgtgggtgttttacggtctccctgtggttcacaaagacagtattctagtttcaaccattaatggtgttgggttagttatcgaacttttctacgttggtgtctacttgatgtactgtggtcacaagaagaaccatcgaaggaacattttgggattcttagctcttgaagttattttggtggtggctatcattcttattacgctctttgcgcttaagggtgattttgttaagcaaacatttgttggtgtgatttgcgatgtcttcaacattgctatgtatggagctccttcattggccattattaaagtggtaaaaacaaagagtgttgaatacatgccattcttgttgtctttggtctgtttcgttaatgctggaatttggactacttactcgctcatcttcaagatcgattactacgtcctcgcaagtaatgggattggaacctttttggcactttctcagttgatagtgtacttcatgtactataagtcaactccaaaggagaagacggtgaagccatcagaagttgagatttctgctacggagagggtttag

SEQ ID NO: 6 - DNA, 477 bp, Arabidopsis thaliana
atgggagagattgggtttacagagaagcaagaagctttggtgaaggaatcgtgggagatactgaaacaagacatccccaaatacagccttcacttcttctcacagatactggagatagcaccagcagcaaaaggcttgttctctttcctaagagactcagatgaagtccctcacaacaatcctaaactcaaagctcatgctgttaaagtcttcaagatgacatgtgaaacagctatacagctgagggaggaaggaaaggtggtagtggctgacacaaccctccaatatttaggctcaattcatctcaaaagcggcgttattgaccctcacttcgaggtggtgaaagaagctttgctaaggacattgaaagaggggttgggggagaaatacaatgaagaagtggaaggtgcttggtctcaagcttatgatcacttggctttagccatcaagaccgagatgaaacaagaagagtcatag

SEQ ID NO: 7 - DNA, 654 bp, Zea mays
atgggggggcgggtggatcacgagtactcttacctgttcaagatggtgctcatcggggacagcggcgtcggcaagtccaatatcctctctcgcttcacgcgcaaccacttctccctcgactccaagtccaccatcggcgtcgagttcgccaccaagtccctacagattgacggcaaaacaataaaggctcagatctgggacacagctgggcaggaaaggtaccgtgcgattacaagcgcctactaccgtggcgccgtggccgccctgcttgtgtacgacatcacgaagaggcagagcttcgacaacgttcacaggtggcttcgtgagctccgcgaccacgctgactccagcatcgtgatcatgatggtgggcaacaaatccgacctgatccacttgagagctatctctgaggacgaaggcaaagcgttggctgagaaggaagggctgttcttcctcgagacgtcagctatggaggccatcaacgtggaggaagccttccagactattatcacggaggtgtatggcatcgtcaacaggaaagcgctggccgccaaggaagcagcagccacagctgccccattgccttcacagggcaaaaccatcagcattgacagcaatgcaggaaatacaaagaaggcatgctgctctacatag

SEQ ID NO: 8 - DNA, 1635 bp, Zea mays
atggggaaccaatgcccaaacgggacccttgggagtgactactacaaccgcccgacgtccaggttcgctgatggttgtcttgaggacgatcgctactctgacttgaagaagtttgacaagccatggcctgaggtgaactcgtttaagcccactgctgttggtattttgaagaggggattggatccaacgtcaatcactgtccttgaaaggaagacggccgacataagggaacattatatcattggtcggaggcttggtcaaggccagtttggcacaacattcctctgcaccgagatcagtacagggtgtgagtatgcatgcaagacaatcccaaagcgaaagctcatcaccaaggaggatgttgaggatgtgcgccgtgagatccagataatgcaccatttgtcaggccacaagaatgttgtttccatcaaggatgtatacgaggatgggcaggcggtgtatattgtgatggagctctgcgccggtggggagctctttgatcgaattcaggagaaagggcattatagcgaacagaaggctgcagagctcataagaatcattattagccttgtggctatgtgccattcacttggggttatgcaccgtgatctaaagccagaaaacttcctcctttgggataaagaagatgacctgtcaataaaagcaatcgattttggtctatctgtgttcttcaaaccaggtcaggttttcactgagctggttggaagtccatactacgttgctcctgaggtactacacaaacggtatggaccagaagcggatgtgtggtcagctggagtgatactgtatgttttgcttagtggggtgccacctttttgggcagagacgcaacaaggtatatttgatgctgtcttgaaggggcacattgattttgactcggacccatggcctaagatatctgaaagcgcaaagaatctcataaggaagatgctctgcccttgtccttcagagcgtctgaaagcccatgaagtactacgccatccttggatctgtgaaaatggagtggctactgatcaggctcttgatcccggtgttctctctcgtctcaaacaattctccacaatgaacaaattaaagaagttggctctgagagtgatagctgaacgactttctgaggaggagattgctgggttaagacaaatgttcaaggcagttgacgttcaaaatagaggcgtaattacttttggtgaacttagacaaggtttaaaaagatatggtagcgaattggagaatagagaaattagtgatataatggaagtggctgataatgacaataatgtgaccatcaattatgaagaatttatcgctgcaactgtgcctcttaacaaaatagaacgtgaggagcacctgatggcagcttttacctacttcgacaaagatggaagtggttatatcacagttgacaagctgcaacgagcttgtggagaacatgacatggatgacactttccttgaagagataattttagaagttgaccaaaacaatgacggtcagattgactacgccgaattcgtagccatgatgcaaggcagcaaagttggacttgggtggcaacaaatggaaaccactctgaatgtaaccttgagagatgcacctcaagtacactgtcactag

SEQ ID NO: 9 - DNA, 1698 bp, Zea mays
atggcgctctcagcttgcccggctcaggaagaactgctgcagcctgctgggaggccgttgaggaagcagcttgctgcagccgcgaggagcatcaactggagctattccctcttctggtccatttcaagcactcaacgaccacgggtgctgacgtggacggacgggttctacaatggcgaggtgaagacgcgtaagatctcccactccgtggagctgacagccgaccagctgctcatgcagaggagcgagcagctccgggagctctacgaggccctccagtccggcgagtgcgaccgccgcgcggcgcggccggtgggctcgctgtcgccggaggacctcggggacaccgagtggtactacgtgatctgcatgacctacgccttcctgcctggccaaggcttgcccggcaggagttccgcgagcaacgagcatgtctggctgtgcaacgcgcacctcgccggcagcaaggacttcccccgcgcgctcctggccaagagcgcgtccattcagacaatcgtctgcatcccgctcatgggtggcgtgcttgagcttggtactactgataaggtgccggaggacccggacttggtcagccgagcaaccgcagcattctgggagccgcaatgtccgacatactcgaaagagccgagctccaacccgtcagcatacgaaaccggggaagccgcatacatagtcgtgttggaggacctcgatcacaatgccatggacatggagacggtgactgccgcctccgggagacacggaactggacaggaggagctaggagaagccgggagcccgtcaaatgcaattagcctggagcacatcacgacggggatcgacgagttctacagcctctgcgaggaaatggacgtgcagccgctagaggatgcctggataatggacgggtctaatttcgaagtcccgtcgtcagcgctcccggtggatggctcaagcgcacccgctgatggttctcgcgcgacaagtttcgtggtttggacgaggtcatcgcactcctgctcgggtgaagcggcggcggtgccggtcatcgaagagccgcagaaattgctgaagaaagcggtggccggcggcggtgcttgggcgaacacgaactgcggtggcgggggcacgacggtaacagcccaggaaaacggagccaagaaccacgtcatgtcagagcgaaagcgccgggagaagctcaacgagatgttcctcgttctcaagtcgttggttccctccattcacaaggtggacaaagcatccatcctcgccgaaactatagcctacctaaaggagcttcaacgaagggtacaagaactggaatccaggaggcaaggtggcagtgggtgtgtcagcaagaaagtctgtgtgggctccaactccaagaggaagagcccagagttcgccggtggcgcgaaggagcacccctgggtcctccccatggacggcaccagcaacgtcaccgtcaccgtctcggacacggacgtgctcctggaggtgcaatgccggtgggagaagctcctgatgacacgggtgttcgacgccatcaagagcctccatttggacgctctctcggttcaggcttcggcaccagatggcttcatgaggctcaagataggagctcagtttgcaggctccggcgccgtcgtgcccggaataatcagccaatctcttcgtaaagctatagggaagcgatag

SEQ ID NO: 10 - DNA, 213 bp, Escherichia coli
atgcaggaaggcatggaagttaaaggtatcgttaagaacctcactgactacggtgcattcgttgatctgggcggcgttgacggcctgctgcacatcactgacatggcctggaaacgcgttaagcatccgagcgaaatcgtcaacgtgggcgacgaaatcactgttaaagtgctgaagttcgaccgcgaacgtacccgtgtatccctgggctag

SEQ ID NO: 11 - DNA, 279 bp, Escherichia coli
atggagcagaaaaaggcaaacatctacaaaggtaaaatcacccgcattgaaccgagtctggaagctgcttttgttgattacggcgctgaacgtcacggtttcctcccactaaaagaaattgcccgcgaatatttccctgctaactacagtgctcatggtcgtcccaacattaaagatgtgttgcgtgaaggtcaggaagtcattgttcagatcgataaagaagagcgcggcaacaaaggcgcggcattaaccacctttatcagtctggcgggtagctag

SEQ ID NO: 12 - DNA, 246 bp, Saccharomyces cerevisiae
atgcttcacaaagtttatgaaggtaaagtgagaaacataactacttttgggtgtttcgtccaaatttttgggacgcgaatgaagaattgtgatggcttagttcatatttcagaaatgtcagaccaaagaacattagatccacatgatgtggtgagacaaggccaacatatctttgtcgaagtgataaaaatacaaaataatggaaaaatatcgctctccatgaaaaatattgatcaacatagttag

SEQ ID NO: 13 - DNA, 234 bp, Escherichia coli
atggcagaaatcgaagtgggccgcgtctacactggtaaagtgacccgtatcgttgactttggcgcatttgttgccatcggcggcggtaaagaaggtctggtccacatctctcaaatcgctgacaaacgcgttgagaaagtgaccgattacctgcagatgggtcaggaagtaccggtgaaagttctggaagttgatcgccagggccgtatccgtctgagcattaaagaagcttag

SEQ ID NO: 14 - DNA, 219 bp, Escherichia coli
atggccaaagaagacaatattgaaatgcaaggtaccgttcttgaaacgttgcctaataccatgttccgcgtagagttagaaaacggtcacgtggttactgcacacatctccggtaaaatgcgcaaaaactacatccgcatcctgacgggcgacaaagtgactgttgaactgaccccgtacgacctgagcaaaggccgcattgtcttccgtagtcgctag

SEQ ID NO: 15 - DNA, 210 bp, Escherichia coli
atgaacaagggcgaccgtgttgaaggtaaaatcaagtctatcactgacttcggtatcttcatcggcttggacggcggcatcgacggcctggttcacctgtctgacatctcctggaacgttgcaggcgaagaagcagttcgtgaatacaaaaaaggcgacgaaatcgctgcagttgttctgcaggttgacgcagaacgtgaacgtatttag

SEQ ID NO: 16 - DNA, 900 bp, Arabidopsis thaliana
atggaaacggaaggaagaagacgagaagtggttgtttcatctctccaattcgcttgctccgacgatatctccaccaatgtcgccgccgctgagcgattagtcagagaagctcacgctaaaggagctaatatcattcttattcaggaactttttgaaggatattacttctgtcaagcacaaagagaagacttctttaagcgagccaagccttacaagaaccatcctaccattgcaaggatgcagaagctggcaaaggaattgggtgtagtgatacctgttagtttctttgaggaggcaaatactgcacattacaattcgattgctataattgatgctgatggaactgacttgggaatttataggaagtctcatattcctgatggacctggttatcaagagaagttttatttcaatcctggagatactggctttaaggttttccagacgaagtttgctaaaattggagtggctatatgttgggatcagtggtttcctgaggcagctcgagctatggttctacagggtgctgaaatactgttttatcccactgctattggttctgaacctcaagaccagggattggattcgcgtgatcattggaggagagttatgcaagggcatgctggagctaacgtggtacctctagtagcctcaaatcgcatagggaaggaaataattgaaactgagcatggacctagtcagatcactttctacggaacttccttcattgccggaccaacaggtgaaattgtggccgaggcagatgataaatcggaagctgttcttgtagcacagtttgatcttgatatgatcaagtcgaaaaggcaaagctggggagtgttccgtgaccgtcgtccagatttgtacaaggtgcttcttactatggatggtaatctctag

SEQ ID NO: 17 - DNA, 780 bp, Oryza sativa
atgatctccccggacgcggctcgcaacgtcgtcggcatcatcggcaatgtcatctccttcggcctcttcctcgcccccgtgccgacgttctggaggatctgcaagaggaaggacgtggaggagttcaaggcggacccatacctagcgacgctgctcaactgcatgctctgggtgttctacggcattcccgttgtccaccccaacagtatcctcgtcgtcaccatcaacggcatcggcctcctcgtcgagggcacctacctcctcatcttcttcctctactcccccaacaagaaacgcctgaggatgtgtgctgtgctgggcgtggagttggtgttcatgttggcggtgattctgggtgtgctgctgggcgcgcacacccacgagaagcgctccatgattgtcggtatcctctgcgtcttcttcggctccatcatgtacttctcccctctcactatcatggggaaagtgataaagacgaagagcgtggagtacatgccgttcttcctgtcgctggtgtgcttcctcaacggcgtctgctggacggcctacgcgctcatccgctttgacatctacgtgaccatccccaatggtctcggcgccctcttcggcgccatccagctcattctctatgcttgctactaccggaccacacctaagaagaccaaggccgccaaggacgtcgagatgccctccgtcgttgtctccggcaccggcgccgccgccgctgccggtggcggtaacaccggcggcggcagcgtctccgtcaccgtcgagcgatag

SEQ ID NO: 18 - DNA, 540 bp, Zea mays
atgatcatctccaagaagaaccgccgcgagatctgcaaatacctcttccatgagggggtcttgtacgccaagaaggactacaacctggccaagcaccccaagcttgatgtgcccaacttggaggtgattaagctcatgcagagcttcaagtcgaaggagtatgtgagggaaaccttctcatggcagtactactactggtacctcaccaacgatggcattgagcacctccgcagcttcctcaacctgccatcagaggttgtgcctaataccctcaagaagtcttccaagcccccgtctcgccccttcggctctggcccacctggtgaccgccccaggggccctcctcgttatgaaggtgacaggcctaggtttggtgatagggatggttacagaggaggtccacgtggcgctccaggtgactttggtggtgataagggtggtgctcctgcagatttccaaccatcttttaggggtagcagacctggctttggccgcggtggcggcggtgctttcggtgctggtggatcttccatggagtag

SEQ ID NO: 19 - DNA, 798 bp, Arabidopsis thaliana
atggcgaccacaaactctctccaccaccaccaccactcctctccttcttacacacaccaccgcaacaatctccattgccaatctcacttcggaccaacttctctttccctcaaacaacccacttccgccgcaacattctcactaatctgctctgcttcttccacctcctcctccaccaccgccgtatctgccgtttcaaccacaaacgcctccgccacaactgccgaaaccgcgaccatattcgacgttctggagaaccatctcgtcaatcaaaacttcagacaagccgacgaggagacacggagattactcattcagatatccggagaagccgccgtgaaacgtggctacgttttcttctccgaggtgaaaacaatctcccccgaagatcttcaagctatcgacaatctatggattaaacacagtgatggtagattcggatacagcgtgcaacgcaaaatctggttaaaagtgaagaaagatttcacaagattcttcgttaaagttgagtggatgaagcttcttgacacagaggttgttcaatacaattacagagcgtttcctgacgaattcaagtgggagcttaacgatgaaacgcctttaggacacttaccgctcacaaacgccttgagaggaacgcagcttctgaaatgcgttttaagccatcctgcgtttgcgacagctgatgataacagtggagaaacagaagacgagcttaacagaggtgttgcggtggctaaggaacaggcaggagtaggagcagacaaaagagtgtttaaaacaaattacagcttctag

SEQ ID NO: 20 - DNA, 1281 bp, Arabidopsis thaliana
atgtctgtttctctctccgccgcctctcacttactctgttcctccaccagagtctctctttcccccgccgtcacctcttcgtcctcgtcccctgtcgttgctctttcttcctctacatcgccacattctcttggaagcgtcgcatcttcttctctgtttcctcactcctccttcgtgcttcagaaaaaacatccgatcaatgggacgagcacgaggatgatttcaccaaaatgtgccgcttctgatgcagctcaattgataagcgctaaagaagatatcaaagttcttctccggactaagttttgccatcccatcttggttagattggggtggcacgatgctggtacttataacaagaatattgaggagtggccactgagaggtggagctaatggaagtcttaggtttgaggctgagcttaagcatgctgcaaatgctggtctgcttaatgctttaaagctcattcagcctctcaaagacaagtatcctaacatctcttatgcggacttattccagttagctagtgccacagcaatagaggaggctggtggtcctgatatcccgatgaaatatgggagagttgatgttgtagcacctgaacagtgtccagaagaaggaagactccctgatgctggacctccttcaccagctgatcatttgagagatgttttctacagaatgggacttgatgacaaggaaatagttgccttgtctggtgcacataccttagggagagccagaccagaccgtagtggttggggaaaacctgagacaaagtacacgaaaactggacctggagaagcaggaggacagtcatggacagtgaaatggctcaagttcgacaactcttatttcaaggatatcaaagaaaagagggacgacgatcttctggtgttacccactgatgcggcgctatttgaagatccttcattcaagaactatgcagagaagtatgctgaagatgtggctgcatttttcaaggactacgctgaagcccatgccaagcttagcaatctcggtgcaaaatttgatcctcccgagggcatagtcattgaaaacgttccagagaagttcgtagctgcaaagtattctacgggaaagaaggagctttcggattcgatgaaaaagaagataagagcagagtatgaagcaattggaggaagcccagataagccattacccacaaattacttcctcaacatcataattgccattggcgttttggtcctcttgtccactctctttggtggtaataacaactccgatttctctggtttctag

SEQ ID NO: 21 - DNA, 1299 bp, Glycine max
atggacaaattgtatgggttgagtcatctcttcatgacagtgtttcttcataacttctccatgttcatggtggtaccagccatcaccgatgtcacaatggctgctctttgtcccggacaagatgaatgctcacttgccatctacatcactggttttcaacaagcgatgatagggctgggcacgcttgtgatgatgccactattgggaaatctttcggataagtatgggaggaaggccatcctcacactccctatgatcctcacaatcattcccgtaggcatattagcttacagcaggacgaaaaaattcttctacgtctactatgtgtttaagatactcatttcaatggtttgcgaaggaagcgttccttgcctcgccctagcttacgtggcagataacgttccagaaagtggacgaagcactgtatttggaattctttcaggaattgggtctgccgcatttgtgtgtgccaccttatctgctcgatttttatcatcagccctaacttttcaagtttctacacttatcgcggtgattggagcactatacatgcaatttttccttcgagattcagtcattgatgacaagcacctttataccccaatcatatcacaaggaaatcccataatatctaaggtcaatggaaacttggaaagtaagaagcatcttttgaaagcattgcgctccataaaggacctaacttctttcctcaatagcagcttgaccattaatcaagcagcaattgttgctttcttcaatagccttgcagatgttggccttcatggatcattgttgtattttttaaaggctcaatttcactttgataagaatcagtttgctgacttgatggtcatttctgggattgcagggactgtgtcacagcttcttcttatgcctattttggctcctattttgggcgagacaagactactctcagttggcctattcttccattgtgtacatatgttcctttacagcatggcatggtcctccttggttccttatgcttccgccatgttctcaattttatatgttttctcacacccttgtatacgaagtattgtatctaaagaagctggtccccatgagcagggaaaggctcaaggttgcatttcaggcatatgttcaattgcacatattgtttctcccttggttttctctccattaacagctctattcctttctgaaaaggcaccttttgattttcctggattcagtataatgtgcattggatttgcttcgatgatatcttttgttcaaagtttgatgcttagagtggctcctcccattttgaattag

SEQ ID NO: 22 - DNA, 1140 bp, Cupriavidus metallidurans
atgatacgaacgaaagctctgcagagctccaatttatcaccactttgtacaagaaagctgggtctcgagttacttggccacgacgcgtgccatttccaggcacttgttcgaatagccccactcgttgtcgtaccagctcacgaccttgatgaacgtgccgtccagcgcgataccggcttcagcatcgaaaatcgaggtgcgggcatcaccgcggaagtccgtggccacaaccttgtcttcggtgtagcccagcacgcccttcagcgcgccctggctctgggccttcatctcggcgcagatttcttcgtacttggccgggttttccagttcgacggtcaggtcgaccaccgaaacgtccgaggtcggcacgcggaacgacataccggtcagcttcttgttcagctgcggaatcaccacgccaacggccttggcggcgccagtcgacgacgggatgatgttttccaggatgccacggccaccgcgccagtccttgttcgacggaccatccacggtcttctgcgtggcggtggcagcgtgcacggtcgtcatcaggccgcgcttgatgccccacttgtcgttcaggacctttgccaccggggccaggcagttggtcgtgcagcttgcgttcgagatgatcgcttcgcccttgtacgtctcgtggttcacgccgaacacgaacatcggggtgtcgtccttcgacggggccgacatgatcaccttcttggcgcccgcgtcgatgtgcttctgcgcgccttccttcgtcaggaagatgccggtcgactcgatcaccacgtcggcgccgacttcgccccacttcagctcggacggatccttgacggcggtcaggcggatcttcttgccgttgaccacgagcgtgttgccttccaccgacacttcgccgtcgaagcggccgtggaccgagtcgtacttcagcatgtacgccaggtagtccggttccagcaggtcgttgatggcgacgacttcaatgtccttgaagttcgcggcggcggcgcggaacaccatgcgcccgatgcggccaaagccgttgatgccgatcttgatggccatggtcctgcaggagcctgcttttttgtacaaacttgtgataaatcaggcgcgcccggattaattaagggttag

SEQ ID NO: 23 - DNA, 1341 bp, Zea mays
atggcggcggcggccggtgacggggccggcgaggccagggcacgggcgctgctgcagcagcaccggccgtttgcgacgccgccaggggagtaccaccacttcggcgcgccttccgccgccgccgacgagatggtggaggcggttgtcctcaggacgccattgaaacggaaacataacgacagaacagaaaatgaagctgccgaatcaaatgactggatgagccctggatatgctaatgctggcagcagcccagttcctacacccccttcagggaaaggtttaaaagcatccaccaagcctaaggctacgaagggccagaaatctggtcctcagacccctttgggttttggttctccgggcaatccttctactcctgttggtggctgccgctatgatagctccctcgggctcttgacaaagaagttcctgaacttgctaaaaggtgcacctggtggcattgttgatctgaataatgctgcagaaactctagaggtacagaaaaggcgtatatatgacatcactaatgttcttgaagggataggactgatagaaaaaaagcttaagaacaacatccgttggaaaggagttgatgactctcgacccggagaagttagtgatgatatgtcaattttacaggcagatattgatgctcttacactgcaagagcgcaatttggatgaacgaataagtgaaatgcgggacagattaagagggcttactgaagatgaaaataatcaaaagtggctttatgtcacggaagaagatatcaaatctttgccatgcttccagaatcagactctaattgctataaaagcaccgcatggcacaactttggaagtcccagatcctgatgaggttaatgattatcctcaaaggagatataggattgtcctaagaagtaccatgggtccgatagatgtgtacctagttagtcaatttgaggagatgagtggcatggagactcctccaaggcctacacagacaataagcatggattctctagagaatcctaggacgcctttggctgcggattgcaacaaagtcacagggatggaatcaaatattcacggaggactgatcctaccttctgatgcacctagtagttcacaggacatttcagggatgatgaagattgtcccttcggagcttgatgctgatacagactactggctcttatcggacaacacaggagttagcatgacgaacatgtgggagacaggaccagatgagtgggatgggattgagaaattcaacgcggaggatttcttggaagtgggcactccccagcagcaggataaaccagccgatgtcgtggatgacgacccctcctgtataatctag

SEQ ID NO: 24 - DNA, 969 bp, Zea mays
atggaggatgccgttgctatagtgccgcgattctttgacttgccactctggttgctcaccggcaatgcgatggtcgatggcctcgatcccatgacgttccgcttacctgcacatttctttggtgtctatgacggacacggtggtgcacaggtagcaaattactgtcgggaacgcctccatgtggccctactggagcagctgagcaggatagaggagactgcgtgtgcagctaacttgggagacatggagttcaagaaacagtgggaaaaggtctttgtggattcttatgctagagtggatgacgaggttgggggaaacacgatgaggggaggtggtgaagaagcaggcacaagtgatgctgctatgacactcgtgccagaacctgtggcacctgagacggtgggttcgacggcggtcgtcgctgtcatctgctcctcacatatcattgtctccaactgtggagattcacgggcagtgctctgccgaggcaagcagcctgtgcctctgtcggtggatcataaacctaacagggaggatgagtatgcaaggattgaggcagagggtggcaaggtcatacaatggaacggttatcgagttttcggtgttcttgcaatgtcgcgatcaattggtgacagatatctgaagccatggataattccagtcccagaggtaacaatagttccgcgggctaaggatgacgagtgccttattcttgccagtgacggcctctgggatgtaatgtcaaatgaagaggtatgtgaaatcgctcgcaagcggatacttctgtggcacaaaaagaacagcacaagctcatcatcagccccacgggttggtgactccgcagactcagccgctcaagcggctgctgaatgcttgtcaaagcttgctcttcagaaggggagcaaagacaacattactgtcgtggtagttgatctgaaagcacagcgcaagttcaagagcaaaacttag

SEQ ID NO: 25 - DNA, 642 bp, Zea mays
atggaggtgaagttgtggaacgacaagcgcgagcgggagctcctggagagctacgcggacctgtacgcgatcatcaaggccgtggagaagctggaacgggcctacgtccgggacctcgtctcagccgccgactacgaggcggagtgcctcaagcttatctcccagttcaactccctctcctcctcgctcgccggcgccgtcaccgtccctcgcttcgtccaggcgtaccgcctcgattgccccgccgcgctcaaccgcctcctccagtcgggcgtcccggccaccgtcgagctccgcgccgcgtccgcctcatccgcgccggccgccaccgccgcctccgcgtcagccatcgcgcactgcgtgcagaccttcatcaccgccatggacgccgtcaagctcaacatgcttgccaacgatcaggtccgccccctgctgcaggacgtcgccacatccatggccaggctcggttccttgctgccgcccgactttgaggggaaggtcaaggttaacgagtggcttgccaagctgcataaaatgggcgccgcggatgaactcaccgagcagcaggccaggcagctcaacttcgacctcgactcggcctacagtgcctttttggctgcgctgcccgccgctggtctgtag

SEQ ID NO: 26 - DNA, 1188 bp, Zea mays
atggccggagtcaccgccaccgggatggccggagttcccgccaccttctcctcagccaccgctcagatcgggggcttcctctcgaagaagccttacgcgccgccgttgtgggccacgcacctctcccccatgccttgccataccttctcgctcggccatttcccaacaccgattcacaagtggaatctgcccaatttgccggaaggaacggaagtgtggatcaagcgagacgatttatcaggcatgcagttgagtggaaacaaggtccggaagctggagttcttgatggcagatgctgtagcacaaggcgcagactgcgttattactgttgggggtatacagagtaaccactgccgtgccacagccgtggctgctaagtatctcaatcttgattgctacctgatactacgtacctccaagcttcttgtggataaggaccctggtttggttggcaatcttcttgtcgagagactagttggggcacacgttgatcttgtgtcaaaagaagaatatggaaaaattggcagtgtggctttagctgacctgctgaaaaaaaggcttctggaagaagggaggaagccgtatgtgattcctgttggtggatcaaactcattgggaacttggggatatattgaggcaataagggagattgagcagcaaattcagcaatctgctgatgttcagtttgatgatattgttgttgcatgtggcagtggtggaaccatcgctggccttgctttaggatccagattgagcagcttaaatacaaaagttcatgcattctctgtttgtgatgaccctgaatacttctatgactatgtccaaggcctgattgatggacttaattctggtttggattcacatgatatagttagcatcgaaaatgctaaggggttaggctatgccatgaacacagctgaggagcttaagtttgtcaaagacatagctgcatcaacaggcattatccttgatccagtctacagtgggaaggcggtttatggtttgctaaaagacatggctggcaatccagccaaatggaaaggtcgaaaagttctgtttatccacacaggtggtcttcttgggttgtatgataaggctgaccagttgtcatctttggctgggagctggcgcagaatggatcttgaagattctgttccacgcaaagatggcactggtaagatgttctag

SEQ ID NO: 27 - DNA, 1398 bp, Arabidopsis thaliana
atgggcataatgatgatgattttgggtcttcttgtgatcattgtttgtttatgtactgctcttctccgatggaaccagatgcgatattctaagaaaggtcttcctcctggaaccatgggctggccaatatttggtgaaacgactgagtttcttaaacaaggaccagatttcatgaaaaaccaaagactaagatatgggagtttcttcaagtctcacattcttggttgcccaacaatagtctcaatggacgcagagttaaacagatacattctaatgaatgaatcgaaaggacttgttgccggttacccgcaatctatgcttgatattctagggacatgcaacatagctgcggttcatggcccgagccaccggctaatgagaggctcgttgctttctttaataagcccaaccatgatgaaagaccatctcttgcctaagattgatgatttcatgagaaactatctttgtggttgggatgatcttgagacagttgatatccaagaaaagaccaaacatatggcatttttatcatcgttgttacaaatagctgagactttgaaaaaaccagaggttgaagaatatagaacagagtttttcaagcttgttgtgggaactctatcggtcccgatcgatatcccgggaacgaattaccgcagtggagtccaagcaagaaacaacatcgataggttattgacagaactgatgcaagaaagaaaagagtctggagaaactttcacagacatgttgggttacttgatgaagaaggaagataaccgatacttgttaaccgataaagagataagagatcaagtggtaacgatcttgtattccggttatgagactgtctctacaacctccatgatggctcttaagtatctccatgatcatccaaaagctcttgaagaactcagaagagaacatttggctataagggagagaaaacgacctgacgaaccgctcactctcgacgatattaaatcgatgaaattcactcgagctgtgatctttgagacatcaagattggcaacgattgttaatggtgtccttaggaaaactactcacgacttagaactcaacggttatttaatcccaaaaggttggagaatttacgtatacacaagagagattaactatgatacatctctttatgaagatccaatgatctttaacccatggagatggatggaaaagagcttagaatcaaagagctatttcttactctttggaggtggagttaggctttgccctggaaaggaactaggaatctcggaagtctcaagcttccttcactactttgttacaaaatatagatgggaagagaatggagaagacaaattaatggtctttccaagagtttctgcaccaaaaggataccatcttaagtgttcaccttactag

SEQ ID NO: 28 - DNA, 2991 bp, Arabidopsis thaliana
atggaaccaacagaaaaaccatcgaccaaaccatcttctcggactctacctagagacactcgtggctctctcgaagtattcaacccgtcaactcagctgacccgacccgataacccggtgttccgtcctgaaccaccagcgtggcaaaacttgagtgatccacgtggcaccagtcctcaaccccgaccacaacaagaaccagctccatccaaccctgttcggtctgatcaagaaatcgctgtcacgacctcatggatggctctgaaagacccatcaccggagacaatctccaagaagacgatcaccgccgagaaaccacagaagtcggcggtggcggctgagcagagagcggcagagtggggattggttttgaagaccgatacaaagacgggaaagccacaaggagtaggcgtgaggaactctggtggaactgagaatgatcctaacgggaaaaagactacatcgcagagaaactcgcaaaactcttgccggagctccggtgagatgtcggacggagatgttcccggcgggaggagtgggattccaagagtatcggaagatctaaaagatgcgttgtcgacgtttcaacaaacgtttgtggtctcagatgctacaaaacctgattatccgattatgtatgcaagtgctggtttcttcaatatgactggttacacttccaaagaagtcgtcggcagaaactgccgatttttacaaggatcaggtacagatgcagatgagttagcaaagataagagagacattagctgctggtaacaattattgtgggcgtatattgaattacaagaaagatgggacctctttttggaatcttctcacgattgctcccattaaagacgagagtggcaaagtcctcaaatttatcggaatgcaagtggaggtgagcaagcacactgaaggggccaaagaaaaggctttgaggcccaatgggcttccggaatctctgattcgatacgatgcccgccaaaaagatatggcgacaaactcagtgacagagctagtagaggcggtgaagagacctcgggcactaagcgaatcgacgaatctccatcccttcatgacaaaatcggagagcgatgaacttccgaaaaaaccagctcggcgaatgtccgaaaatgttgttccgtcaggccgaagaaactctggcggcggaagaagaaactcgatgcagcgaatcaacgaaattcccgagaaaaaatctagaaaatcttccctttccttcatggggatcaagaagaagagcgaatctttggatgaatctatagacgatggatttatagagtatggagaagaagacgatgagattagtgatagggacgagagacctgagagtgtggatgataaagtgagacaaaaggaaatgagaaagggtattgatctagctactacactcgaacgtatcgagaagaatttcgtcatcactgatcctaggcttcccgataatcccattatttttgcatctgatagtttcttggagctcacggaatatagccgtgaagaaattcttggaagaaattgcaggtttctacaaggtccagagactgatctaaccacagtgaagaagattcgaaatgctattgataaccaaaccgaagtgacagttcagctcatcaactacaccaagagcggaaagaagttctggaacattttccacttgcaacctatgcgtgatcagaagggagaagtacaatactttattggagttcaactagacgggagcaagcacgtagaaccagttcgcaatgtcattgaagaaaccgcagtgaaagagggagaagacctggtgaaaaaaacagctgtgaatatcgatgaagcggttcgagaacttcctgatgccaacatgacaccagaggatttatgggcaaaccactcaaaggttgttcattgtaagcctcacaggaaagattcaccaccatggatagctatccaaaaggtgttggaaagtggtgaaccgattggtttgaagcatttcaaaccggtgaaacctttgggttctggtgacacaggaagtgtgcatctagtggaactcgttggaacagatcagttgtttgcaatgaaagcaatggacaaggctgttatgcttaaccgaaacaaagtacatagagctagagctgagagagagatcctagatttgcttgaccatccttttcttcctgcactctacgcttcttttcagacaaaaacacatatatgtcttataacagattactatccaggaggagaactcttcatgctcctagatcgacaacctaggaaggttctcaaagaagatgctgtaagattctatgctgctcaagttgtcgttgcactcgagtatcttcactgtcaaggaataatttaccgagacttgaaaccggaaaacgttttaatccaaggcaatggcgatatctctttgtcggattttgatctgtcttgcttgacatcttgcaaacctcagctgttgattccgagtatagacgagaagaagaagaaaaagcaacaaaagagtcaacaaactccaatcttcatggctgaaccaatgcgtgcatcaaactcatttgttggcactgaagagtacattgctccggaaattatatccggagcaggacatacgagtgcagtagactggtgggctcttggtatacttatgtatgaaatgttatacggatacactccttttagaggaaaaacaagacagaagactttcaccaatgttcttcaaaaagatctcaagtttccagctagcattcctgcaagtcttcaagtgaaacagctgatttttaggctgttacaacgagatccgaagaaaagactaggttgttttgaaggagcaaatgaagtcaagcaacattctttcttcaaaggcataaattgggctctgattcgatgcacgaaccctccagagctcgagactccgatattttctggtgaagctgaaaacggagagaaagttgttgatcctgagctagaagatctgcaaacaaatgttttttag

SEQ ID NO: 29 - DNA, 1227 bp, Arabidopsis thaliana
atggggaagaagaaagggaaagcgatcatagtaggaggaagtatagcaggcttatcttgcgcacactcgctcacgttagcatgctgggatgttttggttctcgagaaatcttccgaacctcctgttgggagtcctactggtgctgggctcggactcgaccctcaggctcggcagatcatcaaatcatggcttactactccacagctcttagatgaaatcaccttgcctctctcgattgatcagaatcagacaactgatagtgagaagaaagtgacaaggattttaacaagagatgaggattttgatttccgagcagcttattggtcagatattcaatctcttctgtataacgcattgcctcagaccatgtttctttggggacataagtttctgtctttcacaatgtcacaagatgaatctaatgtaaaggttaagactttagttgtggaaactcaagaaactgttgaaattgaaggagacttacttattgcagctgatgggtgtttgtcttcgattcggaaaactttcttgcctgactttaaactgaggtactctggttattgtgcttggagaggtgtatttgatttctcagggaatgagaactcggaaacagttagtgggattaagaaagtgtatccggatcttggaaaatgcttgtattttgatctcggtgaacagactcatagcgtgttttacgagctttttaacaagaaactcaactggatttggtatgtcaatcaaccagagcctgacctgaaaagcaactctgttactctaaaagtgagtcaagaaatgatcaataagatgcatcaagaagcagaaaccatttggatccccgaactagcgagactcatgagtgaaacaaaggatcctttccttaatgttatttacgactctgaccctttagaacgaatcttttggggaaacatcgtgttggttggagacgcggctcatcccacgacccctcatggtctaagaagcacaaacatgtcgatacttgatgcggaagtgctaggcaaatgcttagagaactgtggacctgagaatgtaagtttgggtcttgaggaatatcagagaataagattgcctgttgtttctgagcaagttttgtatgcaaggcgtttggggcgtatcaagcaaggtctggatcatgacggaattggagatggcgtttttggtttggagcagagaaacatgccattcttttcctgtgctccccttatctag

SEQ ID NO: 30 - DNA, 2160 bp, Arabidopsis thaliana
atgatccttctctcacttcttctccatcttcttcttcatctcctcaacacttctccttctctttctctttcccccgacggtatcgctttactctcactcaaatccgccgtcgatcactcctcctcctccgctttctccgattggaacgataacgacaccgatccttgtcattggtccggaatctcctgtatgaacatctcagactcttctacctctcgcgtcgttggaatttccctcgccggaaaacatctccgtggctacatcccctcagagcttggctcacttatttacctccgtcgtcttaacctccacaacaacgaactttacggttcaattcctactcaattattcaacgcgacgtcgcttcatagtatcttcttatacggtaacaatctctccggtactcttcctccttcgatctgtaaactcccaaagcttcagaatctcgatttgtctatgaattcgctctctggaactctttcaccggatctcaacaagtgtaaacagcttcaacggttgatcctctccgctaacaacttttccggtgagattcctggtgatatctggccggaattgactaatttagctcagcttgatctctctgctaacgaattttccggcgaaatccctaaggatatcggagagcttaagtctctctctggtactttgaatctctcctttaaccatttatccggccaaatccctaattccttaggaaatctaccggtgacagtctctcttgatctccggaacaacgatttctccggcgagattcctcaatctggttcgttctctaaccaggggccaaccgcatttctcaataatccgaaactgtgtggtttccctctccagaaaacttgtaaagacactgatgagaactctccggggactcgaaagtcgcccgagaataatgcggattctagaagagggttaagtactggattaatagtgttgatctcggtggcagatgcagcaagtgtagcttttattggtttagtgttagtttacttgtactggaagaaaaaagactctgagggagggtgtagctgcacagggaatgcgaaactcggtggtggttcggtgaaggggaaatcgtgttgttgtatcacggggtttccgaaagaggatgattcggaagcggaaggtaatgagagaggagaagggaaaggagatggagagcttgtagcgattgataaagggttttcttttgagcttgatgagttgttgagagcttctgcatatgttttggggaagagtgggttagggatagtgtataaagtggtgttagggaatggagttccggtggcggtgcggcgacttggggaaggaggggaacagaggtataaagagtttgttacggaggttcaagctatggggaaagtgaaacatcctaatgtggtgaagttaagagcttattattgggctcctgatgagaagcttttgattagtgacttcgttaacaatggaagtttagctgatgctcttagagggaggaatggtcaaccatcaccgagcttaacatggtcaacgcgtataaagatcgcaaaaggagctgcgcgtgggttagcttatctacacgagtgtagtccaaggaagttggtacatggcgacgttaagccttccaacattcttcttgattcctccttcactccttacatctctgacttcggtctcacacgtctcattaccatcactgccgcttctgcctcttctaacgaaccttcctcctcctctgctgcgggtggtttcttaggtggagctcttccttacacttccatcaaaccctcagatagatccaacggctataaagcccccgaggcccggctccctggagggaggcctactcagaaatgggacgtatactccttcggtgttgtgcttatggagcttctcaccgggaaatcgccggattcttctccgttaagctcttcctcgacgtctacggtggttgttgaggtgccggatttggtgaagtgggtgaggaaagggtttgaagaggagactccattgtcggacatggttgatccaatgttacttcaagaagttcacgccaagcaacaagtcttgtccgtttttcatctagctctcgcttgtaccgaaggtgaccctgaagtccgtccacgtatgaagaacgtctctgagaacatcgacaaaatctag

SEQ ID NO: 31 - DNA, 1353 bp, Glycine max
atgggcaagactcctttctcctttcgtcgctccgcctctcgccgccgccccaagaagaccgccgccccgccccctcctccctctccgccgcaacatccctacgcggccggattcgccgcctcacccgacgacaacaaccgtctcatcgccgccgccgccggcagcagcgccttgacgaaggcgaagaagaagaccggcaacgtccgcttgtggatgaggtttgaccggtccggccggtcagaactggtggagttggagaagaacgccatcgtccgccacgcagcgattcccgctagagacttgcgaattttgggccccgtcttctcccactcctccaacatcctcgctagagagaaagcaatggtggttaatttggagtttataaaggcaattgtgactgctgaagaagtgttattgcttgatcctcttcggcaggaggttcttccctttgttgagcaactcaggcaacagcttcctggcaaaagtcaacctaaacttctcggcggcacggaagagcaggaaggcgaaatgcatgtctctaatggaagacaatggttgcctacaccggaggcagccgatggtttgcagtctgagcttccgtttgagtttcaagttctggagattgctttggaggctgtgtgcacttatctggactcgaatgtggcggaccttgagcgaggtgcttaccctgtgttggatgaattggctaggaatgttagcaccaagaatcttgagcatgtgcggagtttaaagagtaatcttacgcggttgctggcacgagtgcagaaggtgcgagatgaaattgaacatctgttagatgacaatgaagatatggcacaactatatttgacaaggaagtggttgcagaatcaacaatttgaggaggctcatttgggtgccacaacctcaaataactttcctaatacctcacgttctgttcgtcaacttggttctatcagaagtgaaagtcttgtgaccagccattatgaggatgataacaatgtggaggacttggagatgttgcttgatgcatatttcatgcagttggatggaactcgtaacaaaatattatcagttagggagtatattgacgacactgaagactatgtcaacatccaacttgataaccaccgaaatgaacttattcagctgcagttgacgttgactattgcatcatttgctattgctattgaaactttgattgctggtgcatttggtatgaacattccttgtaacttatataacattgatggagtattttggcccttcgtttggaccacgtctgcggcttgcgtattacttttcttgcttattttagcatatgcaagatggaagaagttgctgggatcatag

SEQ ID NO: 32 - DNA, 570 bp, Arabidopsis thaliana
atgcttaaagctaccggcacagtggctccggctatgcacgtggtgtttccctgtttttcgagtcgaccgcttatcctacctctccggagcacaaagaccttcaaacctctctcatgtttcaaacagcaaggaggcaaaggaatgaatggagtccatgagattgaacttaaagttcgtgattatgaattagaccaatttggtgttgtgaacaacgctgtttatgcaaactactgccaacacggtcaacacgagtttatggagactatcggtatcaactgtgatgaagtgtcccgttctggtgaagcattggcagtttctgaattgacaataaagtttcttgcacctttacgtagtggatgcaagtttgtggtgaaaacgaggatatcggggacatctatgacgcgcatttactttgaacagttcatctttaaacttccaaatcaagagcctattttggaggcaaaaggaatggctgtgtggcttgacaagaggtaccgtcctgtttgtatcccgtcttacatacgctctaatttcggtcacttccaacgtcaacacgttgtcgaatattag

SEQ ID NO: 33 - DNA, 1434 bp, Arabidopsis thaliana
atggacaacattgccgcgcagttgaagcgtgggatatcgagacaattctcgacaggatcaatgagacgaacattaagccgacaattcacgcgccaaaattctctcgatccacggcgtaacaacatgagattcagcttcggtcgtcaatcttcgcttgatccgatcagacgtagtcctgagtctcttagctgcgagccgcatatgtctgtccccgagaatcttgattcgacgatacagcttctctttatggcgagtaaaggtgatgttaatggcgttgaggagctgcttaatgaaggaatagatgtgaatagcattgatcttgatggtcgtactgctcttcacattgcttcctgtgaaggtcattatgatgttgttaaggttcttcttagccggagagctaatatcgatgctcgtgatcgttggggtagtacggcggctgttgatgcaaagtattatgggaatgttgaagtttataatctcttgaaagctcgaggcgctaaagctccgaaaactagaaagactccaatgacggtagggaatccaaaagaagttcctgagtatgagcttaatccactcgagctgcaagtccgaaaagttgatggcatttcaaagggaacttatcaagttgctaaatggaatggcacgcgagtctcattaaaaatattcgataaagatagctattcagatcctgaacgagtaaatgctttcacaaacgaattgactttgctagcaaaagctcggcatccaaatattgttcaatttgttggagccgtcactcaaaatctaccgatgatgattgtagttgagtgtaatccaaaaggtgatctaagtgtctatcttcaaaagaaaggtcgtctttctccttcaaaagctctgagatttgctcttgatattgctagaggaatgaactacctccatgaatgtaaaccagatccgatcatccactgcgagttaatgccaaaaaatattttgctagatagaggagggcaattgaagatctctggttttggtttgataaagttgtcaaagattggagaagacagtgcaaaagtagtgaaccacgaagctcaaatcgataagtcaaattactatatagcacccgaaatttacaaagatgaagtcttcgataaaagggctgatgtgcattcgtttggtgtcattttgtacgagttgaccgagggagtatctttattccatcctaaaccacctgaagaggttgcagaatcgatttgtatagaaggtaaaagaccaacaatcagaacaaagtcaaagagttaccctccggaattgaaagagttgattgaggaatgctggcatccagaaatcagtgtgaggccaatattctctgagattattattcggctcgacaagatagttacaaactgttccaagcagggttggtggaaagacacatttaagttcccttggaaatag

SEQ ID NO: 34 - DNA, 1137 bp, Arabidopsis thaliana
atggcagtggtggatgttcatcgtttcgctgagtcaatcacttgccatgcttggagtcctgatctctccatggttgctctctgtcctaacaacactgaagttcatatctataaatcattgtctcaagaccactgggagaggttacatgtcctccaaaagcatgaccaaattgtttctggaatagattggagctcaaagtccaacaaaatcgtcactgtttctcatgacaggaactcgtacgtctggagcctggaaggagctgaatgggtaccaactctcgttattcttagactaaatcgtgctgcactttgtgtccaatggagccccaaagagaacaagtttgctgttggaagtggtgctaaaactgtttgtatttgctattatgagcaagagaataactggtgggtcagtaagctaatccggaaaaggcacgaatcttcagtcacatctgttgcttggcatcctaataatgttcttctggcaacgacatcaacagatggaaaatgtcgggtattttcaacatttatcaaaggagttgacacaaaggattcaaaagcaggctcaccagcggaaacgaaatttggggagcaaattcttcagcttgatctctcatattcttgggcatttggtgttaaatggtctccaagtggaaacaccttagcttatgtaggtcatagctccatgatttactttgttgatgatgttggtccttctcctttagcccaaagcgttgcatttcgagatttgcctcttcgtgatgtcctgtttatttctgagaaaatggtgataggcgtgggatatgacagcaacccgatggtatttgcctcagatgatactggaatatggagctttatcagatacatcggagagaagaaagcagcatcttcaaattccagttacagttcgcagttttctgaagcatttggaaaattctacggcagtcaatcaaagtccacaacagccaacgatgcttctgaatcacgtggaggtgttcatgataactgcataaattccattgtgtctctgagcaaagcagggagtcctaaagtaatgcgattcagcacttcaggattggatggcaaagttgccatatgggatctggagaacatggaacaagaacttggcaatcagttttag

SEQ ID NO: 35 - DNA, 1590 bp, Arabidopsis thaliana
atggctgcgtctcccaagataggcatcggtattgcctccgtctcatcgcctcaccgtgtctccgccgcctcatccgctctttctcctcctcctcatctcttctttctcactactactactaccacacgtcacggcggctcctatctcctccgtcaaccaacccgaactcgctcttctgattccctccgcctcagagtctccgccaccgccaattctccgtcttcttcttcttcaggaggcgagattatcgagaatgtagtgattataggctccggtcccgccggttatacggcggcgatatatgcagcgcgcgccaatttgaagccggtggtttttgaagggtatcagatgggcggagttcccggtggacagttgatgacaactactgaagttgagaattttccgggattcccagacggtatcacgggtcccgatttaatggagaaaatgagaaagcaagcagagaggtggggagcagagttgtatccagaagatgttgaatctcttagtgtcacaactgctccttttactgtgcaaactagtgaacgtaaggtcaagtgccatagtattatatatgccactggcgctacagcaaggaggttaaggttacctcgagaggaagaattctggagtagggggataagtgcttgtgctatctgtgatggagcttcgcctttatttaaggggcaagtacttgccgtggttggaggaggagatacggctacagaggaagccttgtatctcacgaaatatgcccgtcatgttcatttgcttgttcgcagagatcagttgagagcttccaaggctatgcaagatagagtgatcaacaatccaaacatcacagtgcattacaacacggaaaccgtggacgtattgagcaacaccaagggacagatgtctggcattctactcagaagacttgatacgggtgaagaaactgagctggaggcaaaaggattgttttatggaatagggcattcgccaaacagtcagttattggaaggccaagtcgaactcgacagctccgggtacgtcttggttcgggaaggaacatcaaatacatcagttgaaggtgtatttgctgcaggagatgtgcaggaccacgaatggagacaagctgtaactgctgctggatcaggatgcatagctgctttgtcagccgagagatacctcacaagtaacaatcttcttgttgaatttcaccagcctcaaactgaagaggccaagaaagaattcacacaacgggatgtccaagaaaagtttgacatcactcttacaaagcacaagggacagtatgctcttagaaaactataccatgagagtccaagagttatattggtactatacacttcaccaacatgtggcccctgtaggactctgaagcctattttgaacaaggtggtcgatgagtataaccatgatgtgcattttgttgagattgacatcgaggaagatcaagaaattgctgaagcagctggaattatgggaaccccatgtgtgcagttcttcaagaacaaggaaatgctcaggactatatcgggtgtgaagatgaagaaagagtaccgagaattcattgaggccaataaatag

SEQ ID NO: 36 - DNA, 690 bp, Zea mays
atggatccggactcggtgaagtcgacgctctctaacctggccttcggcaacgtcatcgccgccgccgcccgcgacctccaaaaagaaatggtggctaaagacaaggctcaagcagcacctgcaagccatgatgaagttgatcttgatgagctgttggatgacccagaacttgagaagttgcacgcagagagaattgctgcccttaagaaagaagttgagaagcgtgaagtgctaaaaaggcaaggtcatggtgaatacagggagataactgaaggggacttcctcggggaggttactggcagtgaaaaagtcatatgccatttttaccaccgtgaattttaccgttgcaagatcatggataagcatttgaaggcccttgctccagtctacgtgggaacaaaattcgtcaagcttgatgctgaaaatgctccattctttgtggccaaactggcaatcaaaaccttgccatgtgtaatattgttcaagaagggtattgctgttgaccgattagttgggtttcaagatctcagaagtaaagacgattttccgacaagagcgttggaaaatattctcaagacgaaagggataatcgatgagaagaagaaagatgacgacgatgacgatgaagaaagcgaggctaagaataggagggttaggtcctcaactgctcaagactcagactcagactag

SEQ ID NO: 37 - DNA, 876 bp, Zea mays
atggcttcatcggtggccgccgcggcgagcacattcctgggcacccgcctggcggacccggcgccacagaacgggcgcatcgtggcccggttcgggttcgggttgggcggcaaggcgaagcctgctccgaagaaggtggcgaagacatcgacctcctctgaccggccgctgtggttccccggcgccgtggcgcccgactacctggacggctcgctggtcggcgactacgggttcgacccgttcggtctcgggaagcccgtggagtacctgcagttcgagttggactcgctggaccagaacctggccaagaatgaggccggcggcatcatcggcacccggttcgagtcctccgaagtcaagttcaccccgttgcagccctacagcgaggtgttcggcctccagcggttccgcgagtgcgagctcatccacggccgctgggccatgctcgccaccctcggcgccctctccgtcgagtggctcaccggcgtcacctggcaggacgccggcaaggtggagctggtggacgggtcctcctacctgggccagccgctgccgttctccatctcgacgctcatctggatcgaggtgctcgtgatcggctacatcgagttccagcgcaacgccgagctcgacccggagaagaggctgtaccccggcggctcctacttcgacccgctcggcctggcggccgaccctgagaagaaggagcggctgcagctggcggagatcaagcacgcgcggctcgccatggtcgccttcctcggcttcgccgtgcaggccgccgccaccggcaaggggccgctcaacaactgggccacccacctgagcgacccgctccacaccaccatcttcgacacgttcggagggtcctcttag

SEQ ID NO: 38 - DNA, 1209 bp, Zea mays
atggataatgccttgaggatcacggatgcaagttcacgtcgtccaaccaatcttggcaaagatttggctatgactgaaccagcagctgatagaaaatgccaatctttagtgatggaaaataatgctgtcaaagaaaagaaccctggtgaaaagtcgaagagtgctgtaataggtcatgctgattcttacccctcccaatttctcgagaccaacttgggaaaacaacagtatcgtaatggttacaagaatcaagaattcagggaaaaagatatctttaatcactcgaattcttctgccttctcgagatatggcaatagaaggatagaatcatcaggtgagatacagtttcttccttctcgttgcattgttgggcaagagcagcatgttcatggcaaggacccagttttccaacccaatggggtcttgctgcctcccaatgaccataatacaggtgagagtacaaggcaagctcgaattactctggacagtagcatggagggtgctgacatcatttgctccagtagtgctagggaagatgctggtgcaagtagttcttcccatagaaaggacagtatgagccatccctcatatgggtttgtacctgttccaattcctgtcggtgccatgatgccctatcattgtggtgcaattctgcagccagtatactacccacagggtccacttatgcactgtaattcatctgcaatcaacaaggcaacaattcatcaaacctctggccaatctaactaccgtgaagattgtggtagtggtagaccatctcaggttgatgaacacaaacagtcagaggaaaagcaccagttgcatcattcaagacaaattcatcgggaatcaggacaaccagttgacatggttagagctcacatggatcatgctaaccagagtgcaagctgcagccgggatatctgtaaaggaagcggatgcacgggtagcggtgaagccgataccaatgcgaacacgacggttgccctagagagtggcaacgagagtggcatccaaaatagtgacaggtctcaccgagaagctgctttgatgaagttccgcatgaaaaggaaagacagatgcttcgataaaaaggtcaggtatcatagcaggaagaagcttgcggagcagaggccaagagttaaggggcagtttgtaagccagaagctgaaagcagctatggcaacggaagccgaaactgactcgtag

SEQ ID NO: 39 - DNA, 1723 bp, Zea mays
atgggcgccatgatggcctccataaccagcgagctcctcttcttccttcccttcatcctgctggccctcctcgccttgtacaccaccaccgtcgccaaatgccacggcacccacccgtggcgccgtcagaagaagaagcggcccaacctgcccccgggcgcccgcggatggcccttggtcggcgaaactttcggctacctccgcgcccacccggccacctccgtgggccgcttcatggagcggcatgtcgcacggtacgggaagatataccggtcgagcctgttcggggagcggacggtggtgtcggcggacgcggggctgaaccgctacatcctgcagaacgaggggcggctgttcgagtgcagctacccgcgcagcatcggcggcatcctgggcaagtggtccatgctggtgctcgtgggcgacgcgcaccgcgagatgcgcgctatctcgctcaacttcctcagctccgtccgcctccgcgccgtgctgctccccgaggtggagcgccacaccctgctggtcctccgctcgtggccgccctccgacggcaccttctccgcccagcacgaagccaagaaggtacggtactcatcaccatccttcttctgacccttcaatttgtctccacgcgtagtacgtacgtgccacatcagatcagttctatctatatatgtggctgaatctatgcaaaggatcgccgctaacaaccggtgccccggccgggataacaaccggtgatgggcgcgcggccggccggatgacgagtgcagttcacgtttaacctgatggcgaagaacataatgagcatggaccccggcgaggaggagacggagcggctgcggctggagtacatcaccttcatgaagggcgtcgtgtcagcgccgctcaacttcccgggcacggcctactggaaggcgctcaagtcgcgcgcgtccatacttggagtgatagagaggaagatggaggacaggcttgagaagatgagcagggagaagtcaagcgtggaggaggacgaccttcttggatgggccctgaagcaatccaacctgtccaaggaacagatcctggacctcttgctgagcctgctcttcgcggggcacgagacttcgtccatggcgctcgccctcgccatcttcttcctcgaagggtgccctaaggccgtgcaagaactccgggaggagcatctcctgattgctaggagacaaaggctaaggggggcgtccaaattgagctgggaagactacaaggaaatggttttcacgcagtgtgttataaacgagacattgcggctcggcaacgtggtcaggttcctgcaccggaaggtcatccgagatgtacactacaatgggtacgacataccgcgggggtggaaaatcctgccggttctagcggcggtgcacctggactcgtcgctgtacgaggaccccagccggttcaacccttggagatggaagctgcagagcaacaacgcgccaagcagcttcatgccgtacggcggcgggccgcggctgtgcgccgggtcggagctggccaagctggagatggccatcttcctgcaccacctggtgctcaacttccggtgggagctggcggagccggaccaggccttcgtctaccctttcgtcgacttccccaagggcctcccgatcagggtccagcgggtcgccgacgaccaaggccatcgtagcgttttgaccgagagcacaagaggctagatcgc

SEQ ID NO: 40 - DNA, 777 bp, Arabidopsis thaliana
atgcaggtcctcgtcgtctctcctccgctcatcgccgccgcatctctctctaaacctctcaattctctctctaaagccgcactctctttctccagagccaaacccatttgtcctttccctcaaacctctcgacgaccaatctccgtatacaaatccccaatgaacaaccttttcaacagactcggattcgggtctcgtcctcaagcccaagctgacccatcttccgccgcaatcgcccaaggacccgacgatgatgttccgtcttcaggtcagcaattcgcgcaatttggcgccggttgtttctggggagtggagctagcttaccagagagttcctggtgtgaccaagaccgaggttgggtatagccatggcatcgtgcacaatccgagttacgaggatgtctgtactggcactacgggacataacgaggttgttagagttcagtatgatcccaaagagtgtagctttgagagcttgcttgatgttttctggaatcgtcatgatccaaccaccttgaatcgtcagggtggggatgtgggaacgcagtatcgatcaggtatatactactacacagacgagcaagagcgcatagctcgtgaagctgttgagaaacagcagaagatattgaacaagaggattgtcacagagatacttcccgctacgaaattctacagagcagaaaattaccaccagcaatacctggcaaaagggggtcgcatgggtttaagacaatcagctgagaaaggttgcaaggatccaatccgatgctatggctag

SEQ ID NO: 41 - DNA, 1020 bp, Arabidopsis thaliana
atgggtgaagccgtagaggtcatgttcggaaatgggttcccggagattcacaaagccacatcacccactcaaaccctccactctaaccagcaagactgccattggtatgaagaaaccatcgatgatgatctcaagtggtcttttgccctcaacagtgttctccatcaaggaactagtgagtaccaagatattgctctgttggacaccaaacgttttggaaaggtgcttgtgattgatgggaaaatgcaaagtgctgagagagatgagtttatctaccatgaatgtttgatccatcccgctctccttttccatcccaaccccaagactgtgtttataatgggaggaggtgaaggctctgctgcaagagaaatactaaaacacacgacgatcgagaaagttgttatgtgtgatattgatcaggaagttgttgatttttgcagaagatttctgaccgttaacagcgatgctttctgtaacaaaaagcttgaacttgtgatcaaagatgcaaaggctgaattagagaaaagggaagagaagtttgatatcatagtgggagatttagctgatccagtggaaggtggaccttgttatcagctctacaccaaatccttctaccaaaacattctcaaacccaagcttagccctaatggcatttttgtcacccaggctggaccagcaggaatattcactcataaggaagtcttcacatcaatctacaacaccatgaagcaagtcttcaagtacgtgaaggcttacacagcacatgtgccatcatttgcggacacatggggatgggtgatggcatcggaccacgagtttgacgttgaagttgatgaaatggatcgaagaatcgaagagagagttaacggagaattgatgtatctaaacgctccttctttcgtctctgctgctactctcaacaaaaccatctctctcgcgctagagaaggagactgaagtttatagtgaagagaatgcgagattcattcatggtcatggtgtggcgtaccggcatatttag

SEQ ID NO: 42 - DNA, 1050 bp, Zea mays
atgggcggcctcattatggaccaggccttcgtgcaggcccccgagcaccgccccaagcccatcgtcaccgaggccaccggcatccctctcatcgacctctcgcctctgtccgccagcggcggcgccgtggacgcgctggccgctgaggtgggcgcggcgagccgggactggggcttcttcgtggtcgtgggccacggcgtgcccgcagagaccgtggcgcgcgcgacggaggcgcagcgcgcgttcttcgcgctgccggcagagcggaaggcctccgtgcggaggaacgaggcggagccgctcgggtactacgagtcggagcacaccaagaacgtgagggactggaaggaggtgtacgacctcgcgccgcgcgagccgccgccgccggcagccgtggccgacggcgagctcgtgttcgagaacaagtggccccaggatctgccgggcttcagagaggcgctggaggagtacgcgaaagcgatggaagagctggcgttcaagctgctggagctgatcgcccggagcctgaagctgaggcccgaccggctgcacggcttcttcaaggaccagacgaccttcatccggctgaaccactaccctccatgcccgagccccgacctggccctcggcgtgggacggcacaaggacgccggcgccctgaccatcctgtaccaggacgacgtcggcgggctcgacgtccggcggcgctccgacggcgagtgggtccgcgtcaggcccgtgcccgactctttcatcatcaacgtcggcgacctcatccaggtgtggagcaacgacaggtacgagagcgcggagcaccgggtgtcagtgaactcggcgagagagaggttctccatgccctacttcttcaacccggcgacctacaccatggtggagccggtggaggagctggtgagcgaggacgatccgcccaggtacgacgcctacaactggggcgacttcttcagcaccaggaagaacagcaacttcaagaagctcaacgtggagaacattcagatcgcgcatttcaagaagagcctcgtcctcgcctag

SEQ ID NO: 43 - DNA, 957 bp, Zea mays
atggaagccgaggcggcggccaagaggacgcgggagagcggggaggacgccgccgcggcggggatctccgccgtcatcccgggatggttctccgagatcagccccatgtggcccggtgaggcgcactctttgaaggtggagaaggtgctgttccaagggaagtcagactaccaaaacgttatggtctttcagtcctctacgtacgggaaggtgctcgtccttgatggagttattcaggttacggagagggatgagtgtgcgtaccaagagatgatcactcacctgcccctttgctccatcaaagatcccaagaaggtgttggttattggagggggtgatggtggtgttctgcgtgaggtttcacggcattcctctgtggaacaaattgacatctgtgaaattgacaagatggtggtagatgtatccaaacaatttttccctcatttagctgttggatttgaagaccctcgtgtgtcattacacattggagatggggttgcctttttgaaaaatgctccagaaggtacttatgacgcagtaattgtggactcatctgatccgataggtcctgctcaagagctttttgagaagcctttcttccagttggtggccagagctttgcgtccaggtggagttgtatgcacccaagcagagagcatatggctacatatgcacattattgaagatattgttgtcaattgtcgacaagttttcaaaggctcggttaactatgcttggacaacggtgcctacataccctagcggagttattgggttcatgctttgctccaccgaagggcctgctgttgatttccagcaccctgttttcaacatcgaggaggatgaacatcctatgaaatcaaaaggaccccttaagttctacaactcggagatccacacggcatcattctgtttgccttcttttgcaaagagggtaatcgagtcaaaagcgaactag

SEQ ID NO: 44 - DNA, 489 bp, Arabidopsis thaliana
atgagctccttcaccaccaccaacactccgccaccgtatctcctccggaaaatttatcatcgccgtgtaaaccaaccgttctccgtcgtatgttgcaccggagaaccccaacaagacatcttcacccgccggagaaccttgacttcactaataacattcacggtcatcggcggtgctacgtcatcagcattagcacaggagaaatgggggacaaggtcattcataaaggagaaatattttatgccgggactatcacctgaggatgcggcggcgcgtataaaacagacggctgaaggattaagagacatgagggagatgttggaccacatgtcgtggaggtacgttatattctacataagattgaaacaggcttatctgtctcaggatctcaccaacgccatgaacatcttgccggagagtcgccggaatgattacgttcaggcggcaaacgagcttgtcgaaaacatgagtgaggtatacgttatatag

SEQ ID NO: 45 - DNA, 828 bp, Glycine max
atggagaatgcggaggagatgatgcagcaaaacgacgaggttttgtcggttgaacttccagctccttccggttggaataaactgtttttccctaagaaactgggaacaccaagaaaaagtgagattgtattcattgctccaactggagaggagatcagtaccaaaaaacaattggagcagtacctaaaggcacatcctggcaatcctgtcatttcagagtttgactggggaactggtgagacccctaggcgatcagcaaggatcagtgagaaggtcaagtcaactccaccagcagatagtgatactccaaagaaacgagctcggaaatcatcaggatcaaagaaggataacaaagaaactgaatctgcatcagaggaaggcaaggcaaagtctgatactgaagatcccaaggctgcagaggaggagaaaaatgaaggaaatgataactctaattctggaggaaagcaacttgagaatggagataaaactgaacaaattgatgaacaggccaagaagccagatgtagatatggaagaaaatgatctgaatgatacaaacaataaattagaaaatgattcagatgaaattaagaacagtcatgtgaacggcgaaaatgtgattgctgaaaggcctgaaggtgaagaagctcaaaagcaagaagttgaaccagcagagaaagttgccgaagaagctgctaatactgcggagactgaaaaatccctactgactgaattagaaaaagaaaagaatgaggagaaaacagatactgcgactctagaggctaatgggggaggcgagaaagagaatcctaatgctgcacaaatgtag

SEQ ID NO: 46 - DNA, 1695 bp, Glycine max
atgttttttctaaccagaaatcgacggattgttcaaaagggtgttgatttcaagcagattgacaaagaatgggactgggacaatttcttgattcttcaagcactagttgcctccatggcatgctatatgtttccctttcttcagcatcttcctctctggaatgtaaaaggtcttattgttgctttggttcttcatgtgggagtctcagagccactttattattgggtgcataggaagttccatggagactatcttttcacccattatcattcacttcatcattcatctcctgtaccagagtcttttactgctggaaatgcaacacttttggagcatcttattatgacggtaatcattggaatccctatccttggggcttctttgatgggatatggatcagcaagcatgatatatggttatgttttgatttttgatttcctgagatgcttgggccacagcaatgttgaaattgttcctcatcaattgttcgagaaacttccatttcttagatatgtgatatacacaccgacatatcaccacctacaccactctgataaggacactaatttctgcctcttcatgcctctctttgattcacttggcaataccctcaacaaaaattcatggcaatcacacaaactactaagttcaggttcaggaaacggtgacatggtaccccattttgttttcctggcacatatagttgatgtgtcatccagtatgcatgctcaattcgtctatagatcctttgcttcattgccatacacaacaaggttcttcttgctcccaggcttgcccattacttttctagttttgctagcaatgtgggcttggtccaagacctttttagttagtttctactatctcagaggcagacttcaccaaacgtgggttgtacctagatgtggctttcagtatttcttgccatttgctactgagggaatcaataatcaaattgagcaagctatcctcagggctgataaaattggggttaaagtcatcagccttgctgcattgaataagaatgaatcactaaatgggggtggaaagctttttgtggacaagcaccctaaccttagggtccgagttgttcatgggaacacgttaactgctgctgtcatactcaatgagatccctcaagatgtgaaggaggtgttcctaacaggagccacatccaagcttggaagagcaattgctctctacctttgccaaaagaaagtgaaagttctgatgttaactctctcaacagatagatttcagaggattcaaaaggaagcccctccagaaaatcaaagctatcttgtccaagtgacaaaataccaagctgcacaaaactgcaagacctggatcgttggtaagtggatcacgccaagagagcaatactgggcaccacgtggaacccattttcatcaatttgttgtcccaccaattttatcatttagaaaagattgcacttatggtgacctggcagccatgagattaccagaagacgtggaaggacttgggtgttgtgagtacacgatggataggggagtggttcacgcgtgccatgcaggaggagtggtacatagccttgaaggttggtctcatcacgaagttggggccatagatgttaacagaatcgatcttgtgtgggaagcagcactcaaacatggcctaagaccagtgtcaagtttcacacagaaagaaaattag

SEQ ID NO: 47 - DNA, 1155 bp, Arabidopsis thaliana
atggaaaacacagacgagcttgtctccattgagctaccagctccagcttcatggaagaaactgttttatccgaaaagagccggtactccgagaaagacggagattgtgtttgtggctccaacgggtgaagagattagctcgcggaagcagttggagcagtacctgaaggcccatcctggcaatcctgtcatctctgagtttgagtggacaactggggaaactccaaggaggtcttcaaggatcagccaaaaggttaaggctacaacgcctactcctgacaaagagcccctcctgaagaagagacgatcttctctcacgaagaaggacaataaggaggctgctgagaaaaatgaagaggctgctgtgaaggagaacatggatgttgataaggatgggaagacggaaaacgcagaggctgagaaggagaaagagaaggagggagtgacagaaattgcagaggcggagaaggagaacaacgagggtgagaagactgaggctgagaaggtgaacaaagagggtgagaaaactgaggctgggaaggagggtcaaacggaaattgcagaggctgagaaggagaaggagggtgaaaaggctgaggctgagaacaaagaggcagaagttgtgagagacaagaaagagtccatggaagtggatacctctgagttggagaagaaggctgggagtggagaaggagctgaagaaccttccaaagttgaaggcctcaaggacactgaaatgaaagaggcgcaggaagttgttactgaggctgatgtagagaagaagcctgcagaggaaaagactgagaacaagggcagcgtgacaaccgaagctaacggagaacagaatgtaaccctgggtgagcctaaccttgatgcagatgctgaagcagataagggaaaagaatccaaagaatatgatgagaagacgacagaagctgaggcgaataaggaaaatgacactcaagaatctgatgagaagaagacagaagctgcagcaaataaggagaacgaaacccaagagtctgatgtcaagaagaccgaagctgcagtagcagaggagaagagtaacgacatgaaggcagaagacacaaacagaagcttggaggcgaatcaagttcaacagcagcagggagctgcagcttccgtgagctgttag

SEQ ID NO: 48 - DNA, 2931 bp, Arabidopsis thaliana
atggctctgtttagagatattgttcttcttgggtttctcttctgcttgagcttagtagctactgtgacttcagaggagggagcaacgttgctggagattaagaagtcattcaaggatgtgaacaatgttctttatgactggacaacttcaccttcttcggattattgtgtctggagaggtgtgtcttgtgaaaatgtcaccttcaatgttgttgctcttaatttgtcagatttgaatcttgatggagaaatctcacctgctattggagatctcaagagtctcttgtcaattgatctgcgaggtaatcgcttgtctggacaaatccctgatgagattggtgactgttcttctttgcaaaacttagacttatccttcaatgaattaagtggtgacataccgttttcgatttcgaagttgaagcaacttgagcagctgattctgaagaataaccaattgataggaccgatcccttcaacactttcacagattccaaacctgaaaattctggacttggcacagaataaactcagtggtgagataccaagacttatttactggaatgaagttcttcagtatcttgggttgcgaggaaacaacttagtcggtaacatttctccagatttgtgtcaactgactggtctttggtattttgacgtaagaaacaacagtttgactggtagtatacctgagacgataggaaattgcactgccttccaggttttggacttgtcctacaatcagctaactggtgagatcccttttgacatcggcttcctgcaagttgcaacattatcattgcaaggcaatcaactctctgggaagattccatcagtgattggtctcatgcaagcccttgcagtcttagatctaagtggcaacttgttgagtggatctattcctccgattctcggaaatcttactttcaccgagaaattgtatttgcacagtaacaagctgactggttcaattccacctgagcttggaaacatgtcaaaactccattacctggaactcaatgataatcatctcacgggtcatataccaccagagcttgggaagcttactgacttgtttgatctgaatgtggccaacaatgatctggaaggacctatacctgatcatctgagctcttgcacaaatctaaacagcttaaatgttcatgggaacaagtttagtggcactataccccgagcatttcaaaagctagaaagtatgacttaccttaatctgtccagcaacaatatcaaaggtccaatcccggttgagctatctcgtatcggtaacttagatacattggatctttccaacaacaagataaatggaatcattccttcttcccttggtgatttggagcatcttctcaagatgaacttgagtagaaatcatataaccggtgtagttccaggcgactttggaaatctaagaagcatcatggaaatagatctttcaaataatgatatctctggcccaattccagaagagcttaaccaattacagaacataattttgctgagactggaaaataataacctgactggtaatgttggttcattagccaactgtctcagtctcactgtattgaatgtatctcataacaacctcgtaggcgatatccctaagaacaataacttctcaagattttcaccagacagcttcattggcaatcctggtctttgcggtagttggctaaactcaccgtgtcatgattctcgtcgaactgtacgagtgtcaatctctagagcagctattcttggaatagctattgggggacttgtgatccttctcatggtcttaatagcagcttgccgaccgcataatcctcctccttttcttgatggatcacttgacaaaccagtaacttattcgacaccgaagctcgtcatccttcatatgaacatggcactccacgtttacgaggatatcatgagaatgacagagaatctaagtgagaagtatatcattgggcacggagcatcaagcactgtatacaaatgtgttttgaagaattgtaaaccggttgcgattaagcggctctactctcacaacccacagtcaatgaaacagtttgaaacagaactcgagatgctaagtagcatcaagcacagaaatcttgtgagcctacaagcttattccctctctcacttggggagtcttctgttctatgactatttggaaaatggtagcctctgggatcttcttcatggccctacgaagaaaaagactcttgattgggacacacggcttaagaaagcatatggtgcagcacaaggtttagcttatctacaccatgactgtagtccaaggatcattcacagagacgtgaagtcgtccaacattctcttggacaaagacttagaggctcgtttgacagattttggaatagcgaaaagcttgtgtgtgtcaaagtcacatacttcaacttacgtgatgggcacgataggttacatagaccccgagtatgctcgcacttcacggctcactgagaaatccgatgtctacagttatggaatagtccttcttgagttgttaacccgaaggaaagccgttgatgacgaatccaatctccaccatctgataatgtcaaagacggggaacaatgaagtgatggaaatggcagatccagacatcacatcgacgtgtaaagatctcggtgtggtgaagaaagttttccaactggcactcctatgcaccaaaagacagccgaatgatcggcccacaatgcaccaggtgactcgtgttctcggcagttttatgctatcggaacaaccacctgctgcgactgacacgtcagcgacgctggctggttcgtgctacgtcgatgagtatgcaaatctcaagactcctcattctgtcaattgctcttccatgagtgcttctgatgctcaactgtttcttcggtttggacaagttatttctcagaacagtgagtag

SEQ ID NO: 49 - DNA, 2931 bp, Arabidopsis thaliana; identical to SEQ ID NO: 48

SEQ ID NO: 50 - DNA, 876 bp, Glycine max
atgatgctgaaggcggcaccgcgtgcagtaatctactacctctcggagcacccggctatcgtggggttccggtggagccacgcccaatcatggggcgccacgtggtccttcctcttctcctcaattgcctcctacctcttcctctcagtcttcctatacttctctctttctctcctcttccgccgccgtcaaatccctctcggcccccttcccgccgtccacagcctctccatgtccctcatctccgccacgatcttcgccggcatcctcctctctgccgccgccgagatcagcgacacgcggtggttctggcggcgctccaaaacccccctacagtggctcctctgcttccccttgggcacgcgcccctcggggcgcgtcttcttctggtcctacgtctactacctctcccgcttcctccacatgctccgcaccctcctcagaatcctacgccaccgcaggctatcattttttcatctgttgagtaactcaatctccgcactcgcctccttcctctggctcgagttctcgcagtcctttcaagtcctcgcaattctcttcgccacgctcgtgtacgcagccgtctacggctaccgcttctggaccgccatcggcctccgcggcgcgtgcttccccttcgtcctcagctgccagatcgtgctcctcgcctgcaatgttgcctgccacgtcgccgtcttcttcctccacttcttcctcaagggcgggtgcaatgggatcggcgcgtgggtcttcaactcaatcctcaacctcgctcttcttatgctctctcttaacttctacgtgagaatgcacgttcacaagaggaggaggaaagttagggatgttactgttactgttgctactgcactgtcttag

SEQ ID NO: 51 - DNA, 801 bp, Glycine max
atgcaaagttcaatctcacaatctgagatttgcatcactgattaccttctaccccaagaagttccatctcaatttcaatttccagatatgagcaacaataacataccaatgaaccataccaaccttcaaatgcctcaaatcacatctttctccaagcctccaaggtcctcatcaaatctaagcaaccgcaaaccgtccttgagaaacatcacaatcccttccataacctcaggtcttacaacaactatgtcacaaacaacaacaacaacaacaatagctacaaccatgtataacaacaatcaagttacttcttcttcagatgaaaccaacaacatcaaagagaacaagcactatagaggggttagaagaaggccatggggcaagtatgctgcagaaatccgtgaccctaatagaaaaggctcaagggtgtggcttggaacctttgacacagccatagaagctgccaaggcttatgacaaagctgctttcaagatgagagggagcaaagccatattgaatttccctttggagattggagagtcagaggaatcagtctcaagctgcatcaaggttggtgtgaagagggaaagagaggaagagagtaaaagcaacaactatgagaaaagtgagtttaacaacaataataatagtaataagcatgtgaagaaagaagagtgttctcccaaagctgtttgccctttgactccatcatgttggaaaggcttttgggacactgatgttatgggaactatctttagtgtgcctcctttgtcaccactatctccactaatggttgtttag

SEQ ID NO: 52 - DNA, 978 bp, Zea mays
atgggagaggcctcgccgtcgatcgccaaggacgtcaccgagttgatcgggaacacgccgctggtgtacctcaacaaggtgaccgatgggtgcgtcggccgcgtcgccgccaagctcgagtccatggagccctgctccagcgtcaacgataggattggctacagcatgatcacggacgcagaggagaaagggctgattactccaggcgtgagtgttctgattgaaccaactagcggcaacacaggcattggactggcctttatggctgctgccaagggctacaaacttacactcacaatgcctgcctccatgagcatggagaggaggatcatattgaaggcttttggtgctgaacttgtccttactgacccactcttgggaatgaaaggagctgtcaagaaagcggaagagatacaagcaaagacacccaactcgtacattcttcaacaatttgaaaatccagctaacccaaagattcactatgagactactgggcctgaaatctggaaagctacagcaggaaaaattgatggccttgtatctggtatcgggacaggaggtaccatcaccggtactgggcgatacctcagagagcaaaatcctaatgtcaagctctatggtgtggagccagtggagagtgctgttttgaatggtggaaaacctggaccacacaagattcaaggaattggagctggttttatccctggagtcttggatgttgatctccttgatgaaactctacaggtttcaagtgatgaagctatcgagactgccaaggctcttgctctgaaagaagggttgttggttggaatctcttctggtgcagctgcagctgcggcagttaggcttgctaagaggccagaaaacgccggaaagctatttgttgtcgtgttcccgagcttcggcgagcgctacctctcatcggtgctgttccagtccatcaagaaggaagcggagagcatggtggtcgagccctag

SEQ ID NO: 53 - DNA, 684 bp, Sorghum bicolor
atggccgctgcctctctcctgtccccgtcctgcgcgctcttccgccgccttccctgcgcgtcgcacatctcctcgtcgcacttcaagaggttcgaccgggttcgccggttctcgcccgccgccatgtcgactttctcagggccaaaggaggcgccagcgaataacccggggctccaaaccgaggtcgaccccgccaccaagggctacttcttgcagcaaacgatgttacgtgtgaaggacccaaaagtgagccttgacttctactcacgtgtgatgggcatgtcgttgctgaaaaggttggattttgaagagatgaaattcagtttgtattttcttggttacgaggatgtgacctcagcccctgacaatcatatcaagcggactgaatggacttttaggcaaaaagctactcttgagctcacccacaactggggcacggaaaatgaccctgaattcaaaggttaccataatgggaactcagaccctcgtggttttggtcatataggagtaactgtggatgatgtccacaaggcatgtgaacgctttgaacgtcttggggttgagtttgtgaagaaacctgatgatggaaaaatcaaaggcatcgccttcatcaaagatcctgacggttactggatcgaaatctttgaccacaccattgggacggtgacttcttcagcatcatag

SEQ ID NO: 54 - DNA, 495 bp, Arabidopsis thaliana
atggcctcttctttctcttcacaagccttcttcttgctcacattgtctatggttttaattcctttctctttagctcaagctcccatgatggctccttctggctcaatgtccatgccgcctatgtctagcggcggtggaagctcggttcctcctccagtgatgtctccgatgccaatgatgactccaccacctatgcctatgactccaccacccatgcccatgactccaccacctatgcctatggctccaccaccaatgcccatggcttcaccaccaatgatgccaatgactccatctacaagcccaagcccattaacagttccggatatgccttcgccgccgatgccatccggaatggaatcttcaccttctccaggacccatgccaccggcaatggcggcttcgccggattcaggagctttcaatgttagaaacaacgtcgtaacactttcatgcgttgttggagttgttgcagctcattttctcctcgtttag

SEQ ID NO: 55 - DNA, 666 bp, Zea mays
atgtcgaggcgcggcgactgggtctacgagaacaacggcgggacctgcgtggccatcgccggcgccgattactgtgtcgtcgcggcggacacccgcctctctgtcggatacagcatcctcacgcgcgaccactctaagatctgcgacctggctgacaaatgtgtactagcatcttctggctttcagggtgatattaaggctctgcacaagaacctagctgccagagaattgctataccaacaccagcataacaaaaggatgagctgccctgccatggcacagctcctctccaataccctgtactacaagcgcttcttcccatattacgccttcaatgtgctcggtgggcttgacagcgaggggaaagggtgtgttttcacctatgatgcagtaggttcctacgagagaactggttatagtgctcagggaactggatctactttgattatgccagtcctggacaatcaactaaaatcaccaagtcctctattgctccctgccagggatgctgtcacaccattgtcggagtcagaggccatcgatctagttaaggatgtgtttgcatctgcaactgagagagacatctacactggagacaagttggaaattgtagtcatcaacaaagtcgggactaagcgcgagtacatcgacctgaggaaggactag

SEQ ID NO: 56 - DNA, 690 bp, Triticum aestivum
atgggcgccacggaggattcctcctccggctccgagaccaccacctcgtcctcggtggaggccctggcctcgccgccgtccccgacggccaccaccgcgtcgtcgaagaagaagcggccgcgcaacgacgggcggcacccgacgtaccgcggggtgcgcatgcggagctggggcaagtgggtgtcggagattcgggagccccgcaagaagtcgcgcatctggctcggcaccttcgccaccgcggagatggcggcgcgcgcgcacgacgtggccgccctcgccatcaagggccgtgccgcgcacctcaacttccccgacctcgcccacgagctcccgcgcccggccaccgccgcgcccaaagacgtccaggcggccgccgcactcgccgcctccgccgacttcccggcctctgccactgcagctgccaatgccggcgccaagaaccccgacggcccggaacacagcggcgcctccgcctctgcctccgcctctgcctctgcctctgcctcgccgccgcctgacaccgctgaggatgcgctgttcgacctccccgacctcctcttcgacctcagacacggccctccgtcctgccagctttcgtgcgcctcctcgtgggacgacgacgtggccttcgccggccctggcgccggcgtgttccgcctggaggagccgctgcagtgggagtactag

SEQ ID NO: 57 - DNA, 1653 bp, Escherichia coli
atgttttgtgtgcaatgtgaacaaactatccgtactccggcaggaaacggctgctcatacgcgcaggggatgtgtggtaaaacggcggaaacttctgaccttcaggatttactcatcgcggcgctgcaagggctttctgcctgggcggtaaaagcgcgtgaatacggcatcatcaaccacgatgttgacagcttcgcgccacgtgcctttttctcaaccctgaccaacgttaacttcgattctccgcgtattgtcggctacgctcgtgaagcgattgccctgcgcgaggcgctgaaagcgcaatgcctggctgtagatgccaacgcgcgcgtcgataacccgatggctgacctgcaactggtgagcgacgatctcggcgagctgcaacgtcaggcagcagaatttacccctaacaaagataaagcggcgattggcgaaaacattctcggcctgcgtctgctgtgcctgtatggcctgaaaggtgcggcggcctatatggaacacgcgcatgttctcggtcaatacgacaacgatatttatgcccagtaccataaaatcatggcgtggctggggacctggcctgccgatatgaacgcgcttcttgagtgttcaatggaaatcggccagatgaacttcaaagtgatgagcattctggatgcaggcgaaaccggtaaatacggtcacccgacgccaacccaggtcaacgtcaaagcgacggcgggtaaatgcattctgatttccggtcacgatctcaaagatctctacaacctgctggaacagaccgaaggcacgggcgttaatgtctacacccacggcgaaatgctgcctgcgcatggctacccggagctgcgtaaattcaagcatctggtcggtaactacggcagcggctggcagaatcagcaagtggagttcgctcgtttccctggccccatcgtgatgacctcgaactgcatcatcgacccaaccgtaggcgcttatgacgatcgtatctggacccgcagcattgttggctggcctggcgtgcgtcatctggacggtgatgatttctctgcggttatcacccaggcgcaacagatggcaggcttcccgtacagcgaaattccgcaccttatcaccgtgggttttggtcgccagacgctgcttggcgctgctgatacgctgattgatctggtgagccgtgaaaaactgcgtcatatcttcctgcttggtggctgtgacggcgcacgcggcgagcgccactacttcaccgatttcgccaccagcgtgccggatgactgcctgatcctgaccctcgcctgtggtaaatatcgctttaacaaacttgagtttggcgatatcgaaggtctgccgcgtctggtagatgcaggtcaatgtaacgatgcttactcagcgattattctggctgtcactctggcagagaaactgggctgcggtgtcaacgatctgccgctgtcgctggtgctctcctggtttgaacagaaagcgatcgtcattctgctgacgctgctttctctgggcgtgaaaaatatcgtcaccggcccgactgcacctggtttcctgacaccagacctgctggcggtgctgaacgagaaattcggcctgcgttctatcaccactgttgaagaagacatgaagcaactgttgagcgcgtag

SEQ ID NO: 58 - DNA, 1359 bp, Zea mays
atgcaggcatggcgtggaaaggagagaagcatggctgcagttaatggtactcttgaggatggataccgacttcttcctgcatattgtgagcagattgttaagacgaatcctggtagtgttgcaacctatagaggtattggaccagggaatgccttccagcggctgtttgtctcgtttcgtgcatccatttatggtttcttaaatgggtgcaggccccttctagaaattgacaaggctgacttgaagggaaagtatcttgggacattgctgtgtgcttcagctattgatgctgatcacatgatgttccctctagcattcggtgttgttgattgcgagagcgatgataactggaattggtttatatcggaattgaggaagatgctcggagttaacacagataagatgccggtgttgactatagtttctgagagaaaacggcaagtggttgcagcggtcggatctaatttccccactgcttttcatgggttttgcttgagacacgtgagtgagaatttccgtgatgagttcaagaatactaaactgcttaacattttctggagtgctgtgtatgctctcacagcatcagaatttgatgcaaaggtaaatgaaatgatgcaggttcaggatgttatgccatggttacagcgttttccgccaaacctgtgggcattttcttacttccagggtatcagatatggccattttagtcttgggataaccgagatattgtataacttgtcccttgactgccatgaacttcccatcgtgcaaaccatcgagcacatcaggcaccaactggcttgctggtttgctgaacgccagaacctggcacagtcatacaactcggttcttgttccgtcagctgagaaagttatcctcgaagccatccatgactcacaatgctatcaagtccttcgagcaaacaaggtggagtttgagattgtgtcatcggagcgaaccaacattgtggacacccaagctaggttctgctcgtgccgccgatggcaaatttacggcatcccatgcgcacatgccgccgccgcactgctctcatgcggtgaagacccccgcctctatgctgatgactgcttcagtgtgatgaagtaccgagaaacctactcccagccaatatatcctatcccggacaggagccactggaacgattcgtctccctggtcacaaggtgcggtcagcaaggccgatgtggtgcttggcccgcccaatatccggaggcctcctggccgacccaagatgaagattctaaagatcgagagcatgaagcggccgaagcggatcgtccagtgtggccgatgccatcttcttgggcattctcaaaagaagtgctctttgcgaagctag

SEQ ID NO: 59 - DNA, 780 bp, Oryza sativa
atggtctcgccggacaccatccgcacggccatcggcgtcgtaggcaatggaaccgccctcgtgctcttcctctccccagtgccgacgttcatacggatctggaagaaggggtcggtggagcagtactcggcggtgccgtacgtggcgacgctgctcaactgcatgatgtgggtgctgtacggcctccccgcggtgcacccgcacagcatgctggtcatcaccatcaacggcaccggcatggccatcgagctcacctacatcgccctcttcctcgccttctccctcggcgccgtccgccgccgcgtcctcctcctcctcgccgccgaggtcgccttcgtcgccgccgtcgccgccctcgtcctcaacctcgcccacacccacgagcgacgctccatgatcgtcggtatcctctgcgtcctcttcggcaccggcatgtacgccgcccccctctccgtcatgaaaatggtgatccagactaagagcgtggagtacatgccccttttcttgtccctggcgtcactggtcaacggcatctgctggactgcctacgccctcatccgcttcgacctctacatcacgatccccaacgggctgggagtgatgttcgcggtggcgcagctgatcctgtacgccatctactacaagtcgacgcagcagatcatcgaggcgcgcaagcgcaaggaggccgaccatgtcgccatgaccgatgtcgtcgtcgactccgccaagaacaacccctcctccggcgccgccgccgccgccgccaacggccgctactag

SEQ ID NO: 60 - DNA, 1236 bp, Arabidopsis thaliana
atgggtaagaacgattttctaaccccaaaggcgattgcgaatcgaattaaagccaaaggacttcaaaagcttcgatggtattgtcagatgtgtcagaaacaatgccgagacgagaatggattcaagtgtcattgtatgagcgaatctcaccagaggcagatgcaagtttttgggcagaatccgactcgtgttgtcgatggttactctgaagaattcgagcagacgtttctcgatctgatgaggcggagccaccgtttctctcgtatcgctgccactgttgtctacaatgagtatattaacgatagacatcatgttcacatgaattcgacggagtgggcgacgttgacggagtttatcaagcatcttgggaaaactggtaagtgtaaggttgaagaaactcctaaaggttggtttattacttatatagatagagattctgagactttgtttaaggagaggttgaagaataagagagttaagagtgatttagctgaggaggagaagcaagagagggagattcagagacagattgagagagctgctgagaaattgaatggtggtggtggtgaaggtgaaaccagtggtaatgatgaagttgtggatgatggtgatgatgagaggaagaaagatgaagacttgaggttgaagagtggggtcaaggttggatttgctcttggtggaggtgttaaacaggttgctacgggtaaagagagaggggaaagctcgaaacttttgtttggggatgaagagaatgacaaggttgagagaggggagaagaggaagagaagtggggactccgggaggagcgagaaggagaggagatcagctttggatgagttgatgaaggaggaagagaagaagaaggagaggatgaatcggaaagattactggttgttcgaagggatcattgtgaaggtgatgagtaaggctttggcagagaaagggtattataagcaaaaaggtgttgtgaagaaagtgattgataattatgttggggagatcaaaatgcttgattctaaacatgtgttgagagttgatcaaaaggagctagagactgtgcttccacaaattggagggatggtgaagatagtgaatggggcatatcgtggttcgaatgcaaggttgttgggtgtggatacagagaagttctgtgctaaagtgcagatcgagaaaggtgtctatgatggaagagtcatcaagtccattgagtacgaggacatatgcaaacttgcttag

SEQ ID NO: 61 - DNA, 1437 bp, Escherichia coli
atgacaaggataaaaataaacgcacgccgtatcttcagcttattgattccttttttctttttcacttctgttcacgctgaacaaacggctgctcccgcaaaacctgtaactgtggaagcgaagaatgaaacctttgccccgcagcatcccgatcaatatctctcctggaaagccacctcggaacagtcagagcgtgttgacgccctggcggaagatccacggctggtgatcctgtgggcggggtatcccttctcgcgcgattacaacaagccgcgtggacatgcttttgctgtgaccgatgtgcgtgaaaccctgcgtaccggtgcgccgaaaaacgctgaagatggtccgctaccgatggcatgctggagttgtaaaagcccggatgtggcgcgtctgatccagaaagacggcgaagatggctacttccacggtaaatgggcgcgcggcggtccggaaatcgtcaacaacttaggttgtgccgattgccataacaccgcctctccagagttcgccaaaggcaaaccggagttaaccctttcccgtccgtatgcggctcgcgcgatggaagccattggtaaaccttttgagaaagccggacgtttcgaccagcaatcgatggtttgcggtcagtgccatgtggagtattacttcgacggcaaaaacaaagcggttaaattcccgtgggatgacggcatgaaagtcgaaaatatggagcagtattacgacaaaattgccttctctgactggactaactccctgtcgaaaacgccaatgctgaaagcgcagcacccggaatatgaaacctggacagcgggcattcacggtaaaaacaacgtgacctgtatcgactgccatatgccaaaagtgcagaacgccgaaggcaaactctacaccgaccataaaattggtaatccgtttgataacttcgcccagacttgtgcgaactgccatacccaggacaaagctgccttgcaaaaagtggtcgcggaacgtaagcagtcgattaacgacctgaaaatcaaggttgaagatcaactggttcacgctcacttcgaagcgaaagcagcgctggatgcaggcgcgacggaagctgaaatgaagccaattcaggacgatatccgtcatgcccagtggcgctgggatctggcgatcgcttcccacggcattcatatgcacgcaccggaagaaggtttacggatgctcggtacggcgatggataaagcggcggatgcacgcaccaaactggcgcgcctgctggcgaccaaaggcatcacccatgaaatccagatcccggatatctcaaccaaagagaaagcccagcaggccattggcctgaacatggaacaaatcaaggccgagaagcaggacttcatcaaaacggtgatcccgcagtgggaagaacaggcacgtaaaaacggtctgttaagccaatag

SEQ ID NO: 62 - DNA, 1686 bp, Zea mays
atggctgcggacgccgccgctgcggcgatgtccgcgacttccctctgcgacgatctcgagcccgccaccgtgcgcacccgcatccgcgatgtcctggccgcaggtgccgcgcgtgccggggaccgcgtcgtggtcggtgggtgggtccggacgggccgggagcaggggaagggctctttcgccttcctggagctcagcgacgggtcctgcgctgccacgcttcaggccatcgttgacgccgccgtgcacccgctagcgcgcctcaccgccaccggcacctccgtcctcgtcgagggcgtgatcaaggagccgcccgaggggaccaagcagaacgtcgagctgaaggtcagccgcgtgcttgaggtcggcgaggtcgatgccgccgtctacccgctgcccaagggcaaggtcaaactcacgctcgagaagctcagggacgtcgttcatctccgttcgcgcaccaacacgattggagcggttgctaggattaggcaccagttagcctatgcatcacacaggttctttgatgagaatggatttctctatgtacatacaccaataataactacgagtgactgtgaaggtgctggtgagatgtttcaagtgacaactttatttagccaggctgagaaaactgagaaggaattgagagagaacccaaaaccttctgattctgaaattgaggcagctaaagttcttgtcaaggaaaaaggtgatgtggtcgcacagcttaaagctgcaaaagccagcaaacaagagatatcaactgctgtcgatgagcttaatagggcaaaggaaattgtttcaaaactggaggagaggttcaagttaaagcctgggattccacgcaaggatgatggttcaatagcttttgaaaatgacttcttcaaacgtcaagcttttttgacagtgtctggacagcttcaggttgagacatatgcatgtgctcttagtagcgtttatacctttggaccaacattccgggcagagaactcacatacgtcacgacatttggcagagttttggatggttgaaccggaaatcgcatttgcaaacttgcaggatgacatgaactgtgcagaaaaatatgtacagtacctttgcaagtggctgcttgaccattgccaggaagatatggagtttatggtgaaaaattatgataagagtgcaattgaacgcctggagcttgtttcgtcaactccttttgtgcggatttcatacacaaaggctgtggagctcttgaaaaatgttaccgacaagaagtttgacaacaaagttgaatggggaattgatttagcctctgagcatgaaaggtatttaacagaggatatatttaagaagccagttattgtctataactatccgaaaggaataaaggcattttatatgagactcaatgatgatgacaagacggtggctgcaatggatgttcttgtgcctaaggttggtgaattgattggtggaagccaaagggaggaacggttagatgttctgaaacagaggatacttgatgctggcctgcctttggaaccctatgaatggtacttggacctccgtcgctttggatctgtaaagcacagtggttttgggttgggttttgaaaggatgattctatttgcaaccggaatggagaacatcagagatgttatacccttcccaaggtacccaggaagggctgatctgtag

SEQ ID NO: 63 - DNA, 729 bp, Saccharomyces cerevisiae
atgactgataggaatttctcaccacaacaaggacaaggacctcaagaatcgctcccggagggaccgcaacccagcacgatgattcagagagaggaaatgaatatgccaaggcaatattcagaacagcaacaactgcaagaaaacgaaggggaaggggaaaatacgaggctgcctgtttctgaggaagagttccggatggtacaggagttgcaagctatccaggcgggccatgaccaagctaatctaccgccaagtggtcgagggtcgcttgaaggcgaagataatggaaatagcgacggcgcagacggagaaatggacgaggacgatgaagagtatgatgtgtttaggaacgttggtcaggggttggtgggccactacaaggagataatgatccgttattggcaagaattaatcaacgagatcgagtctacgaatgaacctggttccgagcatcaagatgacttcaaatcacattccttaccatttgcgagaattcgcaaggtcatgaagacggatgaagatgtcaagatgattagtgcagaggcccccatcattttcgccaaagcctgtgagatctttattacagaactgactatgagagcttggtgcgtggcagaaaggaataaaagacgaactttgcagaaggcagatatcgcagaggccctgcaaaagagtgacatgtttgactttctcatcgatgttgtgcctagaagacctcttccacaatag

SEQ ID NO: 64 - DNA, 1299 bp, Zea mays
atgggcctttcaacagtttactccccggccggaccgcgcctcgtgccggcccctctcggccgctgccgctctgcccagccccgccgcccgcgccgagccccgctcgccaccgtccggtgctccgtcgacgccaccaagcaggcgcaggatggcgtggcgacggcggtcgcgacggaggcgccggcgtcgcggaaggagtgcttcggggtcttctgcaccacctacgacctcaaggcggaggacaagaccaagtcgtggaagaagctagtgaatgttgctgtgtcaggcgcggccgggatgatatcaaatcacctgctgttcaaactcgcttctggtgaggttttcggacaagaccaaccaatagcacttaagctactcggctcagaaagatcgtttcaagccctcgaaggtgtagctatggaactggaggactcgctgtatccactgctgagggaagtcagcattggcatagatccttacgtggtctttcaagatgtagattgggcccttcttattggcgctaagccccgaggtcccggcatggagcgagctgcgctactggatatcaatggccaaatctttgctgaccaggggaaagcacttaatgcggtcgcctcgcggaacgcgaaagtcttagttgtcggaaatccctgtaacactaatgcgctgatttgtttgaaaaatgccccaaacataccggcaaaaaactttcatgcattgacgaggttggatgaaaatagagcaaagtgccagctggcactaaaagcaggtgtattttatgacaaagtatcaaacgtgactatttgggggaaccattcgacgactcaggttcctgatttcttgaatgccaaaattgatggaagaccagtgaaagaagtcattaaggataccaagtggttagaggaagagttcaccctcacagttcaaaagcgtggaggtgtgctcatccaaaaatggggcagatcatcagctgcatcgaccgctgtttcgatagtggatgctattagatccctcgtaactcctaccccagaaggtgactggttttctacaggggtttatacgactggaaatccttatggcatagcagaggatatcgtgttcagcatgccatgcagatcgaagggtgatggtgattacgaactagctagtgatgtgttgatggacgattttctctgggaacggattaaaaagagcgaagctgaattgcttgctgagaagaaatgcgttgcccatcttacaggagaggggaatgcattctgtgatcttccggaagataccatgctaccaggagaagtgtag

SEQ ID NO: 65 - DNA, 2046 bp, Arabidopsis thaliana
atgtctggttctgtatctggttgtggttctggtggttgtagtattgtatggtttagaagagatcttagggttgaagataatccagctttagcagcagcagtaagagctggtccagtgattgctctgtttgtttgggcaccagaagaagaaggacactatcatccaggtagggtttctaggtggtggctcaagaacagtttggctcagcttgattcttctcttagaagtcttggtacttgtcttatcaccaagagatctactgatagtgttgcttctcttcttgatgttgttaaatccactggtgcttctcagatcttcttcaaccatttgtatgatccattgtctttggtgcgtgatcaccgagctaaagatgttttgacggcgcaaggcatagcggttcgatcattcaacgcagacttgctttatgagccatgggaagtgactgatgaattaggccgtcctttctctatgtttgctgcgttttgggagagatgtcttagtatgccttatgaccctgagtctcctcttcttccacctaagaagatcatttcaggggatgtgtctaaatgtgttgcggatccattggtgtttgaggatgactctgagaaaggaagcaatgcacttctggctcgtgcttggtctcctggatggagtaatggtgataaagctctcacaacgtttataaacggtccattgcttgaatactctaagaaccgcagaaaagccgatagtgctacaacctcgtttctttctccacacttgcattttggggaagtgagtgtgagaaaagtttttcatcttgttcggatcaaacaggtcgcgtgggcaaacgaaggaaacgaggccggggaagaaagcgtgaatcttttcctgaaatctattggtctcagggagtattctaggtacataagttttaaccatccatattcccatgaaagaccacttcttggccatctaaagttcttcccttgggctgtggatgagaactatttcaaggcatggaggcaaggccggactggatatccgttggtcgatgccgggatgagagagttatgggctactggttggttgcatgatcgcataagagtagttgtttcaagcttctttgttaaagtgcttcaattaccatggagatgggggatgaagtatttctgggacacacttcttgatgcggatttagaaagcgatgctcttggttggcaatacattaccggtactctcccggatagccgggagtttgatcgcatagataaccctcagtttgaagggtacaagtttgatccaaatggtgaatacgtaaggcgatggcttcctgaactctctagactcccgacagactggatacatcatccgtggaacgcacctgagtccgttcttcaagctgctggtatcgagcttggatcaaactatcctctaccaattgtaggattagacgaagcaaaagcacggcttcatgaagcgctttcacagatgtggcaactagaagctgcttcaagagctgcaatagagaacggatccgaagaaggacttggagattctgctgaggtagaggaagctcctatagagttcccaagggacattacaatggaagagactgaaccaaccagactcaacccaaacaggagatatgaggatcagatggttccaagcattacttcttctttgatcagacctgaagaagacgaagagtcgtctcttaatttgagaaattcagtaggagatagcagagcagaggttccaaggaacatggttaacaccaaccaagctcagcagcggagagcagaaccggcttcaaaccaagtcactgctatgattccagaatttaatatcagaattgttgcagagagcactgaagactcaacagcggaatcttccagcagcggaaggagagaaagaagcggaggcatagtccccgagtggtctccagggtactcagagcagttccctagtgaagaaaatggtattggaggaggaagtacaacgtctagctacttgcagaatcaccatgaaatactgaactggagacggctttcacaaaccgggtag

SEQ ID NO: 66 - DNA, 318 bp, Zea mays
atggcaagccgatctagcgcgatggaaggaggggcggcaatacaaaggaggaatgccgtgaagcggcatctgcagcagcgtcagcaggaggcggatttcctcgacaagaaggtcatcgcgtccacctacttcagcatcggggcgttcctcgtgctcgcctgcctcaccgtctcgctgctgatactgccgctggtgctgcctcccctgccgccgccgccgtcgctgctgttgtggctgccggtctgcctgctcgtcttgctggttgtactggccttcatgccgacagatgtgcgcagcatggcctcctcttacctgtag

SEQ ID NO: 67 - DNA, 609 bp, Glycine max
atgaagtggttgactttctggaactgcatatctatcctcgtgttgtcttttgctttcttcttcttctattgtcacacatacacatctactccttccctcatggctgagcaatcttccaagtccatttacgatttcacagtcaaggacatcagtggaaatgatgtgagtctgaataattacagcgggaaggttctactgattgtgaatgtcgcctcacaatgtggtttgacacagacaaattacaaagaattgaatgtattgtacgagaagtacaagaatcaaggatttgaaatcttggcatttccatgcaaccagtttgctggacaggaaccaggaaacaatgaagaaattcaggaagttgtttgcacaaggttcaaggctgaatttcctatctttgataaggttgaagtcaatgggaagaatgcagcgccactttataagtttttaaaggagcagaaagggggaatatttggtgatggtatcaagtggaacttcacaaagttcttagtaaacaaagaagggaaggttgtggacagatatgcacctaccacctcacctctgaaaatcgagaaagacatagagaagctcgaaccatataatttaatttag

SEQ ID NO: 68 - DNA, 972 bp, Deinococcus radiodurans
atgtccgacctgatgaaactgcgcgccgtgtggggcaaccgtccgctgctgggggtggcggcgggcgtgctcatccagaacgaacgcggcgaagtgctgctgcaaaagcgcggtgacgacgggctgtggggcgaacccggcggcggcctggaccccggcgaggcgtttctggcggcggcccagcgcgagctgaaggaggaaaccggcctggaatgcgggaacctgacctggctcggcgtccacgacggcctgacgagcggccccgacctctacacccgctaccccaacggacacgagctgtatctggtcggcacgctctttcacggcacgctgcccgccgatgcgctggcccacgctcagcccgacgacagcggcgagacgctggagctgcgctggtgcgcgctggacgacctaccgccgctgagcagcaacatcaaccgcaccagcctgaacgtgctgcgccgccgcgtcggactccccgaattgccgatgcagccccagcccccgcgccagcccgacccgacgtactgggccgacctgggccgcctgcttgggggtcggctctggttcatgcccggcagcagcgtgttggtgaccgatgaggcgggccgcctgctgctgctgcgccataaggcgaccgaccagtggacgctgcccggcggcaagctcgaacccggtgaatcgttcgaggagtgtgccgcccgcgagctgcttgaggaaacgggcctgcgggccaggcggctcgagcgcctgcacctgctcgccgggccggagttgcgctttcagcagcaggggcaaacctgggacagcctgggcttgctgctccgcgcctctgacgtgagcggcgaactgcggccccctgccggagaactcagcgaggcgcggtatttcgcgcccgatgagctgccgggggtggacgtgctgggaacctacacccggcaagccctggccttctggctcgggcagtcctga

SEQ ID NO: 69 - DNA, 327 bp, Arabidopsis thaliana
atgggtttaatgaggtcgatgcttccaaatgcaaagcaaatcttcaaatcacaatctatgaggaacaagaacggatcatcctcaccatcaacaacaacaacaacttcagggcttgttccgaaaggtcacgtagcggtttacgttggagaacaaatggagaagaagaggtttgtggttccaatatcatacttgaaccatcctttgttcagagaatttcttaatcgcgctgaggaagaatgcggatttcatcactctatgggtggcttgacgataccttgtcgagaagagtcgtttctttatctcattacttctcatcagctgcattag

SEQ ID NO: 70 - DNA, 1800 bp, Arabidopsis thaliana
atggcttctttcacggcaacggctgcggtttctgggagatggcttggtggcaatcatactcagccgccattatcgtcttctcaaagctccgacttgagttattgtagctccttacctatggccagtcgtgtcacacgtaagctcaatgtttcatctgcgcttcacactcctccagctcttcatttccctaagcaatcatcaaactctcccgccattgttgttaagcccaaagccaaagaatccaacactaaacagatgaatttgttccagagagcggcggcggcagcgttggacgcggcggagggtttccttgtcagccacgagaagctacacccgcttcctaaaacggctgatcctagtgttcagatcgccggaaattttgctccggtgaatgaacagcccgtccggcgtaatcttccggtggtcggaaaacttcccgattccatcaaaggagtgtatgtgcgcaacggagctaacccacttcacgagccggtgacaggtcaccacttcttcgacggagacggtatggttcacgccgtcaaattcgaacacggttcagctagctacgcttgccggtttactcagactaaccggtttgttcaggaacgtcaattgggtcgaccggttttccccaaagccatcggtgagcttcacggccacaccggtattgcccgactcatgctattctacgccagagctgcagccggtatagtcgacccggcacacggaaccggtgtagctaacgccggtttggtctatttcaatggccggttattggctatgtcggaggatgatttaccttaccaagttcagatcactcccaatggagatttaaaaaccgttggtcggttcgattttgatggacaattagaatccacaatgattgcccacccgaaagtcgacccggaatccggtgaactcttcgctttaagctacgacgtcgtttcaaagccttacctaaaatacttccgattctcaccggacggaactaaatcaccggacgtcgagattcagcttgatcagccaacgatgatgcacgatttcgcgattacagagaacttcgtcgtcgtacctgaccagcaagtcgttttcaagctgccggagatgatccgcggtgggtctccggtggtttacgacaagaacaaggtcgcaagattcgggattttagacaaatacgccgaagattcatcgaacattaagtggattgatgctccagattgcttctgcttccatctctggaacgcttgggaagagccagaaacagatgaagtcgtcgtgatagggtcctgtatgactccaccagactcaattttcaacgagtctgacgagaatctcaagagtgtcctgtctgaaatccgcctgaatctcaaaaccggtgaatcaactcgccgtccgatcatctccaacgaagatcaacaagtcaacctcgaagcagggatggtcaacagaaacatgctcggccgtaaaaccaaattcgcttacttggctttagccgagccgtggcctaaagtctcaggattcgctaaagttgatctcactactggagaagttaagaaacatctttacggcgataaccgttacggaggagagcctctgtttctccccggagaaggaggagaggaagacgaaggatacatcctctgtttcgttcacgacgagaagacatggaaatcggagttacagatagttaacgccgttagcttagaggttgaagcaacggttaaacttccgtcaagggttccgtacggatttcacggtacattcatcggagccgatgatttggcgaagcaggtcgtgtag

SEQ ID NO: 71 - DNA, 1443 bp, Arabidopsis thaliana
atggaacaagaagatttctatttccctgacaccgatcttgatctcagcttcacatccaccactaccgaccgtacattcgcctcctcgagcgctcgcacaagtctaacattaagcttcaacgacagactctctacttcctctgcagtcacaacctcatccacctcctcctcctccgtcaaccaccgtcgtcatgatcctcactggtcagcaatcaaatcagcaaaacttctctcctccgacggaaacatccacctccgccacctgaaacttatacgccacctcggcaccggaaacctaggccgagtgttcctctgtaacctccgtgactcttccgcaagattcgctttaaaggtcatcgaccgtaactgtctcacgacggagaagaagctctctcaggtcgagacggaggcagagatcctctccttgctggaccacccttttcttcctacgctctatgctcgtatcgacgagtctcactacacgtgtctcctcattgattatgctcccaatggagacttacattccttgttacgcaagcaacctggtaaccgtttaccgattcagccggttagattctttgccgccgaagttctcgttgcattagagtaccttcacgcaatgggaatcgtataccgcgatcttaaacctgaaaacgttttgcttcgtgaagacggacacgtcatgttgtcggattttgatctttgtttcaaatccgacgttgtccctacttttaaatctcgtcgctaccggagatcttcttcatctccgtcgcttcgtcgtagaagaagcggttgcttctccgttgctgcggagaaaaagtacgagagagaggagattgtttcagagtttgcggcagagcctgtaacggcgttttcaagatcttgtgtcggaacacatgagtatcttgcgccggagctagtttccggcaacggacacggaagcggagtagactggtgggcgttcggaatattcctttacgagttattgtacggtacgacgccgtttaagggagagagtaaagagcaaacactgcggaatatagtatcgaccactaagaccgcgagtttccatatggacggtgatttagatgaagctagggacttgattgagaagcttttggttaaggacccaaggaaaaggctaggatgcgccaggggtgcgcaagatatcaaacgtcatccgttttttgatggaatcaagtggccgttgattaggcattataagccaccggaagaagttagaggtcttgtgattaagaagtcaacgagaccacatgctagtcacgtgattgccgtttcaccgcgacggagaaaatcgtttttgtggagggcgttgtcatatttactgcgcggtaaaagctctagtggtgggagtaaaaatcagagcaatagtaattattatcactatgtgggcaaaagctacgcgagtcgcaaacgcgtttag

SEQ ID NO: 72 - DNA, 1434 bp, Arabidopsis thaliana
atggacaacattgccgcgcagttgaagcgtgggatatcgagacaattctcgacaggatcaatgagacgaacattaagccgacaattcacgcgccaaaattctctcgatccacggcgtaacaacatgagattcagcttcggtcgtcaatcttcgcttgatccgatcagacgtagtcctgagtctcttagctgcgagccgcatatgtctgtccccgagaatcttgattcgacgatgcagcttctctttatggcgagtaaaggtgatgttaatggcgttgaggagctgcttaatgaaggaatagatgtgaatagcattgatcttgatggtcgtactgctcttcacattgcttcctgtgaaggtcattatgatgttgttaaggttcttcttagccggagagctaatatcgatgctcgtgatcgttggggtagtacggcggctgttgatgcaaagtattatgggaatgttgaagtttataatctcttgaaagctcgaggcgctaaagctccgaaaactagaaagactccaatgacggtagggaatccaaaagaagttcctgagtatgagcttaatccactcgagctgcaagtccgaaaagttgatggcatttcaaagggaacttatcaagttgctaaatggaatggcacgcgagtctcagtaaaaatattcgataaagatagctattcagatcctgaacgagtaaatgctttcacaaacgaattgactttgctagcaaaagctcggcatccaaatattgttcaatttgttggagccgtcactcaaaatctaccgatgatgattgtagttgagtgtaatccaaaaggtgatctaagtgtctatcttcaaaagaaaggtcgtctttctccttcaaaagctctgagatttgctcttgatattgctagaggaatgaactacctccatgaatgtaaaccagatccgatcatccactgcgagttaatgccaaaaaatattttgctagatagaggagggcaattgaagatctctggttttggtttgataaagttgtcaaagattggagaagacagtgcaaaagtagtgaaccacgaagctcaaatcgataagtcaaattactatatagcacccgaaatttacaaagatgaagtcttcgataaaagggctgatgtgcattcgtttggtgtcattttgtacgagttgaccgagggagtatctttattccatcctaaaccacctgaagaggttgcagaatcgatttgtatagaaggtaaaagaccaacaatcagaacaaagtcaaagagttaccctccggaattgaaagagttgattgaggaatgctggcatccagaaatcagtgtgaggccaatattctctgagattattattcggctcgacaagatagttacaaactgttccaagcagggttggtggaaagacacatttaagttcccttggaaatag

SEQ ID NO: 73 - DNA, 1221 bp, Glycine max
atggcaacgacgtcggtggtgccggcgaaccggcgtcgcgcggcgaaccccgcggaggagatggacttcgagacgacggagggcgtgaaggccatcgcaagcttcgaggagatggggatcaaggacgatctgctccgcggaatctaccagtacggcttcgagaagccctccgccattcagcagcgggccgtcacgcccatcattcagggccgtgacgtcatcgctcaggcccaatccggaacggggaaaacgtccatgattgctctcaccgtttgccaggtcgtcgatacctccgtcagagaggttcaggcattgatattgtcaccaacgagggaactggcctcacagactgagaaagttatattggctattggggatttcattaatatacaagctcatgcatgcgttggtggtaaaagtgtgggagaagatataaggaaacttgagtatggagttcatgtggtgtctggaactcctggccgagtttgtgacatgatcaaaaggagaacattgcgcacgagagctatcaagatgctagttcttgatgaatctgatgaaatgttgagcagagggtttaaagatcaaatttatgatgtgtatagatatctcccacccgaccttcaggtttgcttgatttctgctacccttcctcatgaaatactggagatgacaaacaaattcatgacagatccagtaaggatccttgtaaaacgtgatgaattgacattggagggcatcaaacaattttttgttgccgttgaaagggaggaatggaagtttgataccctgtgtgatctttatgataccctcactatcactcaagctgttatattctgtaacactaagcgaaaggtggactggttaactgaaaaaatgcgtaacaataatttcactgtctcatcaatgcatggtgacatgcctcagaaagaaagagatgctattatgggagaatttcgtgctggaacaacccgtgtactaataacaactgatgtttgggcccgtggtcttgatgtacagcaggtttctctagttatcaattatgaccttccaaataatcgtgagctttacattcatcgaattggccgttctggacgttttggaagaaagggtgttgcgataaattttgtgaagagcgatgacatcaagatcttgagagacattgaacaatactacagtactcagattgatgaaatgccaatgaatgttgctgatcttatatag

SEQ ID NO: 74 - DNA, 669 bp, Zea mays
atgggggccacttctccttcaggcctggagctcaccatggctgtccccggcctcagctcctcctctggctcagaggggtttgtttgcaacaacaatatcagcaacaacggtggcgggaacatgagggacctggacatgaaccagccggcgagcggcggcgaggaggaggatttcctgatgggcggcgtggaagaggacgaggaggagcggggcgccggcggaccgcaccgcccaaagaagctccgcctctccaaggagcagtcccgcctcctcgaggagagcttccgcctcaaccacaccctctcaccgaagcaaaaggaggccttggcgatcaaactgaagctgcggcccaggcaggtggaggtctggtttcagaaccgcagggcaaggactaagctgaagcacacggagatggagtgcgagtacctgaaacgctgcttcggctcgctgacggaggagaaccgccgcctgcagcgggaggtggaggagctgagggcgatgcgcatggcgccgcccacggtgctctcgccgcacacacgccagccactcccggcgtccgcgctcaccatgtgcccccgctgcgagcgcgtcaccgctgccacctgcccgcggatcacccgcccggccgcctcgccgttccaccctcgccgcccctcagcggcgttttag

SEQ ID NO: 75 - DNA, 894 bp, Zea mays
atgagcggcggcggcggccttgggtccggctgctcgtaccagaagttcgtccacttcgcgctggagcagacccgccaccgctccactctcgtcccccacccgtcccaggaaaagttcaggttcataaaagcaaatgaggataacaccgttctcaatgccttgtcattcagcacttccaaaattagactgcttcggagcttgacaattgagcaaaaaaactcggttcaggttcttgattttgctgccttctcaagacctgaatacgaccttcctatattttgtgccaatgccttctcatcccctgcacggagtattgttgtcttggacctcaaccctttgtatgataccactgaacacaaggattacagggaaaaatactacagggctttgatgccccttgtacacaagtacagtgagcttctgccctggggtggcaagattacaagtgagtcgctgagattcttctctcccattgttatctggacggtattcgagccaagcgaagccaaccaccaagctctatactcggccttcgtggattactatatggtctggcttgagttcatggacggagcagttcgcgaaagtagcaaagaaaaaatcgaccgcaatagagaagcgcaacataaatatctcacatggagagcagagaaggatcctgggtacccgctgctaaagaagttgatcggtgagagtggtgccaaggacctggtgagggagttcctcttcgaaggagttggctcgctcggaaccaagtcgtttctggagtatttcgccgagtacgcgcaagaggacgggacggtgaacaagaagcggagcatggcggggaagtcctttggaacccgaccttgggacgcccacggactgttcgtcggcgacgctgtggatggatag

SEQ ID NO: 76 - DNA, 1167 bp, Escherichia coli
atgaaacatctgcatcgattctttagcagtgatgcctcgggaggcattattcttatcattgccgctatcctggcgatgattatggccaacagcggcgcaaccagtggatggtatcacgactttctggagacgccggttcagctccgggttggttcactcgaaatcaacaaaaacatgctgttatggataaatgacgcgctgatggcggtatttttcctgttagtcggtctggaagttaaacgtgaactgatgcaaggatcgctagccagcttacgccaggccgcatttccagttatcgccgctattggtgggatgattgtgccggcattactctatctggcttttaactatgccgatccgattacccgcgaagggtgggcgatcccggcggctactgacattgcttttgcacttggtgtactggcgctgttgggaagtcgtgttccgttagcgctgaagatctttttgatggctctggctattatcgacgatcttggggccatcattatcatcgcattgttctacactaatgacttatcgatggcctctcttggcgtcgcggctgtagcaattgcggtactcgcggtattgaatctgtgtggtgcacgccgcacgggcgtctatattcttgttggcgtggtgttgtggactgcggtgttgaaatcgggggttcacgcaactctggcgggggtaattgtcggcttctttattcctttgaaagagaagcatgggcgttctccagcgaagcgactggagcatgtgttgcacccgtgggtggcgtatctgattttgccgctgtttgcatttgctaatgctggcgtttcactgcaaggcgtcacgctggatggcttgacctccattctgccattggggatcatcgctggcttgctgattggcaaaccgctggggattagtctgttctgctggttggcgctgcgtttgaaactggcgcatctgcctgagggaacgacttatcagcaaattatggtggtggggatcctgtgcggtatcggttttactatgtctatctttattgccagcctggcctttggtagcgtagatccagaactgattaactgggcgaaactcggtatcctggtcggttctatctcttcggcggtaattggatacagctggttacgcgttcgtttgcgtccatcagtttag

SEQ ID NO: 77 - DNA, 2649 bp, Agrobacterium tumefaciens
atgcccgctgaaaccaaaaccacctgcccctattgcggcgtcggctgcggcgtcatcgccaccgtcaatgattccggcgtcgtttccgtcaagggcgacccggaccaccccgccaatttcggtcggctatgctccaagggttcggctctcgccgaaaccatcgatctcgacggccgcctcctccacccggaaatcgccggcaggcgggcggcatgggacgaggcgctcgatctcgtcgcttcccgtttttccgacgccattgccgaacacggcccggattcggtcgccttttacgtttccggccagttactgacggaagattattacctggcgaacaagctgatgaaaggtttcatcggctcggccaatatcgacaccaattcaaggctctgcatgtcgtcctccgtcgccggccaccgccgcgccttcggcgcggatacggtgccgggaacctacgaggatatggagcttgccgatctggtgatcctcaccggttccaacctcgcctggtgccatcccgttctttatcaaaggctggcggcggcgaaggcggcgcggccggggatgaaggtcgtcgtcatcgatccgcgccggacgatgagcgctgatattgccgatatgcaccttgcaatccgcccggatggcgatgtggcgctgtttaccggcctgctggcgcatcttttcgccagcagcgcaatagaccgcggttacgttgaaaaccacacggccggtttcgaggccgccacgcaggccgcaagtgagcatagcctgccggaaattgccgaggccaccggcctgaccatcgccgaactgattcccttttatgaattgttcgagcgcacggaaaaaaccgtcacctgttacagccagggcgtcaaccagtcggagagcggcaccgacaaggtcaacgccatcatcaattgccacctcgccaccggccgcatcggcaggccgggcatggggccgttttcgctgactggtcagccgaacgccatgggcgggcgcgaggttggcgggctggcaaacatgctggctgcccatatgtccatcgaaaatgctgacgaccgcgaccgcgtgcagcgcttctgggcctcgcccgccatcgcgcagaaacccggtctcaaggcggtggatatgttccgggcggtggctgatggccgcatcaaggcgctgtggatcatggccacaaacccggtcgtctccatgccggatgccggtgccgtcgaggtgacgatcaaggcctgtcctttcgtcgtcgtctccgatgtcatggccaatacagacacggcccgccatgctcatgttcttctgccctcgctcggttggggcgaaaaggacggtacggttaccaattccgaacgacgcatttcccgtcagcgcagctttctcgatgcacccggcgaagcgaaagccgactggtggcagatggcggaagtggcccgacgcatgggcttcgacgctgcttttgcttaccagcagccctcggagatttttgcagaacatgcagccctttcgggtttcgagaatgcggggcgtcgggattttgatatcggcggaatcgaacgcgattcctacgagacgatggcacccgtccagtggccgaaagccggggccggcgaggccgaggtgacgcgcttttttgcaaatggccggttttatcatgccgatggcaaggcacgcttcatcgccaccgccctgccggagacggacagaacatcggcggactatccgctgacgctaaataccggccgcattcgcgatcaatggcacacgatgacgcgcaccggcaaaagcgcgcgtctcaccgcccatattgccgaaccttttgcagaaattcacccgcgcgatgcgcaggcgctcggcataaaaagcgccgatctggtggagctggaaagcccgcacggcaaggtcctgctgcgggcgctggtcagtgaaaggcaggcgcggggatcggtctttgcgccgatgcactggaacgaccagttcgcgtcgcgggcgcggatcgatgtcgttgtcgcgccggtcacggacccgcattccggccagcccgcttcgaaaaacgtgggcgtgagggtaacgcgcttcgaggcgagcgcctatggtttcgccatctgccgcagccggccggatgcgccggattgcgcttattgggccgtcgccaaggccgagggcggctatcggatggagcttgccttcgcggaagcgcctgaagactggacgctctgggcgcggcgggtcttcggcatcgatgtccggatcgagccgctgggctatagcgaccggcagacgggcgatctgcgccttgcctttttcgacggcgatacgctgcttgcagcgctgttcatcgcgcgggagccggtggcggtcgctcgcaactgggcgatatcgcagctttccgagcgccatgaggatttgcgcatgcggtttgcgctggtcgccggtcgtccgggggccgggcgggccgatccgggcgcaacggtctgctcctgctttaatgtcggggtgaaccagatcaccgccgccattcgtgagggctgccacagtgtcgaagccatcggcaatgcgttgaacgccggaaccaattgcggctcctgccgcgccgaaatcagggggatcatcgatggatgccttaaaaccgcagcggaatag

SEQ ID NO: 78 - DNA, 279 bp, Zea mays
atgtcgaaccggaggtcacggtccaggcagtctggttcgtcgaggatcactgaggagcagatcagcgaccttgtatcaaagctgcaggacctcctccccgaagctcgccttcagagcaatgcaagagtgccatctgcgagggtgttgcaggagacatgcaactacatcaggaacttgcaccaggaggtggacgacctgagcgagaggctgtcggagctgctggctacgtccgacatgagcagcgcgcaggcggctgtcatccggagcctgctcatgtag

SEQ ID NO: 79 - DNA, 489 bp, Zea mays
atgtctgccgcggagggagccgtcgtgttcagcgaggagaaggaggcgctggtgctcaagtcatgggccatcatgaagaaggattccgccaaccttgggctccgcttcttcctcaagatcctcgagatcgcgccgtcggcgaggcagatgttcccgttcctgcgcgactccgacgtgccgctggagaccaaccccaagctcaagacccacgccgtgtccgtcttcgtcatgacgtgcgaggctgctgcgcagctgcggaaagccgggaagatcaccgtcagggagaccaccctgaagaggctgggcggcacgcacttgaaatacggcgtggcagatggccactttgaggtgacgcggttcgctctgctcgagacgatcaaggaggcgcttccggcggacatgtgggggccggagatgaggaacgcgtggggcgaggcctacgaccaactggtcgcggccatcaagcaagagatgaagccctctgagtag

SEQ ID NO: 80 - DNA, 357 bp, Nostoc punctiforme
atgagcacattgtacgacaatattggtggacaaccagctattgaacaagtagtagatgaactccacaaacgcattgctacagacagcctcctcagtcccatttttgctggtacagatatggcgaagcaacgtaatcatctagttgctttcttaggtcaaatatttgaagggccaaagcagtacggcggtcgtccaatggacaaaacccacgcaggattgaatttacagcaaccacacttcgatgcgatcgccaagcatctcggtgaagcaatggctgtgcgtggagtgtcagcagaaaacactaaagctgcactagatcgcgtcacaaatatgaagggcgctattttgaacaagtag

SEQ ID NO: 81 - DNA, 519 bp, Oryza sativa
atgcagtcgctgcaggacaaggcgtcggagtggagcggcgtggcggcgggggatgcgttcgccatcgacgatgggaacgtcttcgaggcgctgggcggcaccacgcagccgttcgtcgacctctccaccaacttctacaccagggtttatgaggacgaggaggagtggttccggcagatcttcgcggggtcgaagaaggaggacgcgatccggaaccagtacgagttcttggtgcagcgcatgggcggcccgcagctcttctcccagaggagaggacatcctgccctgatagcacggcatcgaccattccctgttacccaccaggctgcagagcgatggctgcaccatatgcagcaagctgtggatactactgacagcatagacgctgccacaaaaaccaaaatgatgtattttttcaggcacactgcatacttccttgttgccggaaatgagatgacaaggcaaggccatggaacttcctgcaagtgcaaacatggagaaagcaaaccagcagaatag

SEQ ID NO: 82 - DNA, 519 bp, Zea mays
atgcagtcgctgcaggacaaggcgtcggagtggagcggggtggcggccgccgatgcctttgccatcgacgacgtcaacatattcgagtccctcggcggcactccgcagccattcgtcgacctttccaccaatttctacaccagggtttatgaggacgaggaggagtggtttcgagagatattcggggggtccaagaaggaggatgccatccagaaccagtatgagttcctgatccagcgcatgggcggcccacctctattctcccagaggagaggacaccctgcccttataggacgacaccgaccattcttggttacccaccgagctgcagagcggtggctacaccacatgcaacaagctttggacgcaactgaaagcatagatgtggactcaaaaacgaaaatgatgaacttctttaggcacactgcttacttccttgttgctggcaatgagatgacaaggcaacagggccatggagtagcctgcaaacatgcaacgagcaaaccagccgagtaatag

SEQ ID NO: 83 - DNA, 1449 bp, Zea mays
atggcgctcacaagaatcggtcttgctggccttgcggtcatggggcagaaccttgccctcaacattgcagagaaagggttccccatctctgtgtacaacaggacaacctccaaggtggacgagaccgtgcagcgtgccaaggcagaaggaaaccttcccgtctacggcttccatgaccccgcgtcctttgtgaactccattcagaagccacgggtggtgatcatgctcgtcaaggccggcgcgccagttgaccagaccatcgcgacgctcgcagctcacttggagcagggcgactgcatcatcgatggggggaacgagtggtacgagaacacggagaggagggagaaggccatggaggagcgcggcctcttgtatcttggcatgggtgtctctggaggagaggagggtgcccgcaacggcccgtccttgatgcccggaggctcgttcgacgcttacaagtacgtcgaagacattgttctcaaggtggctgctcaggtccctgacagtggcccgtgtgtcacgtacattggcaaaggtggatcgggcaactttgtcaagatggttcacaacggaatcgagtatggcgatatgcagctgatttccgaggcatacgacgttctcaagtcggtcggtaagctcaccaacagtgagctgcaccaggtgttctccgagtggaacaagggcgagctcctgagcttcttgatcgagatcacggccgacatctttggcatcaaggacgagcatggcgatggctacctggtggacaaggtccttgacaagaccgggatgaaagggacagggaagtggacggtgcagcaggccgccgagctgtcggtggccgctcctacgatcgaggcgtccttggactcgaggttcctgagcgggctgaaggacgagcgggtggaggcctccaagatcttccagggtgactactactccaccggctcgccggtggacaaggcgcagctggtggaggacgtgaggcaggccctgtacgcgtccaagatctgcagctacgcgcagggcatgaacatcatcaaggccaagagcgcggagaaaggctgggggctcaacctcggcgagctggccaggatctggaagggcgggtgcatcatccgcgccatcttcctggaccgcatcaagaaggcctacgacaggaacccgggcctcgccagcctgctcgtagaccccgagttcgcgcaggagatcatggacaggcaggcggcgtggcgcagggtggtgtgcctcgccatcaacaacggcgtcagcaccccgggaatgtccgctagcctggcctacttcgactcctaccgcagggacaggctgcctgccaacctggtgcaggcccagagggactacttcggggctcacacctacgagagggtcgacatgcctggctctttccacaccgagtggttcaagattgcgcgcaacatctccaacaactag

SEQ ID NO: 84 - DNA, 765 bp, Zea mays
atggcgctcgcgtccacctccgccaccgcgcccgctgccgtgctcaagaccccgttccttggcgccaggcgcgcgctcgccaatgccgccgcgcccaagcccgcgccgcgccgcgcgctcctcgccgtcgccgcggccgccgccaagaagtcgtggatccccgccttcaagagcgacgccgagttcatcaacccgccctggctcgacggatcgctccctggcgacttcgggttcgatccgctggggctgggcaaggacccggcgttcctcaagtggtaccgggaggcggagctgatccatgggcggtgggcgatggccgccgtgctgggcatcttcgtggggcaggcctggagcggcatcccgtggttcgaggccggcgccgacccgggcgccatcgcgcccttctccttcggctcgctgctgggcacgcagctgctgctcatggggtgggtggagtcgaagcggtgggtggacttcttcaacccggactcgcagtccgtcgagtgggccacgccctggtcccgcactgccgagaacttcgccaacttcaccggcgaccagggctacccgggcggcaagttcttcgacccgctcggcctcgccggcaccgtcaaggacggcgtctacgtccccgacgtcgagaagctcgagcggcttaagctggccgagatcaagcacgcccgcatcgccatgcttgccatgctcgttttctacttcgaggccggacagggcaagacgccgctcggcgcgcttggcctatgatag

SEQ ID NO: 85 - DNA, 420 bp, Zea mays
atgagaattagcacagacaagagacaacgcagcagaggatctcgagctgaagcggagcccagatccagaaactgcgcgagacgaacaccaaagcaaactgcatcgattcaagaaagggaactctttttttcgtgcctatttttccccctgtgccaagatgtgacactgactgagcagccgtcggtggatgaacggatctggtccttcagcgcggctgctggatggggcgggggctcaccctggcggcggcggccaccctccgcggcgccttctccgcgtacctcggggtctccggcggcccaccgtgcgccctccaccacctgtcgatgccccacgccgccacctcaagccctcggcccgccctcctgcttgcgtgcgcgcccttcttgcttctcgacgacgattaaaaggctaacctag

SEQ ID NO: 86 - DNA, 702 bp, Zea mays
atgacggtgctggacgccgagtcgcggttccatgtcctggcggtggacgacagcatcatcgacaggaagctcatcgagatgctgctcaagagctcgtcttaccaagtgaccacggtggattccgggaacaaggcgctggagctgctggggctgagggacaacggcgcggaggacgcgtcgccgccgtcatcgtcctcatcatcttcgtcgtcgtcctcccctgaccatcaggagatcgacgtgagtctcatcatcactgactactgcatgcccggcatgacaggatacgatctgctcaagcgagtgaaggggtcctcatcgctcaaggacattccggtggtgatcatgtcgtctgagaacgtgcctgcccggatcagcaggtgcttgcaggatggcgcggaggagttcttcctgaagcccgtgaagccggccgacatgaagaagctcaagtcacacctgctgaagcggaagcagcccaaccagaagaacaagcctcaggcgcaggcggtggagtctcctgagcagcagctggacccgcatccgcagccggtgcacgagccggaggaagccgcggcagatcgcaacggcgtcaacaagaggaaggcagcggccatggaggaggggctgaccgtggtggtgacggcgccggagagcaccaagccgaggaggctgtctacgagcagcctgactgtggagacctag

SEQ ID NO: 87 - DNA, 1833 bp, Zea mays
atggcggctctggccacgtcgcagctcgtcgcaacgcgcgccggcctgggcgtcccggacgcgtccacgttccgccgcggcgccgcgcagggcctgaggggggcccgggcgtcggcggcggcggacacgctcagcatgcggaccagcgcgcgcgcggcgcccaggctccagctgcaccagcagcagcagcaggcgcgccgcggggccaggttcccgtcgctcgtcgtgtgcgccagcgccggcatgaacgtcgtcttcgtcggcgccgagatggcgccgtggagcaagaccggcggcctcggcgacgtcctcggcggcctgccgccggccatggccgcgaatgggcaccgtgtcatggtcgtctctccccgctacgaccagtacaaggacgcctgggacaccagcgtcgtgtccgagatcaagatgggagacaggtacgagacggtcaggttcttccactgctacaagcgcggagtggaccgcgtgttcgttgaccacccactgttcctggagagggtttggggaaagaccgaggagaagatctacgggcctgtcgctggaacggactacagggacaaccagctgcggttcagcctgctatgccaggcagcacttgaagctccaaggatcctgagcctcaacaacaacccatacttctccggaccatacggggaggacgtcgtgttcgtctgcaacgactggcacaccggccctctctcgtgctacctcaagagcaactaccagtcccacggcatctacagggacgcaaagaccgctttctgcatccacaacatctcctaccagggccggttcgccttctccgactacccggagctgaacctccccgagagattcaagtcgtccttcgatttcatcgacggctacgagaagcccgtggaaggccggaagatcaactggatgaaggccgggatcctcgaggccgacagggtcctcaccgtcagcccctactacgccgaggagctcatctccggcatcgccaggggctgcgagctcgacaacatcatgcgcctcaccggcatcaccggcatcgtcaacggcatggacgtcagcgagtgggaccccagcagggacaagtacatcgccgtgaagtacgacgtgtcgacggccgtggaggccaaggcgctgaacaaggaggcgctgcaggcggaggtcgggctcccggtggaccggaacatcccgctggtggcgttcatcggcaggctggaagagcagaagggccccgacgtcatggcggccgccatcccgcagctcatggagatggtggaggacgtgcagatcgttctgctgggcacgggcaagaagaagttcgagcgcatgctcatgagcgccgaggagaagttcccaggcaaggtacgcgccgtggtcaagttcaacgcggcgctggcgcaccacatcatggccggcgccgacgtgctcgccgtcaccagccgcttcgagccctgcggcctcatccagctgcaggggatgcgatacggaacgccctgcgcctgcgcgtccaccggtggactcgtcgacaccatcatcgaaggcaagaccgggttccacatgggccgcctcagcgtcgactgcaacgtcgtggagccggcggacgtcaagaaggtggccaccaccttgcagcgcgccatcaaggtggtcggcacgccggtgtacgaggagatggtgaggaactgcatgatccaggatctctcctggaagggccctgccaagaactgggagaacgtgctgctcagcctcggggtcgccggcggcgagccaggggtcgaaggcgaggagatcgcgccgctcgccaaggagaacgtggccgcgccctag

SEQ ID NO: 88 - DNA, 1020 bp, Escherichia coli
atgaaccaacgtaatgcttcaatgactgtgatcggtgccggctcgtacggcaccgctcttgccatcaccctggcaagaaatggccacgaggttgtcctctggggccatgaccctgaacatatcgcaacgcttgaacgcgaccgctgtaacgccgcgtttctccccgatgtgccttttcccgatacgctccatcttgaaagcgatctcgccactgcgctggcagccagccgtaatattctcgtcgtcgtacccagccatgtctttggtgaagtgctgcgccagattaaaccactgatgcgtcctgatgcgcgtctggtgtgggcgaccaaagggctggaagcggaaaccggacgtctgttacaggacgtggcgcgtgaggccttaggcgatcaaattccgctggcggttatctctggcccaacgtttgcgaaagaactggcggcaggtttaccgacagctatttcgctggcctcgaccgatcagacctttgccgatgatctccagcagctgctgcactgcggcaaaagtttccgcgtttacagcaatccggatttcattggcgtgcagcttggcggcgcggtgaaaaacgttattgccattggtgcggggatgtccgacggtatcggttttggtgcgaatgcgcgtacggcgctgatcacccgtgggctggctgaaatgtcgcgtcttggtgcggcgctgggtgccgaccctgccacctttatgggcatggcggggcttggcgatctggtgcttacctgtaccgacaaccagtcgcgtaaccgccgttttggcatgatgctcggtcagggcatggatgtacaaagcgcgcaggagaagattggtcaggtggtggaaggctaccgcaatacgaaagaagtccgcgaactggcgcatcgcttcggcgttgaaatgccaataaccgaggaaatttatcaagtattatattgcggaaaaaacgcgcgcgaggcagcattgactttactaggtcgtgcacgcaaggacgagcgcagcagccactag

SEQ ID NO: 89 - DNA, 1611 bp, Arabidopsis thaliana
atgaacgccgccgtgtttagtccttctgctttatctctccctatctccttctctaaaacccgatcctcttttctctccagaaagaagggcgtgaaaggagaatttagggtatttgctgtgtttggtgatgagagtggattagttgagaagaagagtcaatggagacctttgtttgatgtggaggatcctagatcaaaagctcctccttataaaggaaagtttttagatgttaatcaagctattgaagttgctaggtttgatattcaatacttggattggcgtgctcgtcaagatcttcttaccattatgattcttcatgacaaggttgttgatgtacttaatcctctagctcgtgagtacaagtccatcggtacagtgaagaaagaactagctggattgcaggaagaattatcgaaagcacaccaacaggttcatatatctgaagcaagggtttcgactgctttagacaagttagcccacatggaagaattggttaatgataggttgttacctggcagagttgtaacggaattagataaaccctcctcttcaaccactgcttctgctgtcgagttagatagggaaaagacaaacacgggtgcgaaaagcttgaatgtttctggtccggttccgccttatagtccacacttgaagaatttttggtatcccgttgctttcactgcagatctcaagcatgatacaatggtaccaattgaatgctttgaacaaccatgggttatctttaggggtgaagacgggaaaccaggatgtgtacggaatacatgtgcgcatagagcatgtcctcttgatcttggcacagtgaacgagggacgtattcaatgtccgtaccatggatgggaatactcaaccgatggagaatgtaagaagatgccgtctacaaagttactgaaggtgaagatcaaatcattaccttgtcttgaacaagaaggtatgatctggatttggcccggtgatgagccacctgcacctatacttccttctttacagcctccatcagggtttttaattcatgctgagcttgtaatggacctcccggtggaacacggtttacttctagataatctcttggatcttgctcatgccccattcactcatacatccacttttgcaaaaggctggagtgtcccaagtttggtgaagtttttaacacctacctcgggtctccaaggatactgggatccatatccaatcgatatggaatttaaaccaccgtgtattgttttatcgacaatcgggatatcaaaacccgggaaactagaaggcaagagcacacagcagtgtgcaacacatcttcatcaactccatgtctgtttaccttcttctaaaaacaagacaagacttctataccgaatgtcactagactttgctcctatattaaagaatcttccattcatggaacatctgtggagacatttcgctgaacaggtcttaaacgaagatctacggctagttttaggacaacaagaacggatgttaaacggagcaaacatatggaatttaccagttgcttatgacaagctcggagttcggtatagactatggaggaacgcagtagatcgtggcgatgataaactacctttctccggctag

SEQ ID NO: 90 - DNA, 405 bp, Escherichia coli
atgtccgtaatgttacaaagtttaaataacattcgcaccctccgtgcgatggctcgcgaattctccattgacgttcttgaagaaatgctcgaaaaattcagggttgtcactaaagaaagacgtgaagaagaagaacagcagcagcgtgaactggcagagcgccaggaaaaaattagcacctggctggagctgatgaaagctgacggaattaacccggaagagttattgggtaatagctctgctgctgcaccacgcgctggtaaaaaacgccagccgcgtccggcgaaatataaattcaccgatgttaacggtgaaactaaaacctggaccggtcagggccgtacaccgaagccaattgctcaggcgctggcagaaggtaaatctctcgacgatttcctgatctag

SEQ ID NO: 91 - DNA, 1677 bp, Saccharomyces cerevisiae
atggcagtccttaacttgaaacgtgaaactgtcgacattgaagagacagcgaagaaagatatcaaaccttattttgcttcgaatgttgaagcggttgatattgatgaagatcccgatgtttcaagatacgatccccagacaggagtgaaaagggcgctcaaaaataggcatatctcattgctagctttgggtggtgttattggcccaggttgtcttgttggtgcaggaaacgcactcaacaaaggtgggccacttgctttacttttaggctttagtattattgggatcattgctttctcagtgatggaatctataggtgaaatgatcactttatatccctcgggcggtggatttaccactttggctcgaagatttcatagcgatgcactgcctgcagtttgcggttatgcttacgttgttgtgttcttcgcagttttggcaaatgagtacaacactctctcctccatactacagttttggggcccacaagtccctctatatggttacatcttgatattctggtttgcatttgaaatttttcaactagttggcgttggtctttttggtgaaacggagtactggcttgcttggttgaaaatagtaggattagtagcctattatattttctcgattgtttacatatctggggatattaggaatagaccagctttcggctttcattattggaatagtccaggtgcattatcacatgggtttaagggaattgcgatagtgtttgtgttttgttcgaccttctattctggaacggaatcagttgccttggctgcaacggaatcaaaaaaccctgggaaggctgtgccacttgctgttcgacaaactctgtggagaattttagttgtttatattggaattgctgttttctatggagcaactgttccgtttgacgacccaaacctctctgcttctaccaaagtcctaaaatctcccattgctatcgccatatctcgtgctggttgggccggcggagctcatctggttaatgccttcattttgataacttgcatctccgccattaatgggtcactttatatagggagcagaaccttgacgcatttagcacatgaaggcctagctccaaaaattctggcttggaccgatcgaagaggcgttcccatccccgccatcactgttttcaacgccttgggcctaatatcattgatgaatgtgagcgttggagctgcaaatgcgtactcttatatcgttaatctttctggtgttggcgtctttattgtctggggtgtaataagttatacgcacctgagaataaggaaggcgtgggttgctcaaggaagatccatagaagagctaccttatgaagcgctattttatccgtggacgccagtacttagtctggccgctaacatttttctagcactcatccaaggatggagctatttcgtaccttttgatgcgggcaattttgttgatgcttatatccttctgcctgttggaattttattgtatattggcatatgtgtttttaagagcaatcattttagaactgttgatttgcggtcaatcaacctagacgaaggacgaagaaaagacatggaggctgatctttctgatcaagagagtagcttagcatcttcggaaacgatgaaggattataaaagtgcaacttttttcagatacctcagcaacattttcacctag

SEQ ID NO: 92 - DNA, 315 bp, Zea mays
atgagcgcggcggcgggcggactgcggcggctgctggcggcggcggcgacggcgggagccgcggaggtgcgggcgtccatcttcggccacgcgctgaaccctacggggaggcgcgcggcgacgaagctcctgcggaagaagatggtgggcgaccaggtggcgcagtggtacccctacgacatcaagcgcgacgacccgctcgtcatggcgcgcgaggagaaggagcgtctggctaaactggaaatgctgaagcgtcgtggcaagggcccgccgaagaagggtcagggaaggcgtgccgtcaagaggagcaagtag

SEQ ID NO: 93 - DNA, 414 bp, Escherichia coli
atgagcgaagcacttaaaattctgaacaacatccgtactcttcgtgcgcaggcaagagaatgtacacttgaaacgctggaagaaatgctggaaaaattagaagttgttgttaacgaacgtcgcgaagaagaaagcgcggctgctgctgaagttgaagagcgcactcgtaaactgcagcaatatcgcgaaatgctgatcgctgacggtattgacccgaacgaactgctgaatagccttgctgccgttaaatctggcaccaaagctaaacgtgctcagcgtccggcaaaatatagctacgttgacgaaaacggcgaaactaaaacctggactggccaaggccgtactccagctgtaatcaaaaaagcaatggatgagcaaggtaaatccctcgacgatttcctgatcaagcaatag

SEQ ID NO: 94 - DNA, 270 bp, Zea mays
atgccttcactccagaaagcattgcctccagaacttgctgataatgtgctcaggttatatcgtgaatgcttacggagggcgaagtatattggccatcagaaacacaatacagaacttttagtcgccatggtgagacaacaattcaagaaaaacatgcatgaaactgatccagagaagatacagaaaatgaaggacgatgctgcaaggggccttatcaatcatattctatatgagtccgagaagattacaggacgcaagttttcaggttag

SEQ ID NO: 95 - DNA, 1431 bp, Chlorella sorokiniana
atggacgccaccaccggcgacttcacggcgctgcagaaggcggtgaagcagatggccaccaaggcgggcactgagggcctggtgcacggcatcaagaaccccgagctgcgccagctgctgaccgagatcttcatgaaggacccggagcagcaggagttcatgcaggcggtgcgcgaggtggccgtctccctgcagcccgtgttcgagaagcgccccgagctgctgcccatcttcaagcagatcgttgagcctgagcgcgtgatcaccttccgcgtgtcctggctggacgacgccggcaacctgcaggtcaaccgcggcttccgcgtgcagtactcgtccgccatcggcccctacaagggcggcctgcgcttccacccctccgtgaacctgtccatcatgaagttccttgcctttgagcagatcttcaagaacagcctgaccaccctgcccatgggcggcggcaagggcggctccgacttcgaccccaagggcaagagcgacgcggaggtgatgcgcttctgccagtccttcatgaccgagctgcagcgccacatcagctacgtgcaggacgtgcccgccggcgacatcggcgtgggcgcgcgcgagattggctaccttttcggccagtacaagcgcatcaccaagaactacaccggcgtgctgaccggcaagggccaggagtatggcggctccgagatccgccccgaggccaccggctacggcgccgtgctgtttgtggagaacgtgctgaaggacaagggcgagagcctcaagggcaagcgctgcctggtgtctggcgcgggcaacgtggcccagtactgcgcggagctgctgctggagaagggcgccatcgtgctgtcgctgtccgactcccagggctacgtgtacgagcccaacggcttcacgcgcgagcagctgcaggcggtgcaggacatgaagaagaagaacaacagcgcccgcatctccgagtacaagagcgacaccgccgtgtatgtgggcgaccgccgcaagccttgggagctggactgccaggtggacatcgccttcccctgcgccacccagaacgagatcgatgagcacgacgccgagctgctgatcaagcacggctgccagtacgtggtggagggcgccaacatgccctccaccaacgaggccatccacaagtacaacaaggccggcatcatctactgccccggcaaggcggccaacgccggcggcgtggcggtcagcggcctggagatgacccagaaccgcatgagcctgaactggactcgcgaggaggttcgcgacaagctggagcgcatcatgaaggacatctacgactccgccatgggcgcgtcccgcgagtacaatgttgacctggctgcgggcgccaacatcgcgggcttcaccaaggtggctgatgccgtcaaggcccagggcgctgtttag

SEQ ID NO: 96 - DNA, 1209 bp, Arabidopsis thaliana
atgttcccaatgtcttccacatccagatcttccgccgccaataatcgcaaagatccaccgcgtaagaaaaacaaggagacgccatctccggtgacgagagaaccaacctcgatcgattcacttcctaatgacttgttattgaactgctttgcccgtgtctctagaatgtattatcccgctctgtctcgtgtctccaagagatttcgatccatcgttacttcaccagagatttacaacactcgatctctcttaaaccgtaccgagaagtgtctctatctatgcttacgcttccctttcgacaataacacacactggttcactctctaccaaaaccctaatcgaaccgtaagcgacaaggtttttctccaaattccatctccccagtatcctcttacgctatcgtcgaatctcgtcgccgttggttctaatatctacagaatcggtggaaccgttggtgatgattcctgccctctcggcttcgatagggaaccttcttcgaaagtctctatcctggattgtcggtctcacacgtggcgtgatggtccgaggatgcgattgaacaggagatcctccacaacaagcgtagttgatgggaagatatatgtaacaggaggcactgaagacacggataatccctcacactggatcgaagtgtttgatccaaaaacacaaagttggggaactgtgacgaaccctcacatcgtcaaggtttgggaggaggtatgctatagacgtgcagtcaaaagcataggacatgacggaaaattatacctgtctggggataagtatgtggtttacgacccagatgaaggtaaatggaactcagtagaagagcattggcttataggttatgcaataggctcgagtaattgcgtggtcgacaacatcttgttctactgggatcaaggagtgttcaaatggtatgacagtaaggtaagttcatggaagcaattgaaaggccttgaagggttacctgatgattttagccagcgtgagtattgtaagttggtggatcttggtgggaagatggcggtgttgtgggataaatgggagtattctggggtctgcatgattttctgtgctgagatttcacttgaaaagcgcgatggagatgagatttgggggaaggttgagtggtttgatactgtacttgaagttggagcgtcttgtagcttgaaaagtgcggatgctctttcagcttctgtttag

SEQ ID NO: 97 - DNA, 705 bp, Arabidopsis thaliana
atgggagagaaagaggaagtgaaactattaggagtatggtacagtccatacgccataagacctaagatcgctcttcgtctcaaatcagtggattatgattacgttgaggaaaatctgtttggatccaagagtgagcttcttctcaaatcaaacccggttcacaagaaagtccctgttctcctccacaacaacaaaccgattgtcgagtctctcaacatcgttgaatacattgatgagacgtggaactcatctgcaccgtccattcttccttcacatccttatgatcgtgctcttgctcgcttttggtctgacttcgttgataacaagtggtttccggcgttgagaatggcggcgatcactaaatcggaagacgcaaaagcgaaagccatggaagaagtggaagaagggttgttgcaactcgaggatgcgtttgtttctataagcaaagggaaaccctttttcggcggtgaagcaatcgggtttatggatatttgctttggaagctttgtggttctcttgaaagctagagaaaagtttaaagcagaaaagcttttagacgaatcaaaaactccttctctttgtaaatgggccgaccggttcttgtccgatgaaacggtgaagaatgtggcaccggagatcgaaaaagtagctgagtttctacaagaacttgaggttagagctcaatccgcagcttcaagatcttag

SEQ ID NO: 98 - DNA, 873 bp, Arabidopsis thaliana
atggaggtctcatggaatgaattacatatcaaagagcgtgtgggtgctggatcatttggaactgttcatcgtgctgagtggcatggatcagatgttgctgtcaagattttgtctattcaagatttccatgatgaccaattcagagaatttctcagagaggttgctataatgaaacgtgttcgtcacccaaatgttgttctcttcatgggtgctgtgacagagcgaccccggttatcaataataacagaatatttgccaagaggcagtctttttcgccttatccataggccagcttctggggagttgctagatcagaggaggaggctacgtatggcattggatgtggccaaggggctcaactacctacactgtcttaatcctcctgtagtgcattgggacctgaaatctccaaatctactggttgataagaactggacagtgaaggtttgcgattttggactttcaagattcaaggcaaacactttcataccatcaaaatctgttgcaggaacacctgagtggatggctccagagtttcttagaggggaaccgacaaacgagaaatcagatgtttacagtttcggagtagtcttatgggagttgattactttgcaacagccttggaatggactcagtcctgctcaggtggttggagcagttgcattccagaacaggcggcttataattcctcccaacacctctccggttttggtatctctaatggaagcttgctgggcagatgagccgtctcagcggccagcatttggtagtatagtggacacattgaagaagctactaaagtctccggtgcagctgatccaaatgggtggagacaaaggggtaattccaactaaatcagctcccatactatag

SEQ ID NO: 99 - DNA, 330 bp, Arabidopsis thaliana
atgtcgaatctaactagcaaatttttattaaacccgttgaatgttcataagcattgtgcagtttcagatgaaaatggtgatagaaaatctcatgttctgaaacaggtgtgttcatgtatctgctgttgcaacagaaggaacaagactcaagctaggagccagaaagggtcctactttataaaagggaaggtccatccggtaagtagaatggagaagtgggaggagaagatcacagaagctaatagtcatggcaaaattgtaagctcttcctcctatgatttgcctttctatgttgttttgcattcttcctctgtagatagctcgacatag

SEQ ID NO: 100 - DNA, 3015 bp, Arabidopsis thaliana
atgatgaaactttttcttctccttctttttcttctccacatttctcataccttcaccgcaagccgaccaatctccgagttccgtgctctcctctcactcaaaacctctctcaccggcgccggagatgacaaaaactcgcctctctcttcctggaaagtctcaacaagcttctgtacatggattggtgtcacgtgcgatgtatctcgccgtcacgtgacttctcttgatctctccggtctcaacctctccggtactctttccccagatgtttctcatttacgtcttcttcagaatctatcactcgctgaaaatctaatctccggtccgattccgccggaaatctcgagcctttccggtcttcgtcacttaaatctctcgaacaatgtcttcaacggttcgtttcccgatgagatttcttctggattggtgaatctccgagttcttgatgtctacaacaacaatctaaccggagatttaccggtttccgtcaccaatctgactcagctccggcaccttcacctcggtggtaactacttcgctggaaagatcccgccttcgtacggaagctggccagttattgagtatctagcggtttccggcaacgagcttgtcgggaaaatccctccagagatcggaaacctaacgactctccgggagctttacatcggctactacaacgctttcgaagacggtcttcctccagagatcggaaatctatcggagctagtcagattcgacggagctaattgcggattaaccggtgagattccgccggagattgggaagcttcagaaactcgatacgcttttcttgcaagtgaatgtcttctccggtccattaacttgggagctaggaacgctatcgagtttaaaatcaatggatttgtctaacaacatgttcaccggagagattccagcgagtttcgcagagttgaagaatctcacgcttttgaatctcttccgtaacaaacttcacggcgagataccggagttcatcggagatttgccggagcttgaagtgttacagctttgggagaacaatttcaccggaagcatcccgcagaaattaggagaaaacggtaaactaaatctcgtcgatctctcttccaataagctgaccggaactttaccgccgaacatgtgctccggtaacaagttagaaactttaatcactcttggaaactttctctttggttcaatccctgattctcttggtaaatgtgagtctttgacccggatccgaatgggtgagaatttcctgaacgggtcaatcccaaaaggactattcggattacccaaattaactcaagtggagctccaagataattatctctccggagagttaccagtcgccggaggtgtctctgttaatcttggtcagatcagtttatcaaacaaccagctctcaggtccattacctccggcgatcgggaacttcaccggcgttcagaaacttcttcttgatggaaacaagttccaaggtcctattccttcagaggtagggaagcttcagcagctctcgaagattgatttcagccacaacttgttctccggtcgaatcgcgccggagattagtcgttgcaagctcttaacgtttgttgatctgagcagaaacgagctctccggtgaaatcccaaatgagatcactgctatgaagatattgaattacttgaacctgtcgagaaaccatctggttggatcaatccctggttcaatctcgtcaatgcagagcttaacatctcttgatttctcttacaacaacctctccggtttagttccgggaacaggacaattcagttacttcaactacacatcgttcttgggtaatcctgatctctgtggtccttatcttggtccttgtaaagacggtgttgctaaaggaggtcaccagagtcatagtaaaggacctttatcagcttctatgaagttattgcttgttcttggactacttgtttgttcgattgcgttcgcggtagtagccataatcaaagctagatcattgaaaaaggcgagtgagtcacgggcttggaggttaacagctttccagagactagacttcacgtgtgacgatgtcttggattctctcaaagaagacaacattataggcaaaggaggagctggtattgtctataaaggcgtaatgcctaatggtgatctagtcgcggttaaaagactcgctgcaatgtctcgtggatcttcccatgatcacggcttcaacgcagagattcaaaccttaggaaggataagacacagacacatagtgaggcttctcggattttgctcaaaccacgagacgaatctacttgtctatgagtacatgcctaatggtagtctcggtgaggtgcttcacggtaagaaaggaggacacttgcattgggacacacgttacaagattgctcttgaagctgctaaaggactctgttaccttcatcacgattgttctccattgatcgttcacagagatgtcaaatcaaacaacatcctccttgattcaaactttgaagctcatgttgctgactttggtctcgctaaattccttcaagattccggtacttctgaatgtatgtctgcaatcgctggctcttacggctacatagctccagagtatgcgtatacgttgaaggtagatgagaagagcgatgtgtatagtttcggtgtggttcttttggaactcgtcaccggaagaaaacctgtcggagaatttggagacggtgtcgatatagtgcaatgggttcgtaaaatgactgattcgaacaaggattcggttctgaaagtattggatccgagactttcttcgattccgattcatgaagtgacgcacgtcttctatgtagcgatgctctgtgtagaagaacaagctgttgagaggccgactatgagagaagttgttcagattctcactgagatcccgaagttgccaccgtcgaaggatcagccgatgacggaatcagcgccggagagtgagctttcgccgaagtctggtgttcaaagtccgccggatctactcaatctatag

SEQ ID NO: 101 - DNA, 315 bp, Arabidopsis thaliana
atggccgctcgttcactctccggtgccgttaaatctctttgctccgccgcatccggaagtctgtcttgttccattgtcttaaggaggagttacgttgctacatcgcagaatgtaacagcagcaggattgagtaagggaggttccaccagagttatggtggggaagatggaacagagaggtttagatcaagaggcagagtctgcttggggaccagatccagttactggatactacagaccttccaatcgtgcggctgagattgatccagctgagctcagagagttgcttttgaaaaacaaagcaaagtctttctag

SEQ ID NO: 102 - DNA, 915 bp, Oryza sativa
atggcggagcatttggcttcaatatttgggactgagaaggatagggttaactgccccttttacttcaagattggggcttgccgtcatggggatcgttgctcccgtctgcacaacaggccaactgtgtcgccgacaattgtgcttgctaacatgtatcagcgccctgatatgatcacaccaggagtcgatgctcaaggccaacctattgatcctgaaaagatgcaggagcactttgaggatttctatgaggatatctatgaggagctgagcaagtttggtgaggttgagaccctcaatgtctgtgataaccttgctgaccacatgataggcaatgtgtatgtccagttcagggaggaagaacaggcagtcgctgcgcataatgcccttcaaggtcgcttctactcagggcgcccaataattgttgagtattcccctgtgactgatttccgtgaggcgacctgtaggcagtttgaggagaacagctgcaaccgtgggggctactgtaattttatgcatgtaaagcagattggcagggagctcaggaggaagctttatggggggcgatccaggaggagccatgggagaagccgcagcccaagcccacgccacaggaggggcaatcgtgaccgtgatgatttccgccgtgaacgtgatggttatcgtggtggtggtgatggttaccgtggcggcggcggtggcggtggtggtgacggttaccgcggcggtgatagttaccgtggtggtggtggtggtggacgcaggggtgggggcagcaggtatgacaggtatgatgatggaggaaggcgcaggcatggcagccccccaaggcgtgcaaggagcccagtcagggaaagcagcgaggaacgcagggcgaagattgaacagtggaaccgtgaacgggaggaaaagccttag

SEQ ID NO: 103 - DNA, 1170 bp, Lactobacillus delbrueckii
atggcttcctcagttctttcctctgcagcagttgccacccgcagcaatgttgctcaagctaacatggttgcacctttcactggccttaagtcagctgcctcattccctgtttcaaggaagcaaaaccttgacatcacttccattgccagcaacggcggaagagtgcaatgcatgcaggtgtggccaccaattaacaagaagaagtacggatccaaacggattggtattttgactagcggcggtgacgcccctggtatgaatgcagccgtaagagccgtaaccagagtcgcgatcgcgaacggtttggaagttttcggtatcagatacggttttgcaggtttggttgcgggcgacattttcccattggaaagtgaagacgtagcccacttgatcaatgtttccggtaccttcctctactctgcgcgttatcctgaatttgcagaagaagaaggacagctggctggtattgagcaattgaagaagcacggcatcgatgctgttgtcgttattggtggggatggttcctaccatggcgccctgcagctgacccgccacggcttcaactcaattggcctgccaggcacgatcgacaacgatatcccttacacggatgccacgatcggctatgacacggcctgcatgacggcaatggacgcgatcgacaagatccgtgacactgcttctagccaccaccgcgtcttcattgtcaacgtaatgggccgcaactgtggtgacatcgctatgcgcgtcggcgtagcctgcggggcggacgcgatcgtcattcctgaaagaccatatgatgtcgaagaaatcgccaaccggctcaagcaagcccaggaaagcggcaaggaccacggtttggtagttgttgctgaaggcgtaatgaccgctgaccaattcatggctgaactgaagaagtatggtgacttcgacgtccgggccaatgttttgggtcacatgcagcggggcggcacgccaactgtttctgaccgggtgctggcttccaagctgggcagcgaagccgttcaccttcttttggaaggcaagggcggcctggctgtcggcattgaaaacggcaaggttacttcacacgacatccttgatttatttgatgagtctcacaggggtgactatgacttgttaaagctcaacgcagatttatcaagatag

SEQ ID NO: 104 - DNA, 2205 bp, Umbelopsis ramanniana
atggcaccggctaggaccactttcttctacgatctagcgttatggatctttaatattatgctcgatgtcttctttaaggagatccgtccaaggggatctcataggattcctcgagaaggtccagtcatttttgtagttgccccgcatgttaaccaatttgtcgaccctcttattcttatgcgagaatgtggacggcgggtatcatttttgattgcagagaaatcaatgcatcagagaggcataggcatgttcgctcgcatgattaacgcaattcccgttattcggcctcaagacttggccaagcctggacaagggagaattcagctcctcaacaccaagacagatccattacgaattacaggcatcgacaccaaatttaccacagagttacaacctaaattctcaattgttttacccaaaaatgttgcgcaaatggaagtcgttcaggtactctctgataccgaaattctcatcaagaaagaagtcaaggaagccaaagctctagctcttttaacctcaccggaaggcagtgcatacaaatgtataccgcatgtggaacaagactccgtttacaaggttgttcatgattcactaaacaataatcagtgtattacgatatttcctgaaggaggcagtcatgaccgcgctgagatgcttccactcaaagccggtgtcacattaatggccttgggggcaatggcaaaatatcctggacttgatgttaaaattgttccatgcggtttaaattattttcacgcacatcgcttccgctctcgagctgtcattgagtttggagatccaataacgatcagtgctgatatggtacaaaacttcaaggaaggtggtaacacgaaaagagatgcatgctcaaaattattggatatcatttataatgctttgaaaagcgtaactgttaatgccagtaactatgagactctgatgatgattcaagcagctagacgattgtacaaacctgctcatcgaaaattgcacatctcacaagttgtggacctcaatcgtcgattcgttatcggatataatatttataaagatgaccctaaagtcatcgaactgcagcacaaagttcttgcgtacaaccaacttattaagtatcatggactaaaagatcaccaagtaccaaagaccaatctaaggagacgggaaacctttgctctcctctcgtacagactcatgttattgtcggtatggggcattttagccttcccaggtgctattctcaatcttccaatcgcaattgtggcgaaatacatcagtacgcggaaggcaaaagaggcattggctggatcgactgtcaagttagcagggcgggatgtcctagcaacatggaagcttctcgttggcctggtgctcatcccaactctgtatggtttatacagtttcgtcgcatttatattcttgatgcgaacggaatggaattggaaatacaaggtgtttgttcccctgaccatatggaatactttaccctttatcagttatgccagcatgcgttttgcggagaacggtttagaagtgtacagatctattcgtcctttatatgtacgactcgttgatcgcgatagtgcagaaggcctgcgacaaaaccgcgaacgcttatcaaccgatatcacggatctcattaacgaatatgctcccaaggtctttaatgattttgatccggataatgtgtttagaccagcatccgttgcagctatggatgccgccagtgttccaagtacacctggtattgacttgcagagattggctagtggattcttcaccaatgctgcagcgcggatggattggcttgatgatcgtaatatctttaactggagtcgacaagaagaaagtgatgtcgatgattcgctgtactttttggatcgcaatagcggaggtataacgggctcggctagcgaagtagaaattaccgcgcataagcgacgcaaaagcactggtcgacgtagtcgcactggcagtctcatccatggtgaaagcggaggcatgaaagtagagtcgatgactacgctaaatgtacagaaaccgtttggtgaattacggctacctgtggctcggcgagcaggttttaaacacggtggagaccaagatgaagccggttcagaagcgacaatcgattatttgcgagttgaggacgatggttatgctggagaccgagaagaaaactcaaagttttcaaagaaaaccatttag

SEQ ID NO: 105 - DNA, 963 bp, Zea mays
atgtcgtcctcgtcctcgtcgtcctccgccgccacggtgttcccgccgtccccgcagctgccgccgcctctcctggtggagaacctgccgccgctgcatcagcttacgccgccggtagccgcggccgcgccggcctccgagcagctctgctacgtgcactgccacttctgcgacaccgtcctcgtcgtgagcgtgcctacgagcagcctgttcaagacggtgacggtacgatgcggccattgcagcagcttgctcaccgtcaacatgaggggcctcctcttcccgggcacgccggcgaacacagccgcggccgcggcggccgcgccaccaccaccacctgctgctgtcaccagtactaccgccaccatcaccacggcgccggcgccgccaccagccacctcggtcaacaacaacgggcagttccacttcatcccccactcgctcgacctcgcgctgcccatccctccccaccaatccctcctgctggacgagatatccagcgccgcgaacccgagcctgcagttgctggagcagcacggcctcggcggcatgatccccagcggcaggaacgcggccgcgctgcacccgcacccgccccagccccagccccagccgcccgcagcgggtaaaggggccaaagagccgtcgccgcgcgctaactccgccatcaacagacctccggagaagaggcagcgcgtgccgtcggcgtacaaccgcttcatcaaggacgaaatccaacgcatcaaggctggcaatcccgacatctcgcacagggaggccttcagcgcggcggccaagaactgggcgcactttccacacatccactttggactcatgccagatcaccaggggcccaagaagacaagcctgctacctcaggatcaccagagaagcgacggcggcgggctactaaaggaagggctgtacgctgcggcagccaacatgggggttgctccatactag

SEQ ID NO: 106 - DNA, 1080 bp, Zea mays
atggaggagatcacccaacactttggagttggcgcaagcagccacggccatggccacggccagcaccaccatcatcaccaccaccaccacccgtgggcatcctccctcagcgccgtcgtagcgccgctgccgccgcaaccgccaagcgcaggcctgccgctgaccctgaacacggtggcggccactgggaacagcggcggtagcggcaacccggtgctgcagcttgccaacggtggcggcctcctcgacacatgcgtcaaggcgaaggagccctcgtcgtcgtctccctacgcaggcgacgtcgaggccatcaaggccaagatcatctcgcacccacactactactcgctcctcactgcctacctcgagtgcaacaaggtgggggcaccaccggaggtgtcggcgaggctgacggagatagcgcaggaggtggaggcgcggcagcgcacggcgctcggcggcctggccgctgcgacggagccggagctggaccagttcatggaggcgtaccacgagatgctggtgaagttcagggaggagctgacgaggccgctgcaggaggcgatggagttcatgcgaagggtggagtcgcagctgaactcgctttccatctccggaaggtcgctgcgcaacatcctttcatctggctcttctgaggaggatcaagaaggtagcggaggagagaccgagctccctgaagttgatgcacatggtgtggaccaagagctgaagcaccatctcctgaagaaatacagtggctatctaagctcgctcaagcaggaactgtcaaagaagaagaagaaagggaagctccctaaggaggctcgccagcagccccttagctggtgggatcagcactacaaatggccttacccctcagagactcagaaagtggcactggctgaatctaccgggcttgacctgaagcagatcaacaactggttcatcaaccagcggaagcggcactggaagccatccgaggagatgcaccacctgatgatggatgggtaccacaccaccaatgccttctacatggacggccacttcatcaacgacggcgggctgtaccggctcggctag

SEQ ID NO: 107 - DNA, 1758 bp, Triticum aestivum
atgtgcggcatactggcggtgctgggctgcgctgatgacacccaggggaagagagtgcgcgtgctcgagctctcgcgcaggctcaagcaccgcggccccgactggagcggcatgcaccaggttggcgactgctacctctcccaccagcgcctcgccattatcgaccctgcctctggcgaccagccgctctacaacgaggacaagtccatcgtcgtcacagtgaatggagagatctacaaccatgaacagctccgggcgcagctctcctcccacacgttcaggacaggcagcgactgcgaggtcatcgcacacctgtacgaggagcatggggagaacttcatcgacatgctggatggtgtcttctccttcgtcttgctcgatacacgcgacaacagcttcattgctgcacgtgatgccattggcgtcacacccctctatattggctggggaattgatgggtcggtatggatatcatcagaggtgaagggcctgaatgatgattgtgagcactttgagatctttcctcctggccatctctactccagcaagcagggaggcttcaagagatggtacaacccaccttggttctccgaggtcattccttcagtgccatatgacccacttgctctcaggaaggctttcgaaaaggctgtcatcaagaggcttatgacggacgttccattcggtgttctactctctggtggccttgactcatcattggttgcagccgttacagttcgtcacctggcaggaacaaaggctgcaaagcgctgggggactaagcttcactctttttgtgtcggacttgaggggtcacctgatctgaaggctgcaaaggaggtagccaattacctgggcaccatgcaccatgagttcaccttcactgttcaggacggcattgatgcaattgaggatgtgatttatcacaccgaaacatatgatgtgacgacaatcagggcaagcacgccaatgttcctgatgtcacgcaagatcaagtcacttggggtcaagatggtcatctctggtgagggttccgatgagattttcggagggtacctctacttccacaaggcacccaacaaagaggagctccaccgtgagacatgtcaaaagatcaaagctctgcatcagtacgattgcttgagggccaacaaggcaacatctgcatggggcctcgaagcacgtgtgccattcttggacaaggagtttatcaatgaggcaatgagcattgatcctgagtggaagatgatccggcctgatcttggaagaattgagaaatggatgctgaggaaagcatttgatgacgaggagcaaccattcctgccgaagcacattctgtacaggcagaaagagcagttcagtgatggtgttggctacagctggattgatggcctaaaggctcacgcagaatcaaatgtgacagataagatgatgtcaaatgcaaagttcatctacccacacaacaccccgactacaaaagaggcctactgttacaggatgatatttgagaggttcttcccccagaactcggcgatcctgacggtgccaggtgggccaagcgttgcatgcagcacggcgaaggcggtagagtgggatgcccagtggtcagggaacctggatccctcagggagagcagcacttggagtccatctctcggcctatgaacaggagcatctcccagcaaccatcatggcaggaaccagcaagaagccaaggatgatcgaggttgcggcgcctggtgtcgcaattgagagttag

SEQ ID NO: 108 - DNA, 2154 bp, Zea mays
atggccaccgcggaccggacccggactttcatgaaggacgtcaaacgcgtcatcatcaaggtgggcactgcagtcgtcacgaggggtgatgatgggcgactggctgtgggccggttggggtgtctttgtgagcaggtaaaagagctgaatgtcttaggatacgaggtgatccttgtgacctcaggtgctgttggtgtggggaagcagaggctcaagtacaggaagcttgtcaatagcagctttgctgatctgcaaaagccacagatggagctggatggaaaggcttgcgctgctgttggtcagagtggcctcatggctctttatgatatgctatttacccaacttgatgtgtcctcctcgcaacttcttgtgacagatagtgattttgagaatccaaactttcgggagaggctctgtgaaactgttgagtcactattagaccttaaagttgtaccaatatttaatgaaaatgatgccatcagcactagaaaggctccatatgaggattcatctggtatattctgggataatgacagtttagctggtcttttggctattgaacttaaagcagatctccttgttctactaagtgatgtagatggtctatacagcggtccaccaagcgaaccgggatcaaagatcattcatacctacattaaagataaacattacagtggaataacttttggggataagtcacgtgtaggtagaggaggaatgacagctaaagtgaaggctgcttttgtggcttcgaacagtggcacacctgttgttattacaagtggatttgcatctcagagcattgttagagttctccaaggagagaagattggtactctcttccataaggatgcaagtctgtgggagccatccaaggatgttagtgctcgtgagatggctgttgctgcaagagaatgttcaaggcgtctgcagaatttatcatcggatgaacgcaagaaaatattgttagacattgcagatgctttggaacaaaatgaggatctaattagaactgaaaatgaagctgatgtatctgcagcacaagatgctggatatcagaaatctttggttgatagattgacattgaagccagaaaagatagcaagccttgcgaaatccatacgcactcttgcaaatatggaagacccaatcaaccagatactcaaaagaacagaggttgctgaagacttagtgctcgaaaaaacatcttgccctctgggtgtgctgttgattgtttttgagtccaggcctgatgccttagtccagattgcgtctttagcagttcgaagtggcaatggtcttctcctgaaaggtggaaaagaagccatgagatcgaacacagtattacataaggttataactggcgcaattcctgacaacgtgggtcaaaaacttattggccttgttacaagtagagatgaaatcgctgatttactaaagcttgatgatgtcattgatcttgtcattccaagaggcagcaataagctggtttcgcaaatcaaagcatcaactaagatacctgtcctcggtcatgcggatggtatttgtcatgtatacattgacaaatcagctgacatgaatatggcaaaacgaatagtgatggatgccaaaactgattacccagcagcctgcaatgctatggagacattgcttgttcataaagaccttataaaggctccaggtcttgatgatatactcctatcactcaaaacagaaggagttgctatttatggagggcctgttgcacatgaagtactgtgtattccgaaagcagattcattccatcatgaatatagctctatggcctgcacaattgagttcgttgatgatgtacagtcagcaattaaccatatacatcgttatggaagtgcacatacagattgcattatcaccacagatgataaagtagcagaaacttttctgcgtcaagttgatagtgctgctgtatttcataatgcgagtacacgattctctgatggggctcgttttggattgggtgccgaggttggcataagcacagggcgtatacatgctcgcgggcctgtgggtgttgaaggtctcttaacaacacgctggatcatgcgaggaagtgggcaagtggtgaatggtgacaagaatgttgcatacacccataagaaccttcccttacaatag

SEQ ID NO: 109 - DNA, 399 bp, Bacillus subtilis
atgggacaatcgtttaacgcaccatatgaagcgattggagaggaacttctatcgcaacttgttgatactttttatgagcgtgtctcgtctcatcccttgctgaagccgatatttccaagtgatttgactgaaacggccagaaaacaaaagcaatttttaacccagtatttgggcggacctcctctttatactgaagagcacggacatcccatgctcagagcaaggcatctcccctttccgattacggccgagagggctgatgcgtggctaagctgtatgagcaaagcgatggatcaggtcgggctggagggcgatattcgtgaatttctgtacgggcgtctggaactgacggccaggcatatggtaaaccagtcagaagcggaggatcgatcatcttag

SEQ ID NO: 110 - DNA, 711 bp, Zea mays
atgacaagaagatattggaacatcaatttgaaagagatgatagaagcgggagttcattttggtcatggtattaagaaatggaatcccaaaatggccccttacatctcggcaaagcgtaaaggtactcatattataaatcttgctagaacagctcgttttttatcagaagcttgtgatttagtttttgatgcagcaagtcagggaaaaagcttcttaattgttggtaccaaaaaaagagcagcggatttagtagcatcagctgcaataaggtctcgttgtcattatgttaataaaaagtggttcagcggtatgttaacgaattggtcgattaccaaaactagactttctcaatttagagacttaagagcagaagaaaaaatgggaaaattccaccatctcccaaaaagagatgcggcaatcttaaagagaaaattatctaccttgcaaagatatctcggcgggatcaaatatatgacgaggttgcctgacattgtgatcgtccttgatcagcaaaaagagtatatagctcttcaggaatgtgccattttggggattcctactatttctttagtcgatacaaattgtgacccagatcttgcgaatatatcgattcctgccaacgatgacactatgacttcaattcgattaattcttaacaaattagtatttgcaatttctgagggccgttctctctatataagaaatcgttag

SEQ ID NO: 111 - DNA, 468 bp, Escherichia coli
atgtacattatggaactgacgactcgcactttacctgcgcggaaacatattgcgctggtggcacacgatcactgcaaacaaatgctgatgagctgggtggaacggcatcaaccgttactggaacaacacgtactgtatgcaacaggcactaccggtaacttaatttcccgcgcgaccggcatgaacgtcaacgcgatgttgagtggcccaatggggggtgaccagcaggttggcgcattgatctcagaagggaaaattgatgtattgattttcttctgggatccactaaatgccgtgccgcacgatcctgacgtgaaagccttgctgcgtctggcgacggtatggaacattccggtcgccaccaacgtggcaacggcagacttcataatccagtcgccgcatttcaacgacgcggtcgatattctgatccccgattatcagcgttatctcgcggaccgtctgaagtag

SEQ ID NO: 112 - DNA, 1167 bp, Glycine max
atgggaaaacgagagaagcagaagcagaggcacgagaagggacaccgtggaagagggtctttcaactatcttcaagaggaccgtgattttgatgacactccaagaccctcaccctctgaagaagaatgtgctgatgacagcaatgaggaaaaagaagaagaagaagaagaagaaggtcatgaaaaccaatctcatgatatgccttccaagttcctcctttaccaacaatctgtgcagtcacccaaaggagatataagttatttgcaaaagttctttctcatgtacgtgggtggaaggatgcccctccatcttcaagaagatttctgtggcacggcgcttcttagtacagaatggctccgcagtgattcaagaagaacagtagtaggattagatttggatcttgaggcactcaattggtgcatggaaagcaacatacctaaagttggggctgatggattttcaagaatgtctctctttcatgggaatgtcctacaacctcttcagtctaaacttgtaaaaatagatcctcagcagctggtaagtgacatttcactgtcacagaatgaagaaaatcttcagactgatgtgccagaatctgatgctccaacaggctctgttgctcaagatgacaagtatactaagagaaacataatactgcctggaagagatatcgtgtgtgcttttaactacagctgctgttgtctacataaacgagcagaactggttctgtatttcaagcatgctcgtgaggccttgtcaactaaaggtggaatttttgtgatggatttatatgggggtacgtcatcagagcacaagttgaggcttcagagaagatttcccaattttacgtatgtatgggagcaagctgaatttgatattattcaacggaagacaaggattagcctccattttcatatgaagaaggaacaaagaaaacttcgccatgcattttcatacagctggcggttgtggacattgcctgaaattagggattgcctagaagaggctggatttcggtctgttcacttttgggttcgagagatgccagacaccacagaaattatgagaacagaggggtttggtgcgggaaagaatgtaaaatatgaagaggctacaagttttcagcaacaagattcttggaatgcttacatagttggtgttgcgtag

SEQ ID NO: 113 - DNA, 1725 bp, Zea mays
atggaggcagctgcagatgaggagaggccactgattcagtacctggctccagaggatgatgaagcttcctcacgatacactagcgacggaacgctcgatatcaacaagcagcgtgctctgaagaagagcaccgggaactggagagcatgcttcatgattctgggtaccgagttcgccgaatgcctggcattttacgcgaccgcaaagaacctggtcacctacctcacggctgagcttggtgagaccaacatcgatgccgcgacgaacgtgtccacctggattggcagctgctacctcacgccgctcatcggcgccttcttggccgacacgtactggggaagatacaagacgatgatagtcttcctcttgctctacatcgttgggatgcttactctgacagcgtcggcgtggctccccttggccatggaggacgactcacctgacaacagcggacttcggcgtgccacagcgtacctggggctctacctcgtttccctaggcacaggaggcatcaagccctgcacggcggccctcggggccgaccagttcgacggcggcgacgcggcggagcgggtcaccaaggcctccttcttcaactggtactacttctgcaccaacatcggctccctgctgtcggggaccgtgctcgtctgggtgcaggaaaatattggatggggagtcgggtttacggtgcagacggtgttcatgctgttcggcctcgccgtgttcgtcgccggtcgcaaggtgtataggtacaagaagctgggcgggagccctctcacaagggtagcccaggtggttgtcgcagctgtgaggaactgccatctcgtgctgcctgatgatacgtcagccctgtaccacgataagcttctaccaactgaaccaaatttcaggattgagtctgccagacaattcagattctttgacaaggctgccataatcaccggcgagaagggtgcagcagcgccgacgagcccgtggagactgtgcacggtgtcccaggtggaggagctgaagatgctgctccggttgctgccggtctgggcatccatggtgctcttcttcgccgtcagtgcgcagacggtaaccacgttcattgagcaggctagggtgatggacaaccgcatcggcccgttcaccattcctccggcgtcgatagcgaccttcgacgtgatcagcgtcatggtctgcgtccccgtctacgacgccgtgctggtgcctctggcccggcgtgccactggcaacgaccgcggcctgtcgcagctgcaccggctctccatcgggatcgcgctgtccgtggtcgtcatggtgtacgcggcgctgctcgagggcaggcgcctggccctcgcgcgggccaacatgcccgccatgaacatcgcgtggcaggcacccatgttcgccgtgcacggcgcggcggcggtcttcgccaccgtcggcgtgctcgagttcttctacgaccagtcgccggacgggatgaagagcctcggcaacgcgctcgcgctgctctccatggcggccgggagctatttcaactcgcttgcgctcagcgctgtcgggtcgatcacggcgcgcggcggggaacgcgggtggctcccggacgacctgaacaagggtcatatggactatttcttctggatgatggccgctcttggaacgctcaacctgctgcacttcttgcactactgcaacagacgatacagaggcaacaacaacaacacttcttag

SEQ ID NO: 114 - DNA, 1278 bp, Zea mays
atgccgtccatcacgcactacgtgctggatcgcctcctagagacacggtcgcctgttcatgtccagaaggtggttcccaagcctccgcccccgcctcctgacaaggccacaccggtgccagtgtctactgccaggacacggtcgtcgctggcatcactctatgccacgcctgagaacaccaccctgccggacttgccttcctcgttcccgggaacctggtcgccatacctcatcaaccataagaggcggggagcctcccttgccaggaccttctctcagggtgatgctgggagggaggtcagccagccaaacctccctgtgatgctgcctgctttgccgagagggtgtgaacccactcaagtccaggagcccgagtttgtgtttcagcaagcaggcaatggtcaagctgaaggtgaaagtgctgtagaagaggctttgaatggcaaaagtgtaatgctacagaaaggcaaggggtctgttatagctgaaatagagcaggagcagcctgagtttgagttttgtcaaagtcttgaagcattagtgaagcctgttaatgttagaaggcctttgaatggtgaggcacccaaaatttgtgagagtgacacctttgaatggcggaagcctagttcacctcttggaacctctgttggtacaccaggtgcagaattctacgatgcatttgaagaaatatccagtgacggtggaactcggtcatcgcgaggcatggatgatgacctccgtgaaatgaggttaagtctgttgatggaaattgagaggaggacacaaacagaagaagcacttgagatctggcaacaggaatggaagaacctgagtcaccacctatctcttgttgccttatcactaccatctccaagtatagctgaggattctgattgtttaaaggtggatcctggagctgagttgtgccagcaaataactgtttcacaacttgtggctgctgctattgctcggggttttgctcgtgctgaagttgaatcagagatggaaactatgattgcgacaaagaactttgagattggaaggctgtcggatagggtccagtactatgaagctgcaaacagggaaatgtctcaaagaaaccaagaagctatcgagatgtcaaggcaacaacgcaaggggcgtaagaagcgacagaagtggttctgggcttcagttgggcttgcagtcacccttggcgccacagccattgcctggtcttacgtaactccgtcgcagccccaggccagtgcagatccaagtagtgctgccagccagtag

SEQ ID NO: 115 - DNA, 2124 bp, Unknown
  Synechocystis sp. PCC 6803
atggaacgcatagatattcatcccacccacaccgctaacggttacaaactccgctgtggccagccctttccctttggggccaccattgtgccggggggagttaatttttccatttactctagccatagcaccgcttgcaccctagtactgttcgagaagcgggctccccagccctttgtggagattccctttccagaatcttttcgcattggtaatgtctattgcatggtggtgtttgacctggattttgagaatctggaatacggctatcgcatggaaggccccaataacttccagcagggccattggtttgaccccagtaaagtccttcttgatccctacgccaaagtggtcagtggccgggatgtttggggcacccaacccaattgggacgatatttatcaacaccggggccgcctcagctttgacgattttgattgggaaaacgattcccccctggatgttcccctcgaagacatggtcatttatgaaatgcatgtgcggggtttcaccaaagatccttcctccggagtaaaggaaaatcaccggggcaccttcgccggcattctcagcaaaattccctatctacaggaattgggtgttaataccatcgaattaatgccgatattcgagtttgatgagtttgaacatagtcgttaccacccagaaacgggggaatttttagttaactactggggttatagcaccgttaacttttttgcacctaaagcgggttacgctgccaccggtaaattcggcatgcagattgacgagttgaaaaacttagtcaaggaactgcataaagtaggtatttccgtcattttggatgtggtttttaaccatacggcggagggcaatgaacggggccccaccatttcctttcgaggattggataacaaaacctattacatgctcaccccggagggttactatttcaactttagtggcactggcaataccttaaactgcaataatcccattgtgcggggcatggtgctggactgtctgcgatactggacagcggaatttcatattgatggttttcgctttgatttagcctctattttgggaagggatccctggggctaccccttggccaatccccctcttttggaaaccctggcctttgatcccattttggcccgttccaaacttattgctgaagcctgggatgccggtgggctataccaagtaggatcttttcccagttatggccgctgggccgaatggaatgggaaataccgagatacggtgcgaaaatttattaaaggagatgcgggggtaattggggaaatggcccaaaggctacagggttcccccgacctttatcaaggagccggacgacctccctccacttcgatcaattttgtgacggcccacgacggctttaccctggcggatttggtggcctataacggcaaacataattacgctaacggggaaaatggcaatgatggagccaacgacaattacagttggaactgcggggtagaaggtcccaccgataaccctgatatcctcagactccgggcccggcaaatgcggaatgcgatcgccattttgttggtgagtcagggggtgcccatgctgttgatgggagacgaaatgggcaaaacccaagacggcaacaataatacctattgccacgattcccctttcaattggctcaattggcatttacttgaacaaaaccaggcttggtttcggtttgtcaaacactgcattgctttccgtctagcccaccctgtattacgcaacagtgaacatttccaaaactgcgattaccttggtgtgggatttcccgatattagttggcacggagtcaagccctggcacgctgactggtccgccgatagccgagttttagcttttatgctttgtggtcgccatgccaaaggtggccgagttaaggataatcaaatttatgtggccatgaatatgcattacgaaagtctttggtttgaactgccagctcccccggtgggcaccacttggcacgttttcgccaacacaggggcccagcctccagaagatatccatccccctgggcaggagccccccctctcttcccaatcatccctactcattggcgatcggagtgttgttattttactggctaaatag

SEQ ID NO: 116 - DNA, 807 bp, Bacillus halodurans
atggcttcctctatgctctcttccgctactatggttgcctctccggctcaggccactatggtcgctcctttcaacggacttaagtcctccgctgccttcccagccacccgcaaggctaacaacgacattacttccatcacaagcaacggcggaagagttaactgcatgcaggtgtggcctccgattggaaagaagaagtttgagactctctcttaccttcctgaccttaccgattccggtggtcgcgtcaactgcatgcaggccatggtgaaacatgatatcgagaaagtactgatctcagaggaagagatacaaaagaaagtaaaagagttaggtgcagaattaacgagcgagtatcaagatacatttccgttggcaatcggtgtgttaaaaggagcacttccttttatggcggatcttatcaagcatattgatacatatttggaaatggatttcatggatgtatcaagctacggaaattctacggtttcttctggagaagtaaaaatcattaaagatttggatacatctgtagagggccgggacatcttaattattgaagatatcatcgacagtgggttaaccttaagttatctcgtagagctcttccgataccgtaaagcaaaatcaattaagattgttacccttttggataaaccgagcggaagaaaagcggacatcaaagcagactttgtcggttttgaagttcctgacgcgtttgtagtgggttacggacttgattatgctgagcgctatcgcaatctgccttatatcggagtgttaaaaccggcagtttatgaaagctag

SEQ ID NO: 117 - DNA, 489 bp, Arabidopsis thaliana
atggtgcggaaacagtttcaacaggctaaaactggaatagaggcattgaagtcaatggatgctaacaactacttgaagaaggttggattagggcgtgacgatatgttcttttggaaacaagtgggaaaagcattgctatgcacttacacaatctttggtatggcttggatttacaatgaaacgtctcctttaggttggtggacgctgaagccaagaccaaaggaagagagagaattggctcatttgtatgagcggcgtgagtttccttatcctggtgatacagaggctatggaggattttgttgcaaaggggggaatgattggtactgcaattggaccgaaaggaattgttgagtccgaaggtgaggctgataattaccagaaggaaatggagaagaagaagtttgataaagaggctcagaaactgtggttgagaatgaggaatgaggttattactgaacttcaagagaaagggcataatcttgaatag

SEQ ID NO: 118 - DNA, 1272 bp, Zea mays
atggcgcaggcggtggtgccggcgatgcagtgccgggtcggagtgaaggcggcggcggggagggtgtggagcgccggcaggactaggaccggccgcggcggcgcctcgccggggttcaaggtcatggccgtcagcacgggcagcaccggggtggtgccgcgcctcgagcagctgctcaacatggacaccacgccctacaccgacaaggtcatcgccgagtacatctgggtcggaggatctggaatcgacatccgaagcaaatcaaggacgatttcgaaacccgtggaggatccctcggaactaccaaaatggaactacgatggatctagcacaggacaagccccgggagaagacagtgaagtcattctatacccccaggctatcttcaaggacccattccgaggtggcaacaacgttttggttatctgtgacacctacacgccacagggggaaccccttccaactaacaaacgccacagggctgcgcaaattttcagtgacccaaaggtcgctgaacaagtgccatggtttggcatagagcaagagtacactttgctccagaaagatgtaaattggcctcttggttggcctgttggaggcttccctggtccccagggtccatactactgtgccgtaggagccgacaaatcatttggccgtgacatatcagatgctcactacaaggcatgcctctacgctggaatcaacattagtggaacaaacggggaggtcatgcctggtcagtgggagtaccaagttggacctagtgttggtattgaagcaggagatcacatatggatttcgagatacattctcgagagaatcacagagcaagctggggttgtccttacccttgatccaaaaccaattcagggtgactggaacggagctggctgccacacaaattacagcacaaagaccatgcgcgaagacggcgggtttgaagagatcaagagagcaatcctgaacctttctctgcgccatgatctgcatattagtgcatacggagaaggaaatgaaagaagactgactgggaaacatgagactgcgagcatcggaacgttctcatggggtgtggcaaaccgcggcgcttctatccgtgtggggcgggataccgaggcaaaagggaaaggttacctggaagaccgtcggccggcatcaaacatggacccgtacattgtgacggggctactggccgagaccacgatcctctggcagccatccctcgaggcggaggctcttgccgccaagaagctggcgctgaaggtgtag

SEQ ID NO: 119 - DNA, 1272 bp, Zea mays
atggcgcaggcggtggtgccggcgatgcagtgccgggtcggagtgaaggcggcggcggggagggtgtggagcgccggcaggactaggaccggccgcggcggcgcctcgccggggttcaaggtcatggccgtcagcacgggcagcaccggggtggtgccgcgcctcgagcagctgctcaacatggacaccacgccctacaccgacaaggtcatcgccgagtacatctgggtcggaggatctggaatcgacatccgaagcaaatcaaggacgatttcgaaacccgtggaggatccctcggaactaccaaaatggaactacgatggatctagcacaggacaagccccgggagaagacagtgaagtcattctatacccccaggctatcttcaaggacccattccgaggtggcaacaacgttttggttatctgtgacacctacacgccacagggggaaccccttccaactaacaaacgccacagggctgcgcaaattttcagtgacccaaaggtcgctgaacaagtgccatggtttggcatagagcaagagtacactttgctccagaaagatgtaaattggcctcttggttggcctgttggaggcttccctggtccccagggtccatactactgtgccgtaggagccgacaaatcatttggccgtgacatatcagatgctcactacaaggcatgcctctacgctggaatcaacattagtggaacaaacggggaggtcatgcctggtcagtgggagtaccaagttggacctagtgttggtattgaagcaggagatcacatatggatttcgagatacattctcgagagaatcacagagcaagctggggttgtccttacccttgatccaaaaccaattcagggtgactggaacggagctggcgcacacacaaattacagcacaaagaccatgcgcgaagacggcgggtttgaagagatcaagagagcaatcctgaacctttctctgcgccatgatctgcatattagtgcatacggagaaggaaatgaaagaagactgactgggaaacatgagactgcgagcatcggaacgttctcatggggtgtggcaaaccgcggctgctctatccgtgtggggcgggataccgaggcaaaagggaaaggttacctggaagaccgtcggccggcatcaaacatggacccgtacattgtgacggggctactggccgagaccacgatcctctggcagccatccctcgaggcggaggctcttgccgccaagaagctggcgctgaaggtgtag

SEQ ID NO: 120 - DNA, 1071 bp, Zea mays
atggcctgcctcaccgacctcgtcaacctcaacctctcggacaccacagagaagatcatcgccgagtacatatggatcggtggatctggcatggatctcaggagcaaagccaggaccctcccgggcccggtaaccgatcccagcaagctgcccaagtggaactacgacggctccagcaccggccaggcccccggcgaggacagcgaggtcatcctgtacccgcaggccatcttcaaggacccattcaggaggggcaacaacatccttgtcatgtgcgattgctacaccccagctggcgagccaattcccaccaacaagaggtacagcgccgccaagatcttcagcagccctgaggtcgctgccgaggagccctggtatggtatcgagcaggagtacaccctccttcagaaggacaccaactggcccctcgggtggcctattggcggcttccctggccctcagggtccttactactgtggaatcggcgcggagaaatcgttcgggcgtgacatagtcgacgcccactacaaggcatgcctgtacgcaggcatcaacatcagtggcatcaacggggaggtcatgccggggcagtgggagttccaggtcggaccgtccgtcggcatctcttcgggcgatcaggtgtgggttgctcgctacattcttgagaggatcaccgagatcgccggcgtggtggtgacgttcgacccgaagccgatcccgggcgactggaacggcgcgggcgcccacaccaactacagcaccgagtccatgaggaaggagggcgggtacgaggtgatcaaggcggccatcgagaagctgaagctgcggcacaaggagcacatcgcggcctacggcgagggcaacgagcgccggctcaccggcaggcacgagaccgccgacatcaacaccttcagctggggagtcgccaaccgtggcgcgtcggtgcgcgtgggtcgcgagacggagcagaacggcaagggctacttcgaggaccgccggccggcgtccaacatggatccctacgtggtcacctccatgatcgccgagaccaccatcgtctggaagccctag

SEQ ID NO: 121 - DNA, 1722 bp, Unknown
  Synechocystis sp. PCC 6803
atgttcactacccccctccccccccaaaagcggctttctacccaaactgaggcgatcgccaaaaatattactgctatccgttctttggactgggaccgggaccggtttgatattgaattcggcctacaaaacggcaccacttacaattcctatctaatccaagcggataaggttgccctagtagatagctcccacgagaaattccgccagttatatctagatttattacagggattaatcgatccccagcgcattgattacctaatcgtcagccacactgagccagaccacagtgggttagtaaaagacattttgcaactcaatccccgcattacggtggtggccaccaaagtagcgttgcaatttctcgacaattttgtccatcaaccctttgagcgtattcaagttaaaagtggcgatcgcctggatttgggccagggccatgatttggaatttgtcagtgctccgaatctccactggccggacaccatgctcacctatgaccccgccacggaaattctcttcacctgcgacgtgtttgggatgcactattgctccgatgcagtttttgacatcgatttgggcaaaatcgcaccggattaccagttttactacgattgcttgatgggtcccaacgcccgttccgttctcgccgccatgaaacgcatggataatctgggcaccattagcaccgttgccaatggccatggccccctattgcgccataacgttggcgaattattacatcgctaccgccattggagcgagtcccaaagtaaagcagaaaaaaccgtggtggttttctatgtggctgattatggctacggcgatcgcctttcccaggccattgccaagggaattactaaaaccggcgtgggggtggacatggtggacctaagctccgccgatcctcaggaaatccaggaactggtgggccatgccagcggggtagttctgggaatgccgcctttacaggctaacgctgatctaagcaccaatttcggcgcagtgttggccgccatgcaaccgaaacaggtctttggtttatacgaatcctatggtggggacgacgagcccattgaccccctccgcaccaaatttttagacctgggtttgcgggaggctttcaaagtgatcaaggtcaaagacacccccagcgaaagcacctatcagctttgtgatgagtccggcactgacttgggtcaaaatctcatccaggcggccaaaataaaacaactcaaatccctggacagcgatctggaaaaggcgatcggtcgcattagtggggggctgtatatcatcactgcccaaaagggagaggttaaaggggccatgcttgcctcttgggtttcccaagccagctttaatccccctggtttcaccgttgctgtggccaaggaccgggccattgaatccctcatgcaagtcggtgatcgctttgtgttgaacattttggaggaaggcaactatcaaattttgatgaaacatttcctcaaacgtttcccccctggtgctgatcgttttgctggagtaaaaacccaaaccgcaagcaacggatcgcctattttgaccgatgcgctagcctatttggagtgtgaagtagctagtcggatggaatgtagtgatcactggattgtttacagccaagtaaccaatggtcgggtagctaaagcagaagggttaaccgccgtacaccatcgcaaagtcggcaattattactag

SEQ ID NO: 122 - DNA, 1944 bp, Zea mays
atgatgggaggcgggctgatgatggatcagagcgtggtgttccctggcgtccacaacttcgtggatctcctgcagcagaacggcgacaagaacctgggcttcgcctcactcatgccgcagacgtcctccggcgaccagtgcgtgatgggggagggtgatcttgtggacccaccgccagacagcttcccggacgccgtggaggacgacagcgatgacgacgttgaggacatcgaggagctggagcgccgcatgtggcgcgaccgcatgaagctgaagcggctcagggagctgcagcagagccgcggcaaggatcccatggctagcggtgggggcctagccgacggctcatccaagccaaggcagtcgcaggagcaggcccggcgcaagaagatgtcgcgcgcgcaggacggcatcctcaagtacatgctcaagatgatggaggtgtgccgcgcgcaggggtttgtgtacgggatcattccggagaagggcaagccggtgagcggcgcctccgacaacctccgtgcctggtggaaggagaaggtccgcttcgaccgcaacggcccggccgccatcgccaagtatcaggccgacaacgccgtcccgggcgccgagaatgagctcgcctcgggcgctgccagccctcattccttgcaggagctgcaggacaccacactcggctcgctgctctcagcactcatgcagcactgcgaccccccacaaaggcgctacccgctggagaagggcgttcctccaccgtggtggcctaccggcgacgaggagtggtggccggagcttggcattcccaaggaccagggcccacccccctacaagaagccccatgaccttaagaaggcctggaaggtgagcgtgctcaccgctgtcatcaagcacatgtcaccagacatagagaagatccgtcgcctcgttcgccagtccaagtgcctccaggacaagatgactgccaaggagatatcgacctggctggcggtcgtcaagcaggaagaggagctgtacctgaagttgcaccctggcgcacgcccgccggcatccactggtggcatcgccagtgccatatctttcaacaccacctcaagcgagtacgacgtggacatcgttgatgagtgcaagggggatgaggctggcaaccagaagacagcagtcactgacccaacctccttcaaccttggtgcggctatcctaagtgacaagttcctcatgccgacgccgatgaaggaggagaccgctgacgtcgagttcatccagaagaggaacgcccccgctcctgctgagccagagctaatgctaaacaaccgggtgtacacctgcaacaacgtccagtgcccgcacagtgactacagctatgcattccttgaccggaatgcccgcaacagccaccagtacacctgtaagtacaacgatccgatcactcagagcgccgagaacaagcctctgccagcaccgccgcaaccacaagccttccagccggccttcagccaagccaatcaggcagtgaacaatctggacttcagcctgcctatggacgggcagaggtccatcgccgagctgatgaacatgtacgacaccaacttcatgacgagcaagaccatgagcagtagtgacagcgtcaccatcatggagaggccgaacgcgatgccccagaggatccagatggacgagggcttcttcggacagggcaacggagtcttcgacgacgtcaatagcatgatgcagaaccaacagcagaatcaggcaccacccgtggtgcagcagcagcagcagcagttcttcatccgcgacgacacgccattcatgagccagatgggcgacatcaccagcacggcggagttcaggttcggctctggtttcaacatgtctagcaccgccgccgccgctgattacccaggcgcggcgcagaagaacgacgggaccaattggttctactag

SEQ ID NO: 123 - DNA, 1758 bp, Hordeum vulgare
atgtgtggcatactggcagtgctgggctgcgccgatgacacccaggggaagagagtgcgggtgctcgagctctcgcgcaggctcaagcaccgcggccccgactggagtggcatgcaccaggtcggtgactgctacctctcccaccagcgcctcgccatcatcgaccctgcctcaggcgaccagccactttacaacgaggacaagtccatcgtcgtcactgtgaatggagagatctacaaccatgaacagctccgggcgcagctctcctcccacacattcaggacaggcagcgactgcgaggtcatcgcacacctgtacgaggagcatggggagaatttcatcgacatgctggatggtgtcttctccttcgtcttgctcgacacacgcgacaacagcttcattgctgcccgtgatgccattggtgtcacacccatgtatgttggctggggaattgatgggtcggtgtggatatcatcagagatgaagggcctgaatgatgattgtgagcactttgagatctttccacctggtcatctctactccagcaaggagggaggcttcaagagatggtacaacccaccttggttctcggaggtcattccttcagtgccatatgatccacttgctctcaggaaagctttcgaaaaggctgtcaccaagaggcttatgacagacgttccattcggtgttctactctctggtggccttgactcatcattggttgcagccgttacagttcgtcacctggcagggacaaaggctgcaaagcgctgggggactaagcttcactctttttgtgtcggacttgaggggtcacctgatctgaaggctgcaaaggaggtagccaattacctgggtaccatgcaccatgagttcaccttcactgttcaggatggcattgatgcaattgaggatgtgatttatcacaccgaaacatatgatgtgacaacaatcagggcaagcacaccaatgttcctgatgtcacgaaagatcaagtcacttggggtcaagatggtcatctctggtgagggttccgatgagatttttggagggtacctctacttccacaaggcacccaacaaagaggagctccaccgtgagacatgtcaaaagatcaaagctctgcatcagtacgattgcttgagggccaacaaggcaacatctgcatggggcctcgaagcacgtgtgccattcttggacaaggagtttatcaatgaggcaatgagcattgatcctgagtggaagatgatccggcctgatcttggaagaattgagaagtgggttctgaggaaagcatttgatgacgaggagcaaccattcctgccgaagcacattctgtacaggcagaaagagcagttcagtgatggtgttggctacagctggattgatggcctaaaggctcacacagaatcaaatgtgaccgataagatgatgtcaaatgcgaagttcatttacccacacaacaccccgactacaaaagaggcctactgttacaggatgatatttgagaggttcttcccccagaactcggcaatcctgacagtgccaggcgggccaagcgtcgcatgcagcacggcgaaggcagtagagtgggatgctcggtggtcggggaacctggatccctcagggagagcagcacttggagtccatctctcggcctatgagcaggagcatctcccagcaaccatcatggcaggaaccagcaagaagccgaggatgatcaaggttgcggcacctggtgtcgcaattgagagttag

SEQ ID NO: 124 - DNA, 1440 bp, Escherichia coli
atgtctattgtggtgaaaaataacattcattgggttggtcaacgtgactgggaagtgcgtgattttcacggcacggaatataaaacgctgcgcggcagcagctacaatagctacctcatccgcgaagaaaaaaacgtgctgatcgacaccgtcgaccataaattcagccgcgaatttgtgcagaacctgcgtaatgaaatcgatctggcggatatcgattacatcgtgattaaccatgcagaagaggaccacgctggggcgctgaccgaactgatggcacaaattcccgatacgccgatctactgtacagccaacgctatcgactcgataaatggtcatcaccatcatccggagtggaattttaatgtggtgaaaactggcgacacgctggatatcggcaacggcaaacagctcatttttgtcgaaacaccaatgctgcactggccggacagcatgatgacttacctgacaggcgacgcggtgctgttcagtaacgatgctttcggtcaacactactgcgacgagcatctgttcaacgatgaagtggatcagacggagcttttcgagcagtgccagcgttactacgccaatatcctgacgccgttcagccgcctggtaacaccgaaaattaccgagatcctgggctttaacttaccagtcgatatgatagccacttcccacggcgtggtatggcgcgataacccgacgcaaattgtcgagctgtacctgaaatgggcggctgattatcaggaagacagaatcaccattttctacgacaccatgtcgaataacacccgcatgatggctgacgctatcgcccaggggattgcggaaaccgacccacgcgtggcggtgaaaattttcaacgtcgcccgaagcgataaaaacgaaatcctgactaatgtcttccgctcaaaaggcgtgctggtcggcacttcgacgatgaataacgtgatgatgccgaaaatcgccgggctggtggaggagatgactggtttacgcttccgtaacaaacgcgccagtgctttcggctctcacggctggagcggcggtgcggtggatcgtctttccacgcgcctgcaggatgcgggtttcgaaatgtcgcttagcctgaaagcgaaatggcgaccagaccaggacgctctgaagttatgccgtgaacacggtcgcgaaatcgcccgtcagtgggcgctcgcgccgctgccgcagagcacggtgaatacggtagttaaagaagaaacctctgccaccacgacggctgacctcggcccacggatgcagtgcagcgtctgccagtggatttacgatccggcaaaaggcgagccaatgcaggacgttgcgccaggaacgccgtggagtgaagtcccggataacttcctctgcccggaatgctccctcggcaaagacgtctttgaagaactggcatcggaggcaaaatag

SEQ ID NO: 125 - DNA, 1065 bp, Zea mays
atggccaccgccgccgcgtctagcctcctcaagtcctccttcgcgggctcccggctcccggccgccacgcggaccacaccggcgtccctcgtggtggccaccggcccgcgcggcgccggcgcggggcccatctgcgcgtccatgtccatgtcctcctccaacccgccctacgacctgacgtccttccggttcagccccatcaaggagtccatcgtgtcccgcgagatgacccgtcgctacatgacggacatgatcacctacgccgacaccgacgtcgtcatcgtgggcgccggctccgcggggctgtcctgcgcgtacgagctctccaaggaccccgccgtgagcatcgccatcgtggagcagtcggtgtcgccgggcggcggcgcgtggctgggcgggcagctgttctcggccatggtggtgcgcaagccggcgcacctgttcctggacgagctgggcgtggcgtacgacgaggccgaggactacgtggtcatcaagcacgccgcgctcttcacgtccacggtcatgagcctgctcctggcgcgccccaacgtgaagctgttcaacgccgtggccgtggaggacctcatcgtcaggggagggcgcgtcggcggcgtcgtcaccaactgggcgctcgtgtccatgaaccacgacacgcagtcctgcatggaccccaacgtcatggaggccaaggtcgtggtcagctcctgcggccacgacgggcccttcggcgccaccggcgtcaagaggctccaggacatcggcatgatcagcgccgtgccggggatgaaggcgctcgacatgaacaccgccgaggacgagatcgtgcgcctcacgcgcgaggtcgttcccggcatgatcgtcaccggaatggaggtcgccgagattgacggcgcccccaggatgggcccgacgtttggcgccatgatgatctccggccagaaggcggcgcacctggcgctcaaggccctgggcaggcccaacgccgtggacgggaccatgtcgccgccgttgcgcgaggagttgatgattgcgtacaaggacgacgaggtcgtggacgcctag

SEQ ID NO: 126 - DNA, 1212 bp, Oryza sativa
atggataatgccttgaggtttgctgattcaagttcacttcgttcaagtgatcctggaaaagatcttttggttgttgcccagaccacagctgacagaaaatgcaaatcttcagcactggaaaataatgctgtcatggaaaataaccttagtgaaaattcaaaggggactgcaacaggccatgctgaatcttgtccgtctcactttgtggagataaatttagaaaagcaacatcatctcaatggttatacaaaccacaagttgaatgagaaagatatctttaatcactcaaattcctctgccttttcgaggtatggtaataagaggatagaatcatcagctcaacggccatttcccccttccttccgcgtggttcaccaacaacctgtttacgacaagaatccccaatccagccgggtcttgctttcctgtgaacataatacacgcgagagtacagtgcaagctcaggtccctttggacagaagcacagagggtgctgcaatcctgtgttccagtagtgtaagagaagatgctggtacaagcagttcctctcctagaaaggacagtttaactcatccttcttatgggtttatacctgttccaattcctgttggtgctgctataccctaccactacggtgcaattatgcagccaatgtattatccacagggtgcttttatgcattgtgattcagctgccatcaacaagacagcaattcagcatgtctcttgtcaatctaactaccatgaaaatcttggtaaaccgccacagattgatgagcacaagcagccagaagaaaaccatcagttgcatcattcaagacaaattctccgagaatcaggagaaccagttgacttggcgaaggctcatatggagcgtattaaccagagtgctagctgtagccaggatattcgcaaaggaagtggatgcactgggagcggtgaaactgatgcaaatacaaatacggtaattgcactagaaagtggcaatgagagcggtgtccagaactgcagtaataatgtattggatggtgaccggtctcgccgtgaagctgccttgttgaaattccggatgaaaagaaaagatagatgtttcgagaaaaaggtcaggtatcatagcaggaagaagcttgcagaacaaagacccagggttaagggccagtttgtgagccaaaaactgaagtcagctataacaacagaggcagaaactgactag

SEQ ID NO: 127 - DNA, 1824 bp, Arabidopsis thaliana
atggacaccaaaatcggatcgatcgatgattgcaagccgacgaacggcgacgtctgtagtccaacaaacggcaccgtcgcaacaatccacaactctgttccttcctccgctatcaccatcaactactgcgacgcgactctcggccgtcacttagctcgtcgtctcgtccaagccggcgttacggatgttttctctgttcccggagatttcaacctcactttgcttgatcacctcatggctgagccggacctcaacctaatcggatgttgtaacgagctaaacgccggttacgctgccgacggttacgctagatctcgtggagtcggcgcttgcgttgttaccttcaccgttggtggactcagcgttttaaacgcgatcgctggtgcttacagcgagaatcttcctcttatctgtatcgtcggaggtcctaactctaacgattatggcactaaccggattcttcatcacaccattggattacctgattttagccaagagcttaggtgcttccaaacagtgacttgttatcaggcggtggtgaacaatttagatgatgctcatgaacagattgataaagcaatatcaacagctttgaaagagagcaagcctgtgtatataagtgtaagctgtaacttagcagcgattcctcatcatacatttagccgtgatcctgtccctttttctctagctccaagattgagcaacaagatgggtttagaagctgcggtggaagcaacattggagtttctgaataaggctgtgaagccagttatggttggtggtcctaagttgcgtgtggctaaagcttgtgatgcctttgttgagctagctgatgcttcaggctatgctttggcgatgatgccttctgcgaaaggctttgtaccagagcaccatcctcatttcattggaacttattggggagcagtgagcactcctttttgctctgagattgtggaatctgcggatgcttacatttttgcaggtccaatcttcaacgactatagctctgttggttactcgcttctcctcaagaaagaaaaagccatcgttgtgcaacctgatcgtatcactgtggccaatggtcctacttttggttgcattttgatgagcgatttcttcagggaattgtctaagagggtgaagcgtaacgagactgcatatgagaactaccataggatctttgtccctgaaggtaagccattgaagtgtgaatcaagagagccattgagagttaacacaatgttccagcacattcagaagatgctctctagtgaaaccgctgtgattgctgaaaccggtgattcttggttcaattgccaaaaactaaagctgccaaaaggatgtgggtacgagtttcagatgcagtatggatcgattgggtggtctgttggtgcaactctaggatacgcacaggcatcaccagagaagcgagtgttggcattcatcggtgatgggagtttccaagtcacggttcaggacatatcaacaatgctgcgtaatggacagaagacgatcatcttcttgattaacaatggtggctacaccattgaagtagagattcatgacggtccttataacgtgattaagaactggaactacactggtctcgttgacgccattcataacggtgaaggcaattgctggactgcaaaggtgagatacgaagaggagttagtggaggcgattacgacagcgacgacggagaagaaagattgtctatgtttcatagaagtgattcttcacaaggatgatacgagcaaagagttgcttgagtggggctcacgcgtctctgctgctaacagccgtcctcccaatcctcagtag

SEQ ID NO: 128 - DNA, 1500 bp, Glycine max
atgtctcaacctttgaccaccaactctgttcttgttgaagaggctgctgctgatggtgattcctccgccgccgcacctcccctcttcgattatcatcgtatcgaccaaaaactgctccaaaacatagtttacgatgctcttgtctggagcaccctcaactgcctccttgttggtgacaaatctgttcagagatcaggaagagttcctggtgtgggcctggtacatctcccactttccttattacctgggccatttcctgaaagtcattggaagcaagggtgcgaattagctcctatatttaatgaacttgttgatcgggtgagtttggatgggaaatttctccaggaatctctctccagaactaagaatgcggatgaatttacctcaagacttttagatattcattctaagatgctacagattaacaaaaaagaggacatacgcatgggaatagttcgttcagattatatgattgatgagaagactaaatcacttttacaaatagagatgaacactatttccacttcatttgctttgattggttgtcttatgactggacttcataagagcttactttctcaatatggaaaattccttggactaaattccaatagggttcctgccaataatgccgttgatcagtctgcagaggccttggctaaagcttggagtgagtataacaatcccagggctgcaattctggtcgtggttcaggttgaagaaagaaacatgtacgagcagcattatatttctgcacttctaagagaaaagcatcatattagaagcatacgcaaaacgttgaccgaaattgatcaggaaggaaaaattctgccagatggaacactttctgtggatggacaagcaatttcagttgtttacttccgggctggctacacgccaaaggactatccttcagaatcagaatggagagctaggctactgatggaacaatcttctgctatcaaatgccctacaatatcttatcatttggttggcaccaaaaagattcaacaggaacttgcaaagcctggtgttcttgagaggttcgttgaaaacaaagaccacattgccaaattgcgtgcatgctttgcagggttgtggagtttggaagactcagatattgttaaaaaagcaattgaaaatccagagctatttgtgatgaagcctcaaagagaaggaggaggaaacaatatttatggtgatgagttgagggaaaccctccttaaattacaggaagcaggttctcaagaagatgcagcatacatccttatgcagaggatatttcccgccacttctccagcaattttggtgcgtgatggtaattgggatacgggtcatgtcatttcagaagctggaatatttggtacttatttaaggaataaggacaagattatcattaataacgaaagtggctatatggtgcgtacaaaaatatcatcatcttatgaaggaggagttttgcctggttttggagtggtagatactgtatacctaacttag

SEQ ID NO: 129 - DNA, 831 bp, Arabidopsis thaliana
atggctaccaccactgcagcagcagcctcaggtatttttgggatccggattcaagatcctagacctggaaccggtagggtccaagcccggttcgggttcagtttcggaaaaaagaaaccggctccaccgccaaagaaatcaaggcaggtccaagacgatggagacagactagtttggttccccggcgcaaacccgccggaatggttggacggatcgatgatcggagaccgtggatttgatccgtttggtttaggtaaaccggctgagtatcttcagtacgatttcgatggacttgaccaaaaccttgccaagaacgtggcgggtgacatcatcgggatcatccaagaatcttcggagatcaaaccgacgccgtttcagccgtacactgaagtctttgggatccaacggttcagagaatgtgagctgatccatggaaggtgggccatgcttggcactctaggcgccatcgccgtagaggctcttacaggaattgcatggcaagacgccggaaaggtggaattggtggaaggatcatcgtatttgggacaaccattgccgttctcgttgacgacgttgatatggatagaagtgttagtggtcggatacattgagttccaacgtaactctgaactggatccagagaaacggatttacccgggtgggtattttgacccgttgggactcgcggctgatccagagaagttggatactttgaagctggctgagataaagcactctcgtctcgctatggtcgcatttctcatctttgctcttcaggcggcctttaccggcaaaggccctgtcagcttccttgccacctttaacaattag

SEQ ID NO: 130 - DNA, 279 bp, Oryza sativa
atgtcaagccggaggtcacggtcgaggcagtcaggctcgtcgaggatcaccgacgagcaaatcagcgatcttgtatccaagttgcaggatctcctccccgaggctcgactccggagcaatgatagagtgccatcttcgagggttctgcaggagacttgcaactacatcaggagcttgcatcaggaggtcgacgacctgagcgagaggctgtcggagctgctggccacgtccgacatgagcagcgcgcaggcggcgatcatccgcagccttctgatgtag

SEQ ID NO: 131 - DNA, 621 bp, Arabidopsis thaliana
atggccctctcacctaattcaagctctttagatttaacaatctcaattccgagcttctctccatctccttcacttggtgatcatcacgggatgagagattttgacataaaccaaacaccaaagacggaagaagatcgtgagtggatgatcggtgcaacaccacatgtcaacgaagatgatagcaactcgggtggccggcggcgcaaaaagctccgtctaacgaaagaacaatcacatcttcttgaagagagtttcatacaaaaccataccttaacccctaagcaaaaaaaagatttggccacctttttgaagcttagtcaaaggcaagttgaggtgtggtttcaaaatcgaagagctcggagtaagctaaagcacacggaaatggaatgtgagtatctaaaaagatggttcggatcgttgaaggaacaaaatcgacggctacaaatagaagttgaagaactacgagcgctaaagccatcatcgacctcggctttaaccatgtgtcctcggtgtgaacgtgtgactgatgcagtagataatgactctaatgccgttcaagagggggcagttcttagcagccggtcacggatgacaatttcctcttcctcttccctctgttag

SEQ ID NO: 132 - DNA, 402 bp, Zea mays
atggctagctttactgcctccgcttccaccgtctccgccgctcgtccggctctccttctcaagcctaccgtcgccatctctgctcctgttcttggtttgcctccaatgggtaagaagaagggaggagtgagatgttcaatggagacaaagcaaggaaacgtctcagtcatgggggctggagtttcagctgcagcaacagctgctttgacggcggtgatgagcaatcccgcgatggctttggttgatgagaggatgtcaacagaaggaacaggattaccctttggtctaagcaacaacctcttgggttggattctgtttggagtctttggtttgatctggactttcttcttcgtctacacttcatctctcgaggaggatgaagaatctggtctttcactctag

SEQ ID NO: 133 - DNA, 978 bp, Zea mays
atggaggccaccgcggtgccgcgggctctgtccctccttgggccatctctgtcgacggcgcagctgctgccttggatgcgtatgaactgcttgcgcgtagccgttggaggaggtgtcaggcggcaggggggcgtagtctgggcgaagaagacgagaaggggccgggacgacgtggcggaggagcgggtggacacgcacagctttgcgccaaaggccgtcctgcttagaaagaaaatggtgagagaggatggccaagtgtcaccagaatttgctgatgcaaatgaagaaaagctgtatgattttcttaatatccagctaaaaagcgatatgaaaagaattcaaaggaggaatctgctgtcgacaatgctctccgcttggacgatcctgctcttgggtccgggtcaggtcagcttagcagagacaaccggtggcgcattcagggagtatatcgacacgtttgatggctacaccttcctgtacccgaagaattggatccaggtccgtggagctggcgcggacatattcttcagagaccccatggtcctcgacgagaacatgtcggtggagatatcgtcgccttcgtcgtccaggtacacgagcgtcgaggacctcggcccaccggagaaggctgcagagaaggtcctcggtcagtacctgacggagttcatgtccaccaggctgggcgttcggcgtgaatccaacgtcctatcggcgtcatccaaggtcgctgacgatggcaagctctactacgaggttgaggtgaacataaaatcctatgcgagcaacaacgagctggcggtgatgccacaggacagggtgcagagcttggagtgggaccgccgatacctgtcagtgctcggcgtcgagaacaagcggctctacgagctccggctgcagacgcccgagcaggtgttcatgcaggaagaggaggacctcagaagagtcatggactccttcagggtcatcaaggcggcgtag

SEQ ID NO: 134 - DNA, 519 bp, Arabidopsis thaliana
atggcgtcaatttctctctcttcttctacggttccgtcgctgaattcgaaagaatcgtcaggtgtttctgctttcgcttctcgttctatctcggccgtcaaatttcagtttccggttcgtcgggttcgaaccggagacttaaagtttccatctttatcttcaacgactcgatgcactcctcgacgtattgaagccaagaagcagacatttgactcatttgaggatctgcttgtgaactctgataaaccagttctagttgactattatgcaacctggtgtggtccttgccagttcatggttccaatactcaatgaagtgagtgaaaccctgaaagacaagatacaggtggtgaagattgataccgaaaaataccccagtattgctaataaatacaagattgaggcacttcctactttcatcctattcaaagatggggaaccttgtgatcgctttgagggtgctttgacggccaaacaactcattcaacgaattgaggattctctaaaagtgaagccatag

SEQ ID NO: 135 - DNA, 1617 bp, Arabidopsis thaliana
atgttggattctctagtgtcgaaactgccttcgttatcgacatctgatcacgcttctgtggttgcgttgaatctctttgttgcacttctttgtgcttgtattgttcttggtcatcttttggaagagaatagatggatgaacgaatccatcaccgccttgttgattgggctaggcactggtgttaccattttgttgattagtaaaggaaaaagctcgcatcttctcgtctttagtgaagatcttttcttcatatatcttttgccacccattatattcaatgcagggtttcaagtaaaaaagaagcagtttttccgcaatttcgtgactattatgctttttggtgctgttgggactattatttcttgcacaatcatatctctaggtgtaacacagttctttaagaagttggacattggaacctttgacttgggtgattatcttgctattggtgccatatttgctgcaacagattcagtatgtacactgcaggttctgaatcaagacgagacacctttgctttacagtcttgtattcggagagggtgttgtgaatgatgcaacgtcagttgtggtcttcaacgcgattcagagctttgatctcactcacctaaaccacgaagctgcttttcatcttcttggaaacttcttgtatttgtttctcctaagtaccttgcttggtgctgcaaccggtctgataagtgcgtatgttatcaagaagctatactttggaaggcactcaactgaccgagaggttgcccttatgatgcttatggcgtatctttcttatatgcttgctgagcttttcgacttgagcggtatcctcactgtgtttttctgtggtattgtgatgtcccattacacatggcacaatgtaacggagagctcaagaataacaacaaagcatacctttgcaactttgtcatttcttgcggagacatttattttcttgtatgttggaatggatgccttggacattgacaagtggagatccgtgagtgacacaccgggaacatcgatcgcagtgagctcaatcctaatgggtctggtcatggttggaagagcagcgttcgtctttccgttatcgtttctatctaacttagccaagaagaatcaaagcgagaaaatcaactttaacatgcaggttgtgatttggtggtctggtctcatgagaggtgctgtatctatggctcttgcatacaacaagtttacaagggccgggcacacagatgtacgcgggaatgcaatcatgatcacgagtacgataactgtctgtctttttagcacagtggtgtttggtatgctgaccaaaccactcataagctacctattaccgcaccagaacgccaccacgagcatgttatctgatgacaacaccccaaaatccatacatatccctttgttggaccaagactcgttcattgagccttcagggaaccacaatgtgcctcggcctgacagtatacgtggcttcttgacacggcccactcgaaccgtgcattactactggagacaatttgatgactccttcatgcgacccgtctttggaggtcgtggctttgtaccctttgttccaggttctccaactgagagaaaccctcctgatcttagtaaggcttag

SEQ ID NO: 136 - DNA, 1011 bp, Zea mays
atggcggagcacctcctgtcgacggccgtgcacgacacgctgccggggagctacgtgcggccggagccggagcgcccgcgcctcgcggaggtcgtgaccggcgcgcgcatccccgtcgtggacctgggcagccccgaccgcggcgcggtcgtggccgccgtcggcgacgcctgccgctcgcacggcttcttccaggtcgtcaaccacgggatacacgccgccctggtcgcggcggtgatggccgcggggcgcggcttcttccggctgccccccgaggagaaggccaagctctactccgacgaccccgccaggaagatccggctgtccaccagcttcaacgtgcgcaaggagacggtgcacaactggcgcgactacctccgcctgcactgccatcccctcgacgagttcctgcccgattggccgtccaacccgcccgatttcaaggagaccatgggcacctactgcaaggaggtccgggagctcgggttcaggctgtacgccgcgatctcggagagcctgggcctagaggcgagctacatgaaggaagcgctgggggagcaggagcagcacatggcggtcaacttctacccgccgtgcccggagccggagctcacctacggcctcccggcgcacaccgaccccaacgcgctcaccatcctgctcatggacccggacgtcgccggcctgcaggtgctccacgccggccagtgggtcgccgtcaacccgcagcccggcgcgctcatcatcaacatcggcgaccagctgcaggcgctgagcaacgggcagtaccggagcgtgtggcaccgcgcggtggtgaactcggaccgggagcgcatgtccgtggcgtcgttcctgtgcccgtgcaaccacgtcgtgctcggccccgcgcggaagctcgtcaccgaggacaccccggccgtgtacaggaactacacgtacgacaagtactacgccaagttctggagcaggaacctggaccaggagcactgcctcgagctcttcagaacctag

SEQ ID NO: 137 - DNA, 951 bp, Zea mays
atgatgacctcgtggcttctgggccgccggggcccctccggcttctcctggagttccaccgccgaccaagtcacgcagggcatctccgccgccggcctcaccgccatcgtcactggggcgtccagcggcatcggcgcggagacggcgcgaacgctggcgctgcgcggggcccacgtcatcatggccgtcaggagccttcccgctgcccaggccgtcaaggacgccgtcctcgcccaggcgccgggggccaagctcgacgtcatggagctcgacctctcgtccatggcctctgtccgcgctttcgcgtcccaattcatcgacaggggtctccccctcaacatccttatcaacaatgcaggagtaatggcaataccttttgcgctttcaaaggatggaattgagatgcagtttgcaactaatcatgttgggcatttcctgctcacacaccttctattggataccatgaagaggacctctcatgaatcaaatttggaaggaagaattgtcaacgtgtcatcagaggggcacagacttgcatatcgggaaggaatccgttttgacaagatcaacgatgaatcagtgtatagtagcattggtgcatatgggcaatcaaagcttgcaaacatattgcatgctaatgaacttgccaggcgatttgaggaagataatgtcaacataactgcaaattctcttcatcctggttccattatcacgaaccttcttcgctaccacagtatcctagatgttctccatcggacgctgggtaaattggtgttgaaaaatgctgagcagggtgcggcaactacatgctatttggcactccacccgcatgtgaagggcgtgtccgggaagtacttctgcgactgtaacctgtacgagccaagcgcgaacgccaaggacatggagttggccaagaggctctgggacttcggcgtcgagctcatcacctag

SEQ ID NO: 138 - DNA, 1197 bp, Unknown
  Synechocystis sp. PCC 6803
atgccaagccgtcccttggggcggagtttcaccactagtttttcgatgaatttacgctacctctggtcaggaaaacagatattgataggaggcggtctaattcctctattattcggtgccgctgtctcggcccagtctcctagccaaactaatcccagtaatcttcctgacgttacccccctcctggctcaacggtcagcgaccgacgatagaaggcagttcaatgagctactgcgccaaggcaaggcctatgtggataacggtaattttccccaggcgatcgccatttaccaacaggcggccatgttggacggggaaaacgcagaactgtttggcagcatgggttatctctacgcccgccagggacaatttgccgaggctagccggagttttcagcaggctctgcgggtaaatcccaacaatcccgactattacgatggtttgggctttagttacgcccgccaaggattgttaaacgaagctgccagcgcctatgccaccgccattagtttaggccccagttcccgtgagtcagttaaataccgccttgccctggggattatcatgctccagcagggagactacaaccgggtgcgtcaactgtataacgaaattcatagtttgcaatcggacaatgaagaagcggcggtgatgatgggggcagccctgctccagagcagtgagtatgaacagttaatcacgttcaacaatcaggcccttagattatttcctaaccgttctgaactaaccttgcaactgggtaaagcttatctggcccagggtgatctggtggcagcccgcagagcgttagaacctaggctcaatccagattggcgtagtttttccctctaccttacctgggcagaactactggaacgggagggaaattttgccggagccctggatgcctataaacaagctctccgcaatgaacccacggcgatcgccgctaaaattggcactggtcggatgtatttggaattggacaatcctgccgaagctgtttgggttttccgtgatttaacccgcctccaacccagtaacgctgatttttattacctgctgggggaagcctacgctgtggacgaaaaaattgacttggccaaaaaatcctttggggaagcgaaaaaactttaccaggcccagggcaacaccgctggcagtgaccggacccaagaaaagctggataatctctag

SEQ ID NO: 139 - DNA, 1446 bp, Brassica napus
atggagaaaaagagcatgttcattgaacaaagcttcaccgatcacaagagtggcgatatgaacaaaaactttgacgatgatggacgccagaaaagaacagggacttggatgacggggagcgcccatataataacagcggtgatagggtcaggagtgttgtcactggcgtgggcaattgcacagctcggatgggtggcaggacccgccgtacttatggctttttccttcataacatactttacatcaaccatgcttgccgactgttatcgttccccagatcctgtcaccggaaaacgaaactatacctacatggaagttgtccgctcttacttaggaggaagaaaagtgatgttatgtggattggctcaatacgggaatctgattggaataacaatcggctacacaatcacagcgtcgattagcatggtggcagtgaagaggtcgaattgtttccacaagaatggacataatgtgaaatgttccacttcaaacactcccttcatgatcatattcgcatgcatccaaattgtacttagccaaatcccaaatttccacaatctctcttggctctccattctagcggccgtaatgtccttttcttacgcctccattggtgtcggtctctccatcgccaaagtggccggtggcggtgtgcacgcaaggacggccctgacaggagttacggtcggagttgatgttactggttctgagaaagtatggagaacattccaagcggttggagatatcgcatttgcttatgcctactcaaccgtacttattgagatacaggacaccttaaaagcaagtccaccatcagaaaacaaagccatgaaaagagcaagccttgtgggtgtatccacaacgaccttcttttacatgttatgcgggtgtgtgggttatgctgcctttggcaataatgcgcctggaaatttcctaaccggttttggtttttatgagcccttctggctaatcgactttgccaatgtctgcatcgctgtgcatcttgttggggcctatcaggtcttttgccagccaatcttccaatttgtagagagccagagtgcaaaacgttggccagataacaagtttattacaggagagtacaaaatgaacgtcccttgcggtggtgattttggtatcagcttgtttagattggtttggaggacttcatatgttgtagttacggctgttgtagcaatgatcttccctttcttcaacgatttcttgggtcttattggagcagcttccttttggcctttgactgtttactttcccattgagatgcatattgctcagaaaaatatgaagaaattttctttcacttggacatggctgaaaatcttgagctgggcttgtttcctcgtctccctcgttgctgctgctggatctgtgcaaggactcatacaaagtcttaaggatttcaagcctttccaggctcccgagtag

SEQ ID NO: 140 - DNA, 1998 bp, Glycine max
atgaagagtatggaaaatgatgacaatgctgaccttaataatcaaaacaattggttgggtttctcactctctcctcaaatgcataatataggagtttcttcacactcacaaccttcctctgctgctgaagtggttcctacaagcttttaccaccacactgctccacttagtagctatggtttctactatggacttgaagctgaaaatgttggattgtattcagctttgccaatcatgcccctcaaatctgatggctctctctatggattggaaactttaagcaggtcacaagcacaagcaatggctactacttcaacaccaaaactggagaacttcttaggtggggaagccatggggacccctcatcactacgaatgtagtgccacagaaacaatgcctctgagcttagacagtgttttttacatccaaccctcacgccgtgacccaaataataaccaaacctaccaaaaccatgttcaacacattagcaccaaccaacaacaacaacagcaagagcttcaagcatattactctaccttgagaaaccatgatatgatattagaagggtcaaagcaaagccaaacttctgacaacaacaatcttcatgttcaaaacatgggtggtgatgatgccgttcctgttcctggcctcaagagttgggaagtgaggaacttccaagctagccatgcacatgagtcaaagatgattgttcctcatgtggaggaaaatgctggtgaatcagggtccattggatcaatggcttatggtgacttgcaatcgttgagcttgtccatgagtcctagctctcagtctagcagtgtcacaagttctcaccgtgcttcacctgctgtcgttgattctgttgccatggatactaagaaaagggggcctgaaaaggttgaccagaagcaaattgttcataggaagtccattgacacctttggacaaagaacctcccagtatagaggagtaacaaggcataggtggactgggagatatgaagctcatctttgggacaacagctgcaagaaagaggggcaaagcaggaaaggaagacaagtttatctagggggttatgatatggaagaaaaagctgcgagagcttatgatctagcggcactcaagtattggggaccctccactcacataaactttcctttggaaaattatcaaaatgaacttgaggaaatgaagaacatgactagacaagagtatgttgctcatttgagaagaaaaagcagcggattctcaagaggggcttccatgtacagaggagtaacaagacaccaccaacatggaaggtggcaagctcgaattggtagagtggctggaaacaaagatctatatcttggaacctttagtacacaagaggaagcagctgaagcctatgatattgctgctataaaattccgaggagcgaatgctgtaaccaactttgacatcacaagatatgatgtggagaaaatcatggcaagcagcaacctccttagcagtgagctagctaggcgcaaccgagagacggacaatgaaactcagtgcattgatcaaaatcacaataagccttctgcatatgaggacactcaagaagctattctaatgcaccagaagagctgtgagagcgaaaatgatcagtggaagatggttctctaccaatcctctcagcaacttgagcagaatccaccaacaattgagagtgacagaactaaccagtccttcgcagtggctttggacaacatgtttcatcaggaagtagaggaatcaagtaaggcgaggacgcatgtgtcaaatccttcttcattggccacaagtttgagcagctcaagagaaggtagccctgataggacaagcttgccaatgctctctggaatgccttcaactgcatcaaaactattggctactaatccaaataacgtgaattcttgggacccttcaccccatttgaggccagcacttactttgcctcaaatgccagtttttgcagcttggacagatgcatag

SEQ ID NO: 141 - DNA, 1122 bp, Arabidopsis thaliana
atggtgaaatcgacggacggtggtggtgggtcttcttcttcttcttcagtggcgccgttcttgagaaaatgttacgatatggttgatgattctactactgactctataatctcatggagtccaagtgcagataatagcttcgttatcttggacaccaccgtcttctctgttcaactcttgcctaaatactttaaacacagcaatttctctagcttcattcgtcagctcaatatctacggttttagaaaagttgatgcagatcgatgggagtttgcgaatgacgggtttgtgagaggtcaaaaggatttgctgaagaatgttatcaggaggaagaatgttcaaagtagtgagcagagcaaacatgagagtacaagtacaacatatgctcaggaaaagagtggattgtggaaggaagttgatattttgaaaggtgataagcaggtattggcgcaggagttgatcaaagttaggcagtatcaggaggtgacggatactaagatgttacatttagaagacagagttcaaggaatggaagagagtcagcaggagatgctttcgtttttggttatggttatgaagaatccaagtcttttagttcagttacttcagccaaaggagaaaaacacttggcgaaaagcgggggaaggagcgaagattgtggaagaagtgactgatgaaggagaatcaaactcatatggtcttcctttagtaacataccagccaccatcggacaacaatggaactgcaaagtcaaactcgaacgacgtaaatgatttcttgagaaacgccgatatgttgaagttctgcttagatgaaaaccatgtgccattgatcatacctgatctatacgatgatggagcatgggaaaagcttttgttgttgagcccttcaaggaagaagacgaagaagcaggagaacattgtgaagaaaggaaaggatgatttgacattggaggaggaggaggaggatggaacaatggaattagacaagagctatatgcttaagctgatatcagaagagatggagaaaccagatgactttgaatttggacagcttactcctgagaggtctaggaaccttgagattttgacagagcagatggaattgctggcttcaaattag

SEQ ID NO: 142 - DNA, 1281 bp, Saccharomyces cerevisiae
atgtcgcaccaaaaccagcttattccacaagcttatatttctaactttcataacagattgacaaacgaagatgatggtatccccatctttacaatggctcaacaaacaaggcagcataaaagggctaaagtggtcaactatgcggaatatgacaacgatctctttgatgaattcaatatgaacggttctaatttcaacaatgctgatacacactataaagataatgcagtgtctcatgaaaatactccggcacttacaaatggtgttaccatggacggttccgaatacaatgtcctagagaacatgaatggagctgatagtattatctctaacaacaaatacgatgcgggttcaaacatggttgtggaatctttatccggtttgaatagcaataacaacgccagcaatggtccgagcaacaaagcgcaggcacaggatattggaaacgccgttctaccggatctgcaagaccaacaccacaaccccttcaacatattgagataccctaaaataagagatactttcattaacggaaaagtggtgtctccatatagactcaacactgatcaagaaacgaaggcaaacgccaattctggagaggcaatcatgataccaattactttggatatagaacatatgggtcataccataaaagaccagtttctctggaactacaatgacgactccatatctccggaggaatttgcctctatatactgtaaagatcttgatatgacttccgctaccttacaaactcaaattgcgaatataataaaagagcagttgaaagacctcgaaaatattgcagccactgagataatgtctgacctccacgtgataatcaacctaacctgcaacttacaagacagattttttgaagataacttccagtggaacttgaacgacaaatcacttactccagaaagatttgctacatccattgtacaggaccttggcttaacaagagagttcatccccttaatatctcaatcgcttcatgaaactatcttgaagataaagaaggactgggtagatggccacttgattcaggaccatgtcccaaacgatgccgcatttgggtacttatctggtataaggctggatattgatgaactgggctccaattggtgcccaagggtggaaatattaacaaaagaagaaatacaaaagagagaaattgaaaaagaaagaaacttaagaagattgaaaagagaaactgatagattatctagaaggggcaggagaagattagatgacttagaaaccacaatgagaatgtag

SEQ ID NO: 143 - DNA, 1764 bp, Saccharomyces cerevisiae
atggcgaaccgtcttctcatatacggccttattttgtgggtaagtataatcggatcttttgcattagataggaacaaaactgctcaaaatgcgaagattggtctacatgataccactgtgatcacgactggaagtacaacgaacgtgcagaaagaacattcctcaccactatccaccggttctttaagaacccatgattttagacaggcctctaaagttgacatacggcaggctgacatacgggaaaacggtgagaggaaagagcaagatgcactaacacagcctgcaacaccaaggaatccgggcgattcgagtaattcatttttatcgttcgacgaatggaagaaggtcaagtcgaaggagcactcatcaggccctgaacgtcatcttagtcgagtgagggagccagtcgatccctcttgctataaagagaaagaatgcataggagaagagttggaaatcgatttggggtttttgacaaacaaaaacgagtggagtgaaagagaagaaaatcaaaaaggattcaatgaggaaaaggacatagagaaagtttacaaaaaaaaattcaactatgcatccttggattgcgctgcaacaattgtcaaaagcaatccagaagcgattggagcgacttctacgttaattgagagcaaagacaagtatttactgaatccctgttcagctccgcagcaattcattgttatagagctttgtgaagatatcctggtggaggaaattgaaattgctaattacgaattcttttcctcgaccttcaagagatttagggtgtcagtttctgatagaataccgatggttaaaaatgaatggacaatattaggagaattcgaggcaagaaattcaagagaactacaaaagtttcaaatacataatccccaaatctgggcaagttatttgaaaatcgaaattctatcccattatgaggacgaattttattgtcccatatccttaatcaaagtatatggtaaatcaatgatggatgagtttaagatcgatcaactaaaggctcaagaggataaagaacaatccataggaactaacaatataaacaatttgaatgaacaaaatatccaagacagatgtaacaatatagaaacgcgtttagagactccaaacacaagcaatctctcagacttagctggtgcattatcatgtacttcaaagctcatccctttgaagttcgatgaatttttcaaggtgcttaatgcatccttttgtccttccaagcaaatgatatcttcttcttcttcttcggctgttcctgtaattccagaagaatccatttttaagaacatcatgaaaaggctgtcacaactggagacaaattctagtttgacagtttcttacattgaggaacagagcaaactgctatctaaatcgtttgaacaacttgaaatggcgcacgaagcaaagttcagtcatcttgtcacgatattcaacgaaacaatgatgagtaatctagatctgctgaataactttgccaatcaattgaaagatcaatctttacgtatattagaagaacagaaactggagaatgacaaatttactaaccgtcatttattgcatttggaaagattggaaaaagaagtcagttttcaaagaagaattgtttatgcgtcatttttcgccttcgtagggttgatatcctatctattaataacgagagagctttactttgaagatttcgaagagagcaaaaatggcgctattgaaaaggcagacattgttcaacaagcaatcagatag

SEQ ID NO: 144 - DNA, 1635 bp, Sinorhizobium meliloti
atgaaagaggcgccgtggttctcgagctcggtcatctatggaatcgacgtgcgcagattttcggacggaaatggcgacgggatcggcgacttcataggtctcaaggagcgcgtgtcttatctgcactatctgggcatcgactgtgtctggctctcgccgttcttcaggtccccctttgccgataacggctacgacgtcagcgactattattccatcgatccggttctcggaacgctggacgacttcctggatttcctgcacgccgccggcgaacagggcattcgcgtcgtcgtcgatctcgtcgccaaccacacatccagcgagcatccgtggttccaggcggcgcggcgcgacgcgaggtgccgcttccgcgactattacgtctggtcggaaagcccgccgccggtcgctccggacaacaagacggcgtttcccggcgaggaaagcagtgtctggacctatgacgatctcgcccaggcctattacttccacaagttccgccatttccagccggacctgaacatcgccaacccggcggtgcgagacgaattgcttcgtgtagtcgactattggctgacattgggcgtcgacggattccgggtggatgccgcgccattcgtaatcggcgaaaccggcatagagcacgcggaccccagggacccccagggctttctcagggaaatgcgcaagctggtcgacgggaggcgccaggacggccttctgctcggcgaagcggacctggcgccggaaaagctgcggtcctatttcggcgacggaaagctcgaccttctgttcaacttcgtgttgtgtgcggctttcgccgcgagcctcgcggggcagaaggccgaccccatcggccaggcgctttcgatcatgccggagccgcctccccatcgcggctgggcgaacttccttcgcaatctcgacgaactgaacctcgatcgcctgccggaagacattcgagaggaaacctttgcagccttcgccccggatgaggagatgcggatctacggacgcggcatcaggcgccgcctcgcgccgatgctggacggaaaccgggcgagaatagaactcgccttcagtctgcttctgtcttccccgggcgtgccgctcattctctacggcgacgagatcggccttggcgaggacctttcccgaccggggcgggagccggtccgcgtgcccatgcagtggaatgcgggttccaatgccggcttctccaccgcccagcgcgccaaactcgtccagccgccggtgacagacggcccattctccttcaagcgggtcaatgtcgaagctcaacgtgaggacccggggtcgcttctgaaccgcgtgcgggcgatgatcctggcgcggcgccggcacgagctcttcaacaggggacgcccggtcatgctgcacaccggagacccggcgctgttcgcgctggcctattccgacggcaccgaactattcgtggtgctgcacaatctttcggacggcaagcggcgggcggagctcgaactgcccggcgcaatcgacgccaggctcaatgacattctcggcgagggtgaggtcgagctttccgggcagcgtctggcgatagggctcggtccgttcggctacgtctggcttcattcgggaaagaaggattag

SEQ ID NO: 145 - DNA, 1071 bp, Zea mays
atgccatgcgtgcagaaggtgcaggcggcgtcgctgtcggtgagaacgcgggtggcgacgacggcgcctgtggccacgccggggtccagcacggcggccaaggatgggaagaagaccgtgcggcagggcgtggtggtgatcacgggcgcgtcgtcggggttgggcctggcggcggccaaggcgctggcggagaccggcaagtggcacgtggtgatggcctgccgcgacttcctcaaggcggccaaggcggccaagggcgccggcatggcggacggcagctacaccatcatgcacctggacctggcctccctcgacagcgtgcggcagttcgtggacagcttccggcgcgccggcatgccgctcgactcgctcgtctgcaacgccgccatctaccggcccacggcaaggacgccgacgttcacggcggacggatacgagatgagcgtcggcgtcaaccacctgggccacttcctcctggcgcgcctgctcctggacgacatgcagaagtccgactacccgtcccgccgcctcatcatcctcggctccatcaccggcaacaccaacacgctggccgggaacatcccgcccaaggccgggctgggcgacctccgcggcctcgcggcggggctgcgcggccagaacggctctgccatgatcgacggctccgagagcttcgacggcgccaaggcgtacaaggacagcaagatctgcaacatgctaacaatgcaggagctgcaccggcggtaccacgaggagacgggcatcacgttcgcgtcgctctacccggggtgcatcgccaccacggggctgttccgcgagcacatcccgctgttccggctgctcttcccgccgttccagaagttcgtcaccaagggcttcgtgtcggaggcggagtccggcaagaggctggcgcaggtggtcagcgaccccagcctcaccaagtcgggggtgtactggagctggaacaaggactcggcgtcgttcgagaaccagctgtcgcaggaggccagcgatccggagaaggccaagaagctctgggagatcagcgagaagctcgtggggcttgcctag

SEQ ID NO: 146 - DNA, 1281 bp, Zea mays
atggcgccggagccggaggatgatattatgaacgagaagaatccccgcccgctcgacgaggacgacatcgcgctcctcaaaacctatgggcttgggccgtactcgactagcattaagaaggtcgagaaggagatcaaggaaatggccaagaaaatcaatgacctttgtggtataaaggagtctgatacagggttggctccacctagccagtgggatttggtttcagataaacagatgatgcaagaagaacaaccgttacaagtggcaaggtgtacaaagatcataagccctaatacggatgatgccaaatatgttataaatgtaaaacaaatcgcaaaatttgttgttggactgggggataaagtgtctccaactgacatcgaggaagggatgagggtcggtgttgatcgcaacaagtaccagattcaaatccctcttccaccaaaaattgacccaagtgttaccatgatgaccgtggaggaaaagccagatgtgacgtacaatgatgttggtggctgcaaggagcagattgagaaaatgcgtgaagttgttgaacttcctatgcttcacccagaaaagtttgtcaagcttggtattgatcctccaaaaggcgtcctttgctatggcccacctggcactggcaagacacttcttgcaagagctgtagcaaatcggactgatgcttgtttcatccgtgtaattggaagtgagttagttcagaagtatgtcggcgaaggtgctcggatggtcagggaacttttccagatggcccgctcaaagaaagcgtgcattgtattcttcgatgaagttgatgctattggtggtgctcgttttgatgatggggtgggtggcgacaatgaggtgcagcgtacaatgttggaaatagtaaaccagcttgatgggtttgatgcaagagggaacatcaaagttctcatggccactaataggcctgatacattggatcctgcacttctgcgtcctggtcgtctggacagaaaggtagaattcgggctacctgacctggagggccgtacccaaatctttaagatccatacacgcaccatgaactgcgagcgagatattcgtttcgagcttctggcacggctctgccccaactctactggagcggatataaggagcgtctgcacagaagccgggatgtatgccattcgtgcccgcaggaaaacggtgacagagaaggattttctcgatgctgtcaataaggtcatcaagggctaccagaaattcagtgcaacacccaagtatatggtgtacaactag

SEQ ID NO: 147 - DNA, 1518 bp, Oryza sativa
atggaggcgttcgtgccgggcggcgcgggggcggcggcggcggcggtcggagggttcgtcgccgcggccgcgctagctgagagggccggcgtgatcgcgccaaggaaacgccccaacgcgcccccagctgttcctggtttacccattatcggaaatctgcatcaactgaaagaaaagaagcctcatcagacctttgcaaaatgggctgaaatttacgggccaatctacactataagaaccggggcttcttctgtagttgtgctcaattcaactgaagtagccaaggaggcgatggttgcaaaattctcatccatatctacccgaaagctatccaaagcactgacagtgcttactcgtgataaatccatggttgctaccagcgactattgtgatttccacaaaatggtgaagcgttatgtcatgtcaagcatgttgggtacttctgcacagaaacaatttcgtgacataagagatatgatgatccataacatgttaagcacttttcataaactggtgaaagatgacccacatgctcctctgatattcagagatgttttcaaggatgagctattccggttgtccatgatccagagcttaggagaggatgtgagttcagtctatgtggatgaatttgggagggacatttcgaaggaagaaatctacaatgctactgtgaccgacatgatgatgtgcgcaattgaggtcgactggagagatttcttcccctacctcagctgggttccaaacaagagcttcgaaacaagagtgtttactacagaaactagacgaactgcggtgatgcgcgccttgatcaagcagcagaaggaaaggattgtgcgtggagaggcaaagacatgctatctggacttcttgctggcagagaacacactgacagatgagcaactgatgatgctagtgtgggaggcactcatagaggctgcagatactaccttggtcaccacagaatgggccatgtatgagcttgccaagaaccctgacaaacaggaacggctttaccaagagatccgggaggtgtgcggcgacgagacggtcaccgaggagcacctcccacggctgccgtacctcaacgccgtcttccacgagacgctgcgccgccactcccctgtcccgctcatacctccgaggttcgtccacgaggacaccaagctcgctggctacgacgtccccgccggcaccgagatggtgatcaacctgtacgggtgcaacatgaacaggaaggagtgggagtcgccggaggagtgggtgccggagaggttcgccggcgggaggctcgaggtggcggacatgtacaagacgatggcgttcggcgccgggaggagggcctgcgcggggagcctgcaggcgactcacatcgcgtgcgccgccgtcgcgcgcttcgtgcaggagttcgggtggaggctgagggagggtgacgaggagaaggtggacaccgtgcagctcaccgcctacaagctccacccgcttcatgtccacctcacgcgcagaggaaggatgtag

SEQ ID NO: 148 - DNA, 414 bp, Arabidopsis thaliana
atggcagattccaccaaagcagggttgaagaagccagctttcactaaggttgatcagctgcgtcctgggactagcggacacaatgtcaatgtgaagattgtcagcacgaaaatggtgttacagaaaggtcgtgctgatggtcctcaagctcgccagttgcggatttctgaatgcattgttggtgacgagacaggagtgatcgtctttaccgcaagaaatgaccaagtggacttaatgaaagagggatcaactgtaactctacgcaatgcgaaaatcgacatgtataaaggatcaatgaggctagctgtagacaagtggggtcgtgttgaagtcacagagcctgcgagcttcaaagtgaaagaagacaccaacatgtcccttatcgagtatgagctcgtaaacgtcgttgaatag

SEQ ID NO: 149 - DNA, 474 bp, Arabidopsis thaliana
atggagaaagtggttgatctcttcggagtcggagaagctaattcccagaagctactcgaaggaggcaaagatctcagcgagatccaacagggattgttcataggatcagtagctgaagcgaataacaaggattttctcaaaagctctaatatcactcatgtcttaaccgttgctgtggccttggctcctccttatcctgatgattttgtctacaaagtcattgaagtatatttcgatgagtgttatagcttcatcgaccaagctattcaatctggtggtggtgttttggttcattgcttcatgggaatgtctaggagtgtgactatagtggtggcttacctgatgaaaaagcatggaatgggattctctaaagctatggaacttgtaaggagccgacgacatcaggcatatcctaatcccggtttcatttcgcagctccagcaatttgaaaaatccatccaaggtaatgcatag

SEQ ID NO: 150 - DNA, 984 bp, Arabidopsis thaliana
atggagacagatagtatggagtgcgtctcatctacgggtaatgagatccatcagaatggtaatggccaccaatcttaccaattctcttcgacgaagactcacggcggagccgctgctgccgccgtcgttaccaatattgttggcccaacagcaactgctccggccactagcgtgtatgagcttctggagtgccctgtctgtacctattctatgtatcctcctatccatcagtgtcataatggacatacattgtgctcgacctgtaaagtgagggttcataacaggtgtcccacatgtagacaagaacttggagatattagatgtttagctcttgagaaagtagccgagtcgcttgagctgccttgcaagttttacaatctgggatgtcctgagatctttccttactacagcaaactgaagcacgagtctctctgtaacttcagaccttacagttgtccttatgctggttcggagtgtggtatcgtaggggacatcccttttcttgtagcccatctcagggatgatcataaagttgacatgcacgctggttccacttttaaccaccgctatgtcaaatccaatccgcgtgaagtagagaacgctacttggatgctaaccgtattccattgctttgggcagtacttctgcctccatttcgaagcgttccagcttgggatgggtccagtatacatggcattcctgagattcatgggggacgaggaagatgcacggagctacagctacagcttagaagtgggaggcagtgggaggaagctaacatgggaaggaaccccaagaagcatcagagatagccacaggaaagtaagagacagcaacgacggtctcatcatccaaagaaacatggctctctttttctccggtggagacaggaaagagcttaaacttagagtcactggtaaaatctggaaagagcaacacagtccagattctggactttccataccaaacctatcttcttcctag

SEQ ID NO: 151 - DNA, 843 bp, Arabidopsis thaliana
atggcttctacttttaggctctctattagcttcctcactctcatcctcttctctctgtgggtagtggaggcacacacgtctagaaagttgatatcaatcaaggaaaaagaaggtcaagatattagtcatttgctcaaagatggtgaatttgatgacccttcgttgtacatgtatttcacactcaatgatctcaaactaggaaccaaattgctgatttacttctacaaaaacgatcttcaaaagcttcctccacttctcacaagacaacaagccgatctcattcctttcactaagtcaaagcttgacttccttctcgaccacttctctatcaccaaagactctcctcaagggaaagccataaaggagactttgggacattgtgatgctaaagctattgaaggagagcataagttttgtggaacttctttggagtcattgatcgatcttgtgaagaaaacaatggggtataatgttgacctcaaggtcatgacgactaaagtaatggtaccggcccaaaattcgataagctacgctttgcataactacacattcgtcgaggctccaaaggaacttgttgggattaagatgttgggatgtcacagaatgccttacccttatgctgtttactattgccatggacataaaggtggaagtagagtctttgaagttaatttggtgacggatgatgggagacaacgggtagtaggacccgctgtctgccacatggacacatccacgtgggacgcggatcatgtagcttttaaggtgttgaagatggagccgaggtcagcaccggtttgccatttcttccctcttgataacattgtgtgggtaacaaagtag

SEQ ID NO: 152 - DNA, 984 bp, Cucurbita ficifolia
atgtctgcggaacatatcgttgggtcggcggccgatgcggcggcgaagaaacctgagattgagaatggggtatccgcctcacagcccgattctatttcctctgtaattcctggatggttttctgaaattagcccaatgtggcctggagaggcccattccttgaaggtggagaaggttttgtttcaagggaagtctgattaccagaacgttttggtatttcagtcatcaacttatgggaaggttctggttttggatggcgtgattcagcttacagagagagatgaatgtgcttaccaagagatgatcacccaccttccactttgctcaattccaaaccccaaaaaggttctcgttatcggtggaggagacggcggtgttttgcgagaggtggctcgccattcatctgttgagcagatagatatctgtgaaatcgacaagatggtagttgatgtttccaaagaatttttccctcgcgtagctgtcgggtttgaggatcctcgtgtcactcttcatattggtgatggcgtcgcatttctgaaggctgttcctgaaggcacttatgatgcagtgatagtggattcttctgatcctattggtcctgcacaagagctctttgagaagcctttttttgcttcagttgccaaagctcttcgaccaggaggcgttgtgtgtactcaagcagagagcatttggcttcacatgcatatcattgaagacattgtaacaaactgccgccaaatattcaaaggctctgtcaactatgcatggactacagttcctacatatccaagcggagtgattgggtttatgctctgctcaactgaggggcctcctcttgatttcaagcatccagtcaacccagtagaggtgaacggtatcgacaccgtgaagagtccgctcaagttttacaactcggagattcatacagcagctttctgtttgccttcttttgcgaagaagatcatcgattcaaaagcaaaatag

SEQ ID NO: 153 - DNA, 984 bp, Cucurbita ficifolia; identical to SEQ ID NO: 152

SEQ ID NO: 154 - DNA, 543 bp, Brassica napus
atggagaaagtggtagatctcttcggagtgggagaagccaatacccagaagctactcgaaggaggcaacgatctcagccaaatccagcagggactcttcataggttcagtagccgaagcgaataacaaagatttgctcaaagcctccaacgtcactcatgtcttaaccatagctgttgccttgtcccctccttaccctgatgactttgtctataaagtcatcgaagttgttgacagatccgagacggatttgactgtgtacttcgatgagtgttatagcttcatcgaccaagctattgaatctggtggtggtgttttggtccattgcttcatggggatctcaaggagtgtgactatagtggtggcttatctgatgagaaagcatgggattggtttctctaaagctatggagatagtaaagagtagacgacctcaagcattgcctaactttggtttcgtttctcagcttcagcagtttgaaaaatccattaaagttcatgatgaggcttcttcttcagtggataataaggagatagtagcatag

SEQ ID NO: 155 - DNA, 1164 bp, Arabidopsis thaliana
atggatgctgaaaagaagagtgcccattttcgccaaatctcatcttataaaccacaattacttgtcctctcctcaatccaagaaaacccttcttcaaaaatctcagaaaaagccaatatcaaagctgacaatgacgccgagattggagttttcggagcagaaaagtacttcagcatgaagctagatcatgttgattccacggcggatatcaccaagcaacatgaaaaggaaaacacacatgatcatcctaatgctaatcctaatcctaatcctaatcctcatcctcatcctcatccccagttgacgaaaacgacgtcgtcaagatcaaaaacaagccgacatggaacgccaagtgtaagatccgagtcaagttgcaacagtcaaacctttctcatgaggattaacaaccacaatgaaaataagcaacggaaaatgaacgatacgagcatctcttttggtgggtttagatgttacggtccctgctctggggtcaaaaccgtccataccgacccaaaaaactcctgtaaaagtagaaattccgatcgggattttgttgcttacgacgcaagaaagcacaacgacaaaccaagactccattttgaagccaagaaagcggattttcatgcgcaagagaagatttcattacctattcaaaggtccgatatcgccatgaacctcgagagaaagctctctctgcttacatgggacgcaataccaaaccaactctctaccaagaacaacaatcacaacaataatggtaataactcttcaatgagtagcaacacgcaagaggaagagacagcaagtgtagcaagttctgatttgttcgagattgagaacataacgagcagtgtctatgagccgagtgaggccagcattggatggagtgtggtaacgggaagtatggcagatcaatcggtgatttcggatttcgatatgatgaagagggtcacgagaaatggtccggtggttaaaaccaaaccggtgattggtgagaaagtccggtcggctgggtttttgtcgggttgtaagagtcacaaagctgtctcggttgttgatagttctagaaaagtgaaagaaacagccaaggttgatcatcacgagatgtctcatcagaagaagtttaaaactgagattaggattcaagacttgagctttctttag

SEQ ID NO: 156 - DNA, 762 bp, Arabidopsis thaliana
atggcttcttcagcagtgtctctccaatccatctctatgacaactctcaacaatctttcatgtaatcaacaatttcatcgaagctctcttcttggttcctctaaatccttccaaaatcttggtatctcatctaacggttcagatttctcctatccatcaagtttcactgccaagaagaacctcactgcttctcgagctctctcccaaaacgggaatatcgaaaaccctagaccaagcaaagttcaagaactgagtgtgtacgaaatcaacgaattagatcgacacagccccaagattcttaaaaacgcattcagcttaatgttcggtctcggagatctcgtaccattcacaaacaaactctacacaggcgatctcaagaaacgcgtgggcatcacggcaggtctctgcgtcgtcatcgaacacgtcccagagaagaaaggtgaaagattcgaagctacttatagcttctacttcggagactatggccacttgtccgttcaaggaccatacttgacttacgaggattcgttcctcgccatcactggtggtgctggaatctttgaaggtgcctacggacaggtcaagcttcaacagcttgtgtatccgacaaaactgttctacactttttaccttaaagggttggctaatgatttgccgttggagctcaccggaacaccggtaccgccgtctaaggacatagagccggcgccggaagctaaggcactggagcctagcggagttataagtaactataccaactag

SEQ ID NO: 157 - DNA, 681 bp, Arabidopsis thaliana
atgtcgcagtgcgttgacggtatcaagcatttatgcacctctgttttagggtgttttgatcttgatttgtataaacaatctggtggccttggagatcctgaattgcttgcaagagacactgtttttagtgtgagtgaaatagaagctctttatgagctttttaagaaaatcagcagtgccgtgattgatgatgggctaataaacaaggaagagtttcagttggctttgtttaagacaaataaaaaagagagtttgtttgcagatcgggttttcgatttgtttgatacaaagcacaatggaatactggggtttgaggaatttgctcatgctctctccgtctttcacccaaatgcgcctatagatgacaaaattcacttttcatttcagctatatgatcttaaacagcaagggtttatcgaacggcaagaggtgaaacaaatggttgtcgctacgcttgctgaatctggaatgaatttgaaggatactgtcattgaggatataatcgacaagacgtttgaggaagcagacacaaaacacgatggaaagatcgataaggaagagtggagaagccttgttcttagacatcccagccttctgaagaacatgactcttcaatatctcaaggatatcacgactacgtttccaagctttgtgttccattctcaggttgaagatacctag

SEQ ID NO: 158 - DNA, 1395 bp, Zea mays
atgtcgggggtcggcagcggcaggccgccggccgcccagaagatcctgcagtcgctgcgaccgccgctgtccttcgccacgccgtcgcggtcgcccttcgccgcgcccgacgactaccaccgctttccgacaccggctgcggccacggcacccgccgccacctcaggcggcgtcggtgcgggggctcctcctcgtgatactatcgaggaggggctgttcatacggactccgctgaaaaggaaagctacatctgaagaaaatgatgctgctgctgagccaagcgattgtatcattaccagtccaatgcccacttcggtctctggtaaaactgttaaagcttctaaggcaaaagctaagaacagtaaaactgggcctcagacacctacatcaaatgttggttcaccactcaatccaccaactcctgttggcacgtgccgctatgacagttcactaggacttctgacaaaaaagttcattaacttgctcaagcaagcgccagatggcattctagatttgaacaatgctgcagaaacactagaggttcaaaagcgacgcatatatgacattactaatgtccttgaaggcattggactaatagagaagacacttaagaatagaatccgttggaaggccctggatgattcaagtgttcaattagataatggtatttccgctttgcaggcagaagttgaaaatcttagtctgcaggagcaagcactagatgagcgtataagtgacatgcgtgaaaaactaagggggttaactgaagatgaaaataataaaaggtggctctatgtgactgaagacgacatcaagggattacccagctttcagaatgaaacactaattgctattaaagcacctcatggtactacacttgaagtacctgatccagatgaggcgggtgattatctccaaaggagatatagaattgtattaagaagtacgatgggaccaatagatgtttacttagttagtcaatttgatgagaaatttgaggaactgggtggtgttgcgacacccgtcaagcattccagtgtgcccagacatcaacccgcggaagatttcaatacttatgctggacaaagtagcacaccaatggacgtggcacatgatgtacagcatggccagaagattccccaggatcctagtgctttgcatgactttggagggatgacaaggattagtccttccgacgtccatacggattctgattactggctcctaacagagggggatgttagcatgactgatatgtggaaaacaggacaagaagtgcagtgggaccagatggatttcctgtcagaagatgttgtcacccctcgagcccataatcagcagccggtcacagttgacgggccacatatggaggttccaagcatggacccataatag

SEQ ID NO: 159 - DNA, 528 bp, Arabidopsis thaliana
atgcaatcgctgcaagataaggcatcggtgttaagcggcgtcgatcaggctgaggcgttcgccatcgacgagtccaatctgttcgacaagcttggtcttcagacattcatcaacctatccaccaatttctataccagggtatatgatgacgaagaagaatggtttcaatcaatattttctaactctaacaaagaagatgccatccaaaaccagtatgagttctttgtccagcgtatgggaggccctcctttgtattctcagagaaaaggtcatcctgctttgatcggacgtcaccgtccatttccagtgacccatcaagctgctgagagatggctagagcacatgcaaaatgctctggacgattcggttgacattgaccaggactcaaaaatcaaaatgatgaagttctttagacacaccgcatttttccttgtggctggaaacgagctgaagaatcagaatgagaaaccgaagcataagcctcaatgtgcttgtaaacacgcagccaataaaccagcagaagaatag

SEQ ID NO: 160 - DNA, 1560 bp, Oryza sativa
atgcagttcagcagtgtgtttcccttagagggtaaagcatgcgtgagcccaataaggagaggtggtgagggctcagctagtgatagattgaagatcggggacagtagcagcatcaagcatgatagagcagtgaggaggatgtgtcttggttataggggcaccaaaaacggtgcacaatgtgtgctcacctcagatgctggcccagacactcttcatgtccgaacatcattccggaggaactttgcggatccaaatgaggttgctgctgttatattgggtggtggcaccgggactcaactttttcctctcacaagcacaagggccacgcctgctgttcctattggaggatgctataggcttatcgatatccccatgagcaactgtttcaacagtggcataaacaagatattcataatgactcaattcaactcagcatctcttaatcgtcacattcatcgtacgtaccttggtggtggaatcaactttactgatggatctgttgaggtattagccgctacacaaatgcctggggaggctgctggttggttccagggtacagcagatgcagttagaaaatttatctgggttcttgaggactattacaagcataaagctatagaacacattttaatcttgtcaggagatcagctttatcgtatggactacatggagcttgtgcagaaacatgttgatgacaatgctgacattactttatcatgtgctcctgttggagagagtcgagcatctgactatggactagtgaagttcgacagttcaggccgtgtaattcaattttctgaaaaacccaagggcactgacttggaagcaatgaaagtggataccagctttctcaattttgccatagacgacccgactaaatttccctacattgcttcgatgggagtttatgtcttcaaaagagatgttcttttaaaccttctaaagtcaagatatgcagaactacatgactttgggtctgaaatcctcccaagagctttacatgagcacaatgtacaggcatatgtcttcgctgactactgggaagacattggaacgatcagatcgttctttgatgcaaacatggccctttgcgagcagcctcccaagtttgagttttatgatccaaaaactcccttcttcacttcacctcgatatttgccgccaacaaagtcagataaatgcaggattaaagatgcgataatttcccatggctgtttcttgcgtgaatgtaccatcgagcattcgatagttggagtccgctcacgccttaactctgcatgtgagctcaagaataccatgatgatgggtgcggatttgtacgaaactgaagatgaaatttcaagactactgtcagaaggcaaggtccccattggtgtaggggaaaacacaaagataaacaactgcatcatcgacatgaacgcgagggttggaaggaacgtggtcatcacaaacagcgagggtgtccaagaaagtgatcggcctgaggaagggtactacataaggtcgggaatcgtggtgatcctgaagaacgcgaccatcaaggacgggaaggtcatatag

SEQ ID NO: 161 - DNA, 939 bp, Zea mays
atgcagtcttcgtgaagaccctgaccggcaagactatcaccctcgaggtggagtcttcagacaccatcgacaacgtcaaggccaagatccaggacaaggagggcattcccccagaccagcagcggctcatctttgctggaaagcagcttgaggacgggcgcacgcttgccgactacaacatccagaaggagagcaccctccacttggtgctgcgcctcaggggaggcatgcagatcttcgtgaagaccctgaccggcaagactatcaccctcgaggtggagtcttcagacaccatcgacaatgtcaaggccaagatccaggacaaggagggcatcccaccggaccagcagcgtttgatcttcgctggcaagcagctggaggatggccgcaccctggcggattacaacatccagaaggagagcactctccacctggtgctccgcctcaggggtggcatgcagatttttgtgaagacattgactggcaagaccatcaccttggaggtggagagctctgacaccattgacaatgtgaaggccaagatccaggacaaggagggcattcccccagaccagcagcgtctgatctttgcgggcaagcagctggaggatggccgcactctcgcggactacaacatccagaaggagagcacccttcaccttgttctccgcctcagaggtggtatgcagatctttgtaaagaccctgactggaaaaaccataaccctggaggttgagagctcggacaccatcgacaatgtgaaggcgaagatccaggacaaggagggcatccccccggaccagcagcgtctgatcttcgccggcaaacagctggaggatggccgcaccctagcagactacaacatccaaaaggagagcaccctccaccttgtgctccgtctccgtggtggtcagtagaacccagcggtactcgctgagg

SEQ ID NO: 162 - DNA, 579 bp, Zea mays
atgtcgtcggcgcccctgcagatcgcgccggtgccggagcatgtgtgctacgtgcactgcaacttctgcaacacaattctcgcggtcagtgtcccgagtcacagcatgctgaacatcgtcacagtccgttgtgggcactgcactagcctgctgtcggtgaacttgagaggactcatccaatcacttcctgtccagaaccaccactactcccagcagcaggagaatttcaccgtccaaaatatgggttttactgaaaattaccctgagtacgcaccttcgtaccgcatgccaacgacgctgtcagcgaaaggtgatctggatcatatgctgcacgtgcgcgctccagagaagaggcagcgtgttccttcagcatataacagatttattaaggaggagatacgaaggattaaagcatgtaacccggacataagccatagggaagccttcagcactgcagcaaagaattgggcacattttccgaatattcattttggtctagggccctgtgaaagtagcaacaatcttgatgaggccaccggtgcaatgtgccatccccagaaagtccaagatctctactag

SEQ ID NO: 163 - DNA, 2523 bp, Zea mays
atggctgcagcggtggcgttgcgagggggaagcagcgatagcggaggatttgataaggttcccgggatggactcgggaaaatacgtgcgctacaccccggagcaagttgaggtgctcgagcggctctacatagattgccccaagccaagctcctcacggcggcagcaactgctgcgcgagtgtcctatactctccaacattgagccaaagcagatcaaggtctggttccagaaccggaggtgccgcgataagcagcggaaggagtcttcgcggcttcaggctgtgaacagaaagttgacggcaatgaacaagcttctaatggaagagaatgagcggcttcagaagcaagtctctcagttggttcatgaaaacgcgcacatgcggcagcagctgcagaatacttcattggccaatgacacaagctgtgaatcaaatgtcactacccctccaaaccctataagggacgcaagtaacccttctggactccttgcaattgcagaggagaccttcacagagttcctctcaaaggctactgggacagctattgattgggtccagatgcctgggatgaagcctggtccggattcagttggtatcgtggccatttcgcatggttgccgtggcgttgctgcccgcgcctgtggtttggtgaatctagaaccaacaaaaggcatagagatcttgaaagatcgtccctcttggttccgtgattgccgaagtcttgaagtgtttacaaggtttccagctggaaatgggggaacaattgaacttatttacatgcagatgtatgccccaacaactttagtccctgcacgtgatttttggacactacgatacacgacaacaatggaagatggcagccttgtggtctgtgagagatccttgagtggttctggtggtggtccaaatgcagcctctacacaacaatttgttagggctgagatgcttccaagtgggtatttagttcgcccatgcgaaggtggaggatcagttgtgcatatagtggaccatctagatctcgaagcatggagtgttcctgaagtgcttcgaccactgtatgagtcttctagagttgttgctcagaaaatgactactgtggcactgcgccaccttagacaaattgctcaagaaacaagtggagaagtagtgtacgccttgggaaggcaacctgcagtcctacggacctttagtcaaagactaagcagggggtttaatgatgccattagcggtttcaatgatgatggctggtctgtaatggggggagatggcattgaagacgttgttattgcttgcaactcaaccaagaaaattaggaataccagcaatgctgggattacatttggagccccaggaggcattatttgtgcgaaggcatccatgttactgcagagcgtcccaccggcagtactggtacgatttctgagggagcatagatctgaatgggctgattacaatattgatgcgtatttggcttcatcattgaagaccagtgcgtgctcacttcctgggttgcgacccatgagattttctgaggggcagatgatcatgccacttgctcacacagtggagaacgaggagattcttgaagttgtccgccttgaaggtcagcctcttactcatgatgaagctcttctttcaagggacatccaccttctccagctttgcactggaatagatgagaaatctgtgggttcctccttccagcttgtgtttgcaccaattgatgagcatttcccagatgatgctccattgatttcttctggctttcgtgtcataccacttgatgtgaaaacagatggtgtatcctctggtaggacgctagatttggcatctagtcttgatgtgggctctgctgcaccccaagcctcaggggatgcatctccagatgactgcaatttgagatctgtgctgacaatcgcctttcaattcccgtatgagatgcaccttcaggacagcgttgcagcaatggcccgtcaatatgttcgtagtgtcatttctgctgtgcaaagagtgtcgatggctatatctccctcccaatctggtctaaatgctgggcataggatgctttctggcttccctgaagctgccacacttgctagatgggtttgccagagttatcactaccatctaggtatggaattacttaatcaatcagatggagctggtgaagcattgttgaaaatgctctggcatcatccagatgctgttctgtgctgctcctttaaggagaaacctatgtttacgtttgcaaacaaggcagggctggacatgttagaaacatctcttgttgccctgcaagacctgacgctagacaagatcttcgacgagtcaggaaggaaagcactattctcagacatctcgaaactaatggaacagggctacgcgtacctgccgtcaggcgtgtgcatgtcaggaatgggccgccatgtttctttcgaccaagctgtagcgtggaaggtgctcggcgaggatagcaacatccactgcctggcgttctgcttcgtcaactggtccttcgtttag

SEQ ID NO: 164 - DNA, 1649 bp, Zea mays
atggtgggcggcggtgagggggatcgcgtgggcggcggcgtaggggttgggggaggccagcagttcgtggaccgcagcaaggtgaggattcttctctgcgacggcgacgccagcagctcccgggaggtgctgcggctcctctgtaactgctcgtaccatgtaacttgcgccaagtctccgcggcaggtgatcaatattctcaactacgagggcggcgagatcgacatcatcctggctgaggttgatctgccggtctccaagtgcttcaagatgctcaagtacattgccaggaacaaggacctgcgccacatccccatcatcagtaggcagccttcctattctgagccttgtgcggttgtgcctattactgtgatgtgctttctgtgaccgtcctccctgtcttatggaactgtgcagtgatgtccaacagagacgaggtgtctgttgttgtcaagtgcttgaggcttggtgcggccgagtacctggtgaagccgctgcgcacgaatgagctgctgaacctttggacccatgtgtggcggcggagacggatgcttggtttgcccgagaaaaacttcttcaatgacaacttcgagttggtgctctcagaacctagtgatgcaaataccaatagcgccaccctcctctcagatgagacagacgacaggcctaaagaaaacacaaatcaagaaacgggcacctcaaatcagcttgaatacgagtctaatccttccgttgctgagcgcgaccagagagacaagatcggtgctccaggctctgccctagatgccagtcaatcatcgactccgggaagaatgttttcacgtcctataaaaactaacctgaaggttgctgagtcgtctgcatttctagcatatgttaagtcaagcaccccagccaccagttcatttgatagcggactacaaagaggtgacagccggttagattctttggataaccatggtaattgctctagtgcaacagatagaagtgacaccggtactgatgtaaatattcggaataaagaagcttttgagatgcctgtgcagtatcctatggtatgcttttcttcctctagcatgcatatggagcgaagcaatgaaggccataatgacacttcaggaactccacctgcataccatttcccattttattatccagggatggtagaacacaacatggcactttcatcagtgcaaaattttcaagcaaacataaacagtgctcaagcacatacaccaccagcgatgcttcatcagtacaatgttttctcccaatgccatagtttacccatgatatcaccatttcagtttaatacttctggcatgagtatgcactcaagtcatttaccgacgcaaaatgtgtggtcatcggcatcgagcacaccaacgcctgacgaaacatgcaatcgctccgagagaagggctgcagcacttgctaaattcaggcagaaaaggaaagagcgctgttttgacaagaaggtgaggtatgtgaacaggaagaaacttgctgagacgaggctaagggtgcgaggtcaatttgttaggcatgcaagcaatatggatatcataagcactggagatgacatatctgaagacgaagatgacgatccaacctccagggaggtagatatgatttcttctccagagtag

SEQ ID NO: 165 - DNA, 1500 bp, Arabidopsis thaliana
atggagaaacagagcatcagaaacacttgttcttcttctttaatgttatcctcaccatcttctttttgggttcgtggtgcgtgtatcggcagaggttgtttcggtgcagttagtacggcgatcagcaaaaccaacggtgaagttttcgccgtgaaatccgtggatctcgccacgagtctccccactcaatcagagtctctcgagaacgaaatatctgtcttccgctcgctaaagcctcacccttacatcgtgaagtttctcggcgacggagtctcgaaagaaggaacgacgacgtttaggaatctctacttagagtatctcccaaacggtgacgtggctagtcacagagccggaggaaaaatcgaagacgagactctgctccagcgttacacggcgtgtcttgtctctgctctccgccacgtacactctcaaggattcgttcactgcgacgtcaaggcgaggaacatcctcgtcagccaaagctccatggtcaagttagccgattttgggtcggcgttcagaatccacacaccgagggctctgatcacgccacgtggaagtccgctttggatggctccggaggtgatcagacgagagtaccaaggtccggagagtgacgtctggtctctcggctgcacgatcatcgagatgttcactgggaaacccgcttgggaagaccacggaattgactcgctgagtcgaatcagtttctctgacgagttaccggttttcccctcgaagttgtcggaaatcggccgtgatttcctagaaaagtgtctgaagcgagacccgaatcagaggtggagttgcgatcagcttttgcagcatccatttctctctcagtgtcacaactcatctccgactgagtcatctccgcgttgcgtacttgactgggtcaactcggggtttgacttagaagaagaagaagaggaagtagggagatcagaattcgaagacgcggcgaaggcaataatttgtaatttggcgacgaccggaggagtaatttgggagtcagatggttgggtggaagttagatgccacgcttcggaagaggaagggacaacaatggaatattcgggatccacaagggtagaatcggaatataacacatcatcggatccaaacgatgacgtggctggtgactcggcgataattgacgtttctatgtctcagaatttaccgcctggaaacgggggatcggcggcggcgctgccatatgaatttgtggtggttttacatttattaatggaaattatggtttatactacatgtatctttagggaaattgttctcactatgtatttgttgtatcagtataatcaaagcaataaactcgaaacgttgtcttttaatcacagcctcaagttttgtttgtttgcacatgtgattcggatcggacaaaactatcttttacgcggtgagatgagatcgagtgtcttaattacgagccattgccttatattgataactctcgtttacagccaaatagttgtattttag

SEQ ID NO: 166 - DNA, 1359 bp, Arabidopsis thaliana
atggcatctggtgttttcgaggatgaagctgaaggaactataacgatcaatgaatatatcgaaaggcttgacgcagaagagctggcagcggatttggtgttgggtggagatgaaggagatgagtgtactttcccaaagggttacatgaaaaggcaagcaattttctcatgcattacatgtacaccagaggggaatgctggaatttgcactgcttgttgcttatcttgtcatgatggccatgagcttttggagctgtggactaagagaaattttcgatgtgattgcgggaactcaaagtttggaactttggcttgtaagcttctcccgagcaaagatatagaaaactctgaaaattcttacaaccataatttcaaaggcttgtactgcacttgcgaccgaccttaccctgacccaaatgtggaagaacaagtagagatgattcagtgttgtctctgtgaggattggtttcatgaggagcatctcggtctcacaccttcagacagtgttggtagccagattccaagggatgaggaaagtgagccgatctatgaagatttcatttgtcaaaactgctccccagcatgttcgtttctgacactttatcctgagaacttgtgggttgttgctaaagtagattccactggttctgctaatgcttgttcagagacaattgagttagacaaaaaccacatggattctgaacccggccagccagagaacggtactgatgctgagaaatctgttgtaggaaaatgttctgagacgatcagtgactcagaacctggccagcctgagaacggcactgaagccgagaaatctgttgtgcaaaaatgttctgagaagatcgatgaatctgaagccggccagcctgagaacagtactgaagccgagaaattcgttgtgcggaaatgttctgagaagatcgatggctctgaaaatgttcctgcagctggttgtgttattaggactgatctaaactcgtgtcctgagtttgagaagaaacctttgtttttgaccaaaaactggaggaacatcctatgcagatgcgaaaagtgccttgagatgtataagcagagaaaggtaagctatctacttgatgcagaggacacaattgttgaatacgagaagaaggcgaaggaaaaaagaacagagaaactggagaaacaagaaggtgaagcacttgatcttctgaataatctagaccacgtatccaaagttgagctccttcacggaatcaaagacttccaagacggactccagggtttaatggagtctgctgggccatcaaaggcgataacttctgcagatatcgagcaaatgttttcaaaactgaaaaacaaacgtaaaaggatggagtag

SEQ ID NO: 167 - DNA, 1551 bp, Zea mays
atggggttcacggaggagttcctgcggcagatggagccgcggatgcagcaggccttcgtcgacatgcgggagctcgagaagggcgccatcgccaaccccgacgagggtcgcatggtgggccactactggctccgcgacccggccctcgctcccaactccttcctccggaacaagatcgagaccgcactcgacaaaatcctcgccttctcccaagatgtcatctctggaaagattctttccccatctggtcgtttcacttcaattctctctataggaatcggagggtcagctttgggccctcaatttgttgccgaggcacttgcacctgataaccctccactgaagataagatttattgacaacacagatcctgctgggattgatcatcaaattgctcaactaggacctgaactggcaactactcttgtaattgtcatttctaagagcggaggcacacctgaaacccgcaatgggctactggaagtacagaaagccttcagagatgcgggtctgcaattctcgaaacagggtgttgcaatcactcaagaaaattctctgttggataacactgccagaatagagggatggttagctcggtttcctatgtttgactgggttggtggtaggacttcagaaatgtcagctgttggtttacttccagctgcattgcagggtattgatatcaaggaaatgctagttggtgcagctttaatggatgaggaaacccggaacactgtggttaaagcaaatccagcagcattgcttgcattatgttggtattgggcatcggaagggataggcaaaaaggatatggttgtgcttccttataaggatagtttgttacttttgagtagatatttgcaacaacttgtcatggaatctcttggaaaagaattcgacctggatggcaaccgtgttaatcaagggctaactgtatatggtaacaaaggaagcactgaccagcatgcttacattcagcagctgagagaaggtgtacacaacttctttgttacgtttattgaggtcttgcgtgacaggcctgctggtcatgattgggagcttgaacctggagtcacgtgtggtgactatttgtttgggatgttgcagggaacccgttctgctctttatgcaaatgaccgggagtctatctctgttactgtgcaagaggtaactcctagagctgttggagcactgattgcactttatgaacgtgctgtggggatttatgcttctttggtaaatatcaatgcctatcatcagcctggtgttgaggctgggaaaaaggcagcaggagaagtattggcccttcagaaaagggttctgactgtattaaaggaggccatctgcgagaaccctactgagccattgactctagatgaaattgcagatcgctgccattgccctgaagatattgagatgatctacaaaataatccagcacatggctgctaacgacagagcacttatagcagaaggcagctgcggctctcctcgcagtgttaaggtgtacctcggtgaatgcagtgtggacgaagatatgcaggccgcatag

SEQ ID NO: 168 - DNA, 1113 bp, Zea mays
atgtctaccgtcttcatgacccaactgccgcgtactctccgtctaatggagggagagcaggatcagggactctttccggcgtcgaccttccatgtcgcaaaggaccctccaatcttgttcccgttcatgatcaccagccccgtccatgtagatcagctccaagggcaaagcagctatggtgatcagcacttggggcagcatgtcttgtctgaatctactcaacagttcaccgatcggacgatgataagtgggtcagaagtcttccctaggcggccatcgccgttcgggcagactatccaaagcatcgatggtgatatgatccagccatctgcgtatgatccatatgatatagtggagaaccagcgcacggaaggattgagcggcggcggctggacagtgtcgtcgtcctcgtcgtcaccgccggcgaagatgaagatcatgcgcaaggcgacgagcgagtatcccgagggtggagctgcaagaaagccaaggagaagagcccaagcgcaccaagacgagagccagctactgacgatgcagcagcaggctatgggcgtcgtcgttagagtgtgctccgactgcaacaccacaaagacccccttgtggaggagtggtcctcgtggccccaagtctctctgcaacgcatgtggcataaggcaaaggaaggcgaggcgggcgatggtggccgcggccgcggcagctgctgccagcaacggaggcgcgcctccacaagcggtgagcggcgttgccacccagcagcagccgaagccgaagccggccaggaaggagaagaggtcggacgccgccgaccggtcgctgccgttcaagaagcggtgcaagatggtggttgtcgatcacgctgccggtgcagcggcagccacggcgacgccagaggccgcagctgctcggagtaccaaggatcaagcggatcacgtctccggcgacaagcaggttgttgcccctgccgccgcgatgaggagtctggatcagagcgagatcgccactcctcctccctcggcggtgtcgtcgtttcatgctgctttcccggccgacgagatcaccgacgccgccatgctgctcatgaccctgtcctgtggtctcgtccgcagctag

SEQ ID NO: 169 - DNA, 465 bp, Oryza sativa
atggcggcgagctcgagcttggatttggtgaagaccatggcggcgtccgggttcctcctccgctgccctgcggcgcccagcgctgtcccactctggggaaggagcgggaggggcggcggcggcggcctcgccttctccgcttcgtcctccaatggtgcagctgttccatcctccctaagtgactcagagaagaagggccctgtggtgatggaaattccactggacaagattaggaggccactgatgcggacgcgtgccaatgatccagccaaggtgcaagaactcatggacagtatccgtgtcattggcctccaagtacctattgacgtactggaggttgatggagtctactatggtttttctggatgtcaccgctatgaggctcaccagcgcctaggtctcccgactatccgctgcaaagtccgtcgcgggacgaaagaaacactaaggcaccatatgcgatag

SEQ ID NO: 170 - DNA, 384 bp, Saccharomyces cerevisiae
atgtcactacaaagcaacagtgtaaaaccaacagaaattcctctctcagagatcagacgccccctagcgcctgtgttggatcctcaaaagatcgacgcaatggtggccacaatgaagggcattcccaccgctagcaagacatgctctctagaacaggctgaggcggctgcctcagccggggaactgccgcccgtggacgtgctgggcgtgcgagtcaagggacagacgctatattatgccttcggcggctgccaccgtctacaggcatacgaccgccgggctcgcgaaacgcagaacgccgccttccccgtgcgctgcagggtgctaccggccactccccgccaaatccgcatgtacctgggcagcagtctcgacatcgaatag

SEQ ID NO: 171 - DNA, 1428 bp, Agrobacterium tumefaciens
atggagaggctcgccaaattgccggtcttctgggggctcgagggtaagcgcgtcgttctgacaggcggatcggacggagcagcctggaaggcggaactgttgttggcctgcggggcgcagcttgatctttattgcgaggaaagcgggctttcggaaagcctcgcgacgctcgtcgcaaaaagcccgatgctgacatggcatgaccgttgctgggatgcagatattttcaaaggggcggaactggcgctggcagattgcgaagctgaagaggaagccggaagattttatcatgccgcgcgggcagcaggcgtgccggtcaatgtcatcgacaagccggaattctgccagttccagtttggttcgatcgtcaatcgctcaccggtggtggtgtcgatctccaccgatggtgccgcgcccattctggcgcaggccatccgccggcgcatcgagacattgctgccgctttcgctcaaggactggggcgctcttgcccagacaattcgagagcgcgttaatctgcggcttgcgcctggcgcggcacggcgctctttctgggaaaagtttgtcgaccgggcttttaccgaaagactggacgagggtagcgaagaacggctgctgaaagatgtagcgacgcggacggggctggcagaatcgggacgtggttttgtgacgctggtgggcgcagggccaggtgatgccgagcttttaaccctgaaagcggtgcgtgccctgcaggcggccgatgtcatcctgttcgacgatctcgtctcagcggaggtgctggaactggcgcggcgggaggccaagcgcatgctggtcggcaagcgcggcggccgcgaaagctgcaaacaggaagacatcaacgacatgatgatccgcttcgccaaggccggtagacgggtggtgcggctgaaatccggcgatccgatgattttcgggcgcgccggcgaggagatcgcggcgctggaagccgaaaatatcccggtcgaggttgtgcccggcatcaccgccgcaagcgccatggcctcacgtctcggcgtttccctgacccatcgcgaccatgcccaatccgttcggttcgtcaccggacattcgcggcagggaaagctgccggaaaatatcgactggcagtccctgtcgaacccttcggtgaccacggtgttttacatgggcgggcgaaccgccgcggacatccagtcttgcctgctcgcccacggcatgcccgcctcgacccccgtggttgtgatgatttccgtcagccgggtgaatgaacaacgctggtgcggttcgctcgcgcaactggttgctgcagtcgagaggctgggcgtgaacgaacccgtgctgatcggtgtcggggatgcgttccgttccgcttctgtcaacggcggagaacagaccgctgctgcgccttttcaaaaagccggctag

SEQ ID NO: 172 - DNA, 2670 bp, Oryza sativa
atggcggcctcggtggagtacaagctggctccgcacccgtgggcgagcaatgctccgtcgagcaacctcgacttgttcccgtccggcggcggcaagcgccgttcgggctccgagaccgactccgacgacgaggacagcataccaccggactggaggtcgctgtaccacccgcggctggaggtggcggagccggccgtcaaggacccccgcgacgaggccacctccgacgcgtgggtgcgtcgccacccggcgctcgtccggctcaccggcaagcacccgttcaactccgagccgccgctgccgcgcctcatgtcgcacggcttcatcacgccggcgccgctccactacgtgcgcaaccacggcgccgtgcccaaggcggactggtcgacgtgggccgtggaggtgaccgggctcgtcaagcgccccgcgaggctcaacatggagcagctcgtgaccgggttcgaggccgtggagctccccgtcacgctggtgtgcgcgggcaaccggcgcaaggagcagaacatggtgcgccagaccgtgggcttcaactggggccccggcgccatctccacctccgtgtggcgcggcgtgcggctgcgcgacgtgctgcggtggtgcggtgtcatgggcgcctccgccggcgcggccaacgtgtgcttcgagggcgccgaggacctcccaggcggcggcgggtgcaagtacggcaccagcctgcgccgcgaggtggccatggaccccgcccacgacgtcatcctcgcctacatgcagaacggcgagccgctcacgcccgaccacggcttccccgtccgggtcatcgtcccgggcttcatcggcggccgcatggtgaaatggctcaagcgcatcatcgtcgcgtccagcgagtcggagagctactaccattaccgcgacaaccgcgtcctcccgtctcacgtcgacgccgagctcgccaatgccgaagcttggtggtacaagccggagtacatgataaacgagctgaacataaactcggtgatcaccacgccgggacacgatgaggtgctccccatcaatgcgctgacgacgcagcggccgtatacgatgaagggatacgcctactccggcggtggccggaaagttacaagggtagaggtgaccctggacggcggcgagacgtggcaggtgtgcaaccttgaccacccggagaggccgaccaagtacggaaagtactggtgctggtgcttctggtccgtcgatgtcgaggtgctcgagctgctcgccgccaaggagatcgccgtccgcgcctgggacgagtccctcaacacccagccggagaagctcatttggaatctcatgggcatgatgaacaactgctggttcagggtgaagacgaagacgtgcaggccgcacaagggggagatcgggctggtgttcgagcacccgacgcagccgggcaaccaggccggcgggtggatggcgaggcagaagcacctcgagacgtcggagagcgcggtgagcacgctgaagcgcagcacgtccacgccgttcctcaacacggccaccacgcagtacaccatgtccgaggtgcgccgccacacgacgccggagtccgcctggatcatcgtgcacggccatgtctacgactgcacggggttcctcaaggaccaccccggcggcgccgacagcatcatgatcaacgccggcaccgactgcaccgaggaattcgacgccatccactccgacaaggcccgtggcctcctcgagatgtaccgcatcggcgagctcatcgtcaccggcagcgactactcgccgcagagcagcagtgctgacctcacgtccatcgttgagagccctacggcagcggcggcgcccgccgtgccggtgtcgaccgtcgcgctgtccaacccgcgggagaaggtgaaatgccggctcatggacaagaagagcctgtcctacaacgtgcgcctgttccggttcgcgctgccgtcgccggaccagaagctcgggctaccggtcggcaagcacgtgtacgtgtgcgcgtcgatcggcggcaagctctgcatgcgcgcgtacacgccgacgagctccgtcgacgaggtcggctacatcgagctcctgatcaagatatacttcaagggcgaggaccccaagttccccgacggcgggctcatgtcgcagtacctggactacctgccgctcggcgccaccatcgacatcaagggcccgatcgggcacatcgagtacgccggccgcggcgccttcacggtgaacggcgagcgccggttcgcgcggcggctcgccatggtggccggcgggacggggatcacgccggtgtaccaggtgatccaggccgtgctctgggaccagcccgacgacggaacggagatgcacgtggtgtacgcgaaccggacggaggacgacatgctcctccgggaggagatcgaccggtgggcggcggcgcacccggcgcggctcaaggtgtggtacgtggtgagcaaggtggcgcggccggaggacgggtgggagtacggcgtggggagggtggacgagcggacgctcagggagcacctgccgccgggcgacggcgagacgctcgcgctcgtgtgcgggccgccggcgatggtcgagtgcacggtgcggccgggcccggagaagatgggctatgacctcgacaagtcctgcctcgtcttctag

SEQ ID NO: 173 - DNA, 813 bp, Arabidopsis thaliana
atggagctgtcgtctgcgtccgccatattaagccactcctcctccgccgctcagcttctcagacctaagctcgggtttattgatttgcttcctcgtcgagcgatgatcgtttcttctccttcttcttcgcttcctcgatttttgcggatggaatctcaatctcagcttcgccaatctatctcttgctctgcttcttcttcttcttctatggcattaggtagaattggagaagtaaagagagtaacaaaggaaacgaatgtttcagtgaagattaatttggatggtactggagttgcagatagttctagtggaattcctttccttgaccatatgttagatcaacttgcttcgcatggcttgtttgatgtgcacgttagagctactggtgatgttcacattgatgatcatcacactaatgaagatatagctcttgccattggaactgctctattaaaggctcttggtgagcgtaaagggattaaccggtttggtgacttcacagctcctctagatgaagcgcttatacatgtttccttggacttgtctggtcgaccatatcttggttacaacttggagataccaactcagagagttggaacatatgatactcagttggtggagcactttttccagtcgttggtgaatacttctggtatgactcttcacatccggcagctcgctggtgaaaactctcatcacataatagaggcgacgtttaaggcgtttgccagagctctacgacaagcaacagagactgatccacgccgtggtgggacaataccaagttcaaaaggagtcttatcacggtcttag

SEQ ID NO: 174 - DNA, 942 bp, Arabidopsis thaliana
atgggaaattgtctctcagcttcgacacttcccaccgaaccaaatgctcccaaatcagtggaggagggtgtgaaagtcttcacggtggcagatctgaagaaagcgactaatgatttcggaaaccagatggaactaggagagagcttgggatacatcaatcccaaaacgttatctccggccaagaaaggtgttggcatggccgtcgcggtcaagaaaatttacttagccaatgaacaagcttttcaagattggcttgttgacgtagagtttctacgacataactctcatccaagcttggtgaagctaattggctactgttatgatcgtgatatgttgtttattgtttctgaatactttccaaatggaagcttaggaagttacatcagtagagatagtcgtccaaagtcattgccgtgggagacacgacttaagatatccataggagcggctcagtgtcttgccttcttgcactctaggaagcaagccggtctataccgcagatatctcactgcttcgaaaatcctgctcgactcggacttcaacgcaagagtttcctattttggaaagccaaaagtttctctcgatgaattggtatacaccatcgggttttcaaatgtagcacctagatatcaatacccacctcccgaatacatactctcagggatgtcgaacatggcgggcgatgtgtatagctttggtgttatactacttaaaatgttaactggtttaggaaaagacctcacaatctcagcaaagcgagaaataaaaaataaaaagtacaacattgtggagatgatcgatccagatttgaagaatagctatccacttgaagcgggaagacttatgtgcgagcttattaaacaatgcctagaggtagacccgaagatgcgaccaaccatgcaagaagtgctagataatctgaatgctatagctcagatttag

SEQ ID NO: 175 - DNA, 1023 bp, Oryza sativa
atgggcgcgaacggcaacgacgtggtggcggcggcggcggcgggggagagcccgatgggggccgcgagggtcgtcgcggagggcggggcgacggtgttccgcggcgcggactactcgctgccccgcacgacggtggcgctcgcgctgtggctgggcggcatccacttcaacgtcttcctcgtcctcgcctcgctcttcctctcccccctccgcgtcgccgccatggttgtggcgttccagctcctcttcatgctcatccccctcaacgacaaggacaaattgggccgcaagatcgccaggttcatatgcaggtacgcgatgggctacttcccgattagtctgcatgtggaggactacaagtgcttcgatcccaacagggcatatgtgttcggctttgagccacattctgtgctgcccatcggagtcgcggcgctcgctgatcttgtcgggttcatgcctctacccaaaattaaggtcctcgcgagcagcgcggtgttctacacaccgttcctgaggcaaatatggacgtggttaggactaattcctgcaacgaggaagaattttcagtcatatctcggagctggttatagctgtatcatagtgcctggaggtgtacaagagattcttcatatggatcatgattcagagattgcctttttgaaatcaaggaaagggtttgtcaagatagctatgcagtctggctgccctttagttcccgttttctgtttcggacagagctacgcgtacaagtggtggagaccgaagggcaaattgtttgtgaaaattgctagagcaattaaatttactcccattgtcttttggggaagatacgggacaccaatccctttcccaacgcccatgcatgtagttgttggcagacccattgaggttgagaaaaattctcagcctaccattgatgagataaatgaagtccatgaacaatttactgtggccttgcaagatcttttcgacaaatacaagacagaaactggatatcctggcctccatctaagagtcctatag

SEQ ID NO: 176 - DNA, 1008 bp, Saccharomyces cerevisiae
atgcactcacaccattcacactccggtgactatagtgcccacggtacggaccctttggattccgtggtcgatcaagtggtcaacctcaactttcacacgtactgtttgacagagcacataccaagaattgaggccaagtttatataccccgaagagcagtcattgggcaagaatcctgaggaagtcataaccaagctagaaacatcgttcaagaatttcatgagtcatgcgcaagaaatcaagactcgttatgctgatagacccgatgtgcggactaaattcattataggaatggagatcgaaagttgtgacatggctcatatcgaatatgcaaagcgactcatgaaggagaataatgatattttgaagttttgtgtgggttcggtccatcacgtcaacgggatccctattgatttcgaccaacaacaatggtacaattcattgcattccttcaatgataatttgaaacattttctcctgtcttacttccaatcacagtacgaaatgctgatcaatattaaaccgttggtcgtgggtcacttcgacctttacaaattatttttgcccaatgacatgctagtaaaccagaaatcgggcaactgcaacgaagaaaccggagttcctgtagcttcactggacgtcatcagtgaatggccagaaatatacgatgcagttgtaagaaatttacaatttatagactcctatggcggcgcaattgaaatcaatacgtccgcattaagaaagcgcctcgaggagccgtaccccagcaaaaccttatgtaatctggtcaagaagcactgtggatccagatttgttctaagtgatgacgcacacggcgtggcgcaagtgggtgtgtgctatgacaaggtaaagaaatacatagtagacgtgctacaattagagtatatttgctaccttgaggaaagccaatcaccagagaatctgttaactgtaaagagattacccatttcgcaattcgttaatgatcccttttgggccaatatatag

SEQ ID NO: 177 - DNA, 387 bp, Glycine max
atggcaaattttgttctacagttttcaaatactttgaggagtttcgctgtgtctgcttcctccaactccaacggagctcctcctggtggttctggaagcagtagtggtgggggtgggggccctgtaatattggaacttcctctagataagatcagaaggcctttgatgaggaccagagcaaatgatcaaaacaaagttctggaattaatggatagtatcaaggaaattggtcttcaagtgcctattgatgtcctcgaggttgatggagtctattatggtttctccggctgtcaccgctatgaggctcatcagcgccttggactccccaccatccgttgcaaaatacgccggggtacaaaagagactgtaaggcatcatctgcgctag

SEQ ID NO: 178 - DNA, 1191 bp, Oryza sativa
atgtccaaccccgaatcgaacccaccaccaccatccgccacatcctgcccgcctcccggctccgccgcgcacgcgggccacgccccgctctgccgctcctgcggcgcgcccacgacgacgcccgtgcctcccccctggtcggcgtcctccgactccccgccgcctgcgtaccgccccatccgcatgccggccatcaacgcgcccaccaacaccgccgccatcgtcctctccccggtgccccagccgctccccgtgccgcccgcctccccgccgttcgccttccaggtccccgccaagcgcatcacctcccccgacgacatcgcccgcttccacgcctccgtccacggccgccacttcctcggcttcgtcgccgcgctctccgcctccgtccacggccgcaagctctccgacccgctcccgtccccgccatccccggtcgtttccgcgctcctcgagctcatctccgcgctctccgccttcgtcgcgtccaccccaccgctcccacacaactcccgctacggcaaccccgccttccgcctgtggcacgagaagctctccgactcggccaaccagctgatcgctccgatcatggccaccgccgggtcgcccgacctcgccggcgccgaggccgagcttgcgccgtaccttctcgactccttcggcaacgccacccgcatcgactacggcacggggcatgagaccaacttcgcggcgttcctctactgcctagcacggcttgggctcatcaccgaggctgattaccccgcggttgtgctacgggtcttcgctgcatacctggacctaatgcgcacgcttcaggacacctacttgctggagcccgctggctcgcatggcgtgtgggggctcgacgattaccacttcctcccattcatatttggcgcggcgcagttgattgatcacaagtacatgaagcccaagtcgatccacaacccggatatcctggataacttctcaaaggagtatatgtacctcgcatgcgttgcctatgtgaagaaggtgaagaaggggccgttcgcagagcactcgccaatgttggatgatatcagtggcgtaccacattggaagaaggtgaacagcgggctgctcaagatgtacaaggctgaggtgcttgagaaagtgccgattatgcagcatttcctctttggttcactcatcaaatgggaggactag

SEQ ID NO: 179 - DNA, 846 bp, Saccharomyces cerevisiae
atgtccgaatatcagccaagtttatttgctttaaatccaatgggtttctcaccattggatggttctaaatcaaccaacgaaaatgtatctgcttccacttctactgccaaaccaatggttggccaattgatttttgataaattcatcaagactgaagaggatccaattatcaaacaggataccccttcgaaccttgattttgattttgctcttccacaaacggcaactgcacctgatgccaagaccgttttgccaattccggagctagatgacgctgtagtggaatctttcttttcgtcaagcactgattcaactccaatgtttgagtatgaaaacctagaagacaactctaaagaatggacatccttgtttgacaatgacattccagttaccactgacgatgtttcattggctgataaggcaattgaatccactgaagaagtttctctggtaccatccaatctggaagtctcgacaacttcattcttacccactcctgttctagaagatgctaaactgactcaaacaagaaaggttaagaaaccaaattcagtcgttaagaagtcacatcatgttggaaaggatgacgaatcgagactggatcatctaggtgttgttgcttacaaccgcaaacagcgttcgattccactttctccaattgtgcccgaatccagtgatcctgctgctctaaaacgtgctagaaacactgaagccgccaggcgttctcgtgcgagaaagttgcaaagaatgaaacaacttgaagacaaggttgaagaattgctttcgaaaaattatcacttggaaaatgaggttgccagattaaagaaattagttggcgaacgctag

SEQ ID NO: 180 - DNA, 2430 bp, Arabidopsis thaliana
atggaaacatcatcaatcgaaatcaacgagcttccattagccaccaaaacccaaacacctcctgcttccgtcgagccaattccaatggagacatcatcaatcgacgagcttccatcgtccgattcgaatgcaacggataacattgaagctgttggtgagaaacggaaacgcgccgatgaagacgagaaaaccaatctcgaatcgtcagacacgaagattactactccttcaccgtggtggaagacgagtctctgttcttactttaggcgtgaggcttcgtgtagtcatggaaacgaatgtaaatacgctcacggtgaagcggagctccggatgaaaccggataatacttgggatccgacttctgagcgtggaaagaaagccaaggctatgaagatgtctgagcatgaagagaaagaagaagacgaggttttgtttactgagcagatgatggaatcaattgatggtgatgaaggaggtggtggtagtgttagtgttgttgatttgtcactaagtaaatgtttggtgcatttacctaataaatggcaatctgatgaattgaagaaatttttaggagaacagggagttctatataagtctgcaaagaaaagaagaggaatgattgttggttttgttacatttgagaatgcagaacaattgcagagtggcgtggagattttggatggaaaaactgttaatagcagtaatttgaagattgctgatgttcttccgcgtacatttgacaagaatgatgcaagaaaatcggttaaaagtgctcgtgacgctgtgactcccttggcttacttgtcttatgctgaccagcttgaacaaaaaaagacttctataggccaaatgctgaaaaaacttgcgaggaatgcgcgtaaagcttgtccaaatgggaattcacttccacaatgggtccttacatcgagagacagaggtggtcttgcatgcaacctcgagggcattatagaatcaccgattacaaatggctacaggaacaagtgtgagttctcggttggattatctcttcaggggaagccaactgttggattcagtctaggaagtttttgtgcgggtgtgacagcagtcgaggagcctgtggattgccccaacgtctccaaaattgcttctcaatatgcttcaatatttcagaagtttatagaaaattcaaaattccaagtttggaataggtttcaacatagtgggttctggcggcaattgacggttcgagaggggagaaaacccggcgtgttttcaaatgatgaagatgctattacaagaatcgcggaggttatgcttatggttcaggtttgtttaactggttctgatgaggcagaagtggccactgagtttgaagaattggcgaaagcgtttgctgaaggagctagagcaagctctcctactcttcctctgactgtattagttgttcagaatcactcaggaatatcaaatgttgcaccacctgatgctccactgcaagtgctggctattccaatttcagataatgggacagatcaggagcaaaccaccaatgtcttgactgaagctcggattcatgatcacattaacaaccttcggttcagcatatccccaacagcattttttcaggttaataccgtcaccgcagagaagttatactcaattgctggagactgggctgaccttggtcccgacactttgctcttcgatgtatgctgtggaactggaacaattgggcttacactggcacatcgtgttggcatggtaattggcatagaaatgaatgcttcggctgtagcagatgccgaacggaatgcaacgatcaatggcataagcaactgcaagttcatctgctcaaaggcagaggatgttatgagctctctacttaaacagtacctagatgtgactcaaatggaagaagctaagcctctaagtaatgctaacgatgatctcaacaaacaaattccctcaacagaagaaatgacaaactcagagcatgtagctgatcaaaacctacctccttcaaacactcaagtggaagaacttcaagacaatgagcagaaggattcctcgtccttagaaccggaaaaaactacaaaaccacagttcaaaaatgtggttgctatagtcgatccacctcgctctggacttcatccagctgtaatcaaagctctaagaacccatccccggttaaagagacttgtgtacatttcgtgcaaccctgaaacgctagtggcaaacgcgatagagctttgcacgccatcttttgatgaaccggatagaggaaacaaaaattacagagggcgcaagaaaataggcattgccgctttggctcgacatagagccaagtcaatgccaacttctgaggcttttagacctgtcaaagcaatggccgttgaccttttcccccacactgaccactgcgaaatggtaatgctccttgagaggtag

SEQ ID NO: 181 - DNA, 336 bp, Zea mays
atggccgccgcccgcggcgccaggctgcgcgcgcaggccacccacaacgtcaagctcatcacgccggacggggaggtacagctcaagatgcccggcgacgtctacatcctggaccatgccgaggaacgagggttggacctgccctactcctgccgcgccggcgcctgctcctcctgcgtcggcaagatcgtctccggctccgtcaaccagttcgaccagagcttcctcgacgacgaccaggtcgccgagggctttgtgctcacctgcatcgcctaccccacctcggacctcgtcatccagacgcacaaggaggatgcactcgtcgagtcgtactag

SEQ ID NO: 182 - DNA, 1521 bp, Zea mays
atggcgaagggcggtgcggtcgtggggacggctgtggtggtgtgcgccgcggctgccgcggcggtgggggtagcggtggtgctgtcgcgcaggaggagtcggcggcgggaggcggaggacgagaggaagaggaaggcggccgcggtaatcgaggaggtggagcagcggctctccacgcccaccgcgctgctccggggcatcgcggacgccatggtcgaggagatggagcgcggccttcgcgctgagccccacgcgccgctcaagatgctcatcagctacgtcgacaacctcccaaccggggatgaacatggtctgttttatgcactggaccttggcgggaccaactttcgtgtcatccgggtccaacttggcggaagggacagacgtgtcgtgaagcaacagtatgaagaggtctccattccgcctcatcttatggttggaacttctacggaactatttgatttcattgctgctgagttggaaaaatttgtgcggactgaaggagaagatttccacctaccagatagcaagcagagggaactgggtttcaccttttctttcccagtgcaccaaacatctatatcatcggggactctaattaagtggaccaaaggattttgcatcaatggcacggttggagaagatgttgtggctgaattgagtagggccatggaaaggcagggtcttgatatgaaagttgcagctctggttaatgatactgtaggcacattggctggtgggagatatgctgataatgatgttgttgctgctgtaatattgggcactggcacaaatgcagcttatgtggaacatgcaaatgtgattcctaaatggaccgggctgctacctagatcagggaacatggtaatcaacatggagtggggaaacttcagatcagataaacttccaaggtcggagtatgataaatccttagacttcgaaagtttgaaccctggtgagcagatatatgaaaagatgatttctggaatgtatcttggagaaattgtccggaggatcctgctgaaactggctcatgatgcttcattgtttggggatgttgttcctccgaaactggaacagctatttatactgaggacgccagatatgtcagccatgcaccatgacacctcacatgatctcaaacacctgggagctaagctgaaggacattcttggggttcctgatacttctctggaagcaagatacatcactcttcatgtgtgcgaccttgtcgcagagagaggtgcacgcctggctgctgctggtatatatggtattctgaagaagctgggtaaagacaaattgctaggtgactttagccaacaaaggactgtagttgctattgacggtggcctatacgagcactacaagaagttcagtgcctgcctagaggcgacgctcacagacctgctcggcgaggaggttgcctcatcggttgttgtcaagttggccaacgacggctcaggaattggagctgcacttcttgctgcctcgcactcccagtatgctgaagctgcatag

SEQ ID NO: 183 - DNA, 1551 bp, Zea mays
atggcgaatcccctagcggggctgcaggaccacctcaagctcgcgcgggactacgcgctcgagggcctctacgacacctccatcatcttcttcgacggcgccatcgcccagatcaacaagcatctaactactttggacgatgctctgattcgtacgaaatggatgaactgcaagaaagcaatctctgaagaagtggaaattgtgaaacagttggatgctcaattaaagtcccttaaagaagctcctgggacaaggcggtcatcatcacctcctattcggtctaataaatcatttgttttccaaccgttggatgagtatccaacatcttcaccagcaccctttgatgatcctgatgtgtgggctccaccaagggatacaccaacccgaagaccaacaagaggtcaatctagtgcaaggaagtcctcccaagatggagcctgggcacgtggttcatcaaggactggaacacctagtcgaagcgcaaaacctaatgggattaaaggaggtgctgttaaatcaactgcctctaacagttctgtaaggaaagggaaacaaagttcaaacaaggctgattcaacgagtagtgatgctgaggaaggtaagtccaagaagggtcagtatgaagggccagatatggacttagctgcaatgcttgaaagggatgttctggattctactccaggagtaagatgggatgatgttgccggacttagtgaggccaaacgactcctcgaggaagcagttgtgcttcctctctggatgcctgaatattttcagggtattcgtcgaccttggaaaggagttcttatgtttggtccaccaggcacgggaaagactcttttggcaaaggcagtggccaccgaatgtggaacaacattctttaatgtttcctctgcaacactggcctctaaatggcgtggcgagagtgagcgcatggtccgttgcttatttgatcttgcgagggcctatgctccaagtacaattttcattgatgaaattgactccttatgcacgtcgcgcggtgcctccggcgaacatgagtcgtcaagaagggtgaagtctgaacttctagtgcaaattgatggtgtaaacaatagctccaccactgatgatggccagccaaaaattgttatggttctggctgctacaaattttccatgggatattgatgaggcactgaggcggaggctggagaagcgtatttatattccacttccagattttgaaagtagaaaggcacttatcaacattaatcttagaacagttcagatagccgcagatgttaacatcgacgaggttgctcggaggacagaaggctatagtggagatgatctgacaaacgtttgccgcgatgcctcaatgaatggcatgaggcgcaagatagcaggcaagacccgcgacgagatcaagaacatgtcaaaggacgagatagccaaggacccggtggccatgtgcgactttgtggaggctctggtgaaggttcagaagagtgtctcgccttcagacatagagaagcatgagaagtggatggctgagtttggatctgcctag

SEQ ID NO: 184 - DNA, 1272 bp, Zea mays
atggcgcaggcggtggtgccggcgatgcagtgccgggtcggagtgaaggcggcggcggggagggtgtggagcgccggcaggactaggaccggccgcggcggcgcctcgccggggttcaaggtcatggccgtcagcacgggcagcaccggggtggtgccgcgcctcgagcagctgctcaacatggacaccacgccctacaccgacaaggtcatcgccgagtacatctgggtcggaggatctggaatcgacatccgaagcaaatcaaggacgatttcgaaacccgtggaggatccctcggaactaccaaaatggaactacgatggatctagcacaggacaagccccgggagaagacagtgaagtcattctatacccccaggctatcttcaaggacccattccgaggtggcaacaacgttttggttatctgtgacacctacacgccacagggggaaccccttccaactaacaaacgccacagggctgcgcaaattttcagtgacccaaaggtcgctgaacaagtgccatggtttggcatagagcaagagtacactttgctccagaaagatgtaaattggcctcttggttggcctgttggaggcttccctggtccccagggtccatactactgtgccgtaggagccgacaaatcatttggccgtgacatatcagatgctcactacaaggcatgcctctacgctggaatcaacattagtggaacaaacggggaggtcatgcctggtcagtgggagtaccaagttggacctagtgttggtattgaagcaggagatcacatatggatttcgagatacattctcgagagaatcacagagcaagctggggttgtccttacccttgatccaaaaccaattcagggtgactggaacggagctggcgcacacacaaattacagcacaaagaccatgcgcgaagacggcgggtttgaagagatcaagagagcaatcctgaacctttctctgcgccatgatctgcatattagtgcatacggagaaggaaatgaaagaagactgactgggaaacatgagactgcgagcatcggaacgttctcatggggtgtggcaaaccgcggcgcttctatccgtgtggggcgggataccgaggcaaaagggaaaggttacctggaagaccgtcggccggcatcaaacatggacccgtacattgtgacggggctactggccgagaccacgatcctctggcagccatccctcgaggcggaggctcttgccgccaagaagctggcgctgaaggtgtag

SEQ ID NO: 185 - DNA, 1272 bp, Zea mays; identical to SEQ ID NO: 184

SEQ ID NO: 186 - DNA, 1383 bp, Arabidopsis thaliana
atggaatcggatctggggaagctcttcattggtgggatttcgtgggatacagacgaagaaaggttaagagactactttagcaactatggtgatgttgttgaagctgtgatcatgagagatcgtgccacaggtcgtgcacgtggcttcggcttcattgtctttgcagacccctgtgtctcagagagagtgatcatggataaacacatcatcgatggccgcacggttgaggcgaagaaggctgtgcctcgagatgatcagcaggtgctaaagcgacacgctagtcctatccaccttatgtcacctgtccatggtggtggtggaaggacaaagaagatcttcgttggaggtttaccgtctagcattaccgaggaggagttcaagaactactttgatcagtttggtactattgctgatgttgttgtaatgtatgatcataacacgcagaggccaagaggttttggcttcatcacatttgattcagatgatgctgttgatagagttcttcacaagaccttccatgagctcaatgggaaactagttgaggtcaaaagagctgtacctaaggagatttcccctgtttctaatatccgaagcccgcttgctagcggtgttaactatggaggcgggtctaataggatgcctgctaatagctactttaacaactttgctcctggtcctggtttttataacagtctaggtcctgttggtcgtcggtttagtcctgttattggtagtggtagaaatgcggtttctgcttttggcctcggtttgaatcatgacttgagtttgaatttgaatccaagctgcgatgggacaagttctacgtttggttataaccgtattccaagcaacccttacttcaacggtgcttccccgaaccgttacacctctccaatcgggcacaatagaactgagtctccttacaattcgaacaatagagacttatggggaaacagaaccgacactgcaggtcccggttggaacttgaatgtctcgaatggaaacaacagaggaaattggggacttccttcttcttctgctgttagtaatgataacaatggctttggaaggaactatgggacaagttctggactttcctcgtccccatttaatggttttgaaggttctataggggaactgtacagaggcggctcagtctacagcgactcaacgtggcagcaacagcagctaccatctcagtcttctcacgagctagacaatttgtctcgcgcttacggttatgatattgacaatgtaggttcagacccatctgcaaatgacccagaaacttacaatggaagctacaatgttggaaatagacaaactaatagaggtaacaaaaaaattcatctcaataaaacttgtaacttggatacattttag

SEQ ID NO: 187 - DNA, 1719 bp, Nostoc punctiforme
atggtagcgatcgcagagaacgttcaacatcggctaactatacaaactgtagaaattgcccctaacacaacggcgattcgctctcttgattgggaccgcgatcgcttcgatatcgaattcggactgcaaaacggcacaacctacaattcatatttaattaggggcgaacaaacagttttgattgatacttctcaccagaagtttcgcgatctgtatttagagactctaaaaggtcttgttaaccccaaaacaattgattacataattgtcagtcacacagagccagaccatagcggcttagtagaagatgtcctgcaattagctcctagagccaccgtcttagcctcaaaagttgcgctacagtttttggaaggcttagtacacgatccattttctaagcgggttgtcaaaactggcgatcgcatagatatcggcaaaggacatgaaatggaattcgtgagtgcgcctaacctgcactggccggatacaatctttagctttgaccgcaaaacccaaattctctacacctgtgatgcttttgggatgcacttttgtgacgatcgcacctttgacgaagatttagaagcgatcgaagctgactttagattttactacgactgcttgatgggtcctaatgctcgttccctgctgaatgccatgaagcggatgggcgatctaggaaagattaatataatagccaatggtcacggtcctttattataccaccatctagatgttctaactgggtgctacgaaaattggagccagagacaagctaaagcagaaaccacagtaggcttgttttttgtctcagattacggttatggcgagcgccttggtcacgcaattgccgaaggtatcctgaaaactggggttggagtagaagtactagatttaagtactgctgagagccaagaaattcaagaactagctggtagagcagctggcatcattattggtatgcccccaagtaccgctgccgccgcccaagctagtatcagctcagtgctagctgtcgccaaaaacaagcaatttgttgggctatttgaatgttacggtggggatgatgaacccattgatacactccgcagaaaatttatcgattctggcatcaaagaagccttcccagccattcgaattagagaggctcccaccgcatcaacattccagttgtgtgaagaagcaggtaaagacttgggacaattgctggtgcgcgatcgcaacatcaagcaaatcaagtctcttgatgtcaacatggaaaaagcgctgggtcgcattagtagtggactgtatatagtcaccactaaaaaagataatgcctcaagtgcaatgctggcatcctgggtaacgcaagcgagtttgcaaccattaggattaacaattgccgttgcgaaagaccgcgccattgattccttaatgcaagtaggcgatcgcttcgtcctcaacgttttggaagaaggcaattatcaagaattgaaaaagcattttctcaagcgtttgcatccaggtgctgaccgctttgcaggagtgaaaactcaaaccgcgaaaaacggttctccgattctaactgatgctttggcatacatggaatgtgaaatacagagcagcatggaatgcagcgaccactggattttatactgcacagtccaagaaggtcgtgtctctaaaaacgatggattgacagccgttcgccatcgcaaagtaggtaattactactag

SEQ ID NO: 188 - DNA, 1563 bp, Zea mays
atggcggagggggagttcaagcccgcggcgatgcaggtggaggctcctgccgaggcggcggcggcgccgtccaagccgcggttcaggatgcccgtcgactccgacaacaaggccaccgagttctggctcttctccttcgcgaggccgcacatgagcgccttccacatgtcgtggttctccttcttctgctgcttcctctccaccttcgcggcgccgccgctgctcccgctcatccgggacacgctggggctcacggccacggacatcggcaacgccgggatcgcctccgtgtccggcgcggtcttcgcgcgcgtggccatgggcacggcgtgcgacctggtgggcccgcgcctggcgtccgcggccatcatactcctcaccacgcccgccgtctactactccgccgtcatcgactccgcctcgtcctacctgctcgtgcgcttcttcacgggcttctcgctcgcgtccttcgtgtccacgcagttctggatgagctccatgttctcgccgcccaaggtggggctggccaacggcgtcgccggggggtggggcaacctcggcggcggcgccgtgcagctcatcatgccgctcgtgttcgaggccatccgcaaggccggggccacgccgttcacggcgtggcgcgtcgccttcttcgtcccgggcctgctgcagacgctgtcggccgtcgccgtgctggcgttcggccaggacatgcccgacggcaactaccgcaagctgcacaggtccggcgacatgcacaaggacagcttcggcaacgtgctccgccacgccgtcaccaactaccgcgcctggatcctggcgctcacctacggatactgcttcggcgtggagctcgccgtggacaacatcgtcgcgcagtacttctacgaccgcttcggcgtcaagctcagcaccgccggcttcatcgccgccagcttcgggatggccaacatcgtctcccgccccggcggcggcctcctgtcggactggctctccagccgcttcggcatgcgcggcaggctgtggggcctgtgggtggtgcagaccatcgggggcgtcctctgcgtcgtgctcggcgccgtcgactactccttcgccgcgtccgtggccgtcatgatactcttctccatgttcgtgcaggcggcctgcgggctcacctttggcatcgtcccgttcgtctcccgaaggtcgctggggctcatctccggcatgaccggcggcggcggcaacgtgggcgccgtgctcacgcagctcatcttcttccacggatccaagtacaagacggagacggggatcaagtacatggggttcatgatcatcgcctgcacgttgcccatcacgctcatctacttcccgcagtggggcggcatgttcctggggccgcggcccggggcgacggcggaggactactacaaccgggagtggacagcgcacgagtgcgacaagggtttcaacaccgcgagcgtacgctttgcggagaacagcgtgcgggaagggggacgctcgggcagccagtccaagcacactactgtgcccgtcgagtcctcgccggccgacgtgtag

SEQ ID NO: 189 - DNA, 1395 bp, Arabidopsis thaliana
atggatcatgatctcgagatcttccctttactctcctacgtcctccaccattccgatcccgcttctcacgcgccaccgtctctagcgattcagcaatctcttgcgaatcgttatccccttctcaccaatccttatgtaatctcctcgttgattgaatcaattcccagtacaatcacgcagacccttttcgtatttggctctcttgggccacgacctgatcctttagctgtctcttctgctcggtctaagatccgagagatcaaagagaatgattctttatcgccggaagatgcggctaaggaagagcaggtttacgctgcggttgtgagtttagaggaagttcatgaaggatatgagaagcagttaagagatttggaggaggagattggtagggtttatgcttcggcggttgaatcattgagcggtggtgatgaagtgaatgaggaggttttagcggtgattaaagacgctgaagatggtggagtcgttgaaaggattgatctttctgatcatgagcttaagcttcttcctgatgctttagggaaaatcgtcggtttggtttcactgaatgtctctcgtaacaatctcaggtttctacctgatacaatctcaggacttgagaaactggaggagctagatttatcttcaaaccgtctcgtgtttcttcccgactctattggactgttacttaatttgaggatcttaaatgtgacggggaacaagctaactttactcccagaaagcattgcgcaatgcaggtcactggtagagttagatgccagcttcaacaacttgacttctttgcctgcaaacttcggatacggattactcaatctcgaaaggctatcgatccagctgaacaaaatccgtttcttccccaattccatatgtgagatgcgttctctaaggtatctcgacgcacacatgaacgaaatccacggccttccaatcgctatagggagactcacaaaccttgaagtcatgaacttgagcagcaacttcagcgacttgattgaacttcctgacacaatctctgatttagctaacttgagggagctagatctcagcaacaaccagatcagagtcttgcctgactcgtttttcaggctggagaagctggagaaactgaacttggaccagaaccctttggagtatcccccacaagagatggttaaccaaagcgctgaagcagttcgagagttcatgaggaagaggtgggaagagatggtggaggaagagcaattgaggagtgtgattgaagctgagaagcaacaaggaggagcaacaggttggctctcatgggggagctccattgttactagccttttctctggaggtactcatggtggtgcagctaagaagcctaaaaactcatttttggatgaacagctctag

SEQ ID NO: 190 - DNA, 1554 bp, Arabidopsis thaliana
atggcgatggccatggctcttcgaaggctttcttcttcaattgacaaacccattcgtcctcttattcgatccacttcatgttacatgtcttctttgcccagtgaagctgttgatgagaaggaaagatctcgtgtcacttggccaaaacagcttaacgcacctttagaggaggttgatcctgagattgctgacattattgagcatgagaaagctagacaatggaagggacttgaacttattccatctgagaacttcacatctgtgtcggtgatgcaagctgttgggtctgtcatgactaacaaatacagtgaaggctatcctggtgccagatactatggaggaaatgagtatatagacatggcagaaaccttatgccagaagcgcgctcttgaagctttccggttagatcctgaaaagtggggagtgaatgttcaacctttgtctggatctcctgccaacttccatgtgtacactgcattgttaaagcctcatgaaagaatcatggcacttgatcttcctcatggtggtcatctttctcatggttatcagactgacaccaagaagatatcagctgtgtctatcttctttgaaacaatgccctatagattggacgagagcactggctacatcgactacgatcagatggagaaaagtgctactcttttcaggccaaaattgattgttgctggtgcaagtgcttatgctagattgtatgactatgcccgcatcagaaaggtctgtaacaagcaaaaagctgtaatgctagcagatatggcacacatcagtggtttggttgctgctaatgtaatcccttcaccgttcgactatgctgatgttgtaaccaccacaactcacaagtcacttcgtggaccccgtggagccatgattttcttcagaaagggtgttaaggaaattaacaagcaagggaaagaggttttgtatgattttgaagacaagatcaaccaagctgtcttccctggtcttcaaggtggtccacacaaccacactatcacaggactagctgttgctttgaaacaggcaactacttcagagtacaaagcataccaagaacaagtcctgagtaacagtgcaaagtttgctcagactctaatggagagaggatatgaacttgtttctggtggaactgacaaccatctggttctagtgaatctaaagcccaagggaattgatggatctagagttgagaaagtgttggaagctgttcacattgcatccaacaaaaacactgttcctggagatgtttctgccatggttcctggtggaatcagaatgggtactcctgctctcacttccagaggctttgttgaggaagactttgccaaagtagctgaatacttcgacaaagctgtgacaatagctctcaaagtcaaatctgaagctcaaggaaccaagttgaaggatttcgtgtcagcaatggaatcctcttcaaccatccaatccgagattgcgaaactgcgccatgaagtcgaggaattcgctaagcagttcccaacaattgggtttgagaaagaaaccatgaagtacaagaactag

SEQ ID NO: 191 - DNA, 915 bp, Zea mays
atgggctcggaggcggactgcgacaggatcaggggcccgtggagccccgaggaggacgacgcgctgcggcggctcgtggagcggcacggcgcgcgcaactggacggcgatcgggcgcgagatcccggggcggtcgggcaagtcgtgccgcctgcggtggtgcaaccagctgtcgccgcaggtggagcgccggcccttcacggcggaggaggacgcggccatcgtccgcgcccacgcccgcctcggcaaccgctgggccgccatcgcgcgcctcctccccggccgcaccgacaacgccgtcaagaaccactggaactgctcgctcaagcgcaagctcgccgccgcgtccgccccggcgggttcctccgacgtcgaggcgcgcccgaccaagcgcgtcagcctctcgcccgacagcccgtcggggtcggggtcggggtcagggtcagggtccgggtccgggtccgggtccgaccgtagcgacctgagccacggcgccggccaggtttaccgcccagtggcgcggtccggcgggttcgagccggcggactgcgcgatgagccgtccgctggaggaagaggaggaggaaaaggaggacccgctcacctccctcagcctctcgcttccaggcacggaccagcggttccaccacgaccgcgcccacagccagttccaggagctcccggcgtcgccgccctcgccctccccgcctccgccgccggttctctcggcgtacccgttcagccccgtgttcatggaggcgatgcaggagctgatccgcacggaggtgcagcggtacatggcgagcgtgggcgtgcgcgccgggtgcggcgccgccggcggggccgacctctgcatgccgcaactggtcgacggcgtcatgcgcgccgccgccgagcgggtcggccggatgcagtag

SEQ ID NO: 192 - DNA, 555 bp, Arabidopsis thaliana
atggagaaatcaacaagaaccctattcataaccatcgtgataacctccatgttgctagggtttggaaactctgatcttgctcaggacagagaggagtgtacgaaccagctcatagaactatccacgtgtattccgtacgttggaggagacgccaaggctccaacaaaagattgttgtgcagggtttggccaagttataagaaagagtgagaagtgtgtttgcatattggtcagagacaaagatgatcctcaacttggtatcaagattaacgcaaccctagccgctcatcttccctccgcttgtcatatcacggctcctaacatcactgactgtatttcgattctgcatctacctcgtaactcaacattggctaaagagtttgagaacttaggaaggattgaagacaactacaactccacatctcctacacaaattcataaagatgggacaggaggaggaaaagccgaaccagtgaagagtaatggatggaaggagaagagttggttgggtgttgagcttttaatatatttgctagtttctctcatcttcttttag

SEQ ID NO: 193 - DNA, 567 bp, Arabidopsis thaliana
atgagaaacaaacatgagaaccccaaaaaacgtcgtatccaggtcttaagtagtgatgatgaatcggaggagtttacaagagaagttccttcagttactcgaaaaggttccaagagaagaagaagagacgagaagatgagtaataagatgcgtaagctacagcaactcgtacctaattgtcacaagacggacaaggtttcggttctcgacaagaccatagagtatatgaaaaaccttcaacttcaacttcagatgatgtcaacagtgggggtgaatccttattttcttccggcgacattaggatttggaatgcacaaccacatgctgacggcaatggcttcggctcacggcctaaatccggcgaatcacatgatgccatcgccgctaattccggcgttaaattggccattaccaccgtttactaatatttcattcccacattcatctagtcaatctctatttcttacaacatcatcaccagcttcttctcctcagtctcttcacggtttggttccttatttcccaagtttcttggatttttcttcccatgcgatgagaagactatag

SEQ ID NO: 194 - DNA, 837 bp, Arabidopsis thaliana
atgaccagagaattcgaactggaaaacaactaccagctttgcgacgagatcggcagaggtagattcggaacaatcactcgctgtttctcacccgcgactaaagaattctacgcctgcaaaaccattgacaagcgcgtgctcatcgacgcattagatcgcgagtgtatagagacggagccgaggatcatggcgatgttaccgccgcatccgaatatcatcaggatcttcgatctctacgaaacagaggattctcttgcgatcgtcatggaattagtcgatccgccgatgacgatttacgatcggttaatctccgccggggggaggttatcagaatcagaatccgcctcatacgcgaaacagatcctcagtgcgcttgctcattgtcaccggtgcgacgtcgttcatcgggatgtgaaacctgacaacgtcttagtcgatctcgtaagcggcggtgttaagctctgtgatttcggatcagcggtgtggttaggcggagaaacggcggagggagttgtgggaacaccgtattacgtggcgccggaggtagtgatggggaggaagtacgacgagaaggttgatatatggagcgctggtgtagtgatatacacgatgctagctggagaaccgccgtttaacggtgagacggcggaagatatatttgaatcgatattgagagggaatttgaggtttccgccgaagaagtttgggtctgtatcatcggaagcgaaggatttgttgaggaaaatgatatgtcgtgatgtttctcggcgattttctgcagaggatgctcttcgacattcatggatgatgaacgttggaaacctccaaagcaattag

SEQ ID NO: 195 - DNA, 1632 bp, Arabidopsis thaliana
atgttcacaagcggtaacgtcaccgctcgggtcttcgaacgtcagattcgaactcctcctcccggcgcttccgtaaatcgtgcaagacacttctacgaaaacctagtcccaagctacacactctacgatgtcgaatctcccgatcactgtttccgcaaattcacagaagacggactcttcctcattagtttcagccgtaaccatcaagaactcatagtctatcgtccttcttggctcacttactccacaaccgatgattccacaaccaccctacctcctctacctcgccgtgcttcgaaattcgacagctttttcactcaactctactcagtcaatctcgcttcttctaacgaactcatctgcaaagacttcttcctctatcaccaaactcgtcgtttcggtcttttcgctacttcaacagctcagatccatgattcatcatctccttctaatgacgctgttcctggtgttccttccattgataagattactttcgtacttcttcgattagatgatggtgttgttcttgatgagagggtttttcttcatgatttcgttaatctggctcataatatgggtgtgtttctttatgatgatcttttagcgattttgtcgttgcgttatcagaggattcatcttcttcagattagagattctggtcatcttgttgatgctcgtgctattggttacttttgtcgtgaagatgatgagcttttcctcaattctagctctcaggcaatgatgagtcaagataagagtaaacagcagagtttatctgggagtaaggaagatgatactggagagaatgggttgcgtcatagtctaagtcagccaagtggttcgaattcgtttcttagtggtgttaagcaacggttactttcttttatcttcagggagatttggaatgaagaatcagataacgtaatgagagttcaaagtcttaagaagaagttttatttccatttccaggattatgtcgacttgattatatggaaggttcagtttttggatcgacaacacctgctaatcaaatttggaagtgtagacggtggggtaacaagaagtgctgatcatcatccagctttcttcgcggtgtataatatggagactactgacattgtagcattctatcagaactcagcagaagatctttaccaattatttgagcagttcagtgatcactttacagtatcaagtagtacaccgttcatgaactttgtaacatcgcattctaacaacgtctatgcccttgaacaactaaaatacacgaagaacaaatcaaacagtttttctcagtttgtgaagaagatgttactctctttgcctttcagttgtcagtcacaaagtccctccccatatttcgaccagtctctcttccggttcgatgaaaagttaatatccgcagcagataggcataggcaatcctcagacaacccaatcaagttcatatctcgaaggcaaccgcaaaccctgaaattcaagataaaaccaggaccagagtgtggaactgcagatggtcgaagcaagaagatatgttcattcttgttccatcctcatttaccacttgccatctctattcaacaaacacttttcatgccaccttctgtcgtcaatatccattttaggcgatag

SEQ ID NO: 196 - DNA, 504 bp, Zea mays
atggcgatttctctcgccaccgcctatatctctccatgttttacaccggaatcgtctaattccgcttcaccatcacgaactctttcctccgtacgattaccttctcagattcgccgattcggaagtgttcaatcgccgtcttcgtctactcgcttcgccccactcactgtaagagcagcaaagaagcaaactttcaactcttttgatgatttgttgcagaactctgataaacctgtacttgtagacttctatgctacttggtgtggtccatgtcagcttatggtacctatactcaatgaagtgagtgaaacactgaaagatataattgcagttgtgaaaattgatactgagaagtacccaagtcttgctaacaaataccagattgaggctttgcccacattcatcttattcaaagacggcaaactctgggaccgtttcgagggtgccttgccagcgaaccaactcgttgagcgtattgagaattctttgcaagtgaaacagtag

SEQ ID NO: 197 - DNA, 1539 bp, Zea mays
atggacgccgccgccgttcacaagcgcaagcgacctgaagaggccgacccaagcgcgggggagctcgacctctccgccgccgacgccgtcgaggtactcgacctccgggccgccaaacgcctccttctggccttcgagcgccgcctccgtgacaacctcgaggcgcgcatgaaataccccgacgaccctgcccgctttgcagactccgagatcgcgctccacgccgagaccgaccgcctccgcctccttgccggcgcgcctgagctcttccccgacctcgtccccatcggcctcgcctcttccctcgcctcccttctcacccacgacaatgtcgatctcgcagctgccgccgcatcactcctcgccgacctcaccgactccgaggacccctccgacctcgccgctgtccaggccctcgccgacgcgctcgtcgacgccaacgcgctcgacctcctcgtccacaatctctcccgcttttccgagaccgaccccgatgaggccgaggccgtgcacaacaccctcgccgtcctcgagaacctcctcgacctccgccccaacctcgccgacaaagtctgcggcggaaccaagcttctacgatggctcctctcgcgcgtcaaggcacgcgagttcgacgccaacaagcagtacgcctccgaaatcctcgcgatactcctgcagaacagccccgccaatcagaagcgcctcggccagatcaacggagtcgacgccctgcttcaggcggttgccatgtacaaatcaagggacccaaagacgtctgacgaggaggagatgctcgagaacctcttcgactgtctctgctgcgtgctcatgcccctggagaacaaggagaggtttgtcaaggctgaaggtgttgagctcatgatcatcattatgaaacagaagaagctggcatacagctctgcgacccgcaccctcgattttgccatgaccaagttcccgcctgcgtgcgaacgatttgttgatgtgcttggccttaagactgcttttgcggccttcatgggcaagattcccgtgaacaagaaaaacaagaaagagagttaccaggaggagctagaagagcgtatcatttcacttattgcttcattgtttggtggtattaccaaaggctcacgaaggatgaggctactaggaaaatttgttgagaatgaatgtgaaaagatagaccgccttatggagttatacacaaggtattcagacagagtgaaagaagagactgaaagacttgatagtcttgatttggaagatttagagatggacgatgatgagcggtataaccgaaaactcgaagctgggctttacacactgcagttaattgcgcttattctgggacacatctggcactctgggaattcccagatgagagcaagagtagaattacttcttaagcagaacaaacttacaaagcaagatgtgaagagcatacttgaggagtaccatgacaacattggagatttggatggacctgaagagaaggaaagagcacaagtgcggaccaaggaaattattgacgcgttgtag

SEQ ID NO: 198 - DNA, 426 bp, Oryza sativa
atggccgccacctcgctgtcgccgccgaccgtggccgggctgcggctggcgccgtcgccgcgcgtgcggtcgccgtctgtggcgttcagggcggcgccggcgaggaggaggtcggtggcggcgagggcggagctgagcccgtcgctggtgatcagcctgagcaccggcgtctccctgttcctggggcggttcgtgttcttcaacttccagcgggagaacgtggcgaagcaggtgccggagcagaacggcaagacgcacttcgacgccggcgacgagcgcgccaaggagttcgccggcctgctccggtccaacgaccccgtcggcttcaacctcgtcgacgtcctcgcctggggctccctcggccacatcgtcgcctactacatcctcgccacctgcagcaacggatacaacccaaacttcttctag

SEQ ID NO: 199 - DNA, 1008 bp, Zea mays
atggcaaggcagagtgcagcctccatgttggctactacgacgccgttgcttctcagcgtcttggccaacatcgccgtggtggagtccatcggggtgtcctacggcatgagcggcgacaacctgccgccggcgagcaccgtcatcggcatgtacaaggacaacggcatcccgctgatgcggatctacgcgccggaccaggcggctctccaggccgtgggcggcacgggcatccgcgtcgtggccggcgcgcccaatgacgtgctgtccagcctcgccgccagccccgccgcggccgcgtcgtgggtccgcaacaacatccaggcctaccccaaggtcgccttccgctgcgtctgcgtgggcaacgaggtggaaggcggcgcggcgcagagcctggtcccggccatggagaacgtccgcgccgcgctggtcgccgccggcctggacggcatcaaggtcaccacgtccgtgtcgcaggccatcctcggcggctacaagccgccgtccgccgccgagttcacggacgaggcgcaggggttcatgggccccgtcctcaggttcctggcgcgcaccggcgcgcctctcatggccagcgtctacccctacttcacctacgccaccaacccggctgccatggacctcagctacgcgctcttcaccgctccgggcaccgtcctccaggacggcgcctacgagtaccagaacctcttcgacgccaccgtcgactccttctacgtggcgatggccaaccacgggggctccggcgtcacccttgtggtgtcggagagcgggtggccgtccgctggcggcgtcgcggcgtcgcccgagaatgcggccatctacaaccagaacctgatcaaccacgtcggccggggaacgccgcgccacccgggcgccatcgagaccatcctcttctccatgttcaacgagaacctcaagcagagcggcgtggagcagaactgggggctcttctaccccaacatgcagcgcgtctaccccatcagcttctag

SEQ ID NO: 200 - DNA, 1668 bp, Zea mays
atgatgagtccggcgtcggagcgcagcctcatcatccagagcgacgacgacgacgacgcccgatccggccacgacgtggaggagccggagcaggactccgactcctcctcgtcgtcctcatcctgcgccaccccacgccgcggcccaagctcacccccctacatccagcaatggccgcagagttacaggcaatcgatcgacattctcagcagcgtgcagtcacccaacctgagctttctggggactccaactctgagcaggctgtcgaactctttcctcgccatcaccgattctttccggagcaaggcccccgaaacgatctctagctttatcaagccactccttggccccacgccaagtgacgagcagcagcggcagcatgaaggcacccgaaagagttccgagtaccttgtgccctcgagaagatcatctctgcagcagatcccagaggatcaaaagccacctgtaggtggccatggggcgtctcatgaccagaactgctcttacacccagggagtgatgaatggaataaatgttctatgtggtgtggggatcctatcaacaccttatgccatcaaacaggggggctggattgggctggcgatactctgtacatttgctcttctcgcatggtacacaggtgtgctcctgcgccattgcctggacagcaaggagggcctcaagacatacccagatattggccatgcagcctttggcagcacaggccgcatagttatctcgataatactgtacgtggagttgtatgcatgttgcatcgagtatttgatattggagggtgacaatttgtcaaaattattccccaatgctcacctgaccattgggagcatgacactgaactcacatgtattttttgcaatcttgactaccatcatagtcatgccaaccacctggctccgtgacctgagctggctgagctacatttcagctgggggtgtcattgcatcaatccttgtggtcatctgcctgttcttggttggggttgtcaatgatttcggctttgagaatgaagggactgcactgaacgccccaggaattcctattgcaattggattatatggttactgctactcagggcatggggtttttccaaatatctattcctccctgaagaatcgcaaccagtttccttcaattctttttacttgtattgggctgtctacctttttgtatgctggtgctgcagtgatgggatacaaaatgtttggtgaagccacagagtcccaattcacactcaacttaccagataattctgtcatttctaagattgctgtttggacaacggtggcaaatccaataaccaaatatgcattaactattattccattggctatgagtttggaagagctgctgccaccaaaccaacaaaagtattctacaataatcatgcttagatcatctctggtgatatcaaccctcctgattgctctatctgtgcctttctttggacttgtgatggccttggttggttctttgtttgccatgcttgtgacctacattttgccttgcgcttgttttttggcgatcctcaagacaaaagtggggtggcatcagatagcagcttgctcgttcatcatagttgtcggggtttgctgtgcctacgtgggaacatactcgtccctgtcgaagataatccagaactacgcgtag

SEQ ID NO: 201 - DNA, 1698 bp, Rhodopseudomonas palustris
atgcgcatccttctcattcacccgaattatcattccggtggcgcggagatcgccggccactggccgccggcatgggccccctatctggcaggcgcgctgaaggcgaacggattcgccgacatcaaattcgtcgatgcgatgaccgaggagatctccaacgaaggtctcgccaagatcatctccgactatcagcccgacctggtcggcgccacatcgatcaccccatcgatttacgcggccgaagaagcactgaaggttgccaagcaggtcaacccgaagatcgtcaccatgctgggcggcgtgcatgcgaccttcatgtatcagcaggtgctgagcgaagcgccgtgggtcgacgtgatcgtccgcggcgaaggcgaagagatcgtcgtcgagctggcgcgcgccgttgcctcgggcaactggccggcgaaccgctccgagatcaagggcctcgcctacaccgaaggctccaacggcgagagccagatcgtcgccaccgcggcggctccgacggtcaaggacctcgacgccatcaagccggactggggcgtactgaactggaatctgtatcgctacattccgatgaacacccgcgtggcgatcccgaacatggcgcgcggctgtccgttcacctgttcgttctgctcgcagtggaaattctggcgcgactaccgcgtccgcgacccgaagaaggtggtcgacgagatccaggagctggtcgagaagtatgacgtcggcttcttcatcctcgccgacgaagaaccgaccatcaaccgcaagaagttcatccagttctgcgaagagctgatcgctcgcggcctgaacaagaaggtgcagtggggcatcaacacccgcgtcaccgacatcctgcgcgacgagcaactgctgaaattctacaacgaagccggcctgatgcacgtctcgctcggcacagaagcggcggctcagctcaagctcgacctgttcaacaaggagaccaagatctccgacaacaagaaggcgatccgcctgctccgcgaagccggcatcgtcgtcgaagcccagttcatcgtcggtctcgactccgagacccccgaaacgctggaagaaacctaccgcatggcgatggactggaagccggacctcgccaactggtcgatgtacaccccgtggccgttcacaccgctgttcaaggaactgtccgacaaggtcgaggtgttcgacttcgcaaagtacaacttcgtcacgccgatcgtgaagccggcggcgatggagcgcggcgaactgctcgaccgggtgatgaacaactatcgccgcttctacatgtacaaagcgttcttctcgtatccctggtcgggaacgggacgtcggcgtcgctacctgctgggctgcctgaaggcgttcctcaaggccggcttcgagcgcaagttctacgacctcggccgcgtcggttattgggggccgcagtcgaagaagaaggtcgacttccagttcgacaccacccgcaagatctcgcacgcgcagatggcggactgggaagccaacgccgaccgctcccgcaaggcggccgcctctcagatggcgatcgtctcggcctgcggcggtggtaccgatcagatggaagagagcgaagccgatgccaaggcggcgctcgccaagaccgtaaccagccgcgtggcggacagcacccatgacgcaggttcggtcacccgtcactag

SEQ ID NO: 202 - DNA, 2751 bp, Oryza sativa
atggctgcttccgtgcagccgcggcagttcggccacctcgagccgggctccgcgccggtgcgcggcgccgcctcctcgaacggcgccaaggcgtaccctcccgcgaacggcatcccacgccgcgccgactcgccggtgcgcgggtgcggcttccctccgctcgtctcgccaccgccgcggaagccgcccagcgacgggtcggacgacgaggaggaggagcaggaggactggcgggagctgtacggctcgcacctgcagctggaggtggagccgccggtgcgcgacgcgcgcgacgagggcaccgccgacgcgtggatcgagcgcaacccgtcgctgatccggctcaccgggaagcacccgctgaactgcgagccgccgctggcgaggctcatgcaccacggcttcatcaccccggcggcgctgcactacgtgcgcaaccacggcgccgtgccgcggggtgactggtcgacgtggaccgtcgatgtgacggggctcgtcaagcggcccatgcggctcaccatggacgagctggtcaacggcttccccgccgtcgagatccccgtcacgctggtctgcgcgggcaaccgccgcaaggagcagaacatggtgcagcagacggtggggttcaactggggcgccgctggcgtgtctacgtcggtgtggcgcggcgcccgcctccgcgacgtgctccggcggtgcggcatcatgcccagcaagggcggcgcgctcaacgtgtgcttcgagggcgccgaggacctccccggcggcggcggctccaagtacggcaccagcatcacacgccagtgggcgctggacccgtcgcgggacatcatgctcgcctacatgcagaatggcgagccgctgctccccgaccacggcttccccgtccgcgccatcatccccggctgcatcggcggccgcatggtcaagtgggtcaagcgcatcatcgtcaccaccgccgagtccgacaactactaccattacaaggacaaccgcgtcctcccgtcccatgtcgacgccgagctcgccaacgccgatgcgtggtggtacaagccagagtacatcatcaacgagctgaacgtgaactcggtgatcacgacgcccgggcacgacgagatcctgcccatcaacggcatcaccacgcagcgcggctacaccatgaagggatacgcctactccggcggcggcaagaggatcacgcgggtggaggtgacgctggacggcggcgagacatggctggtgtgcgtgctggacctcccggagaagcccaccaagtacggcaagcactggtgctggtgcttctggtccgtcgaggtcgaggtgctcgacctcctcggcgccaaggagatcgccgtgcgcgcctgggaccagtcgcacaacacccagcccgagaagctcatctggaatctcatggggatgatgaacaactgctggttcaaggtgaaggtgaacgtgtgccggccgcacaagggtgagatcgggctggtgttcgagcacccgacgcagcccgggaaccagaccggcgggtggatggcgaggcagaagcacctggagacggcggaggcggccgcaccggggctgaagcggagcacgtcgacgccgttcatgaacaccaccgacggcaagcagtttaccatgtccgaggtgcgcaagcactcgtcgcaggactcggcgtggatcgtcgtccacggtcacgtctacgactgcacggccttcctcaaggaccaccccggcggcgccgacagcatcctcatcaacgccggcaccgactgcaccgaggagttcgacgccatccactccgacaaggccaaggcgctcctcgacacctaccgcatcggcgagctcatcaccaccggcgccgggtacagctccgacaactccgtccacggcgcgtccaacctctcccagctcgcccccatccgcgaggccatcaaggcgccggcgcccgtcgcgctctccagcccgcgcgacaaggtcccctgccaactcgtcgacaagaaggagctctcccgcgacgtccgcctcttccgcttcgcgctgccgtcctccgaccaggtgctcggcctccccgtcggcaagcacatcttcgtgtgcgccagcatcgaagggaagctgtgcatgcgggcgtacacgccgacgagcatggtcgacgaggtcggccacttcgacctcctcatcaaggtgtacttcaagaacgagcaccccaagttccccgatggcgggctcatgacgcagtacctggactcgctccccgtgggcgcctacatcgacgtcaaggggccactcggccacgtcgagtacaccggccgcggcgagttcgtcatcaacggcaagccgcggaacgcgcggcggctggcgatgatcgccggcgggagcgggatcacgcccatgtaccaggtcatccagtcggtgctgcgcgaccagccggaggacacgacggagatgcacctggtgtacgcgaaccggacggaggacgacatcctcctccgcgacgagctcgaccggtgggcggcggagtacccggacaggctcaaggtgtggtacgtcatcgaccaggtgaagcggccggaggaagggtggaagtacggcgtcgggttcgtcacggaggaggtgctgcgggagcacgtgccggagggcggcgacgacacgctcgcgctcgcctgcgggccgccgccgatgatcaagttcgccgtctcgccgaacctggagaagatgaagtacgacatggccaattctttcatcgtgttctag

SEQ ID NO: 203 - DNA, 2253 bp, Arabidopsis thaliana
atgccttggtggagtaaatcaaaagatgaaaaaaagaaaactaataaggagagtatcattgatgcgtttaatcggaaactgggattcgcatctgaggataggtctagtggaagatcaagaaaatcaagacgacgacgtgatgagattgtgtctgaaagaggagctatatctcgattaccatcaagatctccctctccttctactcgggtttcacgctgtcagagttttgcagaaagatctcctgctgtacctcttcctcgtcctattgtccgtcctcatgtaaccagtactgattcaggaatgaatggatcacagagaccaggtttagatgcaaatttgaagccgtcatggttgccacttccaaagccccatggtgctacaagcatacctgataataccggtgctgagcctgattttgccactgcttctgtgtctagtggaagttctgtgggtgacattccatctgattctcttctcagtccattggcgtctgattgtgaaaatgggaaccgaacaccagtaaacatatcttcgagggatcagtcaatgcatgcacctcgagcttctagaatacagagtggtgctgttacacctcttcatcctcgagctggagggtcaactactgggtctcctactagaagacttgatgataacagacagcaaagccatcgtctgcctctcccgccgttattaatctctaatacttgtccgttttcacccacatattcagcagcgacatctccgtctgtcccccgaagtccggcaagggcagaggctacggttagccctggatcgcgatggaaaaaagggagattgctggggatgggaagttttggacatgtgtatcttggctttaacagtgaaagtggggagatgtgtgccatgaaagaggttactctatgctcagatgatcctaagtcaagggagagtgcacaacaattggggcaagaaatttcagttctaagccgtttacgacaccaaaatatagtgcagtattatggctctgaaaccgtcgatgacaagctgtatatatatctggagtatgtctccggtggttcgatctataaacttcttcaagagtatggacaatttggtgagaatgccattcgtaactacacacaacaaattttatcagggctcgcatatttgcacgccaaaaatactgttcatagggacatcaaaggagcaaatatattggtggatcctcatggacgagtaaaagttgctgattttgggatggcaaaacatattactgctcaatctggtcctttatcattcaaggggagcccatattggatggcacctgaggtgataaagaattcaaatggcagtaaccttgcggtcgacatatggagtcttggatgtactgttttagaaatggctacaacgaaacctccatggagccagtatgaaggggttcctgctatgttcaagattggaaacagcaaggagcttccagatatccctgatcatttatctgaagaggggaaggattttgtaagaaaatgcctacaaagaaaccccgcaaatcgtcctacagctgctcagcttttggatcatgcttttgtaagaaatgtgatgccgatggaaaggcctattgtgagtggcgagcctgcagaagccatgaatgtagcttcgagcaccatgagatcactggacattggacatgcaaggagtcttccgtgcttagactcggaagatgcaaccaattaccagcagaaaggattaaaacatggctcgggattcagtatatcccaatctcctaggaacatgtcatgcccgatttcaccagtcggtagtccaatctttcactcgcattcaccacacattagcggaagaagatctccatccccaatatctagtccccacgctctctctggttcatcaacacctttaactgggtgtggtggagccatcccgttccatcaccaaagacaaactacagttaacttcttgcatgaaggcataggatcaagcagaagcccgggaagtggcggaaatttctacaccaacagtttctttcaggagcctagtaggcagcaagatcggtcgcggagtagtccaaggactcctcctcatgtattttgggacaacaacggatcgatccagccaggctataattggaacaaggacaaccagccagtcctatctgatcatgtgtcccaacagctcttaagtgagcatctgaaactgaagtccctcgacctgagacccggtttttcaactcccggatcaacaaacagaggaccctaa

SEQ ID NO: 204 - DNA, 663 bp, Zea mays
atggggacgccggagacgtcgcgggagccatgcccggaccggatcctggacgacgtcggcggcgcgttcgggatgggcgccgtcggcggctcggccttccacttcatcaagggcatctacaactcccccaacgggatgcgcatgtccgggggcgcgcaggccgtgcgcatgaacgcgccgcgcgtggggggcagcttcgccgtctggggcggcctcttctcaaccttcgactgcgccatggtctatgcgcgccagaaggaggatccctggaactccattatcgcgggcgccgccacgggtgggtttctctctatgcgccagggcatgggggcggcgggccggtccgcgctcatgggcggtgtcctcctggccctcatcgagggcgccggccttatgctcaaccgcgtcctcgccaacccgccgctgcccgcagaggatcccaaccttaccgcggccatgggcgacaaccctttcccgggcctgccacaggcgccgccggtcgtggcacctccggaagtggcgagctccagcggcgcgggtgggtggtttgggggactgattggcaggaaggatgaagagaagaaatccagcgcgggcaagtcggagatcttggagagcttcgacacgcccagcagtccgataccatcgttcgagtacaagtag

SEQ ID NO: 205 - DNA, 1740 bp, Arabidopsis thaliana
atggtctctaaagagtgttgccgaaacgaaatacgtgcggctattcgacagcttagcgaccgctgtttatactccgccgcaaagtgggcaggagagcagcttgtggggatagagcaagacccgtctaattttacacctgcgaatacgaggtttcagcgaggaagctctagcatccggagaaggttcagcaccaatgaatctatttcaacaccgttaccttccgttggcttctctcaagcagctactcctctcccggaagaagatgaagcgattgatggtgacatttaccttttagcaaagtcctattttgattgtcgagagtatagacgggcctcccatatgcttcgtgaccaagtgagcaagaaatcactgttcttgcgttactatgcgctttatctggctggagaaaaacggaaagaggaagaaatgatagaacttgaaggccctttgggtaagagtgatgccataaaccgtgaactggtatctttggagagggatttatcagctctgaggaggacaggagcaattgactcttttggattatacttgtatggtgtggttcttaaagaaaagggaaatgaaagtcttgcacgtgccagccttgtggagtctgtcaacagttatccttggaactggagtgcctggtcagagctgcagtctctgtgtacttcgatcgaaatcttgaatagccttaacttaaacaatcactggatgaaagagttttttcttggcaatgcttatcaagaactcagaatgcacaccgagtctttggcgaagtacgagtatttgcaaggtattttcagttttagcaattacatccaagctcaaactgcaaaagctcagtatagtcttagggaattcgaccaggttgaaatcatgtttgaagaacttctgagaaacgatccatatcgggtagaagatatggatttgtattctaatgttctgtatgcaaaagaagcatgtgctgcgctgagttaccttgcacataaggtgtttttgactgataagtacagacctgagtcttgctgcatcattggcaactactacagtttaaaaggccagcatgagaaagcagttatgtatttccggagagctttgaaactgaacaagaagtatttatctgcgtggactcttatgggccatgaatatgttgagatgaagaacacgcctgctgccattgatgcatatcgacgagctgttgatataaaccctactgattatcgagcttggtatgggttaggacaagcatatgagatgatggggatgcctttctatgcacttcactattttcgcaaatccatattctttcttccaaatgattctcggttgtggatagccatggctaaatgttatcaaaccgaacagctttacatgcttgaagaggccatcaagtgttacaaaagagctgtgaactgtactgacacggaaggaatagcacttaatcagctggcaaagcttcaccagaagcttggacgtaatgaagaagctgcatattacttcgagaaggatttagagagaatggatgctgaaggattagaaggaccgaacatgtttgaggctttggtttttcttgccacacattttaaaaatcacaagaaattcgaagaagcagaagtgtattgcacccgtcttctcgattatagtggacctgaaaaagaaaaggcaaagagcttactcagagggatcagaatggcgcaaaccggttttccttcaatggatctcgagcattttcctatttag

SEQ ID NO: 206 - DNA, 417 bp, Zea mays
atgcaggttgccgctactgccgtcaggttctcggccgttctgcctgtcaaggggcggccggcggcgaagagtacggtggtggtccgtgtccctgcctcaaggaggagcgtccgtgcagctgctgttgtcgcggccgaggctgcggagatcgactacaactcgagcttctcggtgtttccgatggaggcctgcgacctgctcggcggcgatgcgtgcagcgcacagatgtacccagagaccaagctcgcctcggcggcggcggcggcgagcaggagggtggaggaggtggagagggactacctgtcgtacgacgagccaagaacggtgttcccgggcgaggcgtgcgacgacctcggcggcgagttctgcgaggcgccataccaggccggcgtctccagggagctggcgcacgcctag

SEQ ID NO: 207 - DNA, 1803 bp, Oryza sativa
atggagatcggcgccgttgagaacgggggtgtcgtcggtggtgaagttgtggcaggcaagagggggaagacgccgcaaggttggaagtgcatgccattcatcatagcaactgagacatttgaaaaggttgcgacaattggagtggtagcaaatttgacggtctatcttgtgaagcgcttcaacattgggcaaattgaggcagctaatattaccaacatattcttcggtacgcttaactttgcgccattgctaggcgccttcatctccgacgtctacttgggaaggttcaaaacactagcctatggatgcttcgccagcctcctggggatgctgggaatgactttgtatgcatcacttccagctctcaagccaccgatctgccatgaaaaaacccgactaggcggaggctgcaacagtccatcaacactccagctaagtgtgctatacctttctctaggctttctaattatcggtggaggagcgatccggccttgtagcttgccctttggagtagaccagtttgataagaccgacgaagaaggtcgaaagggactaaacagctattataattggtactatggaacaagtactgctgcccttgtgttatctatgattgtcatcatctacatccagaacaatgtcagctggccaataggatttggcatacccacattactcatgtttctcgccattatcatgttatttctgggtaccaacctgtacgtccatgtacaaccagagggaagcatatttgctggaattgcccaggttttagtggcttcatttaaaaagagaaatctcaagcttccttgtcctcatgatataaaccaacaaggattgatgctctacaaccctccttccaagggcaaccgcgtattcagattgccacttacttcccagttcaggtttctgaacaagggtgcaattgtaatgggtgatgatataaatgttgatggttctgcaagaaactcttgggagctttgcaacgtccaacaaatagaggaggtcaaatgcttaataagaattgtgccggtttgtatttctggagtcttatgctttgtcgcattggctcagcaattcacctatataatcttgcaaacatttacaatggactgtcactttgggacgcactttgaaatcccagcaggctctgttgtatccatatcccttattgccctaactctattcatccccatttatgaccggattttagtaccaatagctagaggattcactggagtggaaagtggtattacacttctacagagacagggtataggattggccatttctcccatttcaatggtggtagcaggacttgtcgaacgtaagaggaggaactcagccttgtcgaatggaggaatatcgcctatgtcagtcttgtggcttgcaccccaacttgttttaatgggtattgctgaggccttcaatgcagttggacaaatagaattctacaataagcagtttccagagaacatgcaaaccctagcaggatctctgttcttctgtactatagctggagcaaactacctgagtactgctctggcaaacatcatgagaaaggtcacgaccagagatggtcactcaagctggttaacagacaacattaatcttggcaaactcgactattacttctattttattgcccttatgggagtcctgaaccttatttattttcttatatgctcacacttctaccaatataaggtaatgtcactccattctgaagaatccatcaaaatacctaccaaggaagaagaagccacagagatcgacattgacacagatgcacctagcaaatag

SEQ ID NO: 208 - DNA, 1065 bp, Zea mays
atggctgcgccggcgacgccgaggccgtcgctgatcctcccacgtgcctcctcgcactcgcactcccaacccagcgccggcgggctcacctcttaccgcgtcaccgcctcccaccgccggcgcggcgatttcgttttcgtcgtcaaccccttgggcgccaatggccgcacgggaaagcagtggaagcagttgctgccgcttctccgcacccgcctcgctgaccagtgcaacatttgcgagtgcatcacttcgggcccatcccatgccatagatgtcacaagggaggctataaaggatggggttgatgccgtgatagctgttggaggtgatggtacacttcatgaggtggtcaatggtttcttttgggaaggaagtccagtgtgtgctctggatcgagggcctgatcattcgacggcgctgggtctcattccacttggaactggctcagattttgctcggacatttggctggacaaatgatccccatgacgcgattgatcgaattgtgagaggagtaaaatcaaaactagacgtaggcgtgatggagggtccaaacagagaaccacacttctttgttaatgttgctgatatccatttgagtgctaaggcaggttattttgcttctatgtataagagttttggtaacttatgctatgtatttggagctttaagagccttttggggacataataatcaagatatgagaataaaggtaaatgggggagaatggagaactgttcataacgtcacagccctgtgcatagggaatgccaaatacttcggtggtggtatgaagataactccaacagctgatccgtttagtggcaaccttgaggttgttattcttcaagatttcaaatggtacgactttattctgaagctacacaggctctatggaggtacacatctatcagtgaatggtgtttcgtcaatgagggtccaatcaattgaagtagcagaggtggcggctagcggtggcgtctttgtgcaatctgacggagagcatttcggctttctgccgaccaagttttcagtccttccccgtgcagttgatttcttctgctag

SEQ ID NO: 209 - DNA, 1314 bp, Zea mays
atggcgctagtacagttcaacggtgccttggttcctcaactcggtgaaaagcctcggctgctatcctcatcacctgcaatcgcaaaggctacctattctgatgcaagattcctgacaccaaaaactggttcaagaggtagaggtaaacacctgctatcacctagttatagtttgcattcacagacctcttctgaacaactaaaccatgtaccatcgtcaagatttcgccagaaaaggggttcacgttttatcgtcagagctgaagctgatttctatagtgtacttggtgtctcaagaaatgctagtaaatctgaaatcaagagcgcctatcggaagcttgctaggagctatcatccagatgtaaacaaagatcctggtgctgaacaaaagttcaaggatatcagtaatgcttatgaggttctgtctgatgatgagaagcgatcgatctatgataaatatggagaagcaggtctgaagggtgctggcatgggcacaggagattactcaaacccgtttgatctctttgagtccctgtttgaagggtttggtggaatgggtggaatggggggtggccgtgctgctcggaacagaccaatgcaaggtgatgatgagagctacaatctggtactcaatttcaaggaagctgtgtttggtgtggagaaggagattgagataaccagattggaaggctgtaacacctgcgacggaagtggtgccaagccaggtacaaaggcaaccacatgtaaaacttgtggaggtcagggccaggtagtctcctccacaagaacaccgcttggaatattccagcaagtctccacctgcaatacttgtggtggcaccggtgaattctccactccttgcaacacctgtgggggtgatggccgggtgcgaaggacaaagaggatcagcctaaaggttcctgctggagtggattctggaagcaggctgagggtccggtctgagggtaatgctggccggcgaggaggccctcctggggacctttatgtcttcattgatgttctctctgatcctgttcttaagcgagatgggacaaacattctctacacatgcaaggtttcttacattgatgcaatccttgggacaaccgtcaaagtccccactgttgacggaacggttgaccttaagataccctcagggactcagccaggcacaactctggtgatgtccaagaaaggtgtcccgcttctcgggaagtcaaatgcccgtggagaccagctggtgcgtgtccaggttgagattccgaagcgtctgagcagcgacgagaagaagctaattgaggagctgcaaacctag

SEQ ID NO: 210 - DNA, 2652 bp, Arabidopsis thaliana
atgccttggtggagtaaatcaaaagatgaaaaaaagaaaactaataaggagagtatcattgatgcgtttaatcggaaactgggattcgcatctgaggataggtctagtggaagatcaagaaaatcaagacgacgacgtgatgagattgtgtctgaaagaggagctatatctcgattaccatcaagatctccctctccttctactcgggtttcacgctgtcagagttttgcagaaagatctcctgctgtacctcttcctcgtcctattgtccgtcctcatgtaaccagtactgattcaggaatgaatggatcacagagaccaggtttagatgcaaatttgaagccgtcatggttgccacttccaaagccccatggtgctacaagcatacctgataataccggtgctgagcctgattttgccactgcttctgtgtctagtggaagttctgtgggtgacattccatctgattctcttctcagtccattggcgtctgattgtgaaaatgggaaccgaacaccagtaaacatatcttcgagggatcagtcaatgcatagtaacaaaaactcagctgagatgtttaagccagtccctaataaaaataggattctgtctgcatctcctaggcggagacctctgggaactcatgtgaagaatctacaaatcccccaacgagatttagtgctatgcagtgctccagatagtttgttgtctagtccttccaggagtccaatgagatcctttattccagatcaagtctcaaaccatgggttgttgattagtaaaccatattcagatgtttccttgcttggatctggacagtgctcaagccccggttcaggttacaactcaggtaacaattccattggtggagatatggctactcagctgttttggcctcaaagcaggtgtagccctgaatgttcccctgtgcctagtccaagaatgacaagccctggtcctagctctagaatacagagtggtgctgttacacctcttcatcctcgagctggagggtcaactactgggtctcctactagaagacttgatgataacagacagcaaagccatcgtctgcctctcccgccgttattaatctctaatacttgtccgttttcacccacatattcagcagcgacatctccgtctgtcccccgaagtccggcaagggcagaggctacggttagccctggatcgcgatggaaaaaagggagattgctggggatgggaagttttggacatgtgtatcttggctttaacagtgaaagtggggagatgtgtgccatgaaagaggttactctatgctcagatgatcctaagtcaagggagagtgcacaacaattggggcaagaaatttcagttctaagccgtttacgacaccaaaatatagtgcagtattatggctctgaaaccgtcgatgacaagctgtatatatatctggagtatgtctccggtggttcgatctataaacttcttcaagagtatggacaatttggtgagaatgccattcgtaactacacacaacaaattttatcagggctcgcatatttgcacgccaaaaatactgttcatagggacatcaaaggagcaaatatattggtggatcctcatggacgagtaaaagttgctgattttgggatggcaaaacatattactgctcaatctggtcctttatcattcaaggggagcccatattggatggcacctgaggtgataaagaattcaaatggcagtaaccttgcggtcgacatatggagtcttggatgtactgttttagaaatggctacaacgaaacctccatggagccagtatgaaggggttcctgctatgttcaagattggaaacagcaaggagcttccagatatccctgatcatttatctgaagaggggaaggattttgtaagaaaatgcctacaaagaaaccccgcaaatcgtcctacagctgctcagcttttggatcatgcttttgtaagaaatgtgatgccgatggaaaggcctattgtgagtggcgagcctgcagaagccatgaatgtagcttcgagcaccatgagatcactggacattggacatgcaaggagtcttccgtgcttagactcggaagatgcaaccaattaccagcagaaaggattaaaacatggctcgggattcagtatatcccaatctcctaggaacatgtcatgcccgatttcaccagtcggtagtccaatctttcactcgcattcaccacacattagcggaagaagatctccatccccaatatctagtccccacgctctctctggttcatcaacacctttaactgggtgtggtggagccatcccgttccatcaccaaagacaaactacagttaacttcttgcatgaaggcataggatcaagcagaagcccgggaagtggcggaaatttctacaccaacagtttctttcaggagcctagtaggcagcaagatcggtcgcggagtagtccaaggactcctcctcatgtattttgggacaacaacggatcgatccagccaggctataattggaacaaggacaaccagccagtcctatctgatcatgtgtcccaacagctcttaagtgagcatctgaaactgaagtccctcgacctgagacccggtttttcaactcccggatcaacaaacagaggaccctaa

SEQ ID NO: 211 - DNA, 1146 bp, Zea mays
atggctgctcccgaagcgcccgcatgctacgtcgggatcgcgcggcagtccgccgccttccgccttatgaaacaaatgggatgggaagaaggtgaaggccttggcaaagacaagcaaggcataaagggtcatgttagggtgaaaaacaagcaggacacactaggtgttggtgtagatagccctcataacaaatgggtatacgataccacccaatttgacaacatattgaagaaactgaaagtgcaatcagctaatcctgttcaagaagaggttgcagctgtagaaagtgattcacctgacatcacacccaagaaagacaaatcagcaaaacatgaagttactaaagttactcgacctcaaggaagatacaagaaaagagagagggggaaaagtgtgaactcttattcagcaacagatcttcaaggcatactcgtacgcaaaaatgaagataattccaaagtggatcagaaacttgaaccgacatgcttggatgaacctgatcccatcatctgtttggatgcagtatcccaagctgatgatgtgaactggtgggggcacaagtttggatttttatcaggagggtttctaggagcaaaatcccgtaaaaataaatcttcacaaaaagatcttgctaatgtccgccagacatttgcagaggaagatcaagaaaatttgtacaatcttgttcaggataaagctacttctggaaagcagggtcttggcatcaaaggcctgccaatgaaagttgctggccaacgttggaagggaaacaaaacttcgtttgttgatagtgatgatgataattcagcccagtccgatgagtattcagaaatcgaagagaatggcgatgaggaagaacatatcagtgcttctgaatcaatagacacagataagaatgcagacaaagaattgcttgtggatgctagacccaaaaccaaggtcaagaaactttgcaaaagaatacttcgtcaggccccatctcagtcaatgaaattgaaggatcttaaggtcgccgttgaggaacactcaaatgttgtattttccagcttctctggtagacgcgaagccctgttgtttttgaagaaaaagcttcaaggaagcaggaaattcaatgtggacggcaagaaagttcagctcgtgtcatag

SEQ ID NO: 212 - DNA, 1695 bp, Zea mays
atggagccatgcaacacagttccatctggagtttcctgggaggtgaggccagatgtagacgctagcgaggagaagaatgaaaaacaagagtcatgtagcaccacagtggacgaagcgcacgaacaagggaaaactgagggacagattgaaattcaggtagcatcatcgatggatatgataagtgatgaagcttttacagctgacaaccaggagcatggaattggagaatcaaatgttacttcagtggaacaagtgactgaagaagagaaaccagcatctgaggatgaagtaaaagagccaccattggtgaactccacggcactattgtatgatactacttcatcaggggattccagtggactgaaacaatacacagcttcgaccgatcagaatctctatgctgaatcaaatacagggtcgtctcctgcatccactgaggacattgacataagtactctggctgtggaaagtgaagtggcggctgagaatgatggcccaattaacagtcaggtgcatgaaactgtagctctagaaaatgtggaaatgaaagatgatgtttcttctgctgaaaatgagcataacagatcgagcagccctgttattcatttagaggacccactagtgtctttgaaggatgttgagcagcatggtccaactcctactaaggactttgttgtacctaacacagaagaccaacaagaagccagagatatcagcttgcaggtacaagctgtggattccatgaaagattgtggcgaagtaccagatggaacaatagaggcttcgacgaatgatgatgaattagaactgggtacttctgcagatgtagaaaagaatgatcaacctaccttgctggaaccaagatcggagtctgtctctgtcccagaactgtccgtcttggatgaatctgacgataaaatgcaatgtggtgtttctggcaaggatgaggaagcacatgtggaggagaaaactgtaactattgctgttgacaaggtaacaggaggttctgcaaatttcgaggatcctctttgtgaggcatcgaggaaggaacctgacattgagaagagtcacccaagcctcggagaagaggaagacgatacaataggtggaacagtcttccctggttcaggtagctgtgaattatcatgtccacaggatggtggcatcgcagtctacgaggggcctgagatggtgtcaccagagagccaaactgatgctcggaaagaaaacatccattcagatgtcgctgagacagatgaatgcaccaagactcagaaggccgctctagcaggcacagagggagaaaattctgctgaagattctggtgtgccggtgtctgagatggacaaatgcaacgagatgccgaaggatgctccgacacttacagcagcaggtgcaaatcctgctgaagacgaagcttccctgaaagacctctctgtgcagacagagaacaaggcttcttctgcctccccagctcctgatgatccgaaggccagcgacgagaagacgctggcagaagagaaccagaagctgaaagagcttctgcaaaagcttctggcgtccggcaacgatcagatgggggtcatcacggacctaagtgagaaggtcaaggtgctggagcggaggctggcacgcaagaagagaccaaaggtgagggtgcacaagccatccaggcatgcttcctgtgtccactag

SEQ ID NO: 213 - DNA, 1524 bp, Oryza sativa
atggccccaatggcgggcggcggcggggtaccgtggggggaccgggccagggtggtcggggcgcagatccgcagcaggttccgcgtcggcgtggcgcccgtggaccggcggtggctgtggcggcgcggggacgggcgcgtcgcctccgaggcggtccggcagtggacggaacgcgtgcggagcctgtggcagagggagaagagtacggatcagatctcctcgtctccggggacgtcccaggtggcggccgcggcgaagccatcatcgagtgctttgaggttctacagaaagaaagtgggcaaggaggttgatggaattgaagattctgttatttttcggtcgcttcaagcattggctgttcctcttattggcaatgcttgtcatatttttatgcatggcctcaactctgttcagatttatggtgcagagaaacttcagcaggcattacaggagagacctaaaggcaagcctctcctaacggtcagcaatcatgtggcagctatggatgatccctttgtaattgcgtcaattctcccaccatcagtcatgttggaagctcaaaagctgagatggacattatgtgcgagtgatcgttgctttacaaatccaattttgtctacattcttcaggtctgttaaagtgctacctgtttctcgtggcgatggcatctaccaaaagggaatggacatggcactttcaaagttgaacaatggtggatgggttcatattttcccagaaggaagtcgttcaaaggatggagggaaaaccgtcgctcctgccaagagaggtgttggaagattggtaatggacgctgacagccttccagttgtaataccctttgtccatacaggaatgcaggatataatgcctgtcggaaaacgtattccaagagcaggcaaaagggtgattgtggttgttggtgatccaatcaacttcaacgaccttatcattgacaacagcgatgaaacccaacacatctctagaggcattttgtatgacaaagcaacagaaaggattgggcagagactgcaggaactgaaagccgaagtcgatagattagcagcagagcagaaatctgaactccaacatcatcatgcccgtgatactgtcaactatggtacccgactgtggcagcaggttgattgggaagcatttggcatggagagttcaatgctgtcaccagaaccttcagacgtgcaagagccgttgaagaaagccaagcctgtactacacctggaatctgaacatgccaagcctgaactacacctggaacctgagcaagccaagcatgagctacacacggaacaatgcgttcctgcagctccaagtgccgagatctgctccaatttcggtgttccgctcttcttcagacagcacacggacccttctgagctcatggggtttgccgcccgtggcctgctcaagaatggcaggttcatggaggaggaaggctaccgggaattgcaacggcagggcgcaatgaacatgttttggggatctcaggccaacaatactgtactatag

SEQ ID NO: 214 - DNA, 738 bp, Zea mays
atggggacggaggccgacgccgcagccgtggattcgcttcggtcgcagatcccgttccagaccgacggggagctcatcctcccgccgcgcgatgtggggctcgtcctcgtcgacctctgcaacggcttctgcaccgtcggcgccgggaacctcgctcctgttgcgccaaataagcagataagtaaaatggtggaagaggccgctaggctctctaagctgttctgtgatagaaacctgccgatctttgcattcctggatacccattatccagataagccggagccaccgtatcctcctcactgtatcattggtactggggaggagaacttcgttccagacctggagtggttggaaaaggagccaaatgtgactataaagaggaaaagttgtattgacggttacatcagctgcatagaggaggacgggtctagtgtttttgttgactgggtgggaaaatatcagatcaaaactgtcttggtactcgggatatgcacggacatctgtgttttggattttgcaagctcaactctggctgctcgaaatattgaccgagtgcctccattacgagatgtcgtgatttattcagaggggtgtgctacatatgaccttcctgttgagatcgctatgaatatcaaaggagctcttgcccatcctcaggacctgatgcatcatattggactctatatggccaaaggaaggggtgcaaaggttgttgacagggtggttattgaaccttag

SEQ ID NO: 215 - DNA, 567 bp, Zea mays
atggcgtcgccggcgcggcggctcctgcagaccaactccgtgcagtacccgacgctccccgcggccgacccgccgagcccgctggccgtcgactccgacgtggtggtcatcctcgccgcgctcctatgcgcgctcatctgcgtcgtggggctggcctccgtggcccggtgcgcgcgctcccgcgccgcgcccgccgccgccaggagggggctcaggaagaaggcgctcagggcgctgccgagcctcgcgtacgaggacgccgtggcggcccgggccgcggacggggcggcggaggtcctggcggagtgcgccatctgcctctcggagttcgcgccacgggaggaggtccgcgtgctgccgcagtgcggccacgccttccacgtcgcctgcatcgacacctggctcgccgcccactcctcctgtccctcgtgccgccgcgtcctcgtcgtcggcgacgcctccagtaagcgcccgccccagcctaagcgctgccgcaagtgcgaggcggccatggacgagccctcctcgtcgtccggttccgccggcgacacgcctgccggttcctag

SEQ ID NO: 216 - DNA, 1848 bp, Zea mays
atggcggctctggccacgtcgcagctcgtcgcaacgcgcgccggcctgggcgtcccggacgcgtccacgttccgccgcggcgccgcgcagggcctgaggggggcccgggcgtcggcggcggcggacacgctcagcatgcggaccagcgcgcgcgcggcgcccaggcaccagcagcaggcgcgccgcgggggcaggttcccgtcgctcgtcgtgtgcgccagcgccggcatgaacgtcgtcttcgtcggcgccgagatggcgccgtggagcaagaccggcggcctcggcgacgtcctcggcggcctgccgccggccatggccgcgaacgggcaccgtgtcatggtcgtctctccccgctacgaccagtacaaggacgcctgggacaccagcgtcgtgtccgagatcaagatgggagacgggtacgagacggtcaggttcttccactgctacaagcgcggagtggaccgcgtgttcgttgaccacccactgttcctggagagggtttggggaaagaccgaggagaagatctacgggcctgtcgctggaacggactacagggacaaccagctgcggttcagcctgctatgccaggcagcacttgaagctccaaggatcctgagcctcaacaacaacccatacttctccggaccatacggggaggacgtcgtgttcgtctgcaacgactggcacaccggccctctctcgtgctacctcaagagcaactaccagtcccacggcatctacagggacgcaaagaccgctttctgcatccacaacatctcctaccagggccggttcgccttctccgactacccggagctgaacctcccggagagattcaagtcgtccttcgatttcatcgacggctacgagaagcccgtggaaggccggaagatcaactggatgaaggccgggatcctcgaggccgacagggtcctcaccgtcagcccctactacgccgaggagctcatctccggcatcgccaggggctgcgagctcgacaacatcatgcgcctcaccggcatcaccggcatcgtcaacggcatggacgtcagcgagtgggaccccagcagggacaagtacatcgccgtgaagtacgacgtgtcgacggccgtggaggccaaggcgctgaacaaggaggcgctgcaggcggaggtcgggctcccggtggaccggaacatcccgctggtggcgttcatcggcaggctggaagagcagaagggccccgacgtcatggcggccgccatcccgcagctcatggagatggtggaggacgtgcagatcgttctgctgggcacgggcaagaagaagttcgagcgcatgctcatgagcgccgaggagaagttcccaggcaaggtgcgcgccgtggtcaagttcaacgcggcgctggcgcaccacatcatggccggcgccgacgtgctcgccgtcaccagccgcttcgagccctgcggcctcatccagctgcaggggatgcgatacggaacgccctgcgcctgcgcgtccaccggtggactcgtcgacaccatcatcgaaggcaagaccgggttccacatgggccgcctcagcgtcgactgtaacgtcgtggagccggcggacgtcaagaaggtggccaccacattgcagcgcgccatcaaggtggtcggcacgccggcgtacgaggagatggtgaggaactgcatgatccaggatctctcctggaagggccctgccaagaactgggagaacgtgctgctcagcctcggggtcgccggcggtgcagggcccctgatctcgcgcgtggtgcaaagatgttgggacatcttcttatatatgctgtttcgtttatgtgatatggacaagtatgtgtag

SEQ ID NO: 217 - DNA, 1164 bp, Zea mays
atgataccttctgtgaggatctctcctggctatgcagccttctctggctccagcctacgcttaaaattacattcaattccatccatctctagtctcaaaccctccaaatatgtggtctcctcgctgaaaccactctacctagcaccgccagatggtccacacacttctgagcttaagtcttggagacaaccacttgagttccgttgtgctgcttctgctgccgatgacaaggagtcaaagactcaggtggtgccagttcagttggaaggcgcacagaggttaaagatctccatctatttcgcgacctggtgggcgcttaatgtgatatttaacatttacaacaagaaggttctcaatgctttcccttacccctggctcacctccacactctcccttgcctgcggctctgcgatgatgcttttctcgtgggccactcgtcttgttgaggcccccaagaccgacctagacttctggaaagttcttttcccggttgctgtggcacatacaattggccatgttgctgcgacagtgagcatgtctaaggtggcagtgtcattcacacacataattaaaagtgcagaacctgcattcactgttttggtgtcaaagttcctccttggggagacgtttccagttccagtctatctttctcttcttccaatcattggtggttgtgctctagctgctgtcacagagctgaactttaatatggttggatttatgggtgctatgatatccaaccttgcatttgttttccgcaacatcttctcgaagaggggcatgaaggggaagtccgtcagtggcatgaattactatgcttgcctgtcaataatgtcgctggtcatactgactccatttgctatagctatggaaggtcctcagatgtgggctgctggttggcaaaaggctgttgccgaagttggacccaatgttgtctggtggatcgctgcacagagcgtgttctatcacttatataaccaggtgtcctacatgtctctcgatcagatctctccattgacgtttagcattggcaatacaatgaaacgtatatcagtgattgtttcatctataattatcttccgcacgcctgtccgccctgtcaatgcactgggagctgccattgccatccttggcacattcctgtactctcaggcaaaggcgtag

SEQ ID NO: 218 - DNA, 819 bp, Glycine max
atggcagaagcaggaagcagcattaacagaggagcaagatggtctctcaatggaacgacggctctcgtcaccggcggcacccgtgggatcgggcacgccatagtgagtgacttggccgcgtttggcgctgctgtgcacacttgctccaggacccaaacagagctcaacaaatgcttacaagagtggcagagtctgggctttcaggtaactgggtcggtgtgtgacgtgtcctcaccatcccagagagagaagctcattgaggaagtcacttccatcttgaatggcaagcttaacatctatgtgaacaatgttggaacaaactttagaaagccaaccattgagtacactgctgaagaatattcacagcttatgacagttaatttagactcctcattccatctgtgccaacttgcatatcctcttctgaaagcatctgaaaatggaagcattgtgtttatttcatctgttgctggtgtggtgagcttgggtactggagctgtttatgcagcaagtaaagctgcaattaatcagcttacaaaaaacctggcttgtgaatgggccaaagacaacataaggagcaactgtgttgtaccatgggcaaccagaaccccacttgtagaacatttgttgagagaccaaaagtttgtggatgatattatgtctcgaactccgattaaacgtatagcagaacccgaagaagtgtcatcgttggtgactttcctttgcttgcctgctgcttcttacatcactggacaggttatttgtgttgatggaggattaacggtgaatggatttcaaaccagcatgagaataacatag

SEQ ID NO: 219 - DNA, 1134 bp, Arabidopsis thaliana
atggccgtaagtttcgtaacaacatctcctgaggaagaagacaaaccgaagctaggccttggaaatattcaaactccgttaatcttcaacccttcaatgcttaaccttcaagccaatatcccaaaccaattcatctggcctgacgacgaaaaaccttccatcaacgttctcgagcttgatgttcctctcatcgaccttcaaaaccttctctctgatccatcctccactttagatgcttcgagactgatctctgaggcctgtaagaagcacggtttcttcctcgtggtcaatcacggcatcagcgaggagcttatttcagacgctcatgaatacacgagccgcttctttgatatgcctctctccgaaaaacagagggttcttagaaaatccggtgagagtgttggctacgcaagcagtttcaccggacgcttctccaccaagcttccatggaaggagaccctttctttccggttttgcgacgacatgagccgctcaaaatccgttcaagattacttctgcgatgcgttgggacatgggtttcagccatttgggaaggtgtatcaagagtattgtgaagcaatgagttctctatcactgaagatcatggagcttctggggctaagtttaggcgtaaaacgggactactttagagagtttttcgaagaaaacgattcaataatgagactgaattactaccctccatgtataaaaccagatctcacactaggaacaggacctcattgtgatccaacatctcttaccatccttcaccaagaccatgttaatggccttcaagtctttgtggaaaatcaatggcgctccattcgtcccaaccccaaggcctttgtggtcaatatcggcgatactttcatggctctatcgaacgatagatacaagagctgcttgcaccgggcggtggtgaacagcgagagcgagaggaaatcacttgcattcttcttgtgtccgaaaaaagacagagtagtgacgccaccgagagagcttttggacagcatcacatcaagaagataccctgacttcacatggtctatgttccttgagttcactcagaaacattatagagcagacatgaacactctccaagccttttcagattggctcaccaaacccatctag

SEQ ID NO: 220 - DNA, 1929 bp, Zea mays
atgatgggaggcgggctgttggtggatcagagcgtggtgttccctggcgtccacaacttcgtggatctcctgcagcagaacggcgacaagaacctgggcttcgggtctctgatgccgcagacgtcctctggcgaccagtgcgtgatgggggagggcgatctcgtggacccgcctccggatagcttcccggacgccggggaggacgacagcgacgatgacgtcgaggacatcgaggagctggagcgccgcatgtggcgcgaccgtatgaagctgaagcggctcagggaactgcagcagacccgcggcaaggactcgttggctagcggtgcgggactggctgatggctcgtccaagccaaggcagtcgcaggagcaggcccggcgcaagaagatgtcgcgcgcgcaggacggcatcctcaagtacatgctcaagatgatggaggtgtgccgcgcgcaggggtttgtgtatgggatcattccggagaagggcaagccagtgagtggtgcctccgacaacctccgtgcgtggtggaaggagaaggtccgcttcgaccgcaacggaccggccgccattgccaagtaccaggccgacaacgccgtccctggcgccgagaacgagctcgcctcgggcgctgctagcccccattccttgcaggagctgcaggacactacgctgggctcgctgctctcagcgctcatgcagcactgcgagcctccacagcggcgctacccgctcgagaagggcgttcctccaccgtggtggcctaccggcgacgaggagtggtggccggaactcggcattcccaaggaccagggcccacccccgtacaagaagcctcatgaccttaagaaggcctggaaggtgagcgtgctcaccgctgtcatcaagcacatgtcaccggacatagagaagatccgtcgcctggttcgccagtccaagtgcctccaggacaagatgactgccaaggagatctcaacctggctggcggtcgtcaagcaggaagaggagctgtaccagaagctgaacccgggcgcacgcccaccggcgtctactggtggcatcgcaagtgccatatccttcaacaccagctcgagcgagtatgatgtggacatcatcgatgagtgcaagggggatgaggccggcaaccagaggacggcagtcactgacccaaccgcgttcaaccttggtgcctctatcctaagcgacaagttcctcgtgccgacgccgatgaaggaggagaccggcgacgtcgagttcatccagaagaggaacgcccccgctgcagccgagccagagctgatgctaaacaaccgagtgtacacctgcaacaacgtccagtgcccgcgcagcgactacagctacggattcctggaccggaatgcccgcaacagccaccagtacacctgcaagcacaaggatccaacctctcagagcaccgagaacaagccgccgtcagcaccgccacagccacaagccttccagccggccttcagccaacccaaccaggcactgaacagtctggatttcagcctgcccatggacgggcagaggtccatcgccgagctgatgaacatgtacgacaacaacttcgtgccgaacaagaacccgagcagtgacagcgtcgccgtcatggagaggccaaacgcgatgccccagcagaggatccagttggacgagggtttcttcgtacagggcaacggagccttcgacgacgtcaacaacagcatgatgcagcagcagcagcagcaggcgccagtgcagcagcagcagcagttcttcatccgcgacgacacgccattcgtgagccagatgggcgacatcgccgccagcgcgccggagctcaggttcggtcctggtttcagcatgtctagcagcgtcgactacccaggcgcggcacagaggaacgacgggaccaattggttctactag

SEQ ID NO: 221 - DNA, 1242 bp, Glycine max
atgggtgaattgggagacatggaagaaaatgaatggcagatggtgcaaacgaaaggaaaccaatttgtggtgaacgaccaacctttctatgttaatggattcaacacatactggttgatggtatttgctgcggatgagtccacaagagggaaggtcactgaggtgttcaaacatgcatcctctgtgggtatgtcagtttgtaggacttgggccttcaatgatggccaatggcgtgctcttcagaaatctccatcagtttatgatgaagacgtattcaaggccttggactttgtggtaagtgaagcaaggaaatacaaaatcaggctcatattatcactggttaacaactgggaggcttatggtggcaaaccacagtatgtgaagtggggcaatgcagctggccttaacttgacctctgatgatgacttcttttcacatccaactctcagaagctactacaaggctcatgttaagacggtgctcaatagagttaatacattcacaaatatcacttacaaggaagatccaacaatttttgcttgggaactgatgaatgagcctcgatgcacctcagactcctcaggtgatgtgttacaggattggataaaagaaatggcattctatgtgaagagcattgatccaaaacacctagtggagattggactagaaggattttatggcccctcaacacctcagaaatatcagttcaacccaaattcatatgctcatgaggttggaactgattttatcaggaaccaccaggttctaggtgttgacttcgcttctgttcacatatatccagactcttggatttcacaatcagttgcagattcccatctcccattcataaagacttggatggaagcccacatagaggatgctgaaaagtatcttggaatgcccgttgtttttgctgagtttggtgtatctgcaaaagctcctggctacaattcaacatatagagacaaccttataaacactgtgtacaagaccatcctgaactctacaaagaaaggaggtagtggggctggaagccttgtgtggcagctctttcctgacggaacggattacatggatgatggctatgcaattgttctctcaaagtcaccttccacgtcaagcattatatcccttcaatccacaaggctagccctcttcaattccctgtgttctaagaaatgccgttggggttgtaagaaaagaaatgtgttggaaaaagtactctatcatgacgaactgtag

SEQ ID NO: 222 - DNA, 1275 bp, Zea mays
atggggctccttcctaccgaccgcatggacagcctcttctccccgcgctgccagtgggtgaacggccccatcatcgtgggcgcggggccctcgggtctcgccgtggcggcgtgcctgcgcgagcagggcgtcccctacgtcatgctggagcgcgccgactgcatcgcgtcgctgtggcagaggcgcacctacgaccgcctcaagctgcacctgcccaagcagttctgcgagctgccgcgcatgcccttccccgaccactacccggagtaccccacccgccgccagttcatcgactacctcgaggactacgccgccaggttcgagatcaggccggagttcagcaccaccgtggtgttggcgcgctacgacgagacgtcgggcctctggcgcgtcaccacctcggcgcccgccggcgccaacggtggcgacgtggagtacatcggccgctggctcgtcgtcgccaccggcgagaacgccgaggccgtcgtgcccgacatcccgggtctcggcggcttccacggcaaggtcacccacgtcagcgactacaagtcaggggaggcctacgccgggaagcgcgtgctcgtggtcggctgcggcaactccgggatggaggtgtcgctcgacctctccgaccacggggcccgcccggccatggtcgtgcgcgacgctgtgcacatcctcccccgtgaggtgctcggcaagtccaccttcgagctcgccgtgctcctcaggcgctggctcccgctctggctcgtcgacaagatcatggtcatcctcgcctggctcgtcctgggcaacctcgccaggctcggcctccgccgccccgccgccggcccgcttgagctcaaggagacacacggccgcacacccgtcctcgacaccggcgcgctcgcgcgcatccgtgccggagatatcgccgtcgtccctgccgtggcacgtttccgaaagggcggtcaggttgagctcgccgacggacgcactctcgacttcgacgccgtcatcctcgccaccggataccgcagcaacgttccccagtggctcgagagcagcaacgattccttcaacaaggaaggataccccaagacggccttccctcacgggtggaagggtcaatctgggctctacgccgtgggtttcacccggcgtggtctcttgggcgcctccaccgacgccgtgcgcattgccaaggacctcggcaacgtctggagggaggagaccaagcccacgaagagggccggcgcctgccacaggcgctgcatctccgtcgtcttctag

SEQ ID NO: 223 - DNA, 1170 bp, Arabidopsis thaliana
atggtgattgctgcagctgtcatcgtgcctttgggccttctcttcttcatatctggtctcgctgtcaatctctttcaggcagtttgctatgtactcattcgaccactgtctaagaacacatacagaaaaattaaccgggtggttgcagaaaccttgtggttggagcttgtatggatagttgactggtgggctggagttaagatccaagtgtttgctgataatgagaccttcaatcgaatgggcaaagaacatgctcttgtcgtttgtaatcaccgaagtgatattgattggcttgtgggatggattctggctcagcggtcaggttgcctgggaagcgcattagctgtaatgaagaagtcttccaaattccttccagtcataggctggtcaatgtggttctcggagtatctctttctggaaagaaattgggccaaggatgaaagcactctaaagtcaggtcttcagcgcttgagcgacttccctcgacctttctggttagccctttttgtggagggaactcgctttacagaagccaaacttaaagccgcacaagagtatgcagcctcctctgaattgcctatccctcgaaatgtgttgattcctcgcaccaaaggtttcgtgtcagctgttagtaatatgcgttcatttgtcccagcaatttatgatatgacagtgactattccaaaaacctctccaccacccacgatgctaagactattcaaaggacaaccttcagtggtgcatgttcacatcaagtgtcactcgatgaaagacttacctgaatcagatgacgcaattgcacagtggtgcagagatcagtttgtggctaaggatgctctgttaggcaaacacatagctgcagacactttccccggtcaacaagaacagaacattggccgtcccataaagtcccttgcggtggttctatcatgggcatgcgtactaactcttggagcaataaagttcctacactgggcacaactcttttcttcatggaaaggtatcacgatatcggcgcttggtctaggtatcatcactctctgtatgcagatcctgatacgctcgtctcagtcagagcgttcgaccccagccaaagtcgtcccagccaagccaaaagacaatcaccacccagaatcatcctcccaaacagaaacggagaaggagaagtaa

SEQ ID NO: 224 - DNA, 1230 bp, Arabidopsis thaliana
atgattaaacagagcaaaaagaagagaaacaagaaaaagagaatcatcactatcgagattaatgattttccaggaggaccagatgggtttgagctggtttcaaggttctgttaccacaacggagaaatcttaatcgacgtctcaaacgtctcgactttgtactgctgctctgtttttctaggcatgtcggagaagttctgtttctctaatctcttccttcagacagagaagtttctagaagaagtgttctatgggtcttggagcgacatcgtttcgtgtctcaagaactgcgagcaagtgttcttccaagcagattcgtatggtcttgtagataaactcattttcgcagctttgaacaaaatctctcagaattcagacgatttttcttcttcttcgctttcttccttcgcctcttctctttctcctgagatggccaagaacacgtcagaatcagacggtaggtatatttcgcggtctgttgcttgcggaagaagcaacgagtggtggttcgaagatatgacaaatctttccccgaagatcatattgaagctagttatgatcattggagcttacaaaaccaacataaaaagcttagtcctaaccagatttcttctccattatctcaagacaaaactccaaaccaaatcaagaactaccactgagcttatgaggaacaagctcgagtactcagatttagctgacacagcggttagaggagtgatttccgcagggacacgtacgttttcttgcaggaaactcttctggattcttcgagttttatccagttttagcctaagtagagagtcaagaatcggtttagaaaccctaataggagaaatgctggaacaagcaacacttgatgatcttctgatatctgcaagaggaagcagagaaagtggtttctacaatgttgatcttgtgataagattactaaaagtatttgtgaagaacagagaagaagaagaagaagaatcaagagagaggaatatgaaagaaattgggaaattgattgataagtatttgagagaaatatctccagatcagaatttgaaagtccccaagtttcttggtgttgcagagagcttgccggattcagctagagattgctttgatggagtttacagagcaattgacatctatctacaggtcagttttttttttttgttaagttataagttttactattatttttttgtttttcttgaatttcttcaccaactaaatgattag

SEQ ID NO: 225 - DNA, 1947 bp, Zea mays
atggctccccacctcctggccgtggccgtggccgtggcggccatcatcgccaccgtctcgttgctggcgcccggcgccgctgcctacccgtggccagtttgtgggacgagcaacgacttcgagcccaacagcacataccaggccaacctcaacctcctcgccgccatgctgcccaacaacgtgtccgcatccccggtcctctacgccaccgccgtcgtcggcgccgtcccggagcaggtctggggcatgggactctgccgcggcgacgccaacgccagcagctgcctcgcctgcctcacccaggcgttccaggacctgcccaacgactgctcctacaacaaggacgccgccatctactacgacccctgcaccctccactactccgacgtccacaccctcgccgacgacgacaccggcccgacgaccatgtcgtacaacatcaacaacaacgccaacgtcacctcggacccggcccggttcgagcgcctcctcgccgccctcgtcaacgccaccgccgagcacgccgcgtccaactccacccggcgattcgccacgggggaggccgacgccgacttcgaccggcagttccccaaggtgtacgcgctggcgcagtgcacgccggaccagacgccggcgcagtgccgcaagtgcctcgccggcctcatatcgcagtcgctggacgggttccagaacaacatcggaggcagggtgctctgggtcaactgcacctggcggtacgagacctcgcccttcttcaatggaccggccatggtgcgcctggcatcgtcgtcgagccctccggcagcggcagcggcaggtggaggggagaggaagtacagcgtgttcatcgtggttcttgcagttgtgctgcccactctagctgccctgaatcttgtgttttgcttctgtttctggcggcggccagcaccacaggcaaagcagtcacagcccatgtattccaccgaagcagaggacgtggaaacggtggactccatgatgatcgacgtctccgccctgcgagccgcaacagggaatttcgacgagagcaacaagctcggcgaaggcgggtttggcgcggtgtacaagggcgtcctcccggacggcgacgagatagcggtgaagcgtctgtcgaagagctcgacgcagggagtggaggagctgaagaacgagctcgcgctggtcgccaggctgaggcacaggaacctcgtcaggctcgtcggcgtgtgcctggagcagcaagaacggctgctcgtctacgagtttgtccccaaccggagcctcgacctggtactcttcggtaccgacacgcgtgagccgctcagctgggagcagaggtacaggatcataaacggcatcgctcgaggcctgcagtacctccacgaggactcccagctcaaggtagtccaccgtgatctcaaggccagcaacatcctgctagacgtggagatgaaccccaagatctcagatttcggcctcgcgaggatcttcggccgggaccggacgcaggccgtcaccagccgcgttgtcggaacctatgggtacctagcaccagaatacctgatgcgcgggaactactccgtgaaatcggacgccttcagcttcggcgtcatggtgctggagatcgtcaccgggaggaagaacaacggcagctcccacaagtccggagacctcttgaccaccgtatgggagcactgggaggccgggacggtggcggagctggtggacccgtccctgggcggaagcttcccggagggcgacgtgctgaggtgcatccacatcggtctgctctgcgtccagggggaccccgctgcccgcccggtgatgtcgtccgtcgtgacgatgcttggaaccgacacggtcaccctccaggctccatccaagccgggattcttcgccagaaagagtggcactagcacgaccgtgtccgctgatgatgggtcgatttag

SEQ ID NO: 226 - DNA, 957 bp, Zea mays
atgggcaaggcctccaaggacaagagggacatctactaccggaaggccaaagaggaaggctggagagctcgcagcgccttcaagctcctccagatagaccaggagttcaacatcttccatggagtgaagcatgtggttgacctgtgtgctgctcccggaagttggagccaggttttgagccggaacctgtatgtaccagcaaaacagtcttctgattgcaaggaaggtgatcttcctctcatcgtcgcaattgacttgcaaccgatggccccaatagaaggtgttatacaagtgcagggcgacatcaccaatgctcggacagcagacgtggtcattaggcattttgatggatgcaaagcagacttggttgtttgcgatggagccccggatgttaccggacttcatgatatggacgaatttgttcagtcccagcttatactcgcggcattggctatcgtgactcatgtactcaaagttggtggaaaatttgtggcgaagatatttcggggtaaagatacgagtctcctgtactgccagctaaaactgttcttctcgcaagttacgtttgcgaagccaaaaagcagccggaactcaagcatcgaggcgtttgcggtctgtgagaactactcacctcctgaagggttcaaggaggaagacctataccacctgctagagaaagtgggtactccctcaggagctggcgatctagattgcagaagcggatggctggagggaccaaacaaggtgtacatcccgttcctggcctgcggggatttgagcggctacgactccgaccgctcgtacccgctgcccagcagcacggacggtggctcgtaccggagccttgaccccgtgcagcctcccatcgccccgccttacaagaccgccctgcagatgaagaaggcttccagccacggcgccggcgcggacgccatcaagccgtccgcagactcctag

SEQ ID NO: 227 - DNA, 645 bp, Zea mays
atgaaaagggagacaatgccttcatggctagaactgttgcttgcaacacaattctttacgacttgtgctaaccatcttcttgctagtcgcaatgaatgtaacctattttgcacccagtgtgagaccaaaccagctgctttctgtaactattgtcgttcaagtgatcattccacccaccgtgtaatccagataaggcgttcatcgtaccatgacgttgtgagggtgtccgagattgaggatatccttgatgtcagcgatgtgcaaacttatgtaatcaatagtgcaaggattgtattcctgaatgagcggccacaactgcgtgcttctagtgtccccatttgtaaggcacccacatcatcaacacatagctgtgagacatgtagccgtgtgctacttgatgcatttcgcttctgctctcttggatgcaatcttagaggcttaaatatggaagctggtatgcaagctatggttggcaacaaccctcggtccaatggtatggatcatgtggctaggattgacaatgttggttcaagtactacaaatgaccaaaacagctgcaatgacaagaactacgaagaaccaccaccaaaaagggttgctcgtcacagacgcaagggaattccccaacgtgcgccattcttctag

SEQ ID NO: 228 - DNA, 2001 bp, Artificial Sequence
  Chimeric synthetic DNA from Escherichia coli and Solanum tuberosum
atggtccgtcctgtagaaaccccaacccgtgaaatcaaaaaactcgacggcctgtgggcattcagtctggatcgcgaaaactgtggaattgatcagcgttggtgggaaagcgcgttacaagaaagccgggcaattgctgtgccaggcagttttaacgatcagttcgccgatgcagatattcgtaattatgcgggcaacgtctggtatcagcgcgaagtctttataccgaaaggttgggcaggccagcgtatcgtgctgcgtttcgatgcggtcactcattacggcaaagtgtgggtcaataatcaggaagtgatggagcatcagggcggctatacgccatttgaagccgatgtcacgccgtatgttattgccgggaaaagtgtacgtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaatttgttgatgtgcaggtatcaccgtttgtgtgaacaacgaactgaactggcagactatcccgccgggaatggtgattaccgacgaaaacggcaagaaaaagcagtcttacttccatgatttctttaactatgccggaatccatcgcagcgtaatgctctacaccacgccgaacacctgggtggacgatatcaccgtggtgacgcatgtcgcgcaagactgtaaccacgcgtctgttgactggcaggtggtggccaatggtgatgtcagcgttgaactgcgtgatgcggatcaacaggtggttgcaactggacaaggcactagcgggactttgcaagtggtgaatccgcacctctggcaaccgggtgaaggttatctctatgaactgtgcgtcacagccaaaagccagacagagtgtgatatctacccgcttcgcgtcggcatccggtcagtggcagtgaagggcgaacagttcctgattaaccacaaaccgttctactttactggctttggtcgtcatgaagatgcggacttgcgtggcaaaggattcgataacgtgctgatggtgcacgaccacgcattaatggactggattggggccaactcctaccgtacctcgcattacccttacgctgaagagatgctcgactgggcagatgaacatggcatcgtggtgattgatgaaactgctgctgtcggctttaacctctctttaggcattggtttcgaagcgggcaacaagccgaaagaactgtacagcgaagaggcagtcaacggggaaactcagcaagcgcacttacaggcgattaaagagctgatagcgcgtgacaaaaaccacccaagcgtggtgatgtggagtattgccaacgaaccggatacccgtccgcaaggtgcacgggaatatttcgcgccactggcggaagcaacgcgtaaactcgacccgacgcgtccgatcacctgcgtcaatgtaatgttctgcgacgctcacaccgataccatcagcgatctctttgatgtgctgtgcctgaaccgttattacggatggtatgtccaaagcggcgatttggaaacggcagagaaggtactggaaaaagaacttctggcctggcaggagaaactgcatcagccgattatcatcaccgaatacggcgtggatacgttagccgggctgcactcaatgtacaccgacatgtggagtgaagagtatcagtgtgcatggctggatatgtatcaccgcgtctttgatcgcgtcagcgccgtcgtcggtgaacaggtatggaatttcgccgattttgcgacctcgcaaggcatattgcgcgttggcggtaacaagaaagggatcttcactcgcgaccgcaaaccgaagtcggcggcttttctgctgcaaaaacgctggactggcatgaacttcggtgaaaaaccgcagcagggaggcaaacaatag

SEQ ID NO: 229 - DNA, 1161 bp, Zea mays
atggacgccagcccgaccccaccgctccccctccgcgccccaactcccagcattgacctccccgctggcaaggacagggccgacgcggcggctaacaaggccgcggctgtgttcgacctgcgccgggagcccaagatcccggagccattcctgtggccgcacgaagaggcgcggccgacctcggccgcggagctggaggtgccggtggtggacgtgggcgtgctgcgcaatggcgacggcgcggggctccgccgcgccgcggcgcaagtggcggcggcgtgcgcgacgcacgggttcttccaggtgtgcgggcacggcgtggacgcggcgctggggcgcgccgcgctggacggcgccagcgacttcttccggctgccgctggctgagaagcagcgggcccggcgcgtccccggcaccgtgtccgggtacacgagcgcgcacgccgaccggttcgcgtccaagctcccctggaaggagaccctgtccttcggcttccacgacggcgccgcggcgcccgtcgtcgtggactacttcaccggcaccctcggccaagatttcgagccagtggggcgggtgtaccagaggtactgcgaggagatgaaggagctgtcgctgacgatcatggagctgctggagctgagcctgggcgtggagcgcggctactaccgggagttcttcgaggacagccgctccatcatgcggtgcaactactacccgccgtgcccggtgccggagcgcacgctgggcacgggcccgcactgcgaccccacggcgctgaccatcctcctgcaggacgacgtcggcgggctggaggtcctggtggacggcgagtggcgccccgtccggcccgtcccaggcgccatggtcatcaacatcggcgacaccttcatggcgctgtccaacgggcggtacaagagctgcctgcaccgcgcggtggtgaaccggcggcaggagcggcaatcgctggccttcttcctgtgcccgcgcgaggaccgggtggtgcgcccgccggccagcgccgcgccgcggcagtacccggacttcacctgggccgacctcatgcgcttcacgcagcgccactaccgcgccgacacccgcacgctggacgccttcacccgctggctctcccacggcccggcggcggcggctccctgcacctag

SEQ ID NO: 230 - DNA, 915 bp, Glycine max
atgttggagggacatcaacttttggggtttggcttctttgtaattggtttatggcacttgttcaaccacatcaagctccatgctcttagttccaagtcctacacatcaaccctatggtttcccaccacaatatccagatacttggagctccacttcatcatggcaagctgcacaatcttcattgccatggaactcttcatcgctcccattcatcaccaaccattagaccctgatggaaccattcccaccacccatctccacaactttgaacactcttccatggccatggctttcttggtctatgccatatttgccatagttcttgatagaattaaatgcaccaaagcacagcatgagctaactcacttgctaggagccatagcttttacacaacaatttcttctcatccaccttcactctagagatcacatgggtccagaaggccaataccacttcttgttgcaacttttgattattatttctttgagtacaaccctaatgggaattggcttccctaagagcttcttggtctgctttgtgcgttctgtcagcataatcttccaaggtgtgtggcttatggtcatggggttcttgctttggacaccagggtttcaagccaaaggttgctccatgcaccttgatgagtctgatgaatatgtggttagatgcagtgatcatgagtcccttcatcgtgccatctccttggtgaacattcagttcagcttcttgttgattctagtcaccattttcgccatgtctttctacttgattctggtcagaagatatggtggtgagaaagtggagtatgtttttctgacaaaggaggaacattaccgtgaagaagatggctttgtgaaacctaacaacgacgttgaatcccaatcccaagagaaaagcatgcaagagcagatttag

SEQ ID NO: 231 - DNA, 690 bp, Glycine max
atggcctcagcatcaggggaggcaccaccaccccaacccacttcaacagaagcagctccagcatcaggctcttcagctccagccatatcagcagcagcaccacaacccggaggatcatcgccggcgcctccgagccgctacgaatcgcaaaagcgtcgagactggaacacgtttctgcagtacctacagaaccacaagcccccattaacgctggcgcggtgcagtggcgcacacgtcattgagttcttgaagtacttggaccaattcgggaaaaccaaggttcacatcacggggtgcccgtactacgggtaccccaaccctcctgcgccctgcgcttgcccactgaaacaagcgtggggaagccttgacgccctgatcgggcgactcagggcggcttacgaggaaaacggaggccgccctgagtctaacccgttcggcgccagggccgtcagaatttacctcagggaggtaagagaaggtcaggctaaagcaagagggatcccttatgagaagaagaagcggaagaggaccaccgtggtgatggtgagtagtggtggtggtggtagtagcggtgcagttgcctctccgagtggcggtggtgataccgctattggtggtggagctggttctagtgctagtttaacttcttcagcaactgccacagctaatgatactacaaccacagtatag

SEQ ID NO: 232 - DNA, 933 bp, Glycine max
atgttggagggacatcaacttttgggctttggcttctttgtaattggtttatggcacttcttcaaccacatcaagctccatgctcttagttccaagtcctactcatcaaccctatggtttcccaccaaaatatccagatacttggagctccacttcatcatggcaagctgcacaatcttcattgcctcggaactcttcattgctcccattcatcaccaaccattagaccctgatggaaccattcccaccacccatctccacaactttgaacactccttcatggccatggctttcttggtctatgccatctttgccatagttcttgatagaaaatgcatcaaagctcagcatgagctaactaatttgctaggagccttagcttttacacaacaatttcttctcatccaccttcactctagggatcacatgggaccagaaggccaataccacttcttgttgcaacttttgatcattatttctttgagtacaaccctcatgggaattggcttccctaagagcttcttggtctgctttgtgcgttctgtcagcataatcttccaaggtgtgtggcttatggtcatgggtttcttgctttggacaccagggttccaagccaaaggttgcttcatgcaccttgaggagtctgatgaatatgtagtgagatgcagtgatgatgagtcacttcatcgtgctatctccttggtgaacattcagttcagcttcttgttgattgtagtcaccatttttggcatgtctttctacttgattctggttaaaagatatggtgagaaagtggagtatgtttttctgacaaaggaggaacattacggtgaagaagatggctttgtgaaacctaaagtcactatccaccttgacaataacatccacgttgaatcccaatcccaagagaaaagcatgcgagagcaaatttag

SEQ ID NO: 233 - DNA, 1092 bp, Cucurbita ficifolia
atgacgtttcctacctctgcaatcggatttgaaggctatgaaaagaggcttgaagtatcattctttgagcccggcatttttgctgacccaaggggcatgggccttcgtgctttgtccaaggcacaactagatgaaattctgacattagccgagtgcaccattgttgattctttgtccaatgactatcttgattcatatgtcctttcggagtcgagcctctttgtctacccatacaagttcatcatcaaaacttgcggcactactaagctgcttctgtctattccagctctgataaagttggctgattctctatcccttaatgtgaaatctgtgaggtacactcgtggaagctttatctttcctggtgcccagtcttttccccatcgcagcttctctgaggaagttgctgttcttgatggctacttggccaagcttggcctccatggctctgcttatgtgatgggaagtcctgatgagacaaggaaatggcacgtttactctgcctgtgccaaaatgggtagccgaagctacaatcccgtctatactctggagatgtgcatgactggcttagacaaggagaaggcgtctgtcttcttcaaaacagacacaagttctgctgctgcaatgactgaaaactccggtatcaggaagatccttccgaaatctgatatatgcgactttgagtttgacccatgtgggtattccatgaatgctattgaaggagatgcggagtctaccatccatgtcactccagaagaagggtttagctatgcaagctttgaagcagctggttatgaattggacgacctggacctgtgtaaggtgattgggagggtgctggcatgcttccagccatctgatttctctgttgccctccactcagatgtggtcggtgaggatctgaaagatttactgtgcctggacctgaaggggtacgagggtggagagaagagctgtgaaatgcttggggaaaatggatccgtcatctatcagagctttaagaatagaggagattatgcgtcatctccaaggtcaatcctcatgaaatgctgttggagagaggacgaggcggacgaggaagttgagaagtag

SEQ ID NO: 234 - DNA, 666 bp, Zea mays
atggcgcgccgtgccagcctgctcctcgccgcggcgctcctcgtcgccgtcgctgccgcggcggtgccgccgacgtgcgagcgcatcgagtgcccgccgtacgtggtggtggacagcgccaacgggttcgagatccggcggtacacggacgccatgtggatcaccacggcgcccatcgaggacatctccttcgtcgccgccacgcgcaccggcttcctccagctgttcgactacatccagggcaagaacgcgtacaacgagacgatcgagatgacggcgccggtgctgacgcgggtgtcgcccagcgacgggcccttctgcgcctccgccttcgccgtgagcttctacgtgccggccaagaaccaggcggacccgccgccggccgagggcctgcgcgtggaccgctgggccggggccaggtacgcggccgtgcgccgcttcggaggcttcgtggcggacgccgacgtcggggagcaggcggcgcgcctcgaggccagcctccagggcacccggtgggccgccgccgtcaacgacgcgcgcagggccgacccggcctcgccttacaccgtcgcgcagtacaactcgcccttcgagttcaccggcagggtcaacgagatctggatgctcttcgacgccgccgacgcggacgacgacgccagtatgtag

SEQ ID NO: 235 - DNA, 1377 bp, Zea mays
atggagccgaggcgcatatcggcgagcccgcgcccatgcagcgggcggcgggtagtggccaggaagaggccgaggcaggaggcggtggtgagcagtgtgcggaagctgcagcgccgggagatcagctcccgccgcgaccgcaccttcaccatgagcgccgcgcaggagcgcttccgcaacatacagctgcaggaagagtttgacactcatgatccaaaggagaacgcttcgctactcccttacttgaggaaaaggtcaaaaatcattgagatagttgcagcgcgtgatatagtctttgctttatcacagtcaggagtatgtgctgcttttagtagagagacaaatcggagaatatgctttctgaacggaagtccagatgaagttatccgcagtttattttacaacaagaataatgattcactcattactgtatcagtatatggttctgaaaacttcagtgctctgcgatgcagaacaactcgaatagagtacgttcgacgaggacaaccggatgctggtttccctctttttgagtctgagtccttgaaatggcctggatttgtagagtttgatgatgtcaatggaagggttttgacttactctgctcaagacagcacttacaaggtgtttgatttgaaaaactacacattactgtatttggtgtctgataagaatgttcaagaaataaagatcagccctgggataatgctattgatttatgcaagaacaagcagctcggttcctctgaagattctttccattgatgatggtacagtcttgaagtccttcagccacctcctccatcgtaacaagaaggtagattttattgagcagttcaatgaaaagcttctggtcaagcaggaaggagagaacctccaaatccttgatgtaaggaacttccaattgacagaagtgagcagaactgagtttatgactccatccgcctttatttttctacatgagctgcaactgttcttgacattccggaatcgagcagtatcagtttggaactttcgaggtgaactggtcacgtcatttgaagatcacctgttgtggcaccccgactgcaacacaaacaacatatacatcacaagcgatcaagatcttattatctcatactgcaaggctgactcaactgattcgtcttcagaagaaaatgctggctctataaacataagcagcatactgtccgggaaatgcctggcaaaaataaacactggaaactccaatgcttgcaaggaaagaaagaaggtgtggaagttccggaacacagtctcggaggcccttgaggacatcacggctctgtactacgacgaggatcgcgacgagatctacactggcaaccggcacggccttgtccatgtgtggtcgagctag

SEQ ID NO: 236 - DNA, 450 bp, Zea mays
atggcgcccaaggccgagaagaagcccgccgccaagaagcctgcggaggaggagccggcggcggagaaggccacggcggggaagaagcccaaggccgagaagcggctccccgcgggcaagtccgcaggcaaggagggtggcgagaagaaggggaagaagaaggcaaagaagtcggtggagacgtacaagatctacatcttcaaggtgctgaagcaggtgcacccggacattggcatctcgtccaaggccatgtccatcatgaactccttcatcaacgacatcttcgagaagctggcggcggaggcggccaagctggcgcggtacaacaagaagcctaccattacgtcccgcgagatccagacctccgtccgcctcgtccttcccggcgagctcgccaagcacgccgtctccgagggcaccaaagccgtcaccaagttcactagctcctag

SEQ ID NO: 237 - DNA, 465 bp, Zea mays
atggcgcccaaggcggagaagaagccggcggcgaagaaggtggcggaggaggagccctcggagaaggcggctccggcggagaaggcccccgcggggaagaagcccaaggcggagaagcggctacctgcgggcaagtccgccggcaaggagggcggcgacaagaagggtaggaagaaggcgaagaagagcgtggagacctacaagatctacatcttcaaggtcctgaagcaggtgcaccccgacatcggcatctcctccaaggccatgtccatcatgaactccttcatcaacgacatcttcgagaagctcgccgcggaggccgccaagctcgcccggtacaacaagaagcccaccatcacctcccgcgagatccagacctccgtccgcctcgtcctccccggcgagctcgccaagcacgccgtctcggagggtaccaaggccgtcaccaagttcacctcgtcttag

SEQ ID NO: 238 - DNA, 411 bp, Zea mays
atggcccgcacgaagcagacggcgaggaagtccactggcggcaaggcgccaaggaagcagctggccaccaaggcggcgcgcaagtctgccccggcgaccggcggagtgaagaagccccaccgtttccgccccggcaccgtcgcgctccgggagatccgcaagtaccagaagagcacggagctgctgatccgcaagctgccgttccagcgcctggtgcgtgagatcgcccaggacttcaagaccgacctccgcttccagagctccgccgtcgccgcgctgcaggaggcgtccgaggcctacctcgtcgggctcttcgaggacaccaacctctgcgccattcacgccaagcgcgtcaccatcatgcccaaggacatccagctcgcccgccgtatccgtggggagagggcctag

SEQ ID NO: 239 - DNA, 456 bp, Glycine max
atgagcgacggaggaaaacgacaaggtggaagagcgttgccgccgccgccaagaggccctccgcctcctcccccctctcgccctcgcctcgaacccgtcgatcgcgaaaagacatgtccgttactgctgcgagtgttcactaagattgggagtcaccattccatggaagactttgccgtcagaggcaaagagcccaaagacgaggttcagatttacacctggaaggacgctactctccgagaactcaccgatcttgtcaaagaagttgctccggctgcaaggagaagaaacgccaaactctccttcgcctttgtattccccgacaaaaacggccgtttcaaagttcaagaggtgggcaagacattatcttatggaaatggaagattagatgatggcaaggctttagccgaacttggttttgaaatcggtgactacttggatgtggctattctgtag

SEQ ID NO: 240 - DNA, 378 bp, Glycine max
atggcgaagttcaatgtggtgcagaagaaaagaagagctctaatagcagagaagaagagacagcttcacggagaccctttaaccggcaagctcaagatcaaggaccaacccctttccctatccggaaaacgcaaacgcaagctcttcaaaaaatggcgccgggaccaaaaggacgccttgcagaatggtttggtaaccatggaagatgttcaaatggcagttgctgaaggggataccaaagatgcccctagaccttcagcaaaaattcacttgaagaagaagacattgaaacttaaacaactcaagcgcaaagggaagaacaaaagaaaatctgatgtgcctgctgctgatgtttcagccgatgcaatggtggaatag

SEQ ID NO: 241 - DNA, 375 bp, Glycine max
atggcgaagttcaatgtggtgcagaagcgaaggagagctctaatagcagagaagaagagacagcttcacggagaccctttaaccggcaagctcaagatcaaggaccaacccctttccctatccggaaaacgcaaacgcaagctcttcaaaaaatggcgccgggaccaaaaggacgccttacagaatggtttggtaaccatggaagatgttcaaatggcagttgctgaaggggataccaaagatacccctagaccttcaccaaaaattcacttaaagaagaaggccttgaaacttaaacagctcaagcgcaaagggaagaacaaaagaaaatctgatgtgcctgctgatgtttcggctgatgcaatggtggaatag

SEQ ID NO: 242 - DNA, 2874 bp, Klebsiella oxytoca
atgacaaaacctgtattagtgctggtcggacacggtatggtcggccaccattttcttgagcaatgcgtcgaccgtcgccttcatcaacggtatcggattgtggtgttctgcgaggaacgctatgccgcctacgaccgggttcatctgactgaatatttcaccggacgcagcgcagaatcgctgtcgctggttgagggcgattttttcgctcagcacggtattgagctgcgcctgagcgaatcggtcgccagcatcgaccgcgaagcgcgggtggtgcgcgatgccttcggccacgaaacccactgggataagctggtgctggcgacggggtcttacccgtttgttccgccggtgccgggtcatcatctcgagggctgttttgtttatcgtacgcttgacgacctcgaccagattgccgcccgcgccgcaaccgcccgacggggtgtggttatcggcggcgggctgctcgggctggaagcggccaacgcgctgaagcagttggggctggaaactcacgttgtcgagtttgcgccgaacctgatggcggtgcagctggacaacggcggcgcggcaatgctgcgagaaaaaatcagtcaactgggcgtcggggtgcataccagcaaggcgacgacggagattgttcgcaacgaacaggggctacagctgaactttgccgacggtagctcgctggcggccgatatgctggtgttctccgccggtattcgcccgcaggacaggctggcgcgcagcggcgggctggaagtgggcgaacgcggcgggatttgtatcgacaaccagtgtcgtacctccgacccggacgtgctggcaatcggcgaatgtgccctgtgggagaacaaaatttatggtctggtggcgcctggctatcagatggcgcgcgccgcagcggctaccctggcgggcgaggaaggctgctttagcggcgcggatatgagcactaagctgaagctgctgggcgttgatgtcgcctcgttcggcgacgcccaggggcgcaccccgggctgtcagagctatcagtggaccgatgggccgcagcagatctacaaaaaaattgtagtcagcgcggagggcaacaaactgctcggcggggtgctggtcggggatgccagcgactatgccacgctgctacagatgatgcttaacggtatggctttacccaatcacccggaaagcctgatccttccggcgctggagggcagcgcgccaaaagcgctcggcgtggcggcgttgccggacagcgcgcagatttgctcctgtcacaacgtcagcaaaggcgatatctgccaggtggtgaacggcggcgcgggcgatatggcggcgataaaaagctgcaccaaagcggcgaccggctgcggcggctgtagcgcgctggtaaaacaggtgatggagtatcagcttgccgagcagggcgttgaagtcaaaaaggatatctgcgagcattttgcgtggtcgcggcaggagatctatcacctggtacgcgtcaaccatattcgcaccttcgaacagcttattacccgctatggacgcggtcacggctgtgagatctgtaaacctctggcggcctcggtgctggcctcctgctggaatgaatatctgctgaagccggcgcatttgcctcttcaggacactaacgaccgctacttcgccaatattcagaaagatggcacctattcggtggtgccgcgtatggcggcgggagaggtgacgccggacgggctgattgcgatcggccagatcgccaaacgctatcagctgtacagtaaagtgaccggcggccagcgtatcgatctgttcggcgcgcgcctggagcagctcccggcaatctggcgcgagctggccgaggcgggatttgaaaccggccacgcctacggcaaatccctgcggacggtgaaatcctgcgtgggttcaacctggtgccgctatggcgtccaggattccaccggcctggcggtaaccctcgaacatcgctataaggggctgcgcgcgccgcacaaaattaaaatggcggtctccggctgtacccgcgaatgcgcggaggcccagagcaaggatattggcatcatcgctacggagaagggctggaatctgtacgtttgcggcaacggcggtatgaagccgcgccatgccgacctgttcgccagcgatctggatgaagccacccttatccgcagtatcgaccggctgctgatgttctatattcgtaccgccgaccgtctgcagcgtaccagtacctggatggataatcttgagggaggcgtcgactatctgcgcgcggttatcctcgaagacagccttggcatcggcgaagagctggagcaggagatggcgcgggtggtcgagagctaccagtgcgaatggcaaaccacccttaacgatccgcagcggctggcgctgttccgctcctacgtgaacagcgatgagccggacgaagcggtgcagcggcaaaccctgcgcggccagccgcagctggccccgttcgcggcgcaggccgaaccggcgctgccgtcccgcccgtggcaggccatttgcgatctcgacgccatcccgcagcaggcggggattggcgcgcggctcggcgagcggcagattgcgctgttccgctttggcgatcaggtatatgccctcgataatcttgaaccgggcagcgaggccaacgttctttcgcgcggcctgctgggcgatgcgggcggtgaaccgatcgtgatttcgcctctgtataagcagcgtattcgcctgcgcgatggccgccagtgcgacgacggcgaactggcggtacgcgcatggccggtaaaagtggagaacggtaaagtatgggttggcaaccagcagctgctggcgcgcgcggaggcctcctag

SEQ ID NO: 243 - DNA, 1905 bp, Zea mays
atggacggatgcgattgcattgagccactatggcctaccgatgatcttctcgtcaagtatcagtacatctcagacttcttcatagcccttgcgtacttctcgattccattggagctcatatattttgtgaagaagtcgtccttcttcccatacagatgggtcctgatccagtttggtgcgtttatagttctttatggggcaacccatctgataaacctgtggacgttcaccacacatacaaagaccgttgcgatggtcatgaccatagcgaagatttctacagcagtcgtgtcctgtgcaactgctttgatgctcgttcatatcattcccgacttgttgagcgtgaaaactagggagttgttcttgaagaataaagctgaggagcttgatagagagatgggacttataaggacgcaggaggagactggtagacatgttaggatgcttacacatgaaatcagaagtactcttgatagacatacaattttgaagactactctcgttgagctaggaaggaccttgggtctggaagaatgtgcattgtggatgccatctcgaagtggctcaagccttcagctttctcatactttgcgccaccagattactgttggatcatcggtgccaatgaatcttcctgtcgtcaatcaagtgttcagtagcaaccgggcaatcataataccccacacatcttctttggcgcgggttcgacctcttgcagggcgatatgttccgccagaagtggccgcagtccgtgtacctcttctacatctttcaaactttcaaataaatgattggcctgagctctcagcaaaaagctttgcaatcatggttttgatgcttccatctgatagtgctagaaaatggcatgtgcatgaattggagctggttgaggtcgttgctgatcaggtagcagttgcactatctcatgcagctattcttgaagagtccatgcgggcacgtgatttactaatggagcagaatgttgccctggatttagctcgaagagaggctgagatggctatccgtgctcgcaatgatttcctagctgttatgaatcacgaaatgagaacacccatgaatgcaataatagccctttcctccttgcttttggaaactgagcttactcctgagcagcgtctaatggtggaaacggtactgaaaagcagcaatttgttagcaacactcatcaatgatgttctggatctttccaaactcgaggatggaagccttgaactggagattaaagcattcaatcttcatgctgttttcaaagaagtgatgggtttcattaaaccaattgcatctatcaagaggctatctgtatcggttatgttggcaccagatctgccattatgtgcaattggtgatgaaaagagactcatgcaaactattctgaacatctctggcaatgctgtaaagtttaccaaggagggacacatcacgcttgtagcttccattgtgaaggctgactctttgagagagttcagaaccccagaatttcatccaactgcaagtgatgaacatttctatttgaaagttcaggtaaaagatacaggctgtggagttagtcctcaggatctaccccatgtattcacaaagtttgctcatcctcaaagtggaggaaaccgagggtttaatggtagtggtcttggccttgccatatgcaagaggtttgttagtcttatgggagggcacatctggatcgacagcgaaggaaccggaagaggttgcaccgcaacattcgtcatcaagctcggcgtgtgtgacaacacaaacacctaccagcagcagctggttcctctagtctggccaagcagtgcagactccaatttgtctgctccgaaagtgctgcccgacgggagaggatctgtttccctgaaatcccggtaccaaagaagcgtatag

SEQ ID NO: 244 - DNA, 2601 bp, Klebsiella oxytoca
atgacggaaaccagaaccacgtgcccctattgcggggttggctgcggcattatcgccagcctgaatgccgacggccaggttaccgtacgcggggatgaacaacatccggcaaactttggccgcctgtgcgtgaagggggcggcgctgggcgaaaccgtcgggctgacgggaagattgctcttcccggaagtcgatggcggtcgcgcgacctgggcccaggcgctggcagcggcgggttcgcgtctgcgggagattatcgacgagcacgggccgcaagcggtggcgttttatgcctccggccagctgctgaccgaggattactacgtggccaataagctgatgaaggggtttatcggcgcggcaaatatcgatactaattcacggctgtgcatgtcttcagcggtcaccggctacaaacgggcgctgggcgctgatgtggtgccgtgcagctatgaggacgtggaaaacagcgatctggtggtgctggtcgggtcgaacgccgcctgggcgcatccggtactctatcagcggctggcgcaggcgaagcgcgacaatccgcaaatgcgggtggtggtcattgatccgcgtcggaccgccacctgcgatattgcggaccggcatctggcgctggctcccggcagcgacggcgggctatttgtcggcctgttgaacgccattgccgcccgcgacgtcatctgcggcgattttagcgatgcgccgcaggcgctggccatcgcgcaggactgggatatcaaccacgtcgcgcagttctgcggcctgccgcgacagcagatcgccgatttctacagcgagtttatcgccgctccccgcgccatcacgctctataccatggggattaaccagtccgccagcggcagcgataaatgtaacgctatcattaacgttcacctggcgagcggtaaatatgggcgtccgggctgcgggcctttttcgctgaccggacaacctaacgccatgggcggacgcgaggtgggcggactggcgaccatgctcgcgtcgcatatgaactttgaaaccgacgatttacggcgtctggcgcgcttctgggggaccgaacgtctggcgcaaacgccggggctggcggcggtggatctgttcgccgccattggccgcggcgaggtgaaagcggtgtggattatgggcaccaacccggtagtgtcgctgccggacagccatgtggtaagcaaagcgctggcggcctgtccgctggtcatcgtgtccgacgtcgccgccgctaccgataccggacgctttgcccatattcgctttcccgcgctggcgtggggagagaagagcggcacggtaaccaactccgaacgaaggatctcacgccagcgcgctttcatggcgccaccgggggaggccagagccgactggtggatcgtcgcccgcgtggcccaggcgctgggcttcggctccgcttttgcctggcagcacccgcacgaggtgttcagcgaacacgccgcgctttcaggatatgaaaatgatggccagcgggcatttgatatcggcggactggcggatctcagccgcgaagcgtgggaggcgctggaaccggtgcgctggccggtgagccgcagtcaggcaagctgggatttgctcaaggggtggcaccgcagcggcaaattgcgcatgatcccggtgaccccgcagcccactcgggcggtcaccgatgcgttctatccgctgatcctcaacagcgggcggatccgcgatcagtggcacaccatgacccgcaccggcgcggtgccgcgtctgatgcagcatattaacgagccggtggtggaagtcgcgccagcggacgcgacgcgctatcagctgctggaaggcgaactggcgcgggtgcgctcaccgaatggggtgatggtagcaaaagtgattgtcagcaatggccagcgtcccgggtcgctgtttgtgccgatgcactggaatgatcagtttgctcgccagggacgggtgaataacctgctgtctgcagtcactgacccgcactccgggcagccggaaagtaaacaggcggcagtggcgatagctgcctggctaccagcgtggaaaggcgagcttttttctcgcttgtcggttccgctacccgcttcactacactggcggcggcgggcatcgcagggaatcattcatctttcgctggcgggggatatcgcctcccgcgagtggcttattgagtggtgccagcgaaaagggtggcaactacagacagccaaaggcggtagcatctggaacctgctggcgtggcagggggaagagctgatgctcggctggtggagcgatgtcaacgaaccgcgcgtggatgccgagtggattagcgccgcgtttcgcagccctccgccgaatgctacccagcgtcacgcattattgagcggcagaaagggtagcgatgaggtaccgcgcggacgcattatctgtagctgctttagcgtgggcgaacgggcgatagacgaagcgattgctactggctgccgtacgcccgccgcactgggagcaaagctcaaatgcggcaccaactgcggctcttgtatcccggaacttaaggcgctgctggcggcgaagctggcgcaggcctag

SEQ ID NO: 245 - DNA, 2064 bp, Arabidopsis thaliana
atggagtttctcggcgacagtcaaaatcacgatagctctgaaacagagaagaagaacaagaagaagaagcgatttcaccgtcacacacctcaccagatccaacggcttgaatcaactttcaatgagtgtcaacatccagatgagaaacagaggaaccaacttagtagagagttgggtttagctccaagacagatcaagttctggtttcaaaacagaagaactcaaaagaaggcacaacacgaaagagctgataattgtgcattgaaagaagagaatgataagattcgatgcgaaaacattgctattagagaagctattaaacacgccatttgccccagctgtggtgattctcctgttaatgaagactcttactttgatgagcaaaagcttcgcatcgaaaatgcacagcttagagatgagctcgaaagggtttcgagtattgcagctaaattcttaggaagaccaatctcccatcttccaccattactaaatccgatgcatgtttcgccattagagttattccataccggaccttcacttgattttgatcttctcccaggaagttgttcttcaatgtctgttccaagtttaccatctcagccaaacttggttttatcagagatggataagtctcttatgaccaacattgctgtgaccgctatggaagaattgcttaggcttcttcaaacaaatgagcctctgtggatcaaaactgatggatgcagagatgttctcaatctcgaaaactatgagaatatgtttacaagatcaagtactagtggtggaaagaagaataaccttggaatggaagcatctagatcttctggtgttgttttcactaatgctattacacttgtggacatgcttatgaactctgtcaaattaacagagctttttccctcgatcgttgcatcatctaaaacccttgcagtgatttcatcgggattgcgtggaaaccatggagatgcattgcatttgatgattgaagagcttcaagtgctttcaccattggtaacaacgcgtgagttctgtgtgctaagatattgtcagcaaatcgaacatggaacttgggcaatagtaaatgtctcatatgagtttcctcagtttatatctcaatctcggtcatatagatttccttctggttgcttgatccaagatatgtccaatggctattcaaaggttacttgggtggaacatggtgaattcgaggagcaagaaccgatacatgagatgtttaaagatatagttcataaaggattagcttttggagctgaacgttggattgctactctccaaagaatgtgtgagagattcacgaatctattggaacctgcaacatcatcccttgatcttggaggagtgattccatcgccagaagggaagagaagtataatgagacttgctcacagaatggtaagcaacttctgcttgagtgttggcacatctaacaacactcgctcaacggttgtctcgggactggatgaatttggaatccgtgtgacttcgcataagagcagacatgaaccaaatggaatggttctatgtgcagccacaagtttctggctccctatttctccacaaaacgtcttcaatttcctcaaagatgagagaactcggcctcagtgggacgttctttcaaatggaaactctgttcaagaagttgctcatatcacaaacggatcaaatcctggaaactgcatatctgttcttcgtggattcaatgcatcatcatcacaaaacaacatgttgattctacaagaaagctgcatagactcatcaagtgcagcgcttgtgatctacactccagtggatctaccagcgttgaacatagcaatgagtggtcaagacacatcttatattccgatattaccctcaggttttgccatttcaccagacggaagcagcaaaggaggaggatcattgataacggttgggtttcagataatggtgagtggtttgcaaccggcaaaactgaacatggagtcaatggagacagtaaataatctcatcaataccactgtccaccaaattaaaacgaccttgaattgtccttcaactgcttag

SEQ ID NO: 246 - DNA, 2670 bp, Zea mays
atggcgaagtcgagcgcggacgacgccgagctgcggcgcgcgtgcgccgcggccgtggcggcgtcaggcgcgcgcggggaggaggtggccttctccatccgcgtcgccaagggccgcggcatcttcgagaagctcggcaggctcgccaagccccgtgtcctcgcgctcaccgttaaacaatcatcaagaggcgaggcgaacaaagcttttctccgagtattaaaatattcatctggggcagtgctcgagccagccaaactttacaagctgaaacatctaacaaaggttgaggttatttccaatgatcccagtggttgtacatttgttctgggatttgataaccttaggagtcagagtgttgccccgcctcaatggacaatgcgtaacattgatgacagaaatcgtctacttttttgtattctgaatatgtgcaaggagatactcagttatcttccaaaagttgttggaattgatattgtggagctagctctttgggcgaaggaaaacacactgaccatagataatcaagtgagtacccaagatggtcaagaaacatcagttgctactcaaaccgagaggaaagtaacagtaactgttgaaaatgatctcgtgtcccaagcaaaagaggaggaagaagacatggaggcacttcttgacacgtatgttatgggaataggtgaagcagatgcattctctgagagattgaagcaggagcttgtggctttggaggctgcaaatgtatatcaattactggaaagcgagcctttaatagaagaggtcttgcagggtctggatgctgctagtgcaactgtagatgatatggatgagtggttacggattttcaatctgaagctgaggcacatgagagaagatattgcatcgattgaatcacgtaacaatggcttggagatgcagtctgtaaacaacaaagggcttatggaagagctagataaattgcttgagcgtctgcggattccacaagagtttgcagcatcattaactggaggctcatttgaagagtcacggatgctgaaaaatgttgaggcatgtgaatggttgacaggggccattcgcagtcttgaagttcctaatttggacccatgctatgtcaacatgcgcgctgttagagagaaaaaggcagagctggagaaactgaaaacaacttttgttcgacgagcatcagagtttttgcggaactacttctccagtttggtagacttcatgatcagtgacaaaagctacttttcacagcgtggacaattgaagcggcctgatcatgcagaccttaggtataaatgcaggacatatgcccgacttctgcagcacttaaagagtctggacaagagctgcttaggtcccttaaggaaggcatactgtcattcccttaatttactactacgacgagaggcacgtgaatttgccaatgaacttcgtgcaagtacaaaagcaccgaagaatcctgctgtttggcttgaaggttctggcggctctggtcataatggaagcagttctgatacttcacaggtctcagatgcatactcaaagatgcttacaatatttatcccgcttcttgtggatgagagttccttttttgcacattttatgtgctttgaagtacctgcacttgttccagctggttctcctaatgctaataagagcaaatccggaggaaatgacccggatgatgatctgggtcttatggatccagatggcaacgatctgaaacctgatagtacctctgctgaactgggtacattgaatgaagctcttcaagaattactcgatggaatccaggaagacttctatgcggtcgtagattgggcttataaaattgaccccttgcgttgcatctcaatgcatgggattacagagcgttacctttctggacagaaagctgatgctgcaggatttgttcgcaaactacttgatgacttggaatcaagaatatcagtacagttcagccggtttattgatgaagcatgccatcaaattgagcgtaacgaaagaaatgtgcggcaaactggaattctagcctacattccaagatttgctgtccttgcatcacgtatggaacaatatatccaagggcagtccagggatttaattgataaagcatacacaaagctagttagcacaatgttcgcaactttggagaaaattgcacagagtgatcctaaaactgctgatattgtgctgattgagaattatgctgctttccagaacagtctttatgacttggctaatgttgtgccaacgcttgcaaagttctaccatcaagccagtgaatcatatgaactagcttgcactcgccatatcagctcactcatttatctgcaatttgagaggttatttcaattcaaccggaaagttgacgaattgacttacactattgctgctgaggagataccgtttcagctgggattatcaaaaactgacctaaggagggtactgaaatccagcttatctgggattgataagtcgattagcgccatgtacaggaggttgcagaagacacttacctccgatgagttgtttccttcgctgtgggacaagtgcaagaaggagtttttggacaaatacgagagttttgttcagatggtgacacggatatatgggaatgagccgatcatgtcagtcaacgaaatgaaagacgtccttgctggtttttag

SEQ ID NO: 247 - DNA, 1506 bp, Zea mays
atgccgccgcgcacggctccggcggcgacctcaaccccgccgcggaaggtgcccctccggaagctgctgcgtgcggcgtcggtcgcctgcggggtgcagttcggctgggcgctgcagctgtcgttgctgaccccgtacgtgcaggagctgggcatcccgcacgcctttgccagtctcgtctggctgtgcggtccgctgtccggcctcctcgtccagcccctcgtcggccacctctccgaccgcatcggccccgccgcttcgccgctcgggcgccgcaggcccttcatcgccgccggcgccgcgtgcatcgccgcagccgtgctcaccgtcggcttctccgctgacctcggccgactcttcggcgacgacgtcaccccgggctcaacgcgcctcggcgccatctgcgtctaccttgtaggattctggctgctcgacgtgggcaacaacggcacgcaggggccctgcagggcgttcctcgccgacctcacagagaatgacccaaggaggactcggatcgctaatgcatacttttcactcttcatggccctgggaaacatacttggatatgccaccggagcatacagtggatggtattcgatatttcctttcactgttacagagtcctgcggcatcagttgtgccaaccttaagtctgcctttcttcttgacattattgttctggtcatcacaacgtacactactgtaacatccgtgcaagaacctcaaacttttggaagtgatgaagcacaaaatccaggtgctgaacaggaagctttcctctgggaactttttgggtcattaagatacttcaccctaccaatttggatggtcttaattgtcactgcccttacttggatggcatggtttccttttaccctctttgatactgattggatgggccgagaaatctatcgaggaagcccagacaacccaggagagacccaaaggtaccatgatggtgtgagaatgggttcttttggtctaatgctcaactctgtcgtccttggattcacctctgttgtgctagaaaagttatgtaggaagtggggagctggacttgtatggggtgtctccaatattctaatgactttgtgcttcttggcaatgcttgtaataacatatgttgcaaagaacatggattatccatccagtggtgcacctccgactggcattgtcgttgcttctttggtggtttttacaattttaggggcacccctggcgatcacatacagtataccatatgcaatggctgctagtcgtgttgaaaatctcggtcttggccaaggcctagcaatgggtattctcaatttagctattgtcataccacaggttattgtgtcacttggcagtggcccatgggatcagctgtttggcggtggaaatgcacccgcttttgcggtggcagccggtgcatctttcatcggtgggctggtggctattctggggcttcctcgggcacgcattgcatcctcgtcctccaggaggagaggcgggacacaccgatag

SEQ ID NO: 248 - DNA, 1188 bp, Zea mays
atggagagatctcaacggcagtctcctccgccaccgtcgccgtcctcctcctcgtcctccgtctccgcggacaccgtcctcgtccctcccggaaagaggcggagggcggcgacggccaaggccggcgccgagcctaataagaggatccgcaaggaccccgccgccgccgccgcggggaagaggagctccgtctacaggggagtcaccaggcacaggtggacgggcaggttcgaggcgcatctctgggacaagcactgcctcgccgcgctccacaacaagaagaaaggcaggcaagtctacctgggggcgtatgacagcgaggaggcagctgctcgtgcctatgacctcgcagctctcaagtactggggtcctgagactctgctcaacttccctgtggaggattactccagcgagatgccggagatggaggccgtgtcccgggaggagtacctggcctccctccgccgcaggagcagcggcttctccaggggcgtctccaagtacagaggcgtcgccaggcatcaccacaacgggaggtgggaggcacggattgggcgagtctttgggaacaagtacctctacttgggaacatttgacactcaagaagaggcagccaaggcctatgaccttgcggccattgaataccgtggcgtcaatgctgtaaccaacttcgacatcagctgctacctggaccacccgctgttcctggcacagctccaacaggagccacaggtggtgccggcactcaaccaagaacctcaacctgatcagagcgaaaccggaactacagagcaagagccggagtcaagcgaagccaagacaccggatggcagtgcagaacccgatgagaacgcggtgcctgacgacaccgcggagcccctcaccacagtcgacgacagcatcgaagagggcttgtggagcccttgcatggattacgagctagacaccatgtcgagaccaaactttggcagctcaatcaatctgagcgagtggttcgctgacgcagacttcgactgcaacatcggatgcctgttcgatgggtgttctgcggctgacgaaggaagcaaggatggtgtaggtctggcagatttcagtctgtttgaggcaggtgatgtccagctgaaggatgttctttcggatatggaagaggggatacaacctccagcgatgatcagtgtgtgcaactag

SEQ ID NO: 249 - DNA, 2304 bp, Zea mays
atggtggtgggaacggcactgctgcgcggggtttcctccgcgtggatcctcctgttcctctcctccctgctcctctcgccgtcagcggcgtctgtcgatttcggccactgcggcggctgcgacgacgcggacgacggcgccctctccagcacctataacatcctgcaatgccagaaggtcagcgacttcctcatcgccgcggcctacttctccatcccgctcgagctgctctacttcgccacctgctccgacctcttccccctcaaatggatcgtgctgcagttcggcgccttcatcgtgctctgcggcctcacacacctcatcactgtgttcacctacgagccgcactccttccacctcgtactcgcccttaccgtcgccaagttcctgacggcactggtctccttcgcgacggccatcaccctgctgacgctgataccacagctcctgagggtgaaggtcagggaaaacttcctgatgaacaaggcgcgtgagctggaccgggaggtggggaggatgaaaaggaaagaagaggcgagctggcatgtgcgcatgctcacacaggagatccgcaagtcgctcgacagacataccatcttgtacaccaccatggttgagctctcgaaggcactggaactgcagaattgtgctgtctggatgcctgatgagaccaggagcacgatgatcttaacacatcagctgagggaaagggatataatggacccacagaaacactcgattcctattgatgatccggatgttcaagaaataaaggcaaccaaggatgcaaaagttcttggcccagattcggcgctaggggtttctagccgaagcaagcatgaagcagggcctgtggctgcaataaggatgccgatgttaagggtgtcaaatttcaaaggagggactccggaagtgatgcagacgagctatgctatcttggttctggttttgcctaatgatggttcattagggtggggtcgaagagagttggagattgttgaggtagttgctgaccaagttgcagtcgctctgtcacatgctgcactcctagaggagtctcagctgatgcgagagaagcttgccgagcagcatagggacttgctgcaggcaaaggatgaagccatgagggcaggggacgctaggaattccttccagactgcaatgtacgatggaatgcgaaggccaatgcactcaatccttggtctcgtctcaatgatgcaacaggagagcatgaatccagagcaaaggcttgtgatggatgccattgccaagacaagcagtgttgcatccacactgatgaacgatgtgatgcaaacatcgacaatgaactgtgagcacttgtctttggtcaggaggccgttcaaccttcattccttcattaaagaagttgttggagtggtcagatgtctaactggttgcaagggtgtggagtttgagtttcaagtggagaattctttgccagaaaggatcattggtgatgagaagagagtcttccatattgtcctgcacatggtaggcactctaacagaccgatgtaatgctggctgtatctcattatatgtaaatgtccataatgaggttgaagataggcataatcatgactggatgctgcgaagagcaaacttctctgggggctatgtatgtgtgaaatttgagattaggattagaaaatcaaagggctatctgttgagttcatcaagcagtcagataagtcagggatccaaacccaacaattctgagatggggcttagcttcaatatgtgcaagaagattgtgcagatgatgaatggcaatatttggtcagtatcagattctaaaagcatcggagaaactatcatgctagtcctccagttccagttggaacctgtgactccggtctctggagcgtcctcagatttgtacagatcatccgcaattcccaactttaatgggctcagagtcctccttgcggacagcgactgcaccaaccgagctgtaactcacaggctcctagagaagcttggttgccgagtcctttcggtcgcttctggcgtccaatgcatcagctccttcgctgcggagtcgtccttccagctggtggttcttgatcttgacatgcagacgatggatggattcgaagtagcccgcgcgatcaggaagttcagtagcaatagttggctgccgttgattattgccctagcagcaagaatcgacgacaacatccgggatcgttgccagaggtcaggagtaaatggcctgatccagaaaccggtcacattagccgcgctgggagatgaactgtatagagtccttcagaacaattag

SEQ ID NO: 250 - DNA, 1398 bp, Zea mays
atgctgctttctgtgcctatccagatggctatgaatccttcatttcgattccgagcgaagcagcactgataatgacgttcagtctgcatacgattcgcttgcttttgcttcggcacgaagcagccctgataaatgacgcccctgcttgttttctgtgtctgaaattctgctgttgcctgactttgttgttgagccagagactgggaccttcaaagagcaataggactcatggaggttggagacgcaagaaacggttctgcagcagcggcactgacaaagggaagtgcggatgatgccgcccgcaaaccgctccctccttgctgcgtcaaggccaaggcgcgtgtgcctgaaaccgaggccaactgccatgatactgtggtttcagggtggttcacggaacccagatcgcgttttggtaaaacaagcaaagtgcagtacttcaataacccgatgtggcctggagaggctcattcattgaaagtggagaagatcttgtttcaagggaaatcgccttaccaagaaattttagtttttgagtcttcaacctatggaaatgttcttgtgcttgatggtatagttcagttgactgacaaggatgaatgcgcataccaggaaatggttactcaccttccactgtgctcaattcctgcaccgaagaatgttttggttgttggaggtggtgatggtggtgtactgcgcgaaatagccagacatgattcagtggaaactattgatatatgtgagattgatcaactagttattgatgtttgcaaagaattctttccaaacttatccattggattcaaagatcctcgtgtccgacttcatgttggtgatgctgttgatttcctgaggaattctcccgaaggaaaatatgatgctattattgtagattcatcagatccaattgggccagcacaggcactcgtggagaaactgtttattcagacaattgctagagctttgaagcctggtggtgttctttgtaatcttgctgagagcatgtggctgcacacacatctaatccaggatatgcttgctatctgtcgacagacattcaaaggtgctgtgcactatgcctggacaagtgttccaacatatcccagtggtgtcattggatttttgctatgtgcaaaagaaggtcgtgcagtgaacttcttaactcctgtgaatccaattgagaaaatagaaggaacaacaaaagctggaagggaactcagattttacaattccgagatccatagggctgcttttgttctgccaacatttgtaagaagagaactggaagcatataccactcctagtacctctgctgaaaacgagaaaccgaaagaatcggtgtcagaaccgcagaagataaagatattgtcaaacaacgccattcttacagcttcctag

SEQ ID NO: 251 - DNA, 522 bp, Zea mays
atgtccaggtctgtggagcctctcatagtcgggcgggtgatcggagaagtcctcgactccttcaacccgtgtgtgaagatgatagtgacctacaactccaacaaactcgtgttcaatggccatgagatctacccatcagctgttgtgtccaaaccaagggtggcggttcaagggggcgatttgcggtctttcttcacattggttatgacagacccagatgttccaggaccaagtgatccatacctaagggagcaccttcattggatcgtgactgatatacctgggacaacagatgcctccttcgggcgacagatcataagctacgagagcccaagacctagcattggtatccacaggttcatttttgtgctcttcaagcagcagggtaggcaaaatgtaactgtgccatccttcagagatcatttcaacacccggcagttcgctgaggaaaatgaccttggcctccctgtagctgccgtctacttcaatgcacagagagaaactgcagctaggagacgttag

SEQ ID NO: 252 - DNA, 472 bp, Zea mays
atgtccaggtctgtggagcctctcatagtcgggcgggtgatcggagaagtcctcgactccttcaacccgtgtgtgaagatgatagtgacctacaactccaacaaactcgtgttcaatggccatgagatctacccatcagctgttgtgtccaaaccaagggtggcggttcaagggggcgatttgcggtctttcttcacattggttatgacagacccagatgttccaggaccaagtgatccatacctaagggagcaccttcattggatcgtgactgatatacctgggacaacagatgcctccttcgggcgacagatcataagctacgagagcccaagacctagcattggtatccacaggttcatttttgtgctcttcaagcagcagggtaggcaaaatgtaactgtgccatccttcagagatcatttcaacacccggcagttcgctgaggaaaatgaccttggcctccctgtag

SEQ ID NO: 253 - DNA, 1479 bp, Arabidopsis thaliana
atgagtgacctccaagcaaacaaagatgcggcggctgtgaatagacagtcttcctcgtcgtcggcggatcttaatgggccatctccgatgagaaagatgatatcggtggcttctattgccgccggtattcagttcggttgggctcttcagctgtctctgctaactccatacgtgcagcttcttggagtcccacacaaatggtcatctttcatatggctctgtggtcctgtctccggcctgcttgtccagccatccgtcggttacttcagcgaccgatgcaagtcaagattcggtcgtcgtcgtcctttcatcgctatgggcgccttacttgtcgccgttgctgtcgtactaatcggatacgcggctgatttcggtcacagcatgggagacaaagtcgacgaacctgtcaagatgcgagccgtagttatcttcgctctcggtttctggatccttgacgtggctaacaacactctccaaggaccttgccgcgcattccttggtgatttagcagctggagacgctaagaaaacacgaacagcaaacgcatttttctccttcttcatggctgttggaaatgttttgggatatgcggccggatcgtacactaacctctacaagatcttccctttcacaatgactaaagcatgcgacatctattgcgcaaatctcaagagctgtttcttcctttccatcactctcctcctagtcgtcaccatcatagctctttggtacgtggaagacaagcaatggtcgcctaaggcagattccgacaacgagaaaactccattctttggtgaaatctttggagctttcaaggtgatgaaacgtccaatgtggatgctattaatcgtcacggccttgaactggatcgcatggttcccttttcttttgtacgatactgattggatgggtcgtgaggtgtacggtggagactcaaaaggagatgacaaaatgaagaaactatacaaccaaggaattcacgttggtgggttgggattgatgcttaactctatcgttcttggattcatgtcacttggtattgaaggtattagtaggaaaatgggaggagctaaaaggctttggggagctgtgaatatcatcctcgccgtgtgtttggcaatgacggttttggttactaaaaaggcagaggagcaccggagaatcgccggtccgatggcccttcctactgatggcatcagagctggagcattgactctctttgcccttcttggaattcctcttgctattacatttagtattccgttcgcgctagcttccataatctctagcagctccggtgccggtcaaggactctctctaggcgttttaaacatgacaatagtgataccacaaatggttgtatcatttggagttggtcctattgatgcgttatttggaggtgggaatttaccaggatttgtggttggagctattgcagcggcaatcagcagtgttgtggcatttaccgttttaccttag

SEQ ID NO: 254 - DNA, 600 bp, Triticum aestivum
atgtcgccggcgacttcttccgcggtgggtaccctatccggcggcctcctcccccacggtgcacatcgccggcgacccttgccaaccgcccgcctcctcccgccgcgttggtctaggctccaggtcaacgcggcccgtcatcgccgcctggccactcccccgcgcgcccagagcgctccctccccagggtacctgccggactcggagttctacaagatcgaggccatcctgaggccatggagggtgtcgcatgtctcgtcgggtttgctagaaatggggatcagaggtgtgacggtgtccgatgtgcggggctatggggcgcagggcgggtcgacggagcggtacgaagggtcagaattttcagaagatacatttattgctaaagttaaaatggaaatagtcgtgtgcaaggagcaggttgagccagtaattgacaaaataattgagaaggccagaactggagaaattggtgatgggaagatattcttgatacccgtcgcggatgttgtaagggtacgcaccggcgaacgcggagtgcatgcggagaggatgatcggcggtctgtcagacaaactgcctccggtgatcacaatctcatga

SEQ ID NO: 255 - DNA, 2874 bp, Klebsiella oxytoca
atgacaaaacctgtattagtgctggtcggacacggtatggtcggccaccattttcttgagcaatgcgtcgaccgtcgccttcatcaacggtatcggattgtggtgttctgcgaggaacgctatgccgcctacgaccgggttcatctgactgaatatttcaccggacgcagcgcagaatcgctgtcgctggttgagggcgattttttcgctcagcacggtattgagctgcgcctgagcgaatcggtcgccagcatcgaccgcgaagcgcgggtggtgcgcgatgccttcggccacgaaacccactgggataagctggtgctggcgacggggtcttacccgtttgttccgccggtgccgggtcatcatctcgagggctgttttgtttatcgtacgcttgacgacctcgaccagattgccgcccgcgccgcaaccgcccgacggggtgtggttatcggcggtgggctgctcgggctggaagcggccaacgcgctgaagcagttggggctggaaactcacgttgtcgagtttgcgccgaacctgatggcggtgcagctggacaacggcggcgcggcaatgctgcgagaaaaaatcagtcaactgggcgtcggggtgcataccagcaaggcgacgacggagattgttcgcaacgaacaggggctacagctgaactttgccgacggtagctcgctggcggccgatatgctggtgttctccgccggtattcgcccgcaggacaggctggcgcgcagcggcgggctggaagtgggcgaacgcggcgggatttgtatcgacaaccagtgtcgtacctccgacccggacgtgctggcaatcggcgaatgtgccctgtgggagaacaaaatttatggtctggtggcgcctggctatcagatggcgcgcgccgcagcggctaccctggcgggcgaggaaggctgctttagcggcgcggatatgagcactaagctgaagctgctgggcgttgatgtcgcctcgttcggcgacgcccaggggcgcaccccgggctgtcagagctatcagtggaccgatgggccgcagcagatctacaaaaaaattgtagtcagcgcggagggcaacaaactgctcggcggggtgctggtcggggatgccagcgactatgccacgctgctacagatgatgcttaacggtatggctttacccaatcacccggaaagcctgatccttccggcgctggagggcagcgcgccaaaagcgctcggcgtggcggcgttgccggacagcgcgcagatttgctcctgtcacaacgtcagcaaaggcgatatctgccaggtggtgaacggcggcgcgggcgatatggcggcgataaaaagctgcaccaaagcggcgaccggctgcggcggctgtagcgcgctggtaaaacaggtgatggagtatcagcttgccgagcagggcgttgaagtcaaaaaggatatctgcgagcattttgcgtggtcgcggcaggagatctatcacctggtacgcgtcaaccatattcgcaccttcgaacagcttattacccgctatggacgcggtcacggctgtgagatctgtaaacctctggcggcctcggtgctggcctcctgctggaatgaatatctgctgaagccggcgcatttgcctcttcaggacactaacgaccgctacttcgccaatattcagaaagatggcacctattcggtggtgccgcgtatggcggcgggagaggtgacgccggacgggctgattgcgatcggccagatcgccaaacgctatcagctgtacagtaaagtgaccggcggccagcgtatcgatctgttcggcgcgcgcctggagcagctcccggcaatctggcgcgagctggccgaggcgggatttgaaaccggccacgcctacggcaaatccctgcggacggtgaaatcctgcgtgggttcaacctggtgccgctatggcgtccaggattccaccggcctggcggtaaccctcgaacatcgctataaggggctgcgcgcgccgcacaaaattaaaatggcggtctccggctgtacccgcgaatgcgcggaggcccagagcaaggatattggcatcatcgctacggagaagggctggaatctgtacgtttgcggcaacggcggtatgaagccgcgccatgccgacctgttcgccagcgatctggatgaagccacccttatccgcagtatcgaccggctgctgatgttctatattcgtaccgccgaccgtctgcagcgtaccagtacctggatggataatcttgagggaggcgtcgactatctgcgcgcggttatcctcgaagacagccttggcatcggcgaagagctggagcaggagatggcgcgggtggtcgagagctaccagtgcgaatggcaaaccacccttaacgatccgcagcggctggcgctgttccgctcctacgtgaacagcgatgagccggacgaagcggtgcagcggcaaaccctgcgcggccagccgcagctggccccgttcgcggcgcaggccgaaccggcgctgccgtcccgcccgtggcaggccatttgcgatctcgacgccatcccgcagcaggcggggattggcgcgcggctcggcgagcggcagattgcgctgttccgctttggcgatcaggtatatgccctcgataatcttgaaccgggcagcgaggccaacgttctttcgcgcggcctgctgggcgatgcgggcggtgaaccgatcgtgatttcgcctctgtataagcagcgtattcgcctgcgcgatggccgccagtgcgacgacggcgaactggcggtacgcgcatggccggtaaaagtggagaacggtaaagtatgggttggcaaccagcagctgctggcgcgcgcggaggcctcctag

SEQ ID NO: 256 - DNA, 315 bp, Arabidopsis thaliana
atgggtatccaattgatcggactctctcaggcaaagcaaaagcttcaaagaagcttatcagcgagaatcgcaagcctcttggctacgtcgggtactaataatgtcccaaagggtcatgtggccgtctatgtgggagagacttatcacaggaagagatttgtgatacctatatcgtatttaaaccacccattgttccaaggtttgttgaacctcgcggaagaagagttcgggttcgaccatcccatgggaggtctcaccatcccttgcactgaagattacttcaccgctctagcttctattctaagtggttcatag

SEQ ID NO: 257 - DNA, 1020 bp, Zea mays
atgccgaacctcgagtgccggatgtatgagcagcggttcccggaggtggatgccgcggtgatgatccaggtgaagcacatcgctgacatgggcgcgtacgtctccctgctcgagtacaacaacatcgagggcatgatcctcttctccgagctctcccgccgtcgtatccgctccatctcctccctcatcaaggttggtcgccaggagcccgccatcgtgctccgtgtcgaccgcgacaagggctacatcgacctttcaaagcgccgcgtctccgaggaggaggcgcacgcatgcgaggacaggtacaacaagtccaagctcgtgcactccatcatgcgccacgtcgccgagacgctcgaggtcgacctcgagccgctctaccagcggattggctggccgctctaccgcaagtacggtcacgccttcgaggccttcaagctcatcgttgcggaccctgacgctatcctcgacgtactcacctatgaggaaaaggaggtcggcccagatggccaggaggtggctaaggtggtgcctgctgtcacccccgaggttaaggattcactggtgaagaacataaggaggaggatgacaccgcagccactcaagatccgtgctgatatagagatgaagtgcttccagtttgatggagtgctccatattaagcaagctatgaagaaagctgaagctgcaggcaatgataattgtcctgtgaagattaaactagttgctcctccactttatgttctgaccacacagacccttgacaaggaccaagggatttcagttctcactgatgcagtcaaggcttgtacagcagagattgaaaaatacaaaggaaagttagtagtgaaggaaccaccaagagctgttagcgagcgggaagacaagctattcctcgaccagattgattccctaatggaacaaaacgcagaggtcgatggtgacgtggacagtgaagaggaggaagatacaggaatgggcaacgttgatcttacaaattctggcgtcactgcttactag

SEQ ID NO: 258 - DNA, 1491 bp, Arabidopsis thaliana
atgactgattataattacattgacaacatgcagggactaataacaattacactcacagcatcgtttcctcaactccacccagcatcatgcaacagccaggacccactcagttgcggcggtccgaataagctccagatcggagttttgctattgggactctgtttcctctccgtagggagtggaggaatacgaccttgtagcatcccttttggggttgatcagtttgaccaacgaactgaggaaggggttaaaggagtggccagtttcttcaactggtattacatgactttcactgtggttctgatcattacgcagaccgtagttgtgtatatccaggatcaagtcagttggattatcggttttagtatccctaccggactcatggctcttgcggttgttatgttttttgccggaatgaagcgttatgtctacgttaaaccagaaggaagtatattctctgggatcgctcaagttatcgtggcagctcgtaagaagcgaaagctgaaacttccggcggaagatgacggcactgtcacctattacgacccagccatcaagtctagcgtgttatccaagttacaccgcagtaaccaattcaggtgtcttgacaaagccgcggtggttatagaaggtgacctaacacccgagggacctcccgcagacaagtggcggttatgcagcgtccaagaagtggaagaagtgaagtgtttgatccgaattgttcctatctggtcggccggaataatctcactcgcggccatgacaacacaaggcactttcacggtctctcaagctttgaaaatggatcgaaacttaggtcctaaattcgagattccggctggttcactctccgtcatctctctcctcacaatcggcatctttcttcccttctacgaccgcgtttttgtaccattcatgcggcgaatcaccggccataaatccggaatcacactcctccaaaggataggaacagggatcgttttcacgatcttttctatgatcgttgcgggcattgtggagcgtatgagacgcatacgctccatcaatgccggagatccaacgggaatgactccaatgtcggtgttttggctttcgccgcagctaattctcatgggactatgtgaagcattcaatatcatcggacaaattgagttcttcaacagtcagtttccagagcacatgagaagtatcgctaattctctcttctctttatcgttcgccggttcgagctaccttagtagtttccttgtgactgtcgttcataaattctccggtgggcatgatcgtccggattggctaaacaagaatctcaacgcgggaaaattggattacttctattatctgattgcggttttgggtgtggttaatctggtttacttttggtattgtgctcggggataccggtacaaggtcggtttaccgattgaagactttgaggaggacaagtcctccgatgatgttgagatgacttccaagaaatcgatggaatag

SEQ ID NO: 259 - DNA, 1020 bp, Zea mays
atgccgaacctcgagtgccggatgtatgagcagcggttcccggaggtggatgccgcggtgatgatccaggtgaagcacatcgctgacatgggcgcgtacgtctccctgctcgagtacaacaacatcgagggcatgatcctcttctccgagctcgcccgccgtcgtatccgctccatctcctccctcatcaaggttggtcgccaggagcccgccatcgtgctccgtgtcgaccgcgacaagggctacatcgacctttcaaagcgccgcgtctccgaggaggaggcgcacgcatgcgaggacaggtacaacaagtccaagctcgtgcactccatcatgcgccacgtcgccgagacgctcgaggtcgacctcgagccgctctaccagcggattggctggccgctctaccgcaagtacggtcacgccttcgaggccttcaagctcatcgttgcggaccctgacgctatcctcgacgtactcacctatgaggaaaaggaggtcggcccagatggccaggaggtggctaaggtggtgcctgctgtcacccccgaggttaaggattcactggtgaagaacataaggaggaggatgacaccgcagccactcaagatccgtgctgatatagagatgaagtgcttccagtttgatggagtgctccatattaagcaagctatgaagaaagctgaagctgcaggcaatgataattgtcctgtgaagattaaactagttgctcctccactttatgttctgaccacacagacccttgacaaggaccaagggatttcagttctcactgatgcagtcaaggcttgtacagcagagattgaaaaatacaaaggaaagttagtagtgaaggaaccaccaagagctgttagcgagcgggaagacaagctattcctcgaccagattgattccctaatggaacaaaacgcagaggtcgatggtgacgtggacagtgaagaggaggaagatacaggaatgggcaacgttgatcttacaaattctggcgtcactgcttactag

SEQ ID NO: 260 - DNA, 456 bp, Arabidopsis thaliana
atggcaccaaaagccggaaagaaaccagcagagaaaaagcccgcagagaaagctccagcagaagaagagaaagtagccgaaaaagcaccagcagagaagaaaccaaaagccggaaaaaaactaccaaaagaagcagtcaccggaggagtcgagaagaagaagaaacgagtcaagaaaagcacagagacatacaagatctacatcttcaaggtgttgaaacaagttcatccagatattggaatctcaagtaaagctatggggattatgaacagttttatcaatgatatattcgataaacttgcgcaagaagcttcaaaattagctaggtataataagaaacctacgattacttctagggagattcagacagctgttagactagtgttacctggtgaacttgctaagcatgctgtttctgaaggaactaaggctgttactaagtttactagctcttag

SEQ ID NO: 261 - DNA, 3114 bp, Arabidopsis thaliana
atggagcgcgcaaggagacttgcttacagaggaatcgtcaaacgtctcgttaacgacacaaaacgacaccgtaacgctgaaacacctcaccttgttcctcacgctccggcgaggtatgtctcttccctttcccctttcatctccacccctcgatctgtcaaccacacggcggctttagggaggcaccagcagacgcgttccatctccgtcgatgctgttaaacccagcgatactttccctcgtcgtcacaactctgcaacaccagacgaacaaacccacatggctaaattctgtggctttgaccatatcgattcactcatcgatgctacggtgcccaaatcgattcgattagattccatgaagttctccaaattcgacgctggtttaaccgagagccaaatgattcaacacatggttgatttagcttccaagaacaaggttttcaaatccttcatcgggatgggttactacaacactcatgtccctactgtcattctccgtaacatcatggagaatccagcttggtacactcaatacactccttatcaagctgagatctctcaaggtcgtctcgaatcgctcctcaatttccagaccgtgatcacagatctcacgggtcttcctatgtccaatgcgtcgcttctggatgaaggcactgctgctgcggaggcaatggccatgtgtaacaacattcttaagggtaaaaagaagacctttgtcattgctagtaactgtcaccctcagactattgatgtttgtaagactagagctgatgggtttgatttgaaagttgtcacctctgatcttaaggatatagattacagctctggtgatgtttgtggggttcttgttcagtatcctggtactgaaggtgaagtcttggattatgctgagtttgttaagaatgctcatgctaatggtgttaaggttgtgatggctacggatttgctggctttgactgtgttgaaacctcctggagaatttggggcggatattgttgttggctctgctcaaaggtttggtgttccgatgggttatggtggtcctcatgctgcgttcttggctacttcacaagagtataagagaatgatgcctgggaggattattggtattagtgttgattcttcaggaaagcaagctctgcgtatggctatgcagactagagaacagcatattaggagggacaaagccactagcaacatctgtactgctcaagcgttgcttgccaacatggctgccatgtatgctgtttaccatggacctgcaggtctaaaatctattgcccagcgtgtccatggtctcgctggtatattttccttagggttgaacaagcttggggttgcagaagttcaagaacttcctttctttgacactgttaaaattaagtgttcggatgcacatgcaattgctgatgcagcttccaaaagtgaaattaatctgcgtgttgtggactcaaccactattactgcttcctttgacgaaacaaccaccttggatgatgtcgataaacttttcaaagtttttgcttctggcaagcctgttccatttacggctgaatctctagcacccgaggttcagaattccattccttctagcctaacaagagagagtccttatcttacccacccaatcttcaacatgtaccacacagagcatgagttgcttaggtacatccacaagttacagtcaaaggatctatcactgtgccacagcatgattccgttgggatcttgtacgatgaaactaaatgcaacaactgaaatgatgccagtcacatggccaagtttcactgacattcacccttttgctcctgttgaacaagcacaaggttatcaggaaatgttcgaaaatttgggtgacctcttgtgtacgatcactgggtttgactctttctcgttgcaacctaatgctggtgctgctggtgagtatgccgggcttatggttatccgcgcatatcacatgtcaagaggagatcatcaccgtaatgtgtgtatcatacctgtctctgcacacggtacaaaccctgcaagtgctgctatgtgcgggatgaaaattattacagttggaactgatgctaagggaaacattaacattgaggaggtgagaaaagctgcagaagccaacaaagacaacttagctgctcttatggttacatacccttcaactcatggagtctatgaagagggcatcgacgagatttgcaacataatacacgaaaatggaggtcaagtgtacatggatggtgccaacatgaatgcacaggttggtttgacgagccctggttttattggagcggatgtgtgccatctcaatctccacaagaccttctgtattcctcatggaggtggtggtcctggtatgggtcccattggtgtgaagaatcatttggcaccatttcttccttctcaccccgtgataccgactggtggtatcccacaacccgagaagacagcacctttgggtgcaatatccgctgcaccatggggatctgcgcttatcttgcctatatcttatacttacattgccatgatgggatctggtgggctcactgatgcctctaagattgcaattttgaatgccaattacatggcaaagcgcctagagaaacactacccagttcttttccgtggtgttaacggaacagtagcacacgaattcatcatagacttgagaggcttcaagaacactgctggaatagaaccagaggatgtggcgaaacggctaatggactatggattccatggacccacaatgtcttggcctgtccctggaactcttatgattgagccaaccgagagtgaaagcaaggcggagctagacaggttctgcgatgctctcatttcaatcagggaagaaattgcacagattgaaaaaggaaatgcagatgtccagaacaacgttctcaagggagctccacatcccccatcgttgctaatggcagacacatggaaaaagccgtattctcgagagtatgctgctttccctgcgccttggctccgctcctccaagttctggcccaccacagggcgtgtggacaatgtatatggagacaggaaactggtgtgcactctcctcccagaggaagaacaagtcgcagctgcagtgtctgcttag

SEQ ID NO: 262 - DNA, 816 bp, Zea mays
atggaccacgaggagataaaggacatcgtgcgcaagttcccagcgttcgcgtactacagcgtggatcgcaagatcaagcccctggtggagctcctgcttgagcttggggtgaaaaattccagcataccaggaatcatcaagaagcggccccagctgtgcgggatcagcatgtcagacaatctcaagccgatgatggcttatctggagagcatcggcgtcgacaaggctcagtggagcaaggtgatcacccgcttcccggcgctcctcacgtacagccggaacaaggtgcagacgaccgtgagcttcctcgccgagctaggtgtctccgagaagagcatcggcaagatcctgacgcggtgcccccacatcatgagctacagcgtggacgacaacctcaggccgaccgccgcctacttccggtcgatcggcgcggacgccgcgtcccttatccagaagagcccgcaggccttcggtctgaacgtcgaggccaagctgaggccgaccacggagttcttcctggcgagggggttcagcgtcgaggaggtcggcgtcatggcgaacaggttcgggatcgttcacacgctgagcctggaggagaacctgctccccaagtacgagttcttcctggcgatggagtacccgaggtgcgagctcgtcaagttcccgcagtactttgggtacagcttggaccggcggataaagccacggtacgcgaggatgactgggtgtggggtgaggttgattttgaaccagatgctttcggtctccgatgccaggtttgagaagattctagagaagaagacggctaggctttag

SEQ ID NO: 263 - DNA, 666 bp, Saccharomyces cerevisiae
atggctagaagaccagctagatgttacagataccaaaagaacaagccttacccaaagtctagatacaacagagctgttccagactccaagatcagaatctacgatttgggtaagaagaaggctaccgtcgatgaattcccattgtgtgtccatttggtttccaacgaattggaacaattgtcttctgaagctttggaagctgctcgtatctgtgccaacaagtacatgactactgtctccggtagagatgctttccacttaagagtcagagtccatcctttccatgtcttgagaatcaacaagatgttgtcttgtgccggtgcggatagattgcaacaaggtatgagaggtgcttggggtaagccacacggtttggccgctcgtgtcgacattggtcaaattatcttctctgtcagaaccaaggacagcaacaaggatgttgtcgttgaaggtttgagaagagccagatacaagttcccaggtcaacaaaagattattttgtctaagaagtggggtttcaccaacttggacagaccagaatacttgaagaagagagaagctggtgaagtcaaggacgacggtgctttcgttaagttcttgtccaagaagggttctttggaaaacaacatcagagaattcccagaatactttgctgctcaagcttag

SEQ ID NO: 264 - DNA, 666 bp, Arabidopsis thaliana
atgggacgaagacctgcgagatgttaccgtcagattaagggaaagccatacccgaaatcacgatactgtcgtggtgtgccagatcccaaaatcaggatctacgatgttggtatgaagaggaaaggtgttgatgagtttccattctgtgttcatttggtttcatgggagaaagagaatgtgtcaagtgaagcacttgaagcagcacgtattgcttgcaacaagtatatggtgaaatctgctgggaaagatgcttttcatttgaggattagggttcatcctttccatgttctcaggattaacaagatgctttcgtgtgctggagctgataggcttcagactggaatgagaggtgcttttggtaaagctcttggtacttgtgctagagttgcgattggacaggttcttttgtctgttaggtgtaaggataatcatggagttcatgctcaggaagctcttcgtagagctaagtttaagttccctggtcgtcaaaagatcattgttagcaggaaatggggattcactaaattcaaccgtgctgagtacacgaagctgagagcgatgaagaggattgtgcctgatggtgtcaatgctaagtttctatcaaaccatggtccattggctaaccgtcaacctggaagtgccttcatatcagccactagcgaatag

SEQ ID NO: 265 - DNA, 669 bp, Glycine max
atggggcggagacctgcgaggtgttataggcaaattaagaacaagccataccccaagtcacgtttctgccgtggtgttcctgatcccaagatcaggatttatgatgttggtatgaagaagaagggtgttgatgagtttcctttctgtgtccatctggttagttgggagaaggaaaatgtttcaagtgaggccctggaagctgctcgcattgcttgcaacaagtacatggccaaatttgctggaaaggatgctttccacttgagagtcagggtgcacccattccatgttcttaggatcaacaagatgctttcgtgtgctggtgctgataggctccaaactggaatgagaggtgcttttggaaagccacagggtacttgtgctagagtggctattggacaggtccttctttctgtccgctgcaaggacagcaacagccatcatgctcaggaggctcttcgccgtgccaagttcaagttccctggtcgtcaaaagattatagttagcaggaaatggggcttcaccaagtttagccgttctgattatctcaagttcaagtcagagaacagaattgtgcccgatggtgtgaatgcaaagcttcttgggtgccatggaccattggccaatcgtgaacctggaagagtctttttggatactgctactagttcttag

SEQ ID NO: 266 - DNA, 1458 bp, Glycine max
atgctaagagagaaaagggagagtgctttgaaaatgggaaagtttagttcaagttacagtacttctgattttgttcactttggagttctacttccctttcttctgttatcacagttgttctttcaacttgcatggtgtggctccatagtaaagttccttcctggattagagggaccccttccttttgttcttgaaaccgggtatgtgggagtgggtgaatcagaggatgtgcaggcattctactacttcattgagtcagagaacaatccaaaggaggatcctctcatgctttggctcactggtggccctggttgctcagctttctctggccttgtcattgaaataggtccaattgcatttaaaaatgaggaatacaatgggagcctgcccaatttggtcttgaggccacactcatggacaaaggttagtagcattatatttgtagacttgcctgtttccacgggcttcacttatgccacaacagagtttgctactcaacgaagcgactggatacaagttcaccaagtccatcaatttcttaggaagtggttgattgaacatccaaattttttgtcaactgatgtttacattggtggcgattcatactctggcattactattccagcaattgttcaagaaatttctctaggaaatgaaaaagggctccaaccatggataaatctccagggatacctgctggggaatccagcaacaactcgaaggcatgaaaactatcgaatatcctttgctcatggaatgggacttatttctgatgaactatacaggtcactgcaaaaaaattgtaaaggagagtacataaatgtagacaccaaaaatgtattatgttctagaaatatcgagacattcaatgaggttacatcaggacttagtatggtcaatattttggacccgtcatgtgattggcttgatactgaaacatcttggaggagatctctacttaagaaatatccgagaaagaatttccttaatactcatctcaaattgccatccttaaactgtcggagttatgcatacttcctctgcggttattgggccaatgatgatagtgttcgcagtgcactgcatatccgtaagggaactataggaaaatggcgtcgctgtaccttcaatatacctaacaaggaggacatctcaagcagctatgagtatcatgtaaatctcagtagaaaaggctatcgttcactgatatacagcggggatcatgacatgaaaattcctttcttggaaactcaagcatggataagctctttgaactattccattgtggatgattggaggcaatggcatacagatggccaagttgcaggatacacaaggacttactccaatcgtatgacatttgccaccgtgaagggaggaggccacacagctccggagtacaagcctgaagaatgcttggccatgttcaggagatggatatctaacaaggctttgtag

SEQ ID NO: 267 - DNA, 945 bp, Glycine max
atgatggcctctcctacatctccaagagttctcttcttgagtctctttgtaactctttccatgattttacatttgagttcagccaggaagttgtctgagtcagacccccaattgcagttccaataccacagaggccctctcctcacaggcaaaatctccgtaaacctaatttggtacggtaagttcaaaccttctcagaaagccattgtcgctgatttcatcacctccctctcctcttccaaacccctcaccgcccaaccatccgttgccacgtggtggaaagccaccgacaaatactacaaaaactcgttccccaaacttgcactctccctagggtcccaaatcgttgatgaaaactactctctaggaaaatcactcaccaccaaccaaatcttaaaactcgcgtccaagggtccacagagaaacgccatcaacatcgttctaacttctgctgaagtggcagtggaggggttctgttcgagtaggtgcggaacacacgggtcctccgtgggggcgcgtgtgaacggtaagaggtataagttcgcctacatgtgggtgggtaactcagagacacagtgccctggtcaatgcgcgtggccgttccaccaacccatttacggtccccagaacccagcacctttggttgcacccaacaacgacgtgggtctcgacggcatggttatcaacgtggctagtcttcttgctgggactgtcactaacccttttggaaatggctactttcaaggacccaaagaagctcctttggaagctggttcggcttgcactggggtttatggtaagggcgcgtatcctggctatgcagggaatctcttggtggaccccaccaccggtgccagttacaacgcgaatggggtcaacggaaggaagtatctgttgccagctcttgttgatcctaaaacctcatcttgttccacgctcgtgtag

SEQ ID NO: 268 - DNA, 1395 bp, Glycine max
atggtgacttgtgccgtgaaaggaggctgccccagtgactacatagccattgccctatccattctttccatcactgtgcttctcttatggtcaatttttcccttcctagttcacaaggttcctcgtaccaaaggcagtggcttttggttacctgtaattcaagttgttgccagcttcaaccttcttctatcaattgtgatgtcaaataatttcttgaaaatgggaaagagacattggttgcggtcatgctacctatggggagtctgggttgaaggtccactagggtttggtttgctgttgagctgtcgcataacacaagcttcacaattatattttatctttgtcaagaggcgcttaccattgataagatcatatatttttcttccacttattctacttccctggattgctgctggtggtgttatccattcaatgaagcctctaagcagtcgctgtcacatgaaagctcaatggaccatcccagttgtatgcctccattcattgtatattgccattttggttggggttacagctgcagttcatcacatagagttcaggtttgatgaactcaaagacctctggcggggaatacttgtatcagttgtgtccattgctgtgtgggttactgcttacatactaaatgaaatttatgacaatatctcatggattgaagttgcctccagatttctgcttttagttgtggctagcatacttgtggtggctttcttttcaatatcaagttcacaaccacttctctcacaaatcagcttgaggagaagagaatccagagaatttcgcacaatgagtcaggctctgggcatacctgatagtggggtactagcagaaagtgaacccatttcaaggatagatcctaatgaaccattggataagcttctcctgaataagagattccggcagtcttttatggcgtttgctgatagttgcttggctggggagagtgtgcacttctttgatgaagtatatgagcttagtaaaatacctgaagatgactgtgttaaaaggatctacatggcacgacatattattgagaaatacatagttgcagttgcggctatggaggtgaacatctctcatagaagcagacaagaaattttatcaacttccaacctcacacgccctgatctcttccataatgcacttaatgagatcattcagctgatgagaacaaatctggcccgagattactggtcttcgatgttcttcctgaagttccaggaagactccaatgtaagatctaatgagtacgagctggagcaaataacagggtggaacttttctccaaggttgagttctgtgcatggtacagacgatccttttcaccaggaccatcttctcaagagctcaggctgtagcaatgatacaactaatttatag

SEQ ID NO: 269 - DNA, 532 bp, Zea mays
atgcaggaggagccagggcgtcgtcccgtgccgccgttcgcgggcgtggacctccgccgccccaagggctaccccgtggcggttgccaaggaggagaggccggcgccgggcggcgacccgtgcccgcggtgcgggtcgcgggacaccaagttctgctactacaacaactacaacacgtcgcagccgcgccacttgtgcaagtcgtgccgccgctactggaccaagggcgggtccctccgcaacgtccccgtcgggggcggcacccgcaagagcagcagcagctcctcatcatcctcggcggcggcggcggcgacgacgacgacgacgtcaacctcgcccggcgccgcgcccaaggccacgaagcggtcgaagaactccaagcgccgccgcgtcgcgcctgccccggaccccgcggcgcccggcacggacgcctccaccgccgacgtcgcgagcacggcaccttcgacggtggctgcctcggagaagccgagcgcgacggagcacgcagcggcggctgtcgccactagatcgc

SEQ ID NO: 270 - DNA, 1551 bp, Arabidopsis thaliana
atggctcttcttctagtttcttcttcctcctcctatgccctcagagtcaccattttcttgtctttcttcttctttctctgcaatggcttctcttaccctactacttcttctcttttcaacacccatcaccatcgtcaccacttggccaagcacaactacaaagatgctctcactaaatcaatcctcttctttgaaggccaaaggtcagggaaacttccttctaaccagagaatgagttggagaagagactctggtctctctgatggctctgctcttcatgtggatttggttggagggtactatgatgcaggagacaatatcaaatttggtttcccaatggcattcacaaccacaatgctttcatggagtgtaattgaattcggtggactcatgaaatctgaattacaaaacgctaaaatagcgattcgttgggctactgattatctcctcaaagccacttcacaacctgacacaatctatgttcaagttggtgatgctaataaagaccattcttgttgggaaagacctgaagacatggatactgtaagaagtgtgtttaaagttgacaagaacattcctggttctgatgtcgccgctgaaaccgccgctgctctagccgccgccgccattgtattcagaaaatctgatccttcttactccaaagtcctcctcaaacgagccatcagtgtttttgcatttgcggacaaatacagaggaacttatagtgcaggattaaaacctgatgtttgtccattttattgctcttactctggttatcaggatgaattgttgtggggagctgcttggttacaaaaagcgacaaagaatataaaatatttgaattacataaaaatcaatggacaaatccttggagctgctgaatatgataacacttttggttgggataacaagcacgctggtgccagaatccttcttactaaggcatttttggttcagaatgtgaagacacttcatgaatacaaaggtcatgctgataatttcatctgctctgttattcctggagctcctttctcttctactcagtatacaccaggtggattattgtttaaaatggcagacgccaacatgcaatacgtgacgtcaacatcgttcttgctcttaacctatgccaaatacttaacctccgccaaaaccgtcgtccattgcggtggctccgtctacactcccggtcgtcttcgctccatcgccaaaagacaggtggattatcttcttggagacaacccattaagaatgtcttacatggttggttacggtccaaaattcccacggagaatccaccaccgtggcttctcattaccttgtgttgcaagccacccggccaagatccaatgccaccaaggatttgcaatcatgaactctcaatctccaaaccctaacttccttgttggtgcagtcgttggtggtccggaccagcatgatcgcttcccagacgaacggtctgattacgagcagtccgagccggctacttacatcaattcaccactcgttggagctcttgcctacttcgctcacgcctatggtcaactctag

SEQ ID NO: 271 - DNA, 264 bp, Zea mays
atgtcgtcgggcggccgacgtggcaggatcagcgacgacgagatcaacgagctgatctccaagctccaggcgctcctcccggaatcctcacgccgccggaacgcgagccggtcgtcggcgtcgaagcttctgaaggagacgtgcgcctacgtcaagagcctgcaccgggaggtggacgacctctcggagcggctgtcggggctcatggagaccatggacaacgacagcccccaggccgagatcatccggagcctcctccggtag

SEQ ID NO: 272 - DNA, 828 bp, Arabidopsis thaliana
atggctaccaccactgcagcagcagcaggtatttttgggatccggattcaagatcctagacctggaacaggtagggtccaagcccggttcgggttcagtttcggaaaaaagaaaccggctccaccgccaaagaaatcaaggcaggtccaagacgatggagacagactagtttggttccccggcgcaaacccgccggaatggttggacggatcgatgatcggagaccgtggatttgatccgtttggtttaggtaaaccggctgagtatcttcagtacgatttcgatggacttgaccaaaaccttgccaagaacgtggcgggtgacatcatcgggatcatccaagaatcttcggagatcaaaccgacgccgtttcagccgtacactgaagtctttgggatccaacggttcagagaatgtgagctgatccatggaaggtgggccatgcttggcactctaggcgccatcgccgtagaggctcttacaggaattgcatggcaagacgccggaaaggtggaattggtggaaggatcatcgtatttgggacaaccattgccgttctcgttgacgacgttgatatggatagaggtgctagtggtcggatacattgagttccaacgtaactctgaactggatccagagaaacggatttacccgggtgggtattttgacccgttgggactcgcggctgatccagagaagttggatactttgaagctggctgagataaagcactctcgtctcgctatggtcgcatttctcatctttgctcttcaggcggcctttaccggcaaaggccctgtcagcttccttgccacctttaacaattag

SEQ ID NO: 273 - DNA, 699 bp, Zea mays
atgctgcggctctcccgcttcctcccctccgcctgcaggaggggttttgatctaaaagaatctctttggagtggttcattgacattccaacaagctgtttccactgcagcaacaaatcttgatgggaacttgtctggcaaaaagtttgcaagttataccgtgttcaagggaaaggctgcactttctatacatcctatactgccaagtttcagcaaattagaatccggaggatctcgagtgagcaaaaatggatcagtaatgctgaccttctttcctgctgttggacaaaggaagtatgactatacaaagaaacagctctttgctctgtcacctactgaagttggaagcctgataagtcttgggcctgctgaatcctgtgaatttttccatgacccatccatgaaatcaagtaatgaaggaacggtgaaaaaatcgctgtcgatcactccacttggcagtgacagtggatactttgttaatataaccgttgtgaacagtgcagagaggactaatgatcgtctttcagtccctatcacaaaagctgagtttgctgtgatccgcacaactctgagttttgcattgccacatattatgggttgggaccaggctttaaccaatcaccatccagctccagctcctccagctagcagcaggcccacggtagagcgtccacacccggattccgaatgggagaggtag

SEQ ID NO: 274 - DNA, 408 bp, Arabidopsis thaliana
atgattcgtgagttctccagtctacaaaacgacatcataaacattcaagaacattattctctcaacaacaacatggacgtgagaggagatcataaccggaaaaacacgagttttcgtggttcagctccagctccgattatggggaagcaagaattgtttcggacattgtcgtcgcagaacagtccaaggaggctaatatcagcgagttacttcagtttagaatcaatggttgtgcttgttggtctcacagcatctctcttgatcttaccgttgattcttccaccattgcctcctcctccttttatgctgcttttgattcctattgggattatggttttgcttatggttcttgctttcatgccttcttctaattccaaacatgtttcttcttcttccacttttatgtag

SEQ ID NO: 275 - DNA, 1353 bp, Zea mays
atggcggccgtagcggcggctccacggccgcagctccccatgctatctggcggcggcggcgcggcactttccagtctcaccctccaaacactggccttcatttcccccctccccatcagccgctgtcaccgctgtgtgctccgctccaacgcctcgtcgtccccgtctccgccgccatcgcaggaggaggcagcggcggctgaggtggttccaacagctgagtcctgcgtcaatctcggtctccagctcttctccaaaggcagggtgaaggatgctcttgaacaatttgagaatgcattagagctgaatccaacatctattgaggcccaggcagcgctatataacaaggcatgctgccatgcgtatagagaagaaagcaaaaaggctgcagaatgtttaagggaagctttgagagactacaatctcaaatttggtaccatacttaatgatccagacttggcgccattcagagcatcaccagaattcaaggaacttcaagaagaggctttgcgtggtggagaagatattggttctggtttccgaagagacctgaaactcattagtgaagtacaagcaccattccgtggtgttcgaagattcttctatgtagctttgacagcagcagctggaatttcaacattctttaccattccccgacttgtactagcagttcgagggggtgatggcgcccctgatcttctggaaactgctggaaatgctgccatcaatattggaggtattgttgttctggtagctttgtatttctgggaaaacaagaaagaagagaagcagatcacacaaatttctcgtaatgaaaccctttcaagattacctgtgcgcctgtcaaccaatcgcattattgaacttgttcaactccgggacatcactaggcctgtgatattggcaggttcaaaagcatctgttactcgggcattgcaaagagctgagaggtatcggactgaactgctcaaacgaggcgttcttctaattcctgtgatctttggtgcttctcagaaagaccaaaccaaaccaaggggttttggtgcaagaagagctgctgcatcagttccttctgttgggggtgactttgaaaagcgtactgaatctattgcagcaaaatcacggttgaagactgaggttcggtttaaggctgatattgtttccccagaacaatgggaaagttggatacgagaccagcaagtgtctgaaggtgtcactcctggtgaggatgtctacataatccttcgtctcgatggacgtgtcagaagatctggaataggcatgccaaactggaatgacatattacaggaactgccacgacttgaagatctgatgagcaaacttgaacggtag

SEQ ID NO: 276 - DNA, 279 bp, Glycine max
atgtctagccgaagatccagacaacattcagggtctacaaggatctccgatgaccaaatcatcgaacttgtttccaaattgcgccaacttgttcctgagattcgcaataggcgatctgacaaggtttcagcgtcgaaggtcctacaagagacctgcaactacatcagaagcttgcacagagaggtgagtgacttgagcgagcgactgtctcagttgttgaccacaattgatgctgatagtgctgaagctggaatcattaggagcctacttaatcaatag

SEQ ID NO: 277 - DNA, 300 bp, Glycine max
atgatggctgctggtggcaggaactccaactttggtgcctctgatgtttatggcctttcagcctcaagagggccaactccaaggccttctaactatgatgaagatggtgggaagccaaagttccattaccatgctggtggaactggacactaccctgcaccaaaccctggcatgttctctccctcaaatgggtccaaaagtgttgctgctgctaatgctaatgctaatgccaaaaggcctaatgggcaggctcagctgaagcctgaggatgggaatagggaccttcatatgtttgtttag

SEQ ID NO: 278 - DNA, 279 bp, Glycine max
atgtctagccgaagatccagacaacattcagggtctacaaggatctccgatgaccaaatcatcgaacttgtttccaaattgcgccaacttgttcctgagattcgcaataggcgatctgataaggtttcagcgtcaaaggtcctacaagagacctgcaactacatcagaggcttgcacagagaggtgagtgacttgagcgagcgactgtctcagttgttgaccacaattgatgctgatagtgctgaggctggaatcattaggagcctacttaatcaatag

SEQ ID NO: 279 - DNA, 411 bp, Zea mays
atggcccgcacgaagcaaacagcaaggaagtcgaccggcggcaaggccccccggaagcagctggccactaaggctgcgcgcaagtcggccccggccaccggcggcgtgaagaagccccaccgcttccgccccggcaccgtcgcgctccgcgagatccgcaagtaccagaagagcactgagctgctcatccgcaagctccccttccagcgcctcgtccgcgagatcgcgcaggacttcaagactgatctgaggttccagtcctccgccgtcgcggcgctgcaggaggccgccgaggcgtacctggtggggctcttcgaggacaccaacctttgcgccatccacgccaagcgcgtcactatcatgcccaaggacatccagctcgcgcggcgcatcaggggcgagagggcttga

SEQ ID NO: 280 - DNA, 1119 bp, Zea mays
atggcccacttgatctcttctgcaatcgcaggcgcgggcaacttggtcgctgatggaatcagtggtgtcactggcgtagcgtcgcaggttgtagaaggcgtagaggacactttaggcagtatcgtagaagcaatcgaccaaggagtcaaggatgaggaccaactggatttgcccaagtacgtgtgtttcaagggagataatggtctgtacctgagtgctcgaacagttgaaggccacccctacctgcagtttgcatcggaagacattggcgacccaagtgtgaggttcatcacctacaaccacaaggtgaacggcaaacgggtggtgcgcttcaagtcgaaccatctcggcaagttctggaggcggagccccaactggatctgggccgacaccgacgacaccagcaccaacaactccgacaccctgttcgaggtcatcaagatcgacgaggatggtgtgtacgcgctccggaacctcggcaacaaccacttctgccacaggctgacctacgacggcaaggagagctgcctgaacgccacaattccgaccatcaggaaggaggcgcacatcaagatcgaagaagccgtcctctcccgaaagatctccaacatcgagtaccacctcaagggcgccaagatcttcgacaagaaggccaagaccctcatcactcgagaggcggtgaacggcaccagcacggacagcaagaccaccatcaccctcaagtacagcgtcatcaagggcaagctatgggattcgagcaagtccatgaagctgggggtcaccaccaccattgaagctggggttcctgtggtcttacccgcaaccattgaggtccagagcgagttcaactccacctacagctggggcgagtccatcatcgagaaagaagagtactccaacgcctacgaggtcgttgtgcctgcatactccgtcgtcacggtcagtgtactcgccacacagggcatctgccaagtccccttctcttatactcaagaggacgttttgactaccggagagaggaaggttttcaagtttgatgacggcatcttccgtggtgtcaacagctttggtttcaagtccgaggtcacggaaaggaagctctccaaggacgacgactag

SEQ ID NO: 281 - DNA, 432 bp, Zea mays
atggtgcacgggacgctggaggtgctgctcgttggggccaagggcctcgagaacaccgattacctctgtaacatggatccgtatgcaattctcaagtgccgttcacaggagcagaagagcagtattgcaactggaaaaggaactacccctgagtggaatgaaaactttatcttcactgtgtctgaccggacaacagacttggtaatcaagcttatggacagtgatacaggcacagcagatgactttgttggtgaagcaacgattccattggaagcagtgtatactgaaaggagcattccaccaacactctataatgttgtgaaaggtgaaaaatactgcggggaaatcaaagttggtctcacattcactcctgaggatactcgccagcggggtctcccagaggacttcggtggatggaagcaatcatcttag

SEQ ID NO: 282 - DNA, 3009 bp, Zea mays
atggcgatggcgccctccacggcggccgcatccacccttctccccgtcctcctcctcatcgccaccgccacccagtgcaccgcagccgattcattctcttctcaggacgctgccgccctcctcaacctctctgcggcggtagcagacccctcgggctacctctccacgcactggactccggacaccgcggtctgctcgtggccgcgcgtgtcctgcgacgccaccgacacacgagtcatctcccttgacctctccggcctcaatctatctggccccatccccgccgccgcgctctcctctttcccgtacctccagtcgctcaacctctccaacaacatactcaactccaccgccttccccgacgagatcatcgcgtcgctcaagagccttcgcgttctcgacctctacaacaacaacctcaccggttcgctgccggcagcgctccccaacctcaccgacctcgtccacgtccacctcggcggcaatttcttctccggcagcatcccgaggtcctacggccagtggagccgcatccggtacctggccctctccgggaacgagctcaccggcgagataccggaggagctcggcaacctgacgacattgagggagctgtacctcggctactacaacaacttcaccggcggtataccacccgagctcgggaggctgcgggcgctcgtccggctcgacatggctaactgcggcatctccgaggagatcccgccggaactggcgaacttgacgtcgctcgacactctgtttcttcagatcaacgctctgtctgggaggctcccgacggagataggcgcaatggggtcgctcaaatcgctcgacctgtcgaacaacttgttcgtcggggagatccccgcgagcttcgcgtcgctcaagaacctgaccctgctgaacctcttccggaatcgcctcgccggtgagattcccgagttcatcggcgacttgccgaacctcgaggttctgcagctgtgggagaacaacttcacaggcgggatacccacgaacctcggcgtggcggcgaccaggctgaggatcgttgacgtgagcacgaacaagctcaccggcgttctgccatccgagctgtgcgccggccagcggctggagacgttcatcgctctgggaaattcgctattcggcgacgttccggacgggctcgcggggtgcccgtcgctgacgaggattcggctgggagagaattttctcaacgggacgatacctgcaaagctgttcacgttgccgaacctgacgcaggtagagctgcacaacaatttgctctccggcgagctccggctggacggagggaaggtgtcttcttcgatcggagagctgagtctgttcaacaaccgactgaccggccaggtgcctaccgggatcggtggactcctgggattacagaagctgttgctcgccgggaacatgttgtccggcgagctcccgccggaggtcgggaagcttcagcagctctcgaaggcggacctttctgggaacctgctctccggagcggtacccccggcgatcggcagatgccgtctgctcaccttcctcgatatctcgagcaacaagctctccggcagcatcccgccggagctcggcagcctccgcatcctcaactacctcaacgtttcccacaacgcgctccaaggggagattccgcctgccatcgccggaatgcagagcctgacagccgtggacttctcgtacaacaacctctcgggcgaggtcccgtccaccggtcagtttggctacttcaacgccacttccttcgcaggcaacgctggcctctgcggggcgttcctctccccgtgccgctccgtgggcgtggcgacttcggccctgggctccctctcttcgacgtccaaactcctgctcgtgctcggcctcctcgcgctgtccgtcgtcttcgcgggcgcggccgtgctgaaggcgcggtcgctgaagcggtccgccgaggcgcgcgcgtggcggctgacggcgttccagcggctggacttcgccgtggacgacgtgctggactgcctcaaggaggagaacgtgatcggcaagggcgggtccgggatcgtgtacaagggcgcgatgccgggcggcgccgtggtggccgtgaagcggctgccggccatcgggcgcgcgggcgcggcgcacgacgactacgggttctcggcggagatacagacgctggggcgcatcaggcaccgccacatcgtgcggctgctcggcttcgcagccaaccgggagaccaacctgctggtgtacgagtacatgccgaacggcagcctcggcgaggtgctccacggcaagaagggcggccacctgcagtgggcgacgcggttcaagatcgccgtggaggcggccaagggcctctgctacctgcaccacgactgctcgccgccgatcctgcaccgcgacgtcaagtccaacaacatcctcctcgacgccgacttcgaggcccacgtcgcggacttcggcctggccaagttcctccggggcaacgctggcggttcggagtgcatgtccgctatcgccgactcgtacggctacattgctcctgagtacgcctacacgctgaaggtggacgagaagagcgacgtgtacagcttcggcgtggtgctgctggagctcatcgccgggcgcaagcccgtcggggagttcggcgacggcgtggacatcgtgcactgggtgcggacggtgaccgggtcgagcaaggagggcgtgatgaagatcgccgacccacggctctcgacggtgcctctgtacgagctaacccacgtcttctacgtcgccatgctgtgcgtggcggagcagagcgtggagcggcccacgatgcgcgaggtcgtgcagatactggccgacatgcccggctcgacatccacgacgtccatagacgtgccccttgtcatcgagccgaaggaggaggacgggggcccggagaagaagcagcagcagcagcaggaagggccacacgactcgccgccgcagcaggatcttcttagtatctag

SEQ ID NO: 283 - DNA, 2076 bp, Zea mays
atggaagcctccgccggctcgtcgccaccgcactcccaaaagaacccgccggagcacggtggcgacatgggaggggcccccgcggaggagatcgaaggggaggcggcggatgacttcatgttcgctgaagacacgttcccctccctcccggacttcccttgcctttcgtcgccgtccagctccaccttctcgtccaactcctcgtcaaactcctccagcgcctacaccaacacggcaggaagagccggcggcgagccctccgagcctgcttcggccggagaagggtttgatgcgctcgatgacatcgaccagctcctcgacttcgcgtcgctttccatgccgtgggactccgagccgttcccgggggttagcatgatgctagagaacgccatgtcggcgccgccgcagccggtgggcgacggcatgagtgaagagaaagccgtgccggaagggaccacagggggagaggaggcctgcatggatgcgtcggagggggaggagctgccgcggttcttcatggagtggctcacgagcaaccgcgaaaacatctcggccgaggatctccgcgggatccgcctccgccgctccaccatcgaggccgccgccgcccggctcggcggcgggcgccagggcaccatgcagctgctcaagctcatcctcacctgggtgcagaaccaccacctccagaggaagcgcccgcgcgacgtgatggaggaggaggcgggcctgcacggccagctccccagcccggtcgccaacccaccaggatacgagttccccgccggcggacaggacatggccgcgggcggcggcacatcctggatgccccaccagcaggcattcacgccgcctgctgcgtacggcggcgacgcggtgtacccgagcgcggcaggccaacagtactctttccaccagggccccagcacgagcagcgtggtcgtgaacagccaaccgttctccccgccgcctgtgggcgacatgcacggcgcgaacatggcctggccgcagcagtacgtgccgttcccaccgcctggggcttccacgggctcttaccctatgccgcagccgttctcccccggattcggcgggcagtacgccggcgccggcgctggccacctctcagtggccccccaacgcatggcaggcgtggaggcctcggcgaccaaggaggcccgcaagaagcgcatggcgagacagcggcgcctgtcctgcctgcagcagcagcgcagccagcagctgagcctgggccagatccaggcctccgtccacctgcaggagccgtcccctcggtccacgcactccggcccggtcacgccgtcagcaggcggctggggattctggtcgccgagcagccagcagcaggtccagaacccgctctccaagtccaattcatcaagggcgccgcctccctcactggaagcggcggcggtggcgccacagacaaagcccgcgcctgctggtgctcggcaggacgacattcaccaccgcctcgcagcggcttcagataagcggcagggcgccaaggcggacaagaacctgcggttcctgctgcagaaggtgctgaagcagagcgacgtcgggagcctcggccgcatcgtgctccccaaaaaggaagcggaggttcacctgccggagctgaagacgagggatggcatctccatccccatggaggacatcggaacgtcgcgcgtgtggaacatgcggtacaggttttggcccaacaacaagagcagaatgtatctgctggagaacacaggggaatttgttcgttccaacgagctccaggagggggatttcatagtgatctactccgatgtcaagtcgggcaaatatctgatacggggcgtgaaggtaaggcccccgccggcgcaagagcaaggcagtggttccagcgcgggaggcaagcacaggcccctctgtccagcaggtccagagagagccgcagccgccggtgctcctgaagacgccgtcgtcgacggggtcagcggcgcctgcaaggggaggtctccggaaggcgtgcggcgggtccggcagcagggagccggcgccatgagccagatggcggtgagcatctag

SEQ ID NO: 284 - DNA, 858 bp, Glycine max
atggtctctcaatggaatgactgctcttgtcaccggcggcactcgtgggatcgggttttcatcattctctccttctcaattcaactcacgttctcttttctgattattactcatttcaaattctgtttcaggcactccatagtgagtgacttggctgcgtttggcgctgcagtgcacacctgttccaggacccaaacagagctcaacaaatgcttacaagagtggcagagtcaggggtttcaggtaactgggtcgctctgtgacgtgtcctcaccaccccagagagagaagctcattcaggaagttgcatccaccttcaatggcaagcttaacatctacgtgaacaatgttggaataaacattagaaagccaaccattgagtacactgctgaagaatattcacagattatgacagttaatttagactcctcattccatctgtgccagcttgcatatcctcttctgaaagcatctgaaaagggaagcattgtgttcatttcatctgttgctggtgtagtgagtttaggtactggagctgtctttgcagcaagtaaagctgcaattaatcagcttacaaaaaacctggcttgtgactgggccaaagacaacatacggagcaactgtgttgtaccatgggcaaccagaaccccggttgtagaacatttgttcaaagaccaaaagtttgtggatgatattatgtctcggactccaattaaacgtatagcagaaccagaagaagtgtcatcgttggtgacttttctttgcttgcctgctgcttcattcatcactggacaggttatttgtgttgatggaggattaactgtgaatggatttcaacccagcatgagaattacctag

SEQ ID NO: 285 - DNA, 1389 bp, Glycine max
atgttttgcaattttcacattattcttctaattgctcttgcacttttggtacaaatatcatctcagcttggctccaaggtagaagtgcttcctggctttgaaggccctcttccttttgaactggaaacagggtacgttggattaggagaaaaagatgatgacatgcaagtgttttactactttgttaagtcagaaaatgatcctcagaaagaccctcttatgctttggctaactggtggtcctggctgctcttcattttcaggtcttgcctttcaaataggtccacttcgattcaagattgaggagtatgatgggagtgtgccaaatttgatcttgaggccacagtcctggacaaaggtttgcaacattatttttgtagatttgccttttggaactggcttctcgtatgcaaaaaatctcactgctcaacggagtgactggaaattagttcaccatacccatcaatttcttaggaagtggctgattgatcacccagaatttctttcaaatgaattttatatgggagctgattcttattctggcatacctgcccctgctattgttcaagagatttcaaatggaaatgaaaaaggtctccaaccacggataaatctccagggatatctgctagggaaccccataacaacaagaaatgaaggaaatgatcaaatcccatttgctcatggaatgggacttatttctgatgaactatatgcgtcacttcagagaaattgtaaaggagagtatgaaaatagagattccagaaatgtgttgtgtttaagagatctcaaacactatgatgagtgcctttcaggaatcaatactttctatattttggatcgctattgtaaatctgattcgcctaaaaaacatgaagctcagtggaggagatctctgactcagaagtttgaggcctctcttaattctcatctcagagtgccagacataagatgccaaatttttgggtttttccttgccactcaatgggccaatgacgaaagtgttcgcaagtcactgcatattcgagagggaactataggcaaatgggaacgttgttacactacagattttgaggaacagatcttcagtagctttgagtttcatgtaaatctcagtgcaaaaggatatcgttctttaatatacagtggagatcatgatgcagttgttcctttcatgtcaacccaagcatggattagggctctaaactactccattgtggaagattggaggccatggcttctagaagaccaagttgcaggatacacaaggatttactcgaatcaaatgacatttgcaactgtgaagggttcaggacatacagctccagagtacaagcctgaggaaggttttgccatgttcagtagatggatagctaatatgcctttgtag

SEQ ID NO: 286 - DNA, 2313 bp, Zea mays
atggacacgccggataggccccgcgccgccgccgccgccgggttcgaggattctcctgtcttcaatttcatcaacaatctctcgcctataccaccacctaaacctttagactcagcacataatgtgcagctattcaagtcatcagacttggcacctgtttcttcgatctttgcctcaccacatgttaatccagtgaaggaaactaaagttttgatcagggatgaatctgttcaccttcctcaagaattgcactcgcctagcagtgtcaggactcgaatagacacctcaggctcttttagaatgatcagatgcaaagacattgtgtcggacaattgcaatatcacttgtcaactaaacgaggcatctattgattcttctgatcatacatcaaactctacaggccaattgactcaatccatacaggatgctgctggcagtatggaaagcgataaggatcaatgcgatgccaataaaacagaccttaccatatcccaggagtgcacaggcctagaaggtatgaaccttgatgagagtggcccagacaaaatggattcgtcacattctgggattgttgttcatgaaaaccagctatctgaacaaaacaatgacgaacctgcagcatataatgagggttacattattacacaccaatcaactagtgatatgctcactttagccataccatctggaacagaaacacaaccagtgaatgatacacaaatggctgataacccctactcttgtgaatccttgttggatgatcagtcaagtggatattgcacccagaattctgtgcatgaaccccatttgtactggactggggcagttgaagggtctgcagtatcctatactccccaaacactccctggtgctttgcaaagtcagctgatgccatgtaacaagctcagtgaaccaaaagattacgtgcctactgagcaaaatgccttgtcacagcacttacgtggcatgcgtaggcgcagccttttcaatgaaaaggctggaattagtaataaaggtgtagacaaaacttcggatcatcatcctgtaaattcaactacccccaaatgcaaaactatttctggtgacaactcaaagcctctaagaacccctccatgcgcattacctggtattggcttgcacttgaatgcccttgctacaatacctaaagagaaaatagtccctcgagagattcagtctactataaatgaatcaagtaacttgataggccctgctggatcttctccagcaccttttgagcaaaacattataaatgatgatttcactcaaacaactgatgttgcaactgccgaagcttctagtcagggtagtcccaagaagaaaaggcataagtttgacaatggtgatggcacttcatgcaagcgttgtagttgtaagaagtcaaaatgcctgaaactttactgtgagtgttttgctgctggagtctattgttctgagccttgttcgtgtatcggctgtcagaacaaccagagtcatatggaaacagttctgtctacacggcaacagattgaatctcgcaatccattagcatttgctcctaaagtcattcatacatctgagcctggtatggacttaggggacttttccaataaaactcctgcttcagctcgtcacaaaaggggatgcaattgcaagaagtcgtcgtgtctaaaaaaatactgtgaatgttttcagggcggcgtgggatgctccgtaagttgcagatgcgagggctgtaagaatgcttttggaaaacgggagggggcttctgtgttaggcataggggaacctaaacagggattggaagaaaaggatgtttgtgtgaaagaagaaaaaagtgaaatcgataaacagcttgttgtctaccagactactgacgctgctcctgctgaaaatgtactgaccacaccttccatggtggagtgcagacccttggcttgtcttccacccgcaagctccaagaaaagctccaaaaaaccacggtcttcaacaaagctcacaggacatccttctcggccgtgcaacttacaagctcctccaaagaccgacgttgtgctctccccattcgaaaactacgcggaaatggtcctcggtgatagcacatcagatatcctgaagggaaattcatctcctcatacttctgttaaagttgtgtcaccgaataagaagcgaatctctcccccacggatgggtatcgggctatctccaatctgtaggagtggcaggaagctgattctcaagtccatcccttctttcccttcccttggtggtgatgtaaacaacgaggatccgaaggccaagctcccagcgccttag

SEQ ID NO: 287 - DNA, 801 bp, Zea mays
atgccaccgccggcgccgctcttcctctcgctcgcctccacgccacctcctgcgcttatgcccgtacaccaccccagggccccgcaatccctaagcctagtccctgcggttgcctcctccagaaaggccgccgccgttctcgcgtgccccgtcgcctccccgcgccactccgactacttcgatccgcgggctccgccgccgccgcgcggggacggagggtacgggcgccctcccaacggcgcgcaggacgggagggtcttcacgagctacagcatctacaagggcaaggccgcgctgtcattcgatcctaggccgccgctcttcgtgccgctcgattctggggcgtacaaggtggccaaggagggcttcgtgctgctgcagttcgcgcccgccgtggccacacgacagtacgactggacgcgcaagcaggtgttctcattatctgtgtgggagataggaaccctgcttactcttggtccaacggattcatgcgagttctttcatgaccctttcaaggggcggagcgaagaaggtaaagtgcgtaaggttctaaaaattgagccaacaccagatggcaatggtcgctttttcaacctcagtgtccagaatcggcttatcaacgttgatgagagcatttacatccctataaccaagggagagtttgctgtcattgtatcaactttcaattacatcataccgcacctcatgggctggagcacatttgtaagttccatcaaacccgaggagtcacggccatacagcaggccgcagtccacgtctgagtacgaatggcgaaggtag

SEQ ID NO: 288 - DNA, 489 bp, Zea mays
atggccatgagagcgcttccgctgaccccttccaggagctcctcgtttggagctcaccaaaccaggccgagcggcggcggccccagatcagtgagagcttatgcgaagggagacgaggagggcgacaagcagtccctcttcggaagcatcaccgaggcgctggacttctcgcaggtccggtcggagaaggacgccgagctgctgtacgaggccagggagtccaccagaggtggagggaggatgacgagggagcagtacggagcacttaggcggaagattggtggcacctaccaggatttcttcaagtcatatgttgaagtcgacgggcaatacgtggaggagggttgggtcgacaagacctgcaagatctgcaagaaggacacaaggggggagccgaggcaggttgacaagctaggaagatacgctcacgttgcgtgcctggagaaccccaaaccgacgaactttttcgccaaaatcttcgccagatag

SEQ ID NO: 289 - DNA, 1551 bp, Arabidopsis thaliana
atggctcttcttctagtttcttcttcctcctcctatgccctcagagtcaccattttcttgtctttcttcttctttctctgcaatggcttctcttaccctactacttcttctcttttcaacacccatcaccatcgtcaccacttggccaagcacaactacaaagatgctctcactaaatcaatcctcttctttgaaggccaaaggtcagggaaacttccttctaaccagagaatgagttggagaagagactctggtctctctgatggctctgctcttcatgtggatttggttggagggtactatgatgcaggagacaatatcaaatttggtttcccaatggcattcacaaccacaatgctttcatggagtgtaattgaattcggtggactcatgaaatctgaattacaaaacgctaaaatagcgattcgttgggctactgattatctcctcaaagccacttcacaacctgacacaatctatgttcaagttggtgatgctaataaagaccattcttgttgggaaagacctgaagacatggatactgtaagaagtgtgtttaaagttgacaagaacattcctggttctgatgtcgccgctgaaaccgccgctgctctagccgccgccgccattgtattcagaaaatctgatccttcttactccaaagtcctcctcaaacgagccatcagtgtttttgcatttgcggacaaatacagaggaacttatagtgcaggattaaaacctgatgtttgtccattttattgctcttactctggttatcaggatgaattgttgtggggagctgcttggttacaaaaagcgacaaagaatataaaatatttgaattacataaaaatcaatggacaaatccttggagctgctgaatatgataacacttttggttgggataacaagcacgctggtgccagaatccttcttactaaggcatttttggttcagaatgtgaagacacttcatgaatacaaaggtcatgctgataatttcatctgctctgttattcctggagctcctttctcttctactcagtatacaccaggtggattattgtttaaaatggcagacgccaacatgcaatacgtgacgtcaacatcgttcttgctcttaacctatgccaaatacttaacctccgccaaaaccgtcgtccattgcggtggctccgtctacactcccggtcgtcttcgctccatcgccaaaagacaggtggattatctacttggagacaacccattaagaatgtcttacatggttggttacggtccaaaattcccacggagaatccaccaccgtggctcctcattaccttgtgttgcaagccacccggccaagatccaatgccaccaaggatttgcaatcatgaactctcaatctccaaaccctaacttccttgttggtgcagtcgttggtggtccggaccagcatgatcgcttcccagacgaacggtctgattacgagcagtccgagccggctacttacatcaattcaccactcgttggagctcttgcctatttcgctcacgcctatggtcaactctag

SEQ ID NO: 290 - DNA, 1008 bp, Glycine max
atggctgatgagagcgtcgttgagtccccagtgaagaggcagagagatgatgatgaagaaaatgaggtctctgtttccatggatgtggagggtggcaaagaccctcttagtaacggtttatcatctgtgattcctgggtggttctctgaaattagttcaatgtggcctggagaggctcactccttgaaggtggaaaagattttgtttcaaggaaagtctgaataccagaatgtcatggtcttccagtcatcaacatatggcaaggttcttgttttagatggagtaattcagctaacagaaagggatgaatgtgcctaccaagaaatgatcactcatcttcctctttgctctattccaaaccccaaaaaggttttggttatcggtggaggtgatggaggggtcatacgagaagtagcacaccattcttcagttgaaaagatagacatttgtgaaattgacaagatggttgttgatgtctccaaacaatacttccctgatgtagctgttgggtatgatgatcctcgtgtgacacttcatattggtgatggagttgcatttctgaaggaagttcctgaaggaacttatgatgctgttatagtggattcatccgatcctattggtcctgctcaagagctttttgaaaagcccttcttttcgtcagttgcaaaggctcttcgtccaggtggagttgtgtgcactcaggcagaaagcatatggcttcatatggatataattgaggacattgtggctaattgtcgccagatttttaaaggctctgtcaactatgcttggactactgttcctacatacccaagtgggatgattggttttatgctttgctcaactgagggaccacctgttgatttcaagcatccagtgaatcccatagatgaaaatgagagtcagaagtcagtaagaccgctgaaattttacaactctgagattcataccgcagctttctgcttgccgtcgtttgcgaagaggaagattggttctaaagcaaattag

SEQ ID NO: 291 - DNA, 384 bp, Zea mays
atgtcggggcgcggaaagggcgggaaggggctgggcaagggcggcgcgaagcgtcaccgcaaggtcctccgcgacaacatccagggcattacgaagccggcgatccggaggctggcgagaaggggcggcgtgaagcgcatctcggggctcatctacgaggagacccgcggcgtgctcaagatcttcctcgagaatgtcattcgcgacgctgtcacctacacggagcacgcccgtcgtaagaccgtcaccgccatggacgtcgtctacgcgctcaagcggcagggccgcaccctctacggatttggcggctgaggggtcaggggtgtcccccagcttctgctggtcgtggcagaagtcttgggtcgcggtcacgaaatggagtga

SEQ ID NO: 292 - DNA, 1386 bp, Arabidopsis thaliana
atggatccttgtccattcatccgtcttacaatcgggaacctagctttgaaagttccgttagcggcgaagacaacgagctccgtcgtgcatccgtcgtcttctccttgtttttgtaaaatcaaactcaaaaacttcccgccgcaaaccgccgcaatcccgtacattcctttggagacgactcagtttccggagatccaaaccctagccgccacgtttcatctcagcagctccgatattcaacgcttagcttccagatctatatttacttctaagccttgtcttaaaattttgatctacactggaagagccggcgctgcttgcggcgtacactccggtcgtcttctggcgaaagtctccgtaccgttggatctatctggtacgcaatcgaaaccgtgcgtcttccacaacggatggatatcagtcggaaaaggagctggaaaatcgtcgtcgtctgctcagtttcacctgaatgtgaaggcggagcctgatcctagattcgtttttcagtttgacggcgagcctgaatgtagtcctcaagtcgttcagattcaaggcaatatccggcaaccagttttcacatgcaaattcagttgccggcacaccggtgatcgtactcagagatcaagatcattgccgactgagacaagtgtttcacggagctggctaaactcgttcgggagtgagagagaacgtcctgggaaagagcgtaaaggatggtccataacagtccatgacttgtccggttcaccagtggccatggcgtcaatcgtcactccattcgtggcatctcctggaaccgatcgtgtgagccggtcaaaccctgggtcatggcttatactgcgtcccggagactgtacctggagaccgtggggaagacttgaagcatggcgggaacgcggtggagccactgatggtctaggttacagattcgaactcatcccagacggatcaagcggtgcaggaatcgtgcttgcggaatcaaccataagttctcacagaggtgggaaattctcaatcgagttgggatcgtcgccttcttcatcgtcgccaacaagtgtggtgaaccgatcgagaagccgtagaggtgggagtagtggaagcggtggaggagcatcgccggcgaatagtccgagaggagggagcggagattacggttacggattgtggccgtggaacgtgtacaaagggtttgtgatgtcagcaagtgtggaaggtgaagggaaatgtagtaagccttgtgtagaggtgagtgtgcagcacgttagctgtatggaagatgcggctgcttacgtggcgctttctgcagccattgatcttagtatggatgcttgcaggctgtttaatcaacggatgaggaaagagctttgccatgagtcactgagctag

SEQ ID NO: 293 - DNA, 768 bp, Oryza sativa
atgggcaggcagccgtgctgcgagaaggttggcctgaagaaggggccatggacggccgacgaggaccagaagctggtcaccttcctcctctccaatggccactgctgctggaggctcgtccccaagctcgcagggctgctcaggtgtgggaagagctgccggctgaggtggacgaactacctgcggcccgacctcaagaggggcctcctttccgaagaggaggagaagctggtcattgacctccacgagcagctcggcaacagatggtccaagattgcggcacggctccccgggaggacggacaacgagatcaagaaccactggaacacccacatcaagaagaagctcaagaagatgggccttgatcccgtcactcaccggccggtgatgtcactcgctcagcctgatcccctgaagcagcagcagcagcagcatgaaccgtccgtctccggcggcaccggtgccgacgacaaggaggaggaggaggaggagacgccgacgagcgcccagccacagggcgtcgcttgcgctgcttcatccgcctccgccgtgtcgtcgtcatgctcctcgtccgccccggcctccgccgcgacacccggcgcggacgtggactggcccggcctcttcgaggtggatgccattcttgacattgactgggctggcttattgtctgcctgcggcgacgatggcggctgcagcgccattggcgtcgatatgttgttcgaccaatgctctgacgttggctttgatcaagatgtgtggatgtag

SEQ ID NO: 294 - DNA, 3114 bp, Arabidopsis thaliana
atggagcgcgcaaggagacttgcttacagaggaatcgtcaaacgtctagttaacgacacaaaacgacaccgtaacgctgaaacacctcaccttgttcctcacgctccggcgaggtatgtctcttccctttcccctttcatctccacccctcgatctgtcaaccacacggcggctttcgggaggcaccagcagacgcgttccatctccgtcgatgctgttaaacccagcgatactttccctcgtcgtcacaactctgcaacaccagacgaacaaacccacatggctaaattctgtggctttgaccatatcgattcactcatcgatgctacggtgcccaaatcgattcgattagattccatgaagttctccaaattcgacgctggtttaaccgagagccaaatgattcaacacatggttgatttagcttccaagaacaaggttttcaaatccttcatcgggatgggttactacaacactcatgtccctactgtcattctccgtaacatcatggagaatccagcttggtacactcaatacactccttatcaagctgagatctctcaaggtcgtctcgaatcgctcctcaatttccagaccgtgatcacagatctcacgggtcttcctatgtccaatgcgtcgcttctggatgaaggcactgctgctgcggaggcaatggccatgtgtaacaacattcttaagggtaaaaagaagacctttgtcattgctagtaactgtcaccctcagactattgatgtttgtaagactagagctgatgggtttgatttgaaagttgtcacctctgatcttaaggatatagattacagctctggtgatgtttgtggggttcttgttcagtatcctggtactgaaggtgaagtcttggattatgctgagtttgttaagaatgctcatgctaatggtgttaaggttgtgatggctacggatttgctggctttgactgtgttgaaacctcctggagaatttggggcggatattgttgttggctctgctcaaaggtttggtgttccgatgggttatggtggtcctcatgctgcgttcttggctacttcacaagagtataagagaatgatgcctgggaggattattggtattagtgttgattcttcaggaaagcaagctctgcgtatggctatgcagactagagaacagcatattaggagggacaaagccactagcaacatctgtactgctcaagcgttgcttgccaacatggctgccatgtatgctgtttaccatggacctgcaggtctaaaatctattgcccagcgtgtccatggtctcgctggtatattttccttagggttgaacaagcttggggttgcagaagttcaagaacttcctttctttgacactgttaaaattaagtgttcggatgcacatgcaattgctgatgcagcttccaaaagtgaaattaatctgcgtgttgtggactcaaccactattactgcttcctttgacgaaacaaccaccttggatgatgtcgataaacttttcaaagtttttgcttctggcaagcctgttccatttacggctgaatctctagcacccgaggttcagaattccattccttctagcctaacaagagagagtccttatcttacccacccaatcttcaacatgtaccacacagagcatgagttgcttaggtacatccacaagttacagtcaaaggatctatcactgtgccacagcatgattccgttgggatcttgtacgatgaaactaaatgcaacaactgaaatgatgccagtcacatggccaagtttcactgacattcacccttttgctcctgttgaacaagcacaaggttatcaggaaatgttcgaaaatttgggtgacctcttgtgtacgatcactgggtttgactctttctcgttgcaacctaatgctggtgctgctggtgagtatgccgggcttatggttatccgcgcatatcacatgtcaagaggagatcatcaccgtaatgtgtgtatcatacctgtctctgcacacggtacaaaccctgcaagtgctgctatgtgcgggatgaaaattattacagttggaactgatgctaagggaaacattaacattgaggaggtgagaaaagctgcagaagccaacaaagacaacttagctgctcttatggttacatacccttcaactcatggagtctatgaagagggcatcgacgagatttgcaacataatacacgaaaatggaggtcaagtgtacatggatggtgccaacatgaatgcacaggttggtttgacgagccctggttttattggagcggatgtgtgccatctcaatctccacaagaccttctgtattcctcatggaggtggtggtcctggtatgggtcccattggtgtgaagaatcatttggcaccatttcttccttctcaccccgtgataccgactggtggtatcccacaacccgagaagacagcacctttgggtgcaatatccgctgcaccatggggatctgcgcttatcttgcctatatcttatacttacattgccatgatgggatctggtgggctcactgatgcctctaagattgcaattttgaatgccaattacatggcaaagcgcctagagaaacactacccagttcttttccgtggtgttaacggaacagtagcacacgaattcatcatagacttgagaggcttcaagaacactgctggaatagaaccagaggatgtggcgaaacggctaatggactatggattccatggacccacaatgtcttggcctgtccctggaactcttatgattgagccaaccgagagtgaaagcaaggcggagctagacaggttctgcgatgctctcatttcaatcagggaagaaattgcacagattgaaaaaggaaatgcagatgtccagaacaacgttctcaagggagctccacatcccccatcgttgctaatggcagacacatggaaaaagccgtattctcgagagtatgctgctttccctgcgccttggctccgctcctccaagttctggcccaccacagggcgtgtggacaatgtatatggagacaggaaactggtgtgcactctcctcccagaggaagaacaagtcgcagctgcagtgtctgcttag

SEQ ID NO: 295 - DNA, 1737 bp, Zea mays
atggcgtcctccaccgcggcctcgccgctcacctgccaccacctcggcagcgttggtgcccgccctcgcctcccgtccctctccatctccctccgccgccgctcctcctcttcctctaagcccacctccctttcccactccctcccctccaagcactcgctggccccaccccccgccgcatccgcatcctcccgtcgcggtctcacccccgtacccgcctccgcctccgccgccgcggctccagcgccggatccagtgccggttccagcaccggctccagcgccggctccagcaccggccgccccgccgaagaagcccgcgctgcagggcgcggccatcaagccgctcctggcctccatcgcgactggcgtcctcatctggctcatcccgccccccgccggcgtgccccgcaacgcgtggcagctcctagccatcttcctctccaccatcgtcggcatcatcacccagccgctgcccctcggcgcggtcgccctcctcggcctcggcgccgccgtgctcagccgcacgctcacgttcgccgcggccttctcggccttcggcgacccgatcccctggctcatcgcgctcgccttcttcttcgcgagggggttcatcaagaccggcctcggctcccgcgtcgcctacgccttcgtcgccgccttcgggtcctcctccctcggcctcggctactcgctcgtattcgccgaggcgctcctcgcccccgccatcccctccgtctcggcgcgcgctggcggcatcttcctaccgctcgtcaagtctctctgtgaggcatgcggctcgcgcgccggcgacggcacggagcgccggctcggagcctggctcatgctcacgtgctttcagacctccgtcgtctcgtcagccatgttcctcactgcgatggcggccaacccgctctcggccaacctcacagctgccactatcggcgaggggatcgggtggacgctctgggccaaggccgccattgtgccggggctgctgtcgctcgtgctcgtgccgctcattctgtatgtgatctacccgccggaggtgaaggcgagccccgatgcgccacgcctggccaaggagcggctcgccaagatgggacccatgagcaaggaggagacgatcatggccggcacgctgctgcttacggttggtctttggatctttggaggcatgctgaatgtggatgcggtttctgcagcaattcttggcctagcagtcctcttaatctcaggggttgtcacatggaaagagtgtttggcagagtctgtggcgtgggatacccttacatggtttgcagcacttatagcaatggctggctacctcaacaaattcgggctgatctcttggttcagtgagactgttgtgaagtttgttggagggcttggcatgtcatggcaactctcattcggtgtgctggtgctgctgtacttctactcgcactatttctttgccagtggtgccgcacacatcggagcaatgttcaccgcgttcctgtcggtggcgagtgccctgggcaccccgtcgcttttcgctgccatggttctttcattcctatcgaacctcatgggcgggaccacccactacggcatcggctctgctcccgtcttatacggcgccgggtatgtcccattggctcagtggtggggctatgggtttgtcatctccgttgtaaacatcatcatctggctcggggtgggcggcttctggtggaagataatcgggctgtggtag

SEQ ID NO: 296 - DNA, 960 bp, Zea mays
atggatttggtcgtcgaaagcgtcgttcatgggcgcttacccgtcaggccatcaaggtttcctcttctgcccggctcgttgccctccactaccgtggcactgagtgctgccttttccggacgtccatgcccacccattgttcgtcggaatgccccagcggtggtgccatttgccaagaagaagaggaatgaatatatcgaagatccgccagatgaggaggtcgcagatgatttcaccgacgagatggaggaggacttcgacgacgccaaagaagacgaaggcgatgtaatggatgatgacgaagagtatgaggacgactatgactttgaagatgattttgagagtgatgatgaacaggatctttatgctggagatggaggtgctggtggcggtatatcccttgctggtgcatggtgggacaaggaagcgttagctttggcagaacaggtctcagcatcattcaacgacgacttgaaaatatatgctttcaagacagctgcaaatttgactattagagtacgcattgagaagatgtccaccaggtatggttctccaacgatagatgacattgaagcatacacaattgcatatcgtgcaaagttggacgaagcagagtcagcaggaaagataccgaaaaacatatcgttggaggtgtcatcccctggtgtggagagagttatccgtatccctgaagagctcgaacgattcaaagaaagggcaatgtatgtcagatacactacagcaagcgatgaggcaaccacacctcaggaaggtgacggcgtgctaacgctaatttcctatgacatggacctgcgagagtgcacctggggcatagctgatgtgaagataaaccggcagcagtctggcaagggcaggcccctgagcaagaagcagagggaatggaggctgcagacaccgttcgagtcgctgaagttggtcaggctgtactctgaatgttag

SEQ ID NO: 297 - DNA, 1146 bp, Zea mays
atggcgaccgctgctgctgcgtcccgggtggctgtctcggcgccggtcttcggttcggacggcggcgccaggagctccgggatcaagggcaacaacaatgttagcttcggcagcaaatcatgggtcggcggcacattggcctgggagagcagctgctcggtgcggcccaggcacgccagcaaggtgctctgcatgtccgtccagcaggcgagcaggagtaaggtctccgtcgcgccgctccatctcgagagcgccaaggagccacctctcaacacgtacaagcccaaggagcccttcacggccaccattgtctcggtggagagtctggtcggccctaaagctccgggggagacttgccacatcgttatcgaccatggtggcaatgggccgtactgggagggccagagctacggtgtcattcctcctggagaaaatcctaaaaagcctggagccccacaaaatgtccggctttattcaattgcatcgactaggtatggagataacttcgatgggcgaaccggaagcttgtgtgtccgccgtgcagtttattatgatcctgagactggcaaggaggacccctcaaagaatggtgtctgcagtaatttcctgtgcaactcaaaacctggggacaagattcaattaacaggtccctccggcaaaataatgcttctgcctgaggaggatccaaacgcaacccatatcatgattgccacgggcaccggtgttgcccccttccgtgggtacctgcgccgcatgttcatggaagatgtcccgaactacagatttggtggcttggcctggctcttcctcggcgttgccaattcagacagccttctgtacgacgaagaattcaccagctaccttaagcagtatccggacaatttcaggtacgacaaagccctcagcagggagcagaagaacaggagcggcggcaagatgtacgttcaggacaagatcgaggagtacagcgacgagatcttcaagctcctggacggcggcgcgcacatctacttctgcggtttgaaggggatgatgcctggaatccaggacacccttaagaaggtggcggagcggagaggcgagagctgggaccagaagctggcccagctcaagaagaacaagcaatggcacgtcgaggtctactag

SEQ ID NO: 298 - DNA, 2385 bp, Arabidopsis thaliana
atggtacattcagagtcatcaatacttagttccttgcgcggtggtgatggcggtggtattccttgttctaaggatgaactagcaataaatggtagttacaccgatcctatggggcggaggaagtccaagcggtttaaggttgctgcggaaagtgagttttcacctgattttggatcgattaccaggcagctcagatcgagaagaatgcagaaggagttcacagttgagacttacgagaccaggaatgtttctgatgtttgtgttctctcttctcaagctgatgttgagttgattcctggagaaattgttgcagaaagagatagctttaagtcggttgattgtaatgacatgtcggttgggttaaccgaaggagctgaatctcttggagttaacatgcaagaacctatgaaagataggaatatgccagagaacacaagtgagcaaaatatggtggaggtccatcctccaagcataagcctgccagaggaagatatgatggggtctgtttgcaggaaaagcatcactggaacaaaggagcttcacggaagaacgatctctgttgggagagacttatctccaaatatggggagcaagttttcaaagaatggaaagaccgctaaacgttctatatcggtggaagaggaaaacttggttctggagaagtcagattctggagaccatttgggtccatcaccagaggttttggaacttgagaaatcagaggtttggataattacagacaaaggggttgtaatgccttcaccagtgaagccttccgagaagaggaatggagattatggtgaaggatctatgaggaagaatagtgagagggttgccctggataaaaagagattagctagtaaatttcggttgtcaaatggtgggcttcctagttgctcaagcagtggggatagtgctcggtataaagttaaggaaacaatgcgtcttttccatgaaacttgtaaaaaaattatgcaagaggaagaagcaaggcctaggaaaagagatggtggcaatttcaaagtggtttgcgaggcttcgaaaattctcaagagtaaagggaaaaatctttatagtggtactcagattattggaactgtgcctggtgttgaggttggcgatgaatttcaatatagaatggagctgaaccttcttggtatacatagaccaagtcaaagtggtatcgactatatgaaagatgacggtggggaactagttgccacgagtattgtatcctcgggaggttataatgacgtgcttgataactctgatgtcttgatctacacgggtcaaggcggaaatgtggggaaaaagaaaaataatgaaccacccaaagaccagcagcttgtaacgggaaaccttgcgttgaaaaacagtataaacaaaaagaaccctgtgcgggtcataagaggcatcaaaaatacgacattacaatcatcagttgttgcaaagaattatgtttacgatggattgtatctggtggaagagtactgggaagaaaccgggtctcacggtaaactcgtcttcaagttcaaactacggcgtattcctggacaacccgagcttccctggaaagaggttgcgaaatcgaaaaaatctgagttccgggatggtctttgcaatgttgatatcacagaagggaaagagacattacccatatgcgctgtgaacaatttagacgatgagaaaccgccaccgtttatctacacggctaaaatgatatatccggattggtgccggccaattcctccaaagagctgcggttgcacaaacggctgctccaagtcaaaaaactgtgcctgcattgtgaaaaacggtggaaagataccttattacgatggagccattgttgaaattaagcccctggtctatgagtgtggcccacactgcaaatgcccaccttcttgcaacatgagagtctcacagcacgggattaagatcaagctggagatcttcaaaacggagtcaagaggttggggagtgagatcgctggaatctattcctatcgggagcttcatctgtgagtacgcaggagagcttctagaggataaacaagctgaaagccttaccgggaaagatgagtatctttttgatctcggggacgaggatgatccgttcaccataaacgcagcacagaaagggaacatagggaggtttataaaccatagctgctcgccgaatctgtacgcacaggacgtattgtacgaccatgaggaaataagaatacctcacattatgttctttgcactggacaatatacctccacttcaggaactctcgtacgactacaattataagatcgatcaggtatacgactctaatggtaatatcaagaagaaattttgctattgtggttccgctgagtgtagtggtaggctctactag

SEQ ID NO: 299 - protein, 359 aa, Zea mays
MEEITQHFGVGASSHGHGHGQHHHHHHHHHPWASSLSAVVAPLPPQPPSAGLPLTLNTVAATGNSGGSGNPVLQLANGGGLLDTCVKAKEPSSSSPYAGDVEAIKAKIISHPHYYSLLTAYLECNKVGAPPEVSARLTEIAQEVEARQRTALGGLAAATEPELDQFMEAYHEMLVKFREELTRPLQEAMEFMRRVESQLNSLSISGRSLRNILSSGSSEEDQEGSGGETELPEVDAHGVDQELKHHLLKKYSGYLSSLKQELSKKKKKGKLPKEARQQPLSWWDQHYKWPYPSETQKVALAESTGLDLKQINNWFINQRKRHWKPSEEMHHLMMDGYHTTNAFYMDGHFINDGGLYRLG

SEQ ID NO: 300 - protein, 599 aa, Arabidopsis thaliana
MASFTATAAVSGRWLGGDHTQPPLSSSQSSDLSYCSSLPMAGRVTRKLNVSSALHTPPALHFPKQSSNSPAIVVKPKAKESNNKQMNLFQRAAAAALDAAEGFLVSHEKLHPLPKTADPSVQIAGNFAPVNEQPVRRNLPVVGKIPDSIKGVYVRNGANPLHEPVTGHHFFDGDGMVHAVKFEDGSASYACRFTQTNRFVQERQLGRPVFPKAIGELHGHTGIARLMLFYARAAAGIVGPAHGTGVANAGLVYFNGRLLAMSEDDLPYQVRITPNGDLKTVGRFNFDGQLESTMIAHPKVDPESGELFALSYDVVSKPYLKYFRFSPDGTKSPDVEIQLDQPTMMHDFAITENFVVVPDQQVVFKLPEMIRGGSPVVYDKNKVARFGILDKYAEDSSNIKWIDAPDCFCFHLWNAWEEPETDEVVVIGSCMTPPDSIFNESDENLKGVLSEIRLNLKTGESTRRPIISNEDQQVNLEAGMVNRNVLGRKTKFAYLALAEPWPKVSGFAKVDLTTGEVKKHLYGDNRYGGEPLFLPGEGGEEDEGYILCFVHDEKTWKSELQIVNAVSLEVEATVKLPSRVPYGFHGTFIGADDLAKQVV

SEQ ID NO: 301 - protein, 230 aa, Arabidopsis thaliana
MEKASFKEKSSVAKMVGTIVSLVGALVVVLYHGPRVFTPSSPPFPQLRQLLLPLSSSNSDWIIGGCLLAIKDTLVPVAFILQAHIMKLYPAPFTVSFFYFLIASILTSLIGIVAEKNNPSIWIIHFDITLVCIVVGGIFNPGYYAIHLWAVRNKGPVYLAIFRPLSILIAVIMGAIFLGDSFYLGSLVGGILISLGFYTVMWGKAKEGKTQFLSLSEETPLLDENIDDRI

SEQ ID NO: 302 - protein, 594 aa, Arabidopsis thaliana
MQKRIALSFPEEVLEHVFSFIQLDKDRNSVSLVCKSWYEIERWCRRKVFIGNCYAVSPATVIRRFPKVRSVELKGKPHFADFNLVPDGWGGYVYPWIEAMSSSYTWLEEIRLKRMVVTDDCLELIAKSFKNFKVLVLSSCEGFSTDGLAAIAATCRNLKELDLRESDVDDVSGHWLSHFPDTYTSLVSLNISCLASEVSFSALERLVTRCPNLKSLKLNRAVPLEKLATLLQRAPQLEELGTGGYTAEVRPDVYSGLSVALSGCKELRCLSGFWDAVPAYLPAVYSVCSRLTTLNLSYATVQSYDLVKLLCQCPKLQRLWVLDYIEDAGLEVLASTCKDLRELRVFPSEPFVMEPNVALTEQGLVSVSMGCPKLESVLYFCRQMTNAALITIARNRPNMTRFRLCIIEPKAPDYLTLEPLDIGFGAIVEHCKDLRRLSLSGLLTDKVFEYIGTYAKKMEMLSVAFAGDSDLGMHHVLSGCDSLRKLEIRDCPFGDKALLANASKLETMRSLWMSSCSVSFGACKLLGQKMPKLNVEVIDERGAPDSRPESCPVERVFIYRTVAGPRFDMPGFVWNMDQDSTMRFSRQIITTNGL

SEQ ID NO: 303 - protein, 239 aa, Arabidopsis thaliana
MVDAKQVRFIIGVIGNVISFGLFAAPAKTFWRIFKKKSVEEFSYVPYVATVMNCMLWVFYGLPVVHKDSILVSTINGVGLVIELFYVGVYLMYCGHKKNHRRNILGFLALEVILVVAIILITLFALKGDFVKQTFVGVICDVFNIAMYGAPSLAIIKVVKTKSVEYMPFLLSLVCFVNAGIWTTYSLIFKIDYYVLASNGIGTFLALSQLIVYFMYYKSTPKEKTVKPSEVEISATERV

SEQ ID NO: 304 - protein, 158 aa, Arabidopsis thaliana
MGEIGFTEKQEALVKESWEILKQDIPKYSLHFFSQILEIAPAAKGLFSFLRDSDEVPHNNPKLKAHAVKVFKMTCETAIQLREEGKVVVADTTLQYLGSIHLKSGVIDPHFEVVKEALLRTLKEGLGEKYNEEVEGAWSQAYDHLALAIKTEMKQEES

SEQ ID NO: 305 - protein, 217 aa, Zea mays
MGGRVDHEYSYLFKMVLIGDSGVGKSNILSRFTRNHFSLDSKSTIGVEFATKSLQIDGKTIKAQIWDTAGQERYRAITSAYYRGAVAALLVYDITKRQSFDNVHRWLRELRDHADSSIVIMMVGNKSDLIHLRAISEDEGKALAEKEGLFFLETSAMEAINVEEAFQTIITEVYGIVNRKALAAKEAAATAAPLPSQGKTISIDSNAGNTKKACCST

SEQ ID NO: 306 - protein, 544 aa, Zea mays
MGNQCPNGTLGSDYYNRPTSRFADGCLEDDRYSDLKKFDKPWPEVNSFKPTAVGILKRGLDPTSITVLERKTADIREHYIIGRRLGQGQFGTTFLCTEISTGCEYACKTIPKRKLITKEDVEDVRREIQIMHHLSGHKNVVSIKDVYEDGQAVYIVMELCAGGELFDRIQEKGHYSEQKAAELIRIIISLVAMCHSLGVMHRDLKPENFLLWDKEDDLSIKAIDFGLSVFFKPGQVFTELVGSPYYVAPEVLHKRYGPEADVWSAGVILYVLLSGVPPFWAETQQGIFDAVLKGHIDFDSDPWPKISESAKNLIRKMLCPCPSERLKAHEVLRHPWICENGVATDQALDPGVLSRLKQFSTMNKLKKLALRVIAERLSEEEIAGLRQMFKAVDVQNRGVITFGELRQGLKRYGSELENREISDIMEVADNDNNVTINYEEFIAATVPLNKIEREEHLMAAFTYFDKDGSGYITVDKLQRACGEHDMDDTFLEEIILEVDQNNDGQIDYAEFVAMMQGSKVGLGWQQMETTLNVTLRDAPQVHCH

SEQ ID NO: 307 - protein, 565 aa, Zea mays
  misc_feature (149)..(149): Xaa can be any naturally occurring amino acid
  misc_feature (167)..(167): Xaa can be any naturally occurring amino acid
MALSACPAQEELLQPAGRPLRKQLAAAARSINWSYSLFWSISSTQRPRVLTWTDGFYNGEVKTRKISHSVELTADQLLMQRSEQLRELYEALQSGECDRRAARPVGSLSPEDLGDTEWYYVICMTYAFLPGQGLPGRSSASNEHVWLCXRAPRRQQGLPPRAPGQEXSIQTIVCIPLMGGVLELGTTDKVPEDPDLVSRATAAFWEPQCPTYSKEPSSNPSAYETGEAAYIVVLEDLDHNAMDMETVTAASGRHGTGQEELGEAGSPSNAISLEHITTGIDEFYSLCEEMDVQPLEDAWIMDGSNFEVPSSALPVDGSSAPADGSRATSFVVWTRSSHSCSGEAAAVPVIEEPQKLLKKAVAGGGAWANTNCGGGGTTVTAQENGAKNHVMSERKRREKLNEMFLVLKSLVPSIHKVDKASILAETIAYLKELQRRVQELESRRQGGSGCVSKKVCVGSNSKRKSPEFAGGAKEHPWVLPMDGTSNVTVTVSDTDVLLEVQCRWEKLLMTRVFDAIKSLHLDALSVQASAPDGFMRLKIGAQFAGSGAVVPGIISQSLRKAIGKR

SEQ ID NO: 308 - protein, 70 aa, Escherichia coli
MQEGMEVKGIVKNLTDYGAFVDLGGVDGLLHITDMAWKRVKHPSEIVNVGDEITVKVLKFDRERTRVSLG

SEQ ID NO: 309 - protein, 92 aa, Escherichia coli
MEQKKANIYKGKITRIEPSLEAAFVDYGAERHGFLPLKEIAREYFPANYSAHGRPNIKDVLREGQEVIVQIDKEERGNKGAALTTFISLAGS

SEQ ID NO: 310 - protein, 81 aa, Saccharomyces cerevisiae
MLHKVYEGKVRNITTFGCFVQIFGTRMKNCDGLVHISEMSDQRTLDPHDVVRQGQHIFVEVIKIQNNGKISLSMKNIDQHS

SEQ ID NO: 311 - protein, 77 aa, Escherichia coli
MAEIEVGRVYTGKVTRIVDFGAFVAIGGGKEGLVHISQIADKRVEKVTDYLQMGQEVPVKVLEVDRQGRIRLSIKEA

SEQ ID NO: 312 - protein, 72 aa, Escherichia coli
MAKEDNIEMQGTVLETLPNTMFRVELENGHVVTAHISGKMRKNYIRILTGDKVTVELTPYDLSKGRIVFRSR

SEQ ID NO: 313 - protein, 69 aa, Escherichia coli
MNKGDRVEGKIKSITDFGIFIGLDGGIDGLVHLSDISWNVAGEEAVREYKKGDEIAAVVLQVDAERERI

SEQ ID NO: 314 - protein, 299 aa, Arabidopsis thaliana
METEGRRREVVVSSLQFACSDDISTNVAAAERLVREAHAKGANIILIQELFEGYYFCQAQREDFFKRAKPYKNHPTIARMQKLAKELGVVIPVSFFEEANTAHYNSIAIIDADGTDLGIYRKSHIPDGPGYQEKFYFNPGDTGFKVFQTKFAKIGVAICWDQWFPEAARAMVLQGAEILFYPTAIGSEPQDQGLDSRDHWRRVMQGHAGANVVPLVASNRIGKEIIETEHGPSQITFYGTSFIAGPTGEIVAEADDKSEAVLVAQFDLDMIKSKRQSWGVFRDRRPDLYKVLLTMDGNL

SEQ ID NO: 315 - protein, 259 aa, Oryza sativa
MISPDAARNVVGIIGNVISFGLFLAPVPTFWRICKRKDVEEFKADPYLATLLNCMLWVFYGIPVVHPNSILVVTINGIGLLVEGTYLLIFFLYSPNKKRLRMCAVLGVELVFMLAVILGVLLGAHTHEKRSMIVGILCVFFGSIMYFSPLTIMGKVIKTKSVEYMPFFLSLVCFLNGVCWTAYALIRFDIYVTIPNGLGALFGAIQLILYACYYRTTPKKTKAAKDVEMPSVVVSGTGAAAAAGGGNTGGGSVSVTVER

SEQ ID NO: 316 - protein, 179 aa, Zea mays
MIISKKNRREICKYLFHEGVLYAKKDYNLAKHPKLDVPNLEVIKLMQSFKSKEYVRETFSWQYYYWYLTNDGIEHLRSFLNLPSEVVPNTLKKSSKPPSRPFGSGPPGDRPRGPPRYEGDRPRFGDRDGYRGGPRGAPGDFGGDKGGAPADFQPSFRGSRPGFGRGGGGAFGAGGSSME

SEQ ID NO: 317 - protein, 265 aa, Arabidopsis thaliana
MATTNSLHHHHHSSPSYTHHRNNLHCQSHFGPTSLSLKQPTSAATFSLICSASSTSSSTTAVSAVSTTNASATTAETATIFDVLENHLVNQNFRQADEETRRLLIQISGEAAVKRGYVFFSEVKTISPEDLQAIDNLWIKHSDGRFGYSVQRKIWLKVKKDFTRFFVKVEWMKLLDTEVVQYNYRAFPDEFKWELNDETPLGHLPLTNALRGTQLLKCVLSHPAFATADDNSGETEDELNRGVAVAKEQAGVGADKRVFKTNYSF

SEQ ID NO: 318 - protein, 426 aa, Arabidopsis thaliana
MSVSLSAASHLLCSSTRVSLSPAVTSSSSSPVVALSSSTSPHSLGSVASSSLFPHSSFVLQKKHPINGTSTRMISPKCAASDAAQLISAKEDIKVLLRTKFCHPILVRLGWHDAGTYNKNIEEWPLRGGANGSLRFEAELKHAANAGLLNALKLIQPLKDKYPNISYADLFQLASATAIEEAGGPDIPMKYGRVDVVAPEQCPEEGRLPDAGPPSPADHLRDVFYRMGLDDKEIVALSGAHTLGRARPDRSGWGKPETKYTKTGPGEAGGQSWTVKWLKFDNSYFKDIKEKRDDDLLVLPTDAALFEDPSFKNYAEKYAEDVAAFFKDYAEAHAKLSNLGAKFDPPEGIVIENVPEKFVAAKYSTGKKELSDSMKKKIRAEYEAIGGSPDKPLPTNYFLNIIIAIGVLVLLSTLFGGNNNSDFSGF

SEQ ID NO: 319 - protein, 432 aa, Glycine max
MDKLYGLSHLFMTVFLHNFSMFMVVPAITDVTMAALCPGQDECSLAIYITGFQQAMIGLGTLVMMPLLGNLSDKYGRKAILTLPMILTIIPVGILAYSRTKKFFYVYYVFKILISMVCEGSVPCLALAYVADNVPESGRSTVFGILSGIGSAAFVCATLSARFLSSALTFQVSTLIAVIGALYMQFFLRDSVIDDKHLYTPIISQGNPIISKVNGNLESKKHLLKALRSIKDLTSFLNSSLTINQAAIVAFFNSLADVGLHGSLLYFLKAQFHFDKNQFADLMVISGIAGTVSQLLLMPILAPILGETRLLSVGLFFHCVHMFLYSMAWSSLVPYASAMFSILYVFSHPCIRSIVSKEAGPHEQGKAQGCISGICSIAHIVSPLVFSPLTALFLSEKAPFDFPGFSIMCIGFASMISFVQSLMLRVAPPILN

SEQ ID NO: 320 - protein, 379 aa, Cupriavidus metallidurans
MIRTKALQSSNLSPLCTRKLGLELLGHDACHFQALVRIAPLVVVPAHDLDERAVQRDTGFSIENRGAGITAEVRGHNLVFGVAQHALQRALALGLHLGADFFVLGRVFQFDGQVDHRNVRGRHAERHTGQLLVQLRNHHANGLGGASRRRDDVFQDATATAPVLVRRTIHGLLRGGGSVHGRHQAALDAPLVVQDLCHRGQAVGRAACVRDDRFALVRLVVHAEHEHRGVVLRRGRHDHLLGARVDVLLRAFLRQEDAGRLDHHVGADFAPLQLGRILDGGQADLLAVDHERVAFHRHFAVEAAVDRVVLQHVRQVVRFQQVVDGDDFNVLEVRGGGAEHHAPDAAKAVDADLDGHGPAGACFFVQTCDKSGAPGLIKG

SEQ ID NO: 321 - protein, 446 aa, Zea mays
MAAAAGDGAGEARARALLQQHRPFATPPGEYHHFGAPSAAADEMVEAVVLRTPLKRKHNDRTENEAAESNDWMSPGYANAGSSPVPTPPSGKGLKASTKPKATKGQKSGPQTPLGFGSPGNPSTPVGGCRYDSSLGLLTKKFLNLLKGAPGGIVDLNNAAETLEVQKRRIYDITNVLEGIGLIEKKLKNNIRWKGVDDSRPGEVSDDMSILQADIDALTLQERNLDERISEMRDRLRGLTEDENNQKWLYVTEEDIKSLPCFQNQTLIAIKAPHGTTLEVPDPDEVNDYPQRRYRIVLRSTMGPIDVYLVSQFEEMSGMETPPRPTQTISMDSLENPRTPLAADCNKVTGMESNIHGGLILPSDAPSSSQDISGMMKIVPSELDADTDYWLLSDNTGVSMTNMWETGPDEWDGIEKFNAEDFLEVGTPQQQDKPADVVDDDPSCII

SEQ ID NO: 322 - protein, 322 aa, Zea mays
MEDAVAIVPRFFDLPLWLLTGNAMVDGLDPMTFRLPAHFFGVYDGHGGAQVANYCRERLHVALLEQLSRIEETACAANLGDMEFKKQWEKVFVDSYARVDDEVGGNTMRGGGEEAGTSDAAMTLVPEPVAPETVGSTAVVAVICSSHIIVSNCGDSRAVLCRGKQPVPLSVDHKPNREDEYARIEAEGGKVIQWNGYRVFGVLAMSRSIGDRYLKPWIIPVPEVTIVPRAKDDECLILASDGLWDVMSNEEVCEIARKRILLWHKKNSTSSSSAPRVGDSADSAAQAAAECLSKLALQKGSKDNITVVVVDLKAQRKFKSKT

SEQ ID NO: 323 - protein, 213 aa, Zea mays
MEVKLWNDKRERELLESYADLYAIIKAVEKLERAYVRDLVSAADYEAECLKLISQFNSLSSSLAGAVTVPRFVQAYRLDCPAALNRLLQSGVPATVELRAASASSAPAATAASASAIAHCVQTFITAMDAVKLNMLANDQVRPLLQDVATSMARLGSLLPPDFEGKVKVNEWLAKLHKMGAADELTEQQARQLNFDLDSAYSAFLAALPAAGL

SEQ ID NO: 324 - protein, 395 aa, Zea mays
MAGVTATGMAGVPATFSSATAQIGGFLSKKPYAPPLWATHLSPMPCHTFSLGHFPTPIHKWNLPNLPEGTEVWIKRDDLSGMQLSGNKVRKLEFLMADAVAQGADCVITVGGIQSNHCRATAVAAKYLNLDCYLILRTSKLLVDKDPGLVGNLLVERLVGAHVDLVSKEEYGKIGSVALADLLKKRLLEEGRKPYVIPVGGSNSLGTWGYIEAIREIEQQIQQSADVQFDDIVVACGSGGTIAGLALGSRLSSLNTKVHAFSVCDDPEYFYDYVQGLIDGLNSGLDSHDIVSIENAKGLGYAMNTAEELKFVKDIAASTGIILDPVYSGKAVYGLLKDMAGNPAKWKGRKVLFIHTGGLLGLYDKADQLSSLAGSWRRMDLEDSVPRKDGTGKMF

SEQ ID NO: 325 - protein, 465 aa, Arabidopsis thaliana
MGIMMMILGLLVIIVCLCTALLRWNQMRYSKKGLPPGTMGWPIFGETTEFLKQGPDFMKNQRLRYGSFFKSHILGCPTIVSMDAELNRYILMNESKGLVAGYPQSMLDILGTCNIAAVHGPSHRLMRGSLLSLISPTMMKDHLLPKIDDFMRNYLCGWDDLETVDIQEKTKHMAFLSSLLQIAETLKKPEVEEYRTEFFKLVVGTLSVPIDIPGTNYRSGVQARNNIDRLLTELMQERKESGETFTDMLGYLMKKEDNRYLLTDKEIRDQVVTILYSGYETVSTTSMMALKYLHDHPKALEELRREHLAIRERKRPDEPLTLDDIKSMKFTRAVIFETSRLATIVNGVLRKTTHDLELNGYLIPKGWRIYVYTREINYDTSLYEDPMIFNPWRWMEKSLESKSYFLLFGGGVRLCPGKELGISEVSSFLHYFVTKYRWEENGEDKLMVFPRVSAPKGYHLKCSPY

SEQ ID NO: 326 - protein, 996 aa, Arabidopsis thaliana
MEPTEKPSTKPSSRTLPRDTRGSLEVFNPSTQLTRPDNPVFRPEPPAWQNLSDPRGTSPQPRPQQEPAPSNPVRSDQEIAVTTSWMALKDPSPETISKKTITAEKPQKSAVAAEQRAAEWGLVLKTDTKTGKPQGVGVRNSGGTENDPNGKKTTSQRNSQNSCRSSGEMSDGDVPGGRSGIPRVSEDLKDALSTFQQTFVVSDATKPDYPIMYASAGFFNMTGYTSKEVVGRNCRFLQGSGTDADELAKIRETLAAGNNYCGRILNYKKDGTSFWNLLTIAPIKDESGKVLKFIGMQVEVSKHTEGAKEKALRPNGLPESLIRYDARQKDMATNSVTELVEAVKRPRALSESTNLHPFMTKSESDELPKKPARRMSENVVPSGRRNSGGGRRNSMQRINEIPEKKSRKSSLSFMGIKKKSESLDESIDDGFIEYGEEDDEISDRDERPESVDDKVRQKEMRKGIDLATTLERIEKNFVITDPRLPDNPIIFASDSFLELTEYSREEILGRNCRFLQGPETDLTTVKKIRNAIDNQTEVTVQLINYTKSGKKFWNIFHLQPMRDQKGEVQYFIGVQLDGSKHVEPVRNVIEETAVKEGEDLVKKTAVNIDEAVRELPDANMTPEDLWANHSKVVHCKPHRKDSPPWIAIQKVLESGEPIGLKHFKPVKPLGSGDTGSVHLVELVGTDQLFAMKAMDKAVMLNRNKVHRARAEREILDLLDHPFLPALYASFQTKTHICLITDYYPGGELFMLLDRQPRKVLKEDAVRFYAAQVVVALEYLHCQGIIYRDLKPENVLIQGNGDISLSDFDLSCLTSCKPQLLIPSIDEKKKKKQQKSQQTPIFMAEPMRASNSFVGTEEYIAPEIISGAGHTSAVDWWALGILMYEMLYGYTPFRGKTRQKTFTNVLQKDLKFPASIPASLQVKQLIFRLLQRDPKKRLGCFEGANEVKQHSFFKGINWALIRCTNPPELETPIFSGEAENGEKVVDPELEDLQTNVF

SEQ ID NO: 327 - protein, 408 aa, Arabidopsis thaliana
MGKKKGKAIIVGGSIAGLSCAHSLTLACWDVLVLEKSSEPPVGSPTGAGLGLDPQARQIIKSWLTTPQLLDEITLPLSIDQNQTTDSEKKVTRILTRDEDFDFRAAYWSDIQSLLYNALPQTMFLWGHKFLSFTMSQDESNVKVKTLVVETQETVEIEGDLLIAADGCLSSIRKTFLPDFKLRYSGYCAWRGVFDFSGNENSETVSGIKKVYPDLGKCLYFDLGEQTHSVFYELFNKKLNWIWYVNQPEPDLKSNSVTLKVSQEMINKMHQEAETIWIPELARLMSETKDPFLNVIYDSDPLERIFWGNIVLVGDAAHPTTPHGLRSTNMSILDAEVLGKCLENCGPENVSLGLEEYQRIRLPVVSEQVLYARRLGRIKQGLDHDGIGDGVFGLEQRNMPFFSCAPLI

SEQ ID NO: 328 - protein, 719 aa, Arabidopsis thaliana
MILLSLLLHLLLHLLNTSPSLSLSPDGIALLSLKSAVDHSSSSAFSDWNDNDTDPCHWSGISCMNISDSSTSRVVGISLAGKHLRGYIPSELGSLIYLRRLNLHNNELYGSIPTQLFNATSLHSIFLYGNNLSGTLPPSICKLPKLQNLDLSMNSLSGTLSPDLNKCKQLQRLILSANNFSGEIPGDIWPELTNLAQLDLSANEFSGEIPKDIGELKSLSGTLNLSFNHLSGQIPNSLGNLPVTVSLDLRNNDFSGEIPQSGSFSNQGPTAFLNNPKLCGFPLQKTCKDTDENSPGTRKSPENNADSRRGLSTGLIVLISVADAASVAFIGLVLVYLYWKKKDSEGGCSCTGNAKLGGGSVKGKSCCCITGFPKEDDSEAEGNERGEGKGDGELVAIDKGFSFELDELLRASAYVLGKSGLGIVYKVVLGNGVPVAVRRLGEGGEQRYKEFVTEVQAMGKVKHPNVVKLRAYYWAPDEKLLISDFVNNGSLADALRGRNGQPSPSLTWSTRIKIAKGAARGLAYLHECSPRKLVHGDVKPSNILLDSSFTPYISDFGLTRLITITAASASSNEPSSSSAAGGFLGGALPYTSIKPSDRSNGYKAPEARLPGGRPTQKWDVYSFGVVLMELLTGKSPDSSPLSSSSTSTVVVEVPDLVKWVRKGFEEETPLSDMVDPMLLQEVHAKQQVLSVFHLALACTEGDPEVRPRMKNVSENIDKI

SEQ ID NO: 329 - protein, 450 aa, Glycine max
MGKTPFSFRRSASRRRPKKTAAPPPPPSPPQHPYAAGFAASPDDNNRLIAAAAGSSALTKAKKKTGNVRLWMRFDRSGRSELVELEKNAIVRHAAIPARDLRILGPVFSHSSNILAREKAMVVNLEFIKAIVTAEEVLLLDPLRQEVLPFVEQLRQQLPGKSQPKLLGGTEEQEGEMHVSNGRQWLPTPEAADGLQSELPFEFQVLEIALEAVCTYLDSNVADLERGAYPVLDELARNVSTKNLEHVRSLKSNLTRLLARVQKVRDEIEHLLDDNEDMAQLYLTRKWLQNQQFEEAHLGATTSNNFPNTSRSVRQLGSIRSESLVTSHYEDDNNVEDLEMLLDAYFMQLDGTRNKILSVREYIDDTEDYVNIQLDNHRNELIQLQLTLTIASFAIAIETLIAGAFGMNIPCNLYNIDGVFWPFVWTTSAACVLLFLLILAYARWKKLLGS

SEQ ID NO: 330 - protein, 189 aa, Arabidopsis thaliana
MLKATGTVAPAMHVVFPCFSSRPLILPLRSTKTFKPLSCFKQQGGKGMNGVHEIELKVRDYELDQFGVVNNAVYANYCQHGQHEFMETIGINCDEVSRSGEALAVSELTIKFLAPLRSGCKFVVKTRISGTSMTRIYFEQFIFKLPNQEPILEAKGMAVWLDKRYRPVCIPSYIRSNFGHFQRQHVVEY

SEQ ID NO: 331 - protein, 477 aa, Arabidopsis thaliana
MDNIAAQLKRGISRQFSTGSMRRTLSRQFTRQNSLDPRRNNMRFSFGRQSSLDPIRRSPESLSCEPHMSVPENLDSTIQLLFMASKGDVNGVEELLNEGIDVNSIDLDGRTALHIASCEGHYDVVKVLLSRRANIDARDRWGSTAAVDAKYYGNVEVYNLLKARGAKAPKTRKTPMTVGNPKEVPEYELNPLELQVRKVDGISKGTYQVAKWNGTRVSLKIFDKDSYSDPERVNAFTNELTLLAKARHPNIVQFVGAVTQNLPMMIVVECNPKGDLSVYLQKKGRLSPSKALRFALDIARGMNYLHECKPDPIIHCELMPKNILLDRGGQLKISGFGLIKLSKIGEDSAKVVNHEAQIDKSNYYIAPEIYKDEVFDKRADVHSFGVILYELTEGVSLFHPKPPEEVAESICIEGKRPTIRTKSKSYPPELKELIEECWHPEISVRPIFSEIIIRLDKIVTNCSKQGWWKDTFKFPWK

SEQ ID NO: 332 - protein, 378 aa, Arabidopsis thaliana
MAVVDVHRFAESITCHAWSPDLSMVALCPNNTEVHIYKSLSQDHWERLHVLQKHDQIVSGIDWSSKSNKIVTVSHDRNSYVWSLEGAEWVPTLVILRLNRAALCVQWSPKENKFAVGSGAKTVCICYYEQENNWWVSKLIRKRHESSVTSVAWHPNNVLLATTSTDGKCRVFSTFIKGVDTKDSKAGSPAETKFGEQILQLDLSYSWAFGVKWSPSGNTLAYVGHSSMIYFVDDVGPSPLAQSVAFRDLPLRDVLFISEKMVIGVGYDSNPMVFASDDTGIWSFIRYIGEKKAASSNSSYSSQFSEAFGKFYGSQSKSTTANDASESRGGVHDNCINSIVSLSKAGSPKVMRFSTSGLDGKVAIWDLENMEQELGNQF

SEQ ID NO: 333 - protein, 529 aa, Arabidopsis thaliana
MAASPKIGIGIASVSSPHRVSAASSALSPPPHLFFLTTTTTTRHGGSYLLRQPTRTRSSDSLRLRVSATANSPSSSSSGGEIIENVVIIGSGPAGYTAAIYAARANLKPVVFEGYQMGGVPGGQLMTTTEVENFPGFPDGITGPDLMEKMRKQAERWGAELYPEDVESLSVTTAPFTVQTSERKVKCHSIIYATGATARRLRLPREEEFWSRGISACAICDGASPLFKGQVLAVVGGGDTATEEALYLTKYARHVHLLVRRDQLRASKAMQDRVINNPNITVHYNTETVDVLSNTKGQMSGILLRRLDTGEETELEAKGLFYGIGHSPNSQLLEGQVELDSSGYVLVREGTSNTSVEGVFAAGDVQDHEWRQAVTAAGSGCIAALSAERYLTSNNLLVEFHQPQTEEAKKEFTQRDVQEKFDITLTKHKGQYALRKLYHESPRVILVLYTSPTCGPCRTLKPILNKVVDEYNHDVHFVEIDIEEDQEIAEAAGIMGTPCVQFFKNKEMLRTISGVKMKKEYREFIEANK

SEQ ID NO: 334 - protein, 229 aa, Zea mays
MDPDSVKSTLSNLAFGNVIAAAARDLQKEMVAKDKAQAAPASHDEVDLDELLDDPELEKLHAERIAALKKEVEKREVLKRQGHGEYREITEGDFLGEVTGSEKVICHFYHREFYRCKIMDKHLKALAPVYVGTKFVKLDAENAPFFVAKLAIKTLPCVILFKKGIAVDRLVGFQDLRSKDDFPTRALENILKTKGIIDEKKKDDDDDDEESEAKNRRVRSSTAQDSDSD

SEQ ID NO: 335 - protein, 291 aa, Zea mays
MASSVAAAASTFLGTRLADPAPQNGRIVARFGFGLGGKAKPAPKKVAKTSTSSDRPLWFPGAVAPDYLDGSLVGDYGFDPFGLGKPVEYLQFELDSLDQNLAKNEAGGIIGTRFESSEVKFTPLQPYSEVFGLQRFRECELIHGRWAMLATLGALSVEWLTGVTWQDAGKVELVDGSSYLGQPLPFSISTLIWIEVLVIGYIEFQRNAELDPEKRLYPGGSYFDPLGLAADPEKKERLQLAEIKHARLAMVAFLGFAVQAAATGKGPLNNWATHLSDPLHTTIFDTFGGSS

SEQ ID NO: 336 - protein, 402 aa, Zea mays
MDNALRITDASSRRPTNLGKDLAMTEPAADRKCQSLVMENNAVKEKNPGEKSKSAVIGHADSYPSQFLETNLGKQQYRNGYKNQEFREKDIFNHSNSSAFSRYGNRRIESSGEIQFLPSRCIVGQEQHVHGKDPVFQPNGVLLPPNDHNTGESTRQARITLDSSMEGADIICSSSAREDAGASSSSHRKDSMSHPSYGFVPVPIPVGAMMPYHCGAILQPVYYPQGPLMHCNSSAINKATIHQTSGQSNYREDCGSGRPSQVDEHKQSEEKHQLHHSRQIHRESGQPVDMVRAHMDHANQSASCSRDICKGSGCTGSGEADTNANTTVALESGNESGIQNSDRSHREAALMKFRMKRKDRCFDKKVRYHSRKKLAEQRPRVKGQFVSQKLKAAMATEAETDS

SEQ ID NO: 337 - protein, 508 aa, Zea mays
MGAMMASITSELLFFLPFILLALLALYTTTVAKCHGTHPWRRQKKKRPNLPPGARGWPLVGETFGYLRAHPATSVGRFMERHVARYGKIYRSSLFGERTVVSADAGLNRYILQNEGRLFECSYPRSIGGILGKWSMLVLVGDAHREMRAISLNFLSSVRLRAVLLPEVERHTLLVLRSWPPSDGTFSAQHEAKKFTFNLMAKNIMSMDPGEEETERLRLEYITFMKGVVSAPLNFPGTAYWKALKSRASILGVIERKMEDRLEKMSREKSSVEEDDLLGWALKQSNLSKEQILDLLLSLLFAGHETSSMALALAIFFLEGCPKAVQELREEHLLIARRQRLRGASKLSWEDYKEMVFTQCVINETLRLGNVVRFLHRKVIRDVHYNGYDIPRGWKILPVLAAVHLDSSLYEDPSRFNPWRWKLQSNNAPSSFMPYGGGPRLCAGSELAKLEMAIFLHHLVLNFRWELAEPDQAFVYPFVDFPKGLPIRVQRVADDQGHRSVLTESTRG

SEQ ID NO: 338 - protein, 258 aa, Arabidopsis thaliana
MQVLVVSPPLIAAASLSKPLNSLSKAALSFSRAKPICPFPQTSRRPISVYKSPMNNLFNRLGFGSRPQAQADPSSAAIAQGPDDDVPSSGQQFAQFGAGCFWGVELAYQRVPGVTKTEVGYSHGIVHNPSYEDVCTGTTGHNEVVRVQYDPKECSFESLLDVFWNRHDPTTLNRQGGDVGTQYRSGIYYYTDEQERIAREAVEKQQKILNKRIVTEILPATKFYRAENYHQQYLAKGGRMGLRQSAEKGCKDPIRCYG

SEQ ID NO: 339 - protein, 339 aa, Arabidopsis thaliana
MGEAVEVMFGNGFPEIHKATSPTQTLHSNQQDCHWYEETIDDDLKWSFALNSVLHQGTSEYQDIALLDTKRFGKVLVIDGKMQSAERDEFIYHECLIHPALLFHPNPKTVFIMGGGEGSAAREILKHTTIEKVVMCDIDQEVVDFCRRFLTVNSDAFCNKKLELVIKDAKAELEKREEKFDIIVGDLADPVEGGPCYQLYTKSFYQNILKPKLSPNGIFVTQAGPAGIFTHKEVFTSIYNTMKQVFKYVKAYTAHVPSFADTWGWVMASDHEFDVEVDEMDRRIEERVNGELMYLNAPSFVSAATLNKTISLALEKETEVYSEENARFIHGHGVAYRHI

SEQ ID NO: 340 - protein, 349 aa, Zea mays
MGGLIMDQAFVQAPEHRPKPIVTEATGIPLIDLSPLSASGGAVDALAAEVGAASRDWGFFVVVGHGVPAETVARATEAQRAFFALPAERKASVRRNEAEPLGYYESEHTKNVRDWKEVYDLAPREPPPPAAVADGELVFENKWPQDLPGFREALEEYAKAMEELAFKLLELIARSLKLRPDRLHGFFKDQTTFIRLNHYPPCPSPDLALGVGRHKDAGALTILYQDDVGGLDVRRRSDGEWVRVRPVPDSFIINVGDLIQVWSNDRYESAEHRVSVNSARERFSMPYFFNPATYTMVEPVEELVSEDDPPRYDAYNWGDFFSTRKNSNFKKLNVENIQIAHFKKSLVLA

SEQ ID NO: 341 - protein, 318 aa, Zea mays
MEAEAAAKRTRESGEDAAAAGISAVIPGWFSEISPMWPGEAHSLKVEKVLFQGKSDYQNVMVFQSSTYGKVLVLDGVIQVTERDECAYQEMITHLPLCSIKDPKKVLVIGGGDGGVLREVSRHSSVEQIDICEIDKMVVDVSKQFFPHLAVGFEDPRVSLHIGDGVAFLKNAPEGTYDAVIVDSSDPIGPAQELFEKPFFQLVARALRPGGVVCTQAESIWLHMHIIEDIVVNCRQVFKGSVNYAWTTVPTYPSGVIGFMLCSTEGPAVDFQHPVFNIEEDEHPMKSKGPLKFYNSEIHTASFCLPSFAKRVIESKAN

SEQ ID NO: 342 - protein, 162 aa, Arabidopsis thaliana
MSSFTTTNTPPPYLLRKIYHRRVNQPFSVVCCTGEPQQDIFTRRRTLTSLITFTVIGGATSSALAQEKWGTRSFIKEKYFMPGLSPEDAAARIKQTAEGLRDMREMLDHMSWRYVIFYIRLKQAYLSQDLTNAMNILPESRRNDYVQAANELVENMSEVYVI

SEQ ID NO: 343 - protein, 275 aa, Glycine max
MENAEEMMQQNDEVLSVELPAPSGWNKLFFPKKLGTPRKSEIVFIAPTGEEISTKKQLEQYLKAHPGNPVISEFDWGTGETPRRSARISEKVKSTPPADSDTPKKRARKSSGSKKDNKETESASEEGKAKSDTEDPKAAEEEKNEGNDNSNSGGKQLENGDKTEQIDEQAKKPDVDMEENDLNDTNNKLENDSDEIKNSHVNGENVIAERPEGEEAQKQEVEPAEKVAEEAANTAETEKSLLTELEKEKNEEKTDTATLEANGGGEKENPNAAQM

SEQ ID NO: 344 - protein, 564 aa, Glycine max
MFFLTRNRRIVQKGVDFKQIDKEWDWDNFLILQALVASMACYMFPFLQHLPLWNVKGLIVALVLHVGVSEPLYYWVHRKFHGDYLFTHYHSLHHSSPVPESFTAGNATLLEHLIMTVIIGIPILGASLMGYGSASMIYGYVLIFDFLRCLGHSNVEIVPHQLFEKLPFLRYVIYTPTYHHLHHSDKDTNFCLFMPLFDSLGNTLNKNSWQSHKLLSSGSGNGDMVPHFVFLAHIVDVSSSMHAQFVYRSFASLPYTTRFFLLPGLPITFLVLLAMWAWSKTFLVSFYYLRGRLHQTWVVPRCGFQYFLPFATEGINNQIEQAILRADKIGVKVISLAALNKNESLNGGGKLFVDKHPNLRVRVVHGNTLTAAVILNEIPQDVKEVFLTGATSKLGRAIALYLCQKKVKVLMLTLSTDRFQRIQKEAPPENQSYLVQVTKYQAAQNCKTWIVGKWITPREQYWAPRGTHFHQFVVPPILSFRKDCTYGDLAAMRLPEDVEGLGCCEYTMDRGVVHACHAGGVVHSLEGWSHHEVGAIDVNRIDLVWEAALKHGLRPVSSFTQKEN

SEQ ID NO: 345 - protein, 384 aa, Arabidopsis thaliana
MENTDELVSIELPAPASWKKLFYPKRAGTPRKTEIVFVAPTGEEISSRKQLEQYLKAHPGNPVISEFEWTTGETPRRSSRISQKVKATTPTPDKEPLLKKRRSSLTKKDNKEAAEKNEEAAVKENMDVDKDGKTENAEAEKEKEKEGVTEIAEAEKENNEGEKTEAEKVNKEGEKTEAGKEGQTEIAEAEKEKEGEKAEAENKEAEVVRDKKESMEVDTSELEKKAGSGEGAEEPSKVEGLKDTEMKEAQEVVTEADVEKKPAEEKTENKGSVTTEANGEQNVTLGEPNLDADAEADKGKESKEYDEKTTEAEANKENDTQESDEKKTEAAANKENETQESDVKKTEAAVAEEKSNDMKAEDTNRSLEANQVQQQQGAAASVSC

SEQ ID NO: 346 - protein, 976 aa, Arabidopsis thaliana
MALFRDIVLLGFLFCLSLVATVTSEEGATLLEIKKSFKDVNNVLYDWTTSPSSDYCVWRGVSCENVTFNVVALNLSDLNLDGEISPAIGDLKSLLSIDLRGNRLSGQIPDEIGDCSSLQNLDLSFNELSGDIPFSISKLKQLEQLILKNNQLIGPIPSTLSQIPNLKILDLAQNKLSGEIPRLIYWNEVLQYLGLRGNNLVGNISPDLCQLTGLWYFDVRNNSLTGSIPETIGNCTAFQVLDLSYNQLTGEIPFDIGFLQVATLSLQGNQLSGKIPSVIGLMQALAVLDLSGNLLSGSIPPILGNLTFTEKLYLHSNKLTGSIPPELGNMSKLHYLELNDNHLTGHIPPELGKLTDLFDLNVANNDLEGPIPDHLSSCTNLNSLNVHGNKFSGTIPRAFQKLESMTYLNLSSNNIKGPIPVELSRIGNLDTLDLSNNKINGIIPSSLGDLEHLLKMNLSRNHITGVVPGDFGNLRSIMEIDLSNNDISGPIPEELNQLQNIILLRLENNNLTGNVGSLANCLSLTVLNVSHNNLVGDIPKNNNFSRFSPDSFIGNPGLCGSWLNSPCHDSRRTVRVSISRAAILGIAIGGLVILLMVLIAACRPHNPPPFLDGSLDKPVTYSTPKLVILHMNMALHVYEDIMRMTENLSEKYIIGHGASSTVYKCVLKNCKPVAIKRLYSHNPQSMKQFETELEMLSSIKHRNLVSLQAYSLSHLGSLLFYDYLENGSLWDLLHGPTKKKTLDWDTRLKKAYGAAQGLAYLHHDCSPRIIHRDVKSSNILLDKDLEARLTDFGIAKSLCVSKSHTSTYVMGTIGYIDPEYARTSRLTEKSDVYSYGIVLLELLTRRKAVDDESNLHHLIMSKTGNNEVMEMADPDITSTCKDLGVVKKVFQLALLCTKRQPNDRPTMHQVTRVLGSFMLSEQPPAATDTSATLAGSCYVDEYANLKTPHSVNCSSMSASDAQLFLRFGQVISQNSE

SEQ ID NO: 347 - protein, 976 aa, Arabidopsis thaliana; identical to SEQ ID NO: 346

SEQ ID NO: 348 - protein, 291 aa, Glycine max
MMLKAAPRAVIYYLSEHPAIVGFRWSHAQSWGATWSFLFSSIASYLFLSVFLYFSLSLLFRRRQIPLGPLPAVHSLSMSLISATIFAGILLSAAAEISDTRWFWRRSKTPLQWLLCFPLGTRPSGRVFFWSYVYYLSRFLHMLRTLLRILRHRRLSFFHLLSNSISALASFLWLEFSQSFQVLAILFATLVYAAVYGYRFWTAIGLRGACFPFVLSCQIVLLACNVACHVAVFFLHFFLKGGCNGIGAWVFNSILNLALLMLSLNFYVRMHVHKRRRKVRDVTVTVATALS

SEQ ID NO: 349 - protein, 266 aa, Glycine max
MQSSISQSEICITDYLLPQEVPSQFQFPDMSNNNIPMNHTNLQMPQITSFSKPPRSSSNLSNRKPSLRNITIPSITSGLTTTMSQTTTTTTIATTMYNNNQVTSSSDETNNIKENKHYRGVRRRPWGKYAAEIRDPNRKGSRVWLGTFDTAIEAAKAYDKAAFKMRGSKAILNFPLEIGESEESVSSCIKVGVKREREEESKSNNYEKSEFNNNNNSNKHVKKEECSPKAVCPLTPSCWKGFWDTDVMGTIFSVPPLSPLSPLMVV

SEQ ID NO: 350 - protein, 325 aa, Zea mays
MGEASPSIAKDVTELIGNTPLVYLNKVTDGCVGRVAAKLESMEPCSSVNDRIGYSMITDAEEKGLITPGVSVLIEPTSGNTGIGLAFMAAAKGYKLTLTMPASMSMERRIILKAFGAELVLTDPLLGMKGAVKKAEEIQAKTPNSYILQQFENPANPKIHYETTGPEIWKATAGKIDGLVSGIGTGGTITGTGRYLREQNPNVKLYGVEPVESAVLNGGKPGPHKIQGIGAGFIPGVLDVDLLDETLQVSSDEAIETAKALALKEGLLVGISSGAAAAAAVRLAKRPENAGKLFVVVFPSFGERYLSSVLFQSIKKEAESMVVEP

SEQ ID NO: 351 - protein, 227 aa, Sorghum bicolor
MAAASLLSPSCALFRRLPCASHISSSHFKRFDRVRRFSPAAMSTFSGPKEAPANNPGLQTEVDPATKGYFLQQTMLRVKDPKVSLDFYSRVMGMSLLKRLDFEEMKFSLYFLGYEDVTSAPDNHIKRTEWTFRQKATLELTHNWGTENDPEFKGYHNGNSDPRGFGHIGVTVDDVHKACERFERLGVEFVKKPDDGKIKGIAFIKDPDGYWIEIFDHTIGTVTSSAS

SEQ ID NO: 352 - protein, 164 aa, Arabidopsis thaliana
MASSFSSQAFFLLTLSMVLIPFSLAQAPMMAPSGSMSMPPMSSGGGSSVPPPVMSPMPMMTPPPMPMTPPPMPMTPPPMPMAPPPMPMASPPMMPMTPSTSPSPLTVPDMPSPPMPSGMESSPSPGPMPPAMAASPDSGAFNVRNNVVTLSCVVGVVAAHFLLV

SEQ ID NO: 353 - protein, 221 aa, Zea mays
MSRRGDWVYENNGGTCVAIAGADYCVVAADTRLSVGYSILTRDHSKICDLADKCVLASSGFQGDIKALHKNLAARELLYQHQHNKRMSCPAMAQLLSNTLYYKRFFPYYAFNVLGGLDSEGKGCVFTYDAVGSYERTGYSAQGTGSTLIMPVLDNQLKSPSPLLLPARDAVTPLSESEAIDLVKDVFASATERDIYTGDKLEIVVINKVGTKREYIDLRKD

SEQ ID NO: 354 - protein, 229 aa, Triticum aestivum
MGATEDSSSGSETTTSSSVEALASPPSPTATTASSKKKRPRNDGRHPTYRGVRMRSWGKWVSEIREPRKKSRIWLGTFATAEMAARAHDVAALAIKGRAAHLNFPDLAHELPRPATAAPKDVQAAAALAASADFPASATAAANAGAKNPDGPEHSGASASASASASASASPPPDTAEDALFDLPDLLFDLRHGPPSCQLSCASSWDDDVAFAGPGAGVFRLEEPLQWEY

SEQ ID NO: 355 - protein, 550 aa, Escherichia coli
MFCVQCEQTIRTPAGNGCSYAQGMCGKTAETSDLQDLLIAALQGLSAWAVKAREYGIINHDVDSFAPRAFFSTLTNVNFDSPRIVGYAREAIALREALKAQCLAVDANARVDNPMADLQLVSDDLGELQRQAAEFTPNKDKAAIGENILGLRLLCLYGLKGAAAYMEHAHVLGQYDNDIYAQYHKIMAWLGTWPADMNALLECSMEIGQMNFKVMSILDAGETGKYGHPTPTQVNVKATAGKCILISGHDLKDLYNLLEQTEGTGVNVYTHGEMLPAHGYPELRKFKHLVGNYGSGWQNQQVEFARFPGPIVMTSNCIIDPTVGAYDDRIWTRSIVGWPGVRHLDGDDFSAVITQAQQMAGFPYSEIPHLITVGFGRQTLLGAADTLIDLVSREKLRHIFLLGGCDGARGERHYFTDFATSVPDDCLILTLACGKYRFNKLEFGDIEGLPRLVDAGQCNDAYSAIILAVTLAEKLGCGVNDLPLSLVLSWFEQKAIVILLTLLSLGVKNIVTGPTAPGFLTPDLLAVLNEKFGLRSITTVEEDMKQLLSA

SEQ ID NO: 356 - protein, 452 aa, Zea mays
MQAWRGKERSMAAVNGTLEDGYRLLPAYCEQIVKTNPGSVATYRGIGPGNAFQRLFVSFRASIYGFLNGCRPLLEIDKADLKGKYLGTLLCASAIDADHMMFPLAFGVVDCESDDNWNWFISELRKMLGVNTDKMPVLTIVSERKRQVVAAVGSNFPTAFHGFCLRHVSENFRDEFKNTKLLNIFWSAVYALTASEFDAKVNEMMQVQDVMPWLQRFPPNLWAFSYFQGIRYGHFSLGITEILYNLSLDCHELPIVQTIEHIRHQLACWFAERQNLAQSYNSVLVPSAEKVILEAIHDSQCYQVLRANKVEFEIVSSERTNIVDTQARFCSCRRWQIYGIPCAHAAAALLSCGEDPRLYADDCFSVMKYRETYSQPIYPIPDRSHWNDSSPWSQGAVSKADVVLGPPNIRRPPGRPKMKILKIESMKRPKRIVQCGRCHLLGHSQKKCSLRS

SEQ ID NO: 357 - protein, 259 aa, Oryza sativa
MVSPDTIRTAIGVVGNGTALVLFLSPVPTFIRIWKKGSVEQYSAVPYVATLLNCMMWVLYGLPAVHPHSMLVITINGTGMAIELTYIALFLAFSLGAVRRRVLLLLAAEVAFVAAVAALVLNLAHTHERRSMIVGILCVLFGTGMYAAPLSVMKMVIQTKSVEYMPLFLSLASLVNGICWTAYALIRFDLYITIPNGLGVMFAVAQLILYAIYYKSTQQIIEARKRKEADHVAMTDVVVDSAKNNPSSGAAAAAANGRY

SEQ ID NO: 358 - protein, 411 aa, Arabidopsis thaliana
MGKNDFLTPKAIANRIKAKGLQKLRWYCQMCQKQCRDENGFKCHCMSESHQRQMQVFGQNPTRVVDGYSEEFEQTFLDLMRRSHRFSRIAATVVYNEYINDRHHVHMNSTEWATLTEFIKHLGKTGKCKVEETPKGWFITYIDRDSETLFKERLKNKRVKSDLAEEEKQEREIQRQIERAAEKLNGGGGEGETSGNDEVVDDGDDERKKDEDLRLKSGVKVGFALGGGVKQVATGKERGESSKLLFGDEENDKVERGEKRKRSGDSGRSEKERRSALDELMKEEEKKKERMNRKDYWLFEGIIVKVMSKALAEKGYYKQKGVVKKVIDNYVGEIKMLDSKHVLRVDQKELETVLPQIGGMVKIVNGAYRGSNARLLGVDTEKFCAKVQIEKGVYDGRVIKSIEYEDICKLA

SEQ ID NO: 359 - protein, 478 aa, Escherichia coli
MTRIKINARRIFSLLIPFFFFTSVHAEQTAAPAKPVTVEAKNETFAPQHPDQYLSWKATSEQSERVDALAEDPRLVILWAGYPFSRDYNKPRGHAFAVTDVRETLRTGAPKNAEDGPLPMACWSCKSPDVARLIQKDGEDGYFHGKWARGGPEIVNNLGCADCHNTASPEFAKGKPELTLSRPYAARAMEAIGKPFEKAGRFDQQSMVCGQCHVEYYFDGKNKAVKFPWDDGMKVENMEQYYDKIAFSDWTNSLSKTPMLKAQHPEYETWTAGIHGKNNVTCIDCHMPKVQNAEGKLYTDHKIGNPFDNFAQTCANCHTQDKAALQKVVAERKQSINDLKIKVEDQLVHAHFEAKAALDAGATEAEMKPIQDDIRHAQWRWDLAIASHGIHMHAPEEGLRMLGTAMDKAADARTKLARLLATKGITHEIQIPDISTKEKAQQAIGLNMEQIKAEKQDFIKTVIPQWEEQARKNGLLSQ

SEQ ID NO: 360 - protein, 561 aa, Zea mays
MAADAAAAAMSATSLCDDLEPATVRTRIRDVLAAGAARAGDRVVVGGWVRTGREQGKGSFAFLELSDGSCAATLQAIVDAAVHPLARLTATGTSVLVEGVIKEPPEGTKQNVELKVSRVLEVGEVDAAVYPLPKGKVKLTLEKLRDVVHLRSRTNTIGAVARIRHQLAYASHRFFDENGFLYVHTPIITTSDCEGAGEMFQVTTLFSQAEKTEKELRENPKPSDSEIEAAKVLVKEKGDVVAQLKAAKASKQEISTAVDELNRAKEIVSKLEERFKLKPGIPRKDDGSIAFENDFFKRQAFLTVSGQLQVETYACALSSVYTFGPTFRAENSHTSRHLAEFWMVEPEIAFANLQDDMNCAEKYVQYLCKWLLDHCQEDMEFMVKNYDKSAIERLELVSSTPFVRISYTKAVELLKNVTDKKFDNKVEWGIDLASEHERYLTEDIFKKPVIVYNYPKGIKAFYMRLNDDDKTVAAMDVLVPKVGELIGGSQREERLDVLKQRILDAGLPLEPYEWYLDLRRFGSVKHSGFGLGFERMILFATGMENIRDVIPFPRYPGRADL

SEQ ID NO: 361 - protein, 242 aa, Saccharomyces cerevisiae
MTDRNFSPQQGQGPQESLPEGPQPSTMIQREEMNMPRQYSEQQQLQENEGEGENTRLPVSEEEFRMVQELQAIQAGHDQANLPPSGRGSLEGEDNGNSDGADGEMDEDDEEYDVFRNVGQGLVGHYKEIMIRYWQELINEIESTNEPGSEHQDDFKSHSLPFARIRKVMKTDEDVKMISAEAPIIFAKACEIFITELTMRAWCVAERNKRRTLQKADIAEALQKSDMFDFLIDVVPRRPLPQ

SEQ ID NO: 362 - protein, 432 aa, Zea mays
MGLSTVYSPAGPRLVPAPLGRCRSAQPRRPRRAPLATVRCSVDATKQAQDGVATAVATEAPASRKECFGVFCTTYDLKAEDKTKSWKKLVNVAVSGAAGMISNHLLFKLASGEVFGQDQPIALKLLGSERSFQALEGVAMELEDSLYPLLREVSIGIDPYVVFQDVDWALLIGAKPRGPGMERAALLDINGQIFADQGKALNAVASRNAKVLVVGNPCNTNALICLKNAPNIPAKNFHALTRLDENRAKCQLALKAGVFYDKVSNVTIWGNHSTTQVPDFLNAKIDGRPVKEVIKDTKWLEEEFTLTVQKRGGVLIQKWGRSSAASTAVSIVDAIRSLVTPTPEGDWFSTGVYTTGNPYGIAEDIVFSMPCRSKGDGDYELASDVLMDDFLWERIKKSEAELLAEKKCVAHLTGEGNAFCDLPEDTMLPGEV

SEQ ID NO: 363 - protein, 681 aa, Arabidopsis thaliana
MSGSVSGCGSGGCSIVWFRRDLRVEDNPALAAAVRAGPVIALFVWAPEEEGHYHPGRVSRWWLKNSLAQLDSSLRSLGTCLITKRSTDSVASLLDVVKSTGASQIFFNHLYDPLSLVRDHRAKDVLTAQGIAVRSFNADLLYEPWEVTDELGRPFSMFAAFWERCLSMPYDPESPLLPPKKIISGDVSKCVADPLVFEDDSEKGSNALLARAWSPGWSNGDKALTTFINGPLLEYSKNRRKADSATTSFLSPHLHFGEVSVRKVFHLVRIKQVAWANEGNEAGEESVNLFLKSIGLREYSRYISFNHPYSHERPLLGHLKFFPWAVDENYFKAWRQGRTGYPLVDAGMRELWATGWLHDRIRVVVSSFFVKVLQLPWRWGMKYFWDTLLDADLESDALGWQYITGTLPDSREFDRIDNPQFEGYKFDPNGEYVRRWLPELSRLPTDWIHHPWNAPESVLQAAGIELGSNYPLPIVGLDEAKARLHEALSQMWQLEAASRAAIENGSEEGLGDSAEVEEAPIEFPRDITMEETEPTRLNPNRRYEDQMVPSITSSLIRPEEDEESSLNLRNSVGDSRAEVPRNMVNTNQAQQRRAEPASNQVTAMIPEFNIRIVAESTEDSTAESSSSGRRERSGGIVPEWSPGYSEQFPSEENGIGGGSTTSSYLQNHHEILNWRRLSQTG

SEQ ID NO: 364 - protein, 105 aa, Zea mays
MASRSSAMEGGAAIQRRNAVKRHLQQRQQEADFLDKKVIASTYFSIGAFLVLACLTVSLLILPLVLPPLPPPPSLLLWLPVCLLVLLVVLAFMPTDVRSMASSYL

SEQ ID NO: 365 - protein, 202 aa, Glycine max
MKWLTFWNCISILVLSFAFFFFYCHTYTSTPSLMAEQSSKSIYDFTVKDISGNDVSLNNYSGKVLLIVNVASQCGLTQTNYKELNVLYEKYKNQGFEILAFPCNQFAGQEPGNNEEIQEVVCTRFKAEFPIFDKVEVNGKNAAPLYKFLKEQKGGIFGDGIKWNFTKFLVNKEGKVVDRYAPTTSPLKIEKDIEKLEPYNLI

SEQ ID NO: 366 - protein, 323 aa, Deinococcus radiodurans
MSDLMKLRAVWGNRPLLGVAAGVLIQNERGEVLLQKRGDDGLWGEPGGGLDPGEAFLAAAQRELKEETGLECGNLTWLGVHDGLTSGPDLYTRYPNGHELYLVGTLFHGTLPADALAHAQPDDSGETLELRWCALDDLPPLSSNINRTSLNVLRRRVGLPELPMQPQPPRQPDPTYWADLGRLLGGRLWFMPGSSVLVTDEAGRLLLLRHKATDQWTLPGGKLEPGESFEECAARELLEETGLRARRLERLHLLAGPELRFQQQGQTWDSLGLLLRASDVSGELRPPAGELSEARYFAPDELPGVDVLGTYTRQALAFWLGQS

SEQ ID NO: 367 - protein, 108 aa, Arabidopsis thaliana
MGLMRSMLPNAKQIFKSQSMRNKNGSSSPSTTTTTSGLVPKGHVAVYVGEQMEKKRFVVPISYLNHPLFREFLNRAEEECGFHHSMGGLTIPCREESFLYLITSHQLH

SEQ ID NO: 368 - protein, 599 aa, Arabidopsis thaliana
MASFTATAAVSGRWLGGNHTQPPLSSSQSSDLSYCSSLPMASRVTRKLNVSSALHTPPALHFPKQSSNSPAIVVKPKAKESNTKQMNLFQRAAAAALDAAEGFLVSHEKLHPLPKTADPSVQIAGNFAPVNEQPVRRNLPVVGKLPDSIKGVYVRNGANPLHEPVTGHHFFDGDGMVHAVKFEHGSASYACRFTQTNRFVQERQLGRPVFPKAIGELHGHTGIARLMLFYARAAAGIVDPAHGTGVANAGLVYFNGRLLAMSEDDLPYQVQITPNGDLKTVGRFDFDGQLESTMIAHPKVDPESGELFALSYDVVSKPYLKYFRFSPDGTKSPDVEIQLDQPTMMHDFAITENFVVVPDQQVVFKLPEMIRGGSPVVYDKNKVARFGILDKYAEDSSNIKWIDAPDCFCFHLWNAWEEPETDEVVVIGSCMTPPDSIFNESDENLKSVLSEIRLNLKTGESTRRPIISNEDQQVNLEAGMVNRNMLGRKTKFAYLALAEPWPKVSGFAKVDLTTGEVKKHLYGDNRYGGEPLFLPGEGGEEDEGYILCFVHDEKTWKSELQIVNAVSLEVEATVKLPSRVPYGFHGTFIGADDLAKQVV

SEQ ID NO: 369 - protein, 480 aa, Arabidopsis thaliana
MEQEDFYFPDTDLDLSFTSTTTDRTFASSSARTSLTLSFNDRLSTSSAVTTSSTSSSSVNHRRHDPHWSAIKSAKLLSSDGNIHLRHLKLIRHLGTGNLGRVFLCNLRDSSARFALKVIDRNCLTTEKKLSQVETEAEILSLLDHPFLPTLYARIDESHYTCLLIDYAPNGDLHSLLRKQPGNRLPIQPVRFFAAEVLVALEYLHAMGIVYRDLKPENVLLREDGHVMLSDFDLCFKSDVVPTFKSRRYRRSSSSPSLRRRRSGCFSVAAEKKYEREEIVSEFAAEPVTAFSRSCVGTHEYLAPELVSGNGHGSGVDWWAFGIFLYELLYGTTPFKGESKEQTLRNIVSTTKTASFHMDGDLDEARDLIEKLLVKDPRKRLGCARGAQDIKRHPFFDGIKWPLIRHYKPPEEVRGLVIKKSTRPHASHVIAVSPRRRKSFLWRALSYLLRGKSSSGGSKNQSNSNYYHYVGKSYASRKRV

SEQ ID NO: 370 - protein, 477 aa, Arabidopsis thaliana
MDNIAAQLKRGISRQFSTGSMRRTLSRQFTRQNSLDPRRNNMRFSFGRQSSLDPIRRSPESLSCEPHMSVPENLDSTMQLLFMASKGDVNGVEELLNEGIDVNSIDLDGRTALHIASCEGHYDVVKVLLSRRANIDARDRWGSTAAVDAKYYGNVEVYNLLKARGAKAPKTRKTPMTVGNPKEVPEYELNPLELQVRKVDGISKGTYQVAKWNGTRVSVKIFDKDSYSDPERVNAFTNELTLLAKARHPNIVQFVGAVTQNLPMMIVVECNPKGDLSVYLQKKGRLSPSKALRFALDIARGMNYLHECKPDPIIHCELMPKNILLDRGGQLKISGFGLIKLSKIGEDSAKVVNHEAQIDKSNYYIAPEIYKDEVFDKRADVHSFGVILYELTEGVSLFHPKPPEEVAESICIEGKRPTIRTKSKSYPPELKELIEECWHPEISVRPIFSEIIIRLDKIVTNCSKQGWWKDTFKFPWK

SEQ ID NO: 371 - protein, 406 aa, Glycine max
MATTSVVPANRRRAANPAEEMDFETTEGVKAIASFEEMGIKDDLLRGIYQYGFEKPSAIQQRAVTPIIQGRDVIAQAQSGTGKTSMIALTVCQVVDTSVREVQALILSPTRELASQTEKVILAIGDFINIQAHACVGGKSVGEDIRKLEYGVHVVSGTPGRVCDMIKRRTLRTRAIKMLVLDESDEMLSRGFKDQIYDVYRYLPPDLQVCLISATLPHEILEMTNKFMTDPVRILVKRDELTLEGIKQFFVAVEREEWKFDTLCDLYDTLTITQAVIFCNTKRKVDWLTEKMRNNNFTVSSMHGDMPQKERDAIMGEFRAGTTRVLITTDVWARGLDVQQVSLVINYDLPNNRELYIHRIGRSGRFGRKGVAINFVKSDDIKILRDIEQYYSTQIDEMPMNVADLI

SEQ ID NO: 372 - protein, 222 aa, Zea mays
MGATSPSGLELTMAVPGLSSSSGSEGFVCNNNISNNGGGNMRDLDMNQPASGGEEEDFLMGGVEEDEEERGAGGPHRPKKLRLSKEQSRLLEESFRLNHTLSPKQKEALAIKLKLRPRQVEVWFQNRRARTKLKHTEMECEYLKRCFGSLTEENRRLQREVEELRAMRMAPPTVLSPHTRQPLPASALTMCPRCERVTAATCPRITRPAASPFHPRRPSAAF

SEQ ID NO: 373 - protein, 297 aa, Zea mays
MSGGGGLGSGCSYQKFVHFALEQTRHRSTLVPHPSQEKFRFIKANEDNTVLNALSFSTSKIRLLRSLTIEQKNSVQVLDFAAFSRPEYDLPIFCANAFSSPARSIVVLDLNPLYDTTEHKDYREKYYRALMPLVHKYSELLPWGGKITSESLRFFSPIVIWTVFEPSEANHQALYSAFVDYYMVWLEFMDGAVRESSKEKIDRNREAQHKYLTWRAEKDPGYPLLKKLIGESGAKDLVREFLFEGVGSLGTKSFLEYFAEYAQEDGTVNKKRSMAGKSFGTRPWDAHGLFVGDAVDG

SEQ ID NO: 374 - protein, 388 aa, Escherichia coli
MKHLHRFFSSDASGGIILIIAAILAMIMANSGATSGWYHDFLETPVQLRVGSLEINKNMLLWINDALMAVFFLLVGLEVKRELMQGSLASLRQAAFPVIAAIGGMIVPALLYLAFNYADPITREGWAIPAATDIAFALGVLALLGSRVPLALKIFLMALAIIDDLGAIIIIALFYTNDLSMASLGVAAVAIAVLAVLNLCGARRTGVYILVGVVLWTAVLKSGVHATLAGVIVGFFIPLKEKHGRSPAKRLEHVLHPWVAYLILPLFAFANAGVSLQGVTLDGLTSILPLGIIAGLLIGKPLGISLFCWLALRLKLAHLPEGTTYQQIMVVGILCGIGFTMSIFIASLAFGSVDPELINWAKLGILVGSISSAVIGYSWLRVRLRPSV

SEQ ID NO: 375 - protein, 882 aa, Agrobacterium tumefaciens
MPAETKTTCPYCGVGCGVIATVNDSGVVSVKGDPDHPANFGRLCSKGSALAETIDLDGRLLHPEIAGRRAAWDEALDLVASRFSDAIAEHGPDSVAFYVSGQLLTEDYYLANKLMKGFIGSANIDTNSRLCMSSSVAGHRRAFGADTVPGTYEDMELADLVILTGSNLAWCHPVLYQRLAAAKAARPGMKVVVIDPRRTMSADIADMHLAIRPDGDVALFTGLLAHLFASSAIDRGYVENHTAGFEAATQAASEHSLPEIAEATGLTIAELIPFYELFERTEKTVTCYSQGVNQSESGTDKVNAIINCHLATGRIGRPGMGPFSLTGQPNAMGGREVGGLANMLAAHMSIENADDRDRVQRFWASPAIAQKPGLKAVDMFRAVADGRIKALWIMATNPVVSMPDAGAVEVTIKACPFVVVSDVMANTDTARHAHVLLPSLGWGEKDGTVTNSERRISRQRSFLDAPGEAKADWWQMAEVARRMGFDAAFAYQQPSEIFAEHAALSGFENAGRRDFDIGGIERDSYETMAPVQWPKAGAGEAEVTRFFANGRFYHADGKARFIATALPETDRTSADYPLTLNTGRIRDQWHTMTRTGKSARLTAHIAEPFAEIHPRDAQALGIKSADLVELESPHGKVLLRALVSERQARGSVFAPMHWNDQFASRARIDVVVAPVTDPHSGQPASKNVGVRVTRFEASAYGFAICRSRPDAPDCAYWAVAKAEGGYRMELAFAEAPEDWTLWARRVFGIDVRIEPLGYSDRQTGDLRLAFFDGDTLLAALFIAREPVAVARNWAISQLSERHEDLRMRFALVAGRPGAGRADPGATVCSCFNVGVNQITAAIREGCHSVEAIGNALNAGTNCGSCRAEIRGIIDGCLKTAAE

SEQ ID NO: 376 - protein, 92 aa, Zea mays
MSNRRSRSRQSGSSRITEEQISDLVSKLQDLLPEARLQSNARVPSARVLQETCNYIRNLHQEVDDLSERLSELLATSDMSSAQAAVIRSLLM

SEQ ID NO: 377 - protein, 162 aa, Zea mays
MSAAEGAVVFSEEKEALVLKSWAIMKKDSANLGLRFFLKILEIAPSARQMFPFLRDSDVPLETNPKLKTHAVSVFVMTCEAAAQLRKAGKITVRETTLKRLGGTHLKYGVADGHFEVTRFALLETIKEALPADMWGPEMRNAWGEAYDQLVAAIKQEMKPSE

SEQ ID NO: 378 - protein, 118 aa, Nostoc punctiforme
MSTLYDNIGGQPAIEQVVDELHKRIATDSLLSPIFAGTDMAKQRNHLVAFLGQIFEGPKQYGGRPMDKTHAGLNLQQPHFDAIAKHLGEAMAVRGVSAENTKAALDRVTNMKGAILNK

SEQ ID NO: 379 - protein, 172 aa, Oryza sativa
MQSLQDKASEWSGVAAGDAFAIDDGNVFEALGGTTQPFVDLSTNFYTRVYEDEEEWFRQIFAGSKKEDAIRNQYEFLVQRMGGPQLFSQRRGHPALIARHRPFPVTHQAAERWLHHMQQAVDTTDSIDAATKTKMMYFFRHTAYFLVAGNEMTRQGHGTSCKCKHGESKPAE

SEQ ID NO: 380 - protein, 171 aa, Zea mays
MQSLQDKASEWSGVAAADAFAIDDVNIFESLGGTPQPFVDLSTNFYTRVYEDEEEWFREIFGGSKKEDAIQNQYEFLIQRMGGPPLFSQRRGHPALIGRHRPFLVTHRAAERWLHHMQQALDATESIDVDSKTKMMNFFRHTAYFLVAGNEMTRQQGHGVACKHATSKPAE

SEQ ID NO: 381 - protein, 482 aa, Zea mays
MALTRIGLAGLAVMGQNLALNIAEKGFPISVYNRTTSKVDETVQRAKAEGNLPVYGFHDPASFVNSIQKPRVVIMLVKAGAPVDQTIATLAAHLEQGDCIIDGGNEWYENTERREKAMEERGLLYLGMGVSGGEEGARNGPSLMPGGSFDAYKYVEDIVLKVAAQVPDSGPCVTYIGKGGSGNFVKMVHNGIEYGDMQLISEAYDVLKSVGKLTNSELHQVFSEWNKGELLSFLIEITADIFGIKDEHGDGYLVDKVLDKTGMKGTGKWTVQQAAELSVAAPTIEASLDSRFLSGLKDERVEASKIFQGDYYSTGSPVDKAQLVEDVRQALYASKICSYAQGMNIIKAKSAEKGWGLNLGELARIWKGGCIIRAIFLDRIKKAYDRNPGLASLLVDPEFAQEIMDRQAAWRRVVCLAINNGVSTPGMSASLAYFDSYRRDRLPANLVQAQRDYFGAHTYERVDMPGSFHTEWFKIARNISNN

SEQ ID NO: 382 - protein, 253 aa, Zea mays
MALASTSATAPAAVLKTPFLGARRALANAAAPKPAPRRALLAVAAAAAKKSWIPAFKSDAEFINPPWLDGSLPGDFGFDPLGLGKDPAFLKWYREAELIHGRWAMAAVLGIFVGQAWSGIPWFEAGADPGAIAPFSFGSLLGTQLLLMGWVESKRWVDFFNPDSQSVEWATPWSRTAENFANFTGDQGYPGGKFFDPLGLAGTVKDGVYVPDVEKLERLKLAEIKHARIAMLAMLVFYFEAGQGKTPLGALGL

SEQ ID NO: 383 - protein, 139 aa, Zea mays
MRISTDKRQRSRGSRAEAEPRSRNCARRTPKQTASIQERELFFSCLFFPLCQDVTLTEQPSVDERIWSFSAAAGWGGGSPWRRRPPSAAPSPRTSGSPAAHRAPSTTCRCPTPPPQALGPPSCLRARPSCFSTTIKRLT

SEQ ID NO: 384 - protein, 233 aa, Zea mays
MTVLDAESRFHVLAVDDSIIDRKLIEMLLKSSSYQVTTVDSGNKALELLGLRDNGAEDASPPSSSSSSSSSSSPDHQEIDVSLIITDYCMPGMTGYDLLKRVKGSSSLKDIPVVIMSSENVPARISRCLQDGAEEFFLKPVKPADMKKLKSHLLKRKQPNQKNKPQAQAVESPEQQLDPHPQPVHEPEEAAADRNGVNKRKAAAMEEGLTVVVTAPESTKPRRLSTSSLTVET

SEQ ID NO: 385 - protein, 610 aa, Zea mays
MAALATSQLVATRAGLGVPDASTFRRGAAQGLRGARASAAADTLSMRTSARAAPRLQLHQQQQQARRGARFPSLVVCASAGMNVVFVGAEMAPWSKTGGLGDVLGGLPPAMAANGHRVMVVSPRYDQYKDAWDTSVVSEIKMGDRYETVRFFHCYKRGVDRVFVDHPLFLERVWGKTEEKIYGPVAGTDYRDNQLRFSLLCQAALEAPRILSLNNNPYFSGPYGEDVVFVCNDWHTGPLSCYLKSNYQSHGIYRDAKTAFCIHNISYQGRFAFSDYPELNLPERFKSSFDFIDGYEKPVEGRKINWMKAGILEADRVLTVSPYYAEELISGIARGCELDNIMRLTGITGIVNGMDVSEWDPSRDKYIAVKYDVSTAVEAKALNKEALQAEVGLPVDRNIPLVAFIGRLEEQKGPDVMAAAIPQLMEMVEDVQIVLLGTGKKKFERMLMSAEEKFPGKVRAVVKFNAALAHHIMAGADVLAVTSRFEPCGLIQLQGMRYGTPCACASTGGLVDTIIEGKTGFHMGRLSVDCNVVEPADVKKVATTLQRAIKVVGTPVYEEMVRNCMIQDLSWKGPAKNWENVLLSLGVAGGEPGVEGEEIAPLAKENVAAP

SEQ ID NO: 386 - protein, 339 aa, Escherichia coli
MNQRNASMTVIGAGSYGTALAITLARNGHEVVLWGHDPEHIATLERDRCNAAFLPDVPFPDTLHLESDLATALAASRNILVVVPSHVFGEVLRQIKPLMRPDARLVWATKGLEAETGRLLQDVAREALGDQIPLAVISGPTFAKELAAGLPTAISLASTDQTFADDLQQLLHCGKSFRVYSNPDFIGVQLGGAVKNVIAIGAGMSDGIGFGANARTALITRGLAEMSRLGAALGADPATFMGMAGLGDLVLTCTDNQSRNRRFGMMLGQGMDVQSAQEKIGQVVEGYRNTKEVRELAHRFGVEMPITEEIYQVLYCGKNAREAALTLLGRARKDERSSH

SEQ ID NO: 387 - protein, 536 aa, Arabidopsis thaliana
MNAAVFSPSALSLPISFSKTRSSFLSRKKGVKGEFRVFAVFGDESGLVEKKSQWRPLFDVEDPRSKAPPYKGKFLDVNQAIEVARFDIQYLDWRARQDLLTIMILHDKVVDVLNPLAREYKSIGTVKKELAGLQEELSKAHQQVHISEARVSTALDKLAHMEELVNDRLLPGRVVTELDKPSSSTTASAVELDREKTNTGAKSLNVSGPVPPYSPHLKNFWYPVAFTADLKHDTMVPIECFEQPWVIFRGEDGKPGCVRNTCAHRACPLDLGTVNEGRIQCPYHGWEYSTDGECKKMPSTKLLKVKIKSLPCLEQEGMIWIWPGDEPPAPILPSLQPPSGFLIHAELVMDLPVEHGLLLDNLLDLAHAPFTHTSTFAKGWSVPSLVKFLTPTSGLQGYWDPYPIDMEFKPPCIVLSTIGISKPGKLEGKSTQQCATHLHQLHVCLPSSKNKTRLLYRMSLDFAPILKNLPFMEHLWRHFAEQVLNEDLRLVLGQQERMLNGANIWNLPVAYDKLGVRYRLWRNAVDRGDDKLPFSG

SEQ ID NO: 388 - protein, 134 aa, Escherichia coli
MSVMLQSLNNIRTLRAMAREFSIDVLEEMLEKFRVVTKERREEEEQQQRELAERQEKISTWLELMKADGINPEELLGNSSAAAPRAGKKRQPRPAKYKFTDVNGETKTWTGQGRTPKPIAQALAEGKSLDDFLI

SEQ ID NO: 389 - protein, 558 aa, Saccharomyces cerevisiae
MAVLNLKRETVDIEETAKKDIKPYFASNVEAVDIDEDPDVSRYDPQTGVKRALKNRHISLLALGGVIGPGCLVGAGNALNKGGPLALLLGFSIIGIIAFSVMESIGEMITLYPSGGGFTTLARRFHSDALPAVCGYAYVVVFFAVLANEYNTLSSILQFWGPQVPLYGYILIFWFAFEIFQLVGVGLFGETEYWLAWLKIVGLVAYYIFSIVYISGDIRNRPAFGFHYWNSPGALSHGFKGIAIVFVFCSTFYSGTESVALAATESKNPGKAVPLAVRQTLWRILVVYIGIAVFYGATVPFDDPNLSASTKVLKSPIAIAISRAGWAGGAHLVNAFILITCISAINGSLYIGSRTLTHLAHEGLAPKILAWTDRRGVPIPAITVFNALGLISLMNVSVGAANAYSYIVNLSGVGVFIVWGVISYTHLRIRKAWVAQGRSIEELPYEALFYPWTPVLSLAANIFLALIQGWSYFVPFDAGNFVDAYILLPVGILLYIGICVFKSNHFRTVDLRSINLDEGRRKDMEADLSDQESSLASSETMKDYKSATFFRYLSNIFT

SEQ ID NO: 390 - protein, 104 aa, Zea mays
MSAAAGGLRRLLAAAATAGAAEVRASIFGHALNPTGRRAATKLLRKKMVGDQVAQWYPYDIKRDDPLVMAREEKERLAKLEMLKRRGKGPPKKGQGRRAVKRSK

SEQ ID NO: 391 - protein, 137 aa, Escherichia coli
MSEALKILNNIRTLRAQARECTLETLEEMLEKLEVVVNERREEESAAAAEVEERTRKLQQYREMLIADGIDPNELLNSLAAVKSGTKAKRAQRPAKYSYVDENGETKTWTGQGRTPAVIKKAMDEQGKSLDDFLIKQ

SEQ ID NO: 392 - protein, 89 aa, Zea mays
MPSLQKALPPELADNVLRLYRECLRRAKYIGHQKHNTELLVAMVRQQFKKNMHETDPEKIQKMKDDAARGLINHILYESEKITGRKFSG

SEQ ID NO: 393 - protein, 476 aa, Chlorella sorokiniana
MDATTGDFTALQKAVKQMATKAGTEGLVHGIKNPELRQLLTEIFMKDPEQQEFMQAVREVAVSLQPVFEKRPELLPIFKQIVEPERVITFRVSWLDDAGNLQVNRGFRVQYSSAIGPYKGGLRFHPSVNLSIMKFLAFEQIFKNSLTTLPMGGGKGGSDFDPKGKSDAEVMRFCQSFMTELQRHISYVQDVPAGDIGVGAREIGYLFGQYKRITKNYTGVLTGKGQEYGGSEIRPEATGYGAVLFVENVLKDKGESLKGKRCLVSGAGNVAQYCAELLLEKGAIVLSLSDSQGYVYEPNGFTREQLQAVQDMKKKNNSARISEYKSDTAVYVGDRRKPWELDCQVDIAFPCATQNEIDEHDAELLIKHGCQYVVEGANMPSTNEAIHKYNKAGIIYCPGKAANAGGVAVSGLEMTQNRMSLNWTREEVRDKLERIMKDIYDSAMGASREYNVDLAAGANIAGFTKVADAVKAQGAV

SEQ ID NO: 394 - protein, 402 aa, Arabidopsis thaliana
MFPMSSTSRSSAANNRKDPPRKKNKETPSPVTREPTSIDSLPNDLLLNCFARVSRMYYPALSRVSKRFRSIVTSPEIYNTRSLLNRTEKCLYLCLRFPFDNNTHWFTLYQNPNRTVSDKVFLQIPSPQYPLTLSSNLVAVGSNIYRIGGTVGDDSCPLGFDREPSSKVSILDCRSHTWRDGPRMRLNRRSSTTSVVDGKIYVTGGTEDTDNPSHWIEVFDPKTQSWGTVTNPHIVKVWEEVCYRRAVKSIGHDGKLYLSGDKYVVYDPDEGKWNSVEEHWLIGYAIGSSNCVVDNILFYWDQGVFKWYDSKVSSWKQLKGLEGLPDDFSQREYCKLVDLGGKMAVLWDKWEYSGVCMIFCAEISLEKRDGDEIWGKVEWFDTVLEVGASCSLKSADALSASV

SEQ ID NO: 395 - protein, 234 aa, Arabidopsis thaliana
MGEKEEVKLLGVWYSPYAIRPKIALRLKSVDYDYVEENLFGSKSELLLKSNPVHKKVPVLLHNNKPIVESLNIVEYIDETWNSSAPSILPSHPYDRALARFWSDFVDNKWFPALRMAAITKSEDAKAKAMEEVEEGLLQLEDAFVSISKGKPFFGGEAIGFMDICFGSFVVLLKAREKFKAEKLLDESKTPSLCKWADRFLSDETVKNVAPEIEKVAEFLQELEVRAQSAASRS

SEQ ID NO: 396 - protein, 290 aa, Arabidopsis thaliana
MEVSWNELHIKERVGAGSFGTVHRAEWHGSDVAVKILSIQDFHDDQFREFLREVAIMKRVRHPNVVLFMGAVTERPRLSIITEYLPRGSLFRLIHRPASGELLDQRRRLRMALDVAKGLNYLHCLNPPVVHWDLKSPNLLVDKNWTVKVCDFGLSRFKANTFIPSKSVAGTPEWMAPEFLRGEPTNEKSDVYSFGVVLWELITLQQPWNGLSPAQVVGAVAFQNRRLIIPPNTSPVLVSLMEACWADEPSQRPAFGSIVDTLKKLLKSPVQLIQMGGDKGVIPTKSAPIL

SEQ ID NO: 397 - protein, 109 aa, Arabidopsis thaliana
MSNLTSKFLLNPLNVHKHCAVSDENGDRKSHVLKQVCSCICCCNRRNKTQARSQKGSYFIKGKVHPVSRMEKWEEKITEANSHGKIVSSSSYDLPFYVVLHSSSVDSST

SEQ ID NO: 398 - protein, 1004 aa, Arabidopsis thaliana
MMKLFLLLLFLLHISHTFTASRPISEFRALLSLKTSLTGAGDDKNSPLSSWKVSTSFCTWIGVTCDVSRRHVTSLDLSGLNLSGTLSPDVSHLRLLQNLSLAENLISGPIPPEISSLSGLRHLNLSNNVFNGSFPDEISSGLVNLRVLDVYNNNLTGDLPVSVTNLTQLRHLHLGGNYFAGKIPPSYGSWPVIEYLAVSGNELVGKIPPEIGNLTTLRELYIGYYNAFEDGLPPEIGNLSELVRFDGANCGLTGEIPPEIGKLQKLDTLFLQVNVFSGPLTWELGTLSSLKSMDLSNNMFTGEIPASFAELKNLTLLNLFRNKLHGEIPEFIGDLPELEVLQLWENNFTGSIPQKLGENGKLNLVDLSSNKLTGTLPPNMCSGNKLETLITLGNFLFGSIPDSLGKCESLTRIRMGENFLNGSIPKGLFGLPKLTQVELQDNYLSGELPVAGGVSVNLGQISLSNNQLSGPLPPAIGNFTGVQKLLLDGNKFQGPIPSEVGKLQQLSKIDFSHNLFSGRIAPEISRCKLLTFVDLSRNELSGEIPNEITAMKILNYLNLSRNHLVGSIPGSISSMQSLTSLDFSYNNLSGLVPGTGQFSYFNYTSFLGNPDLCGPYLGPCKDGVAKGGHQSHSKGPLSASMKLLLVLGLLVCSIAFAVVAIIKARSLKKASESRAWRLTAFQRLDFTCDDVLDSLKEDNIIGKGGAGIVYKGVMPNGDLVAVKRLAAMSRGSSHDHGFNAEIQTLGRIRHRHIVRLLGFCSNHETNLLVYEYMPNGSLGEVLHGKKGGHLHWDTRYKIALEAAKGLCYLHHDCSPLIVHRDVKSNNILLDSNFEAHVADFGLAKFLQDSGTSECMSAIAGSYGYIAPEYAYTLKVDEKSDVYSFGVVLLELVTGRKPVGEFGDGVDIVQWVRKMTDSNKDSVLKVLDPRLSSIPIHEVTHVFYVAMLCVEEQAVERPTMREVVQILTEIPKLPPSKDQPMTESAPESELSPKSGVQSPPDLLNL

SEQ ID NO: 399 - protein, 104 aa, Arabidopsis thaliana
MAARSLSGAVKSLCSAASGSLSCSIVLRRSYVATSQNVTAAGLSKGGSTRVMVGKMEQRGLDQEAESAWGPDPVTGYYRPSNRAAEIDPAELRELLLKNKAKSF

SEQ ID NO: 400 - protein, 304 aa, Oryza sativa
MAEHLASIFGTEKDRVNCPFYFKIGACRHGDRCSRLHNRPTVSPTIVLANMYQRPDMITPGVDAQGQPIDPEKMQEHFEDFYEDIYEELSKFGEVETLNVCDNLADHMIGNVYVQFREEEQAVAAHNALQGRFYSGRPIIVEYSPVTDFREATCRQFEENSCNRGGYCNFMHVKQIGRELRRKLYGGRSRRSHGRSRSPSPRHRRGNRDRDDFRRERDGYRGGGDGYRGGGGGGGGDGYRGGDSYRGGGGGGRRGGGSRYDRYDDGGRRRHGSPPRRARSPVRESSEERRAKIEQWNREREEKP

SEQ ID NO: 401 - protein, 389 aa, Lactobacillus delbrueckii
MASSVLSSAAVATRSNVAQANMVAPFTGLKSAASFPVSRKQNLDITSIASNGGRVQCMQVWPPINKKKYGSKRIGILTSGGDAPGMNAAVRAVTRVAIANGLEVFGIRYGFAGLVAGDIFPLESEDVAHLINVSGTFLYSARYPEFAEEEGQLAGIEQLKKHGIDAVVVIGGDGSYHGALQLTRHGFNSIGLPGTIDNDIPYTDATIGYDTACMTAMDAIDKIRDTASSHHRVFIVNVMGRNCGDIAMRVGVACGADAIVIPERPYDVEEIANRLKQAQESGKDHGLVVVAEGVMTADQFMAELKKYGDFDVRANVLGHMQRGGTPTVSDRVLASKLGSEAVHLLLEGKGGLAVGIENGKVTSHDILDLFDESHRGDYDLLKLNADLSR

SEQ ID NO: 402 - protein, 734 aa, Umbelopsis ramanniana
MAPARTTFFYDLALWIFNIMLDVFFKEIRPRGSHRIPREGPVIFVVAPHVNQFVDPLILMRECGRRVSFLIAEKSMHQRGIGMFARMINAIPVIRPQDLAKPGQGRIQLLNTKTDPLRITGIDTKFTTELQPKFSIVLPKNVAQMEVVQVLSDTEILIKKEVKEAKALALLTSPEGSAYKCIPHVEQDSVYKVVHDSLNNNQCITIFPEGGSHDRAEMLPLKAGVTLMALGAMAKYPGLDVKIVPCGLNYFHAHRFRSRAVIEFGDPITISADMVQNFKEGGNTKRDACSKLLDIIYNALKSVTVNASNYETLMMIQAARRLYKPAHRKLHISQVVDLNRRFVIGYNIYKDDPKVIELQHKVLAYNQLIKYHGLKDHQVPKTNLRRRETFALLSYRLMLLSVWGILAFPGAILNLPIAIVAKYISTRKAKEALAGSTVKLAGRDVLATWKLLVGLVLIPTLYGLYSFVAFIFLMRTEWNWKYKVFVPLTIWNTLPFISYASMRFAENGLEVYRSIRPLYVRLVDRDSAEGLRQNRERLSTDITDLINEYAPKVFNDFDPDNVFRPASVAAMDAASVPSTPGIDLQRLASGFFTNAAARMDWLDDRNIFNWSRQEESDVDDSLYFLDRNSGGITGSASEVEITAHKRRKSTGRRSRTGSLIHGESGGMKVESMTTLNVQKPFGELRLPVARRAGFKHGGDQDEAGSEATIDYLRVEDDGYAGDREENSKFSKKTI

SEQ ID NO: 403 - protein, 320 aa, Zea mays
MSSSSSSSSAATVFPPSPQLPPPLLVENLPPLHQLTPPVAAAAPASEQLCYVHCHFCDTVLVVSVPTSSLFKTVTVRCGHCSSLLTVNMRGLLFPGTPANTAAAAAAAPPPPPAAVTSTTATITTAPAPPPATSVNNNGQFHFIPHSLDLALPIPPHQSLLLDEISSAANPSLQLLEQHGLGGMIPSGRNAAALHPHPPQPQPQPPAAGKGAKEPSPRANSAINRPPEKRQRVPSAYNRFIKDEIQRIKAGNPDISHREAFSAAAKNWAHFPHIHFGLMPDHQGPKKTSLLPQDHQRSDGGGLLKEGLYAAAANMGVAPY

SEQ ID NO: 404 - protein, 359 aa, Zea mays; identical to SEQ ID NO: 299

SEQ ID NO: 405 - protein, 585 aa, Triticum aestivum
MCGILAVLGCADDTQGKRVRVLELSRRLKHRGPDWSGMHQVGDCYLSHQRLAIIDPASGDQPLYNEDKSIVVTVNGEIYNHEQLRAQLSSHTFRTGSDCEVIAHLYEEHGENFIDMLDGVFSFVLLDTRDNSFIAARDAIGVTPLYIGWGIDGSVWISSEVKGLNDDCEHFEIFPPGHLYSSKQGGFKRWYNPPWFSEVIPSVPYDPLALRKAFEKAVIKRLMTDVPFGVLLSGGLDSSLVAAVTVRHLAGTKAAKRWGTKLHSFCVGLEGSPDLKAAKEVANYLGTMHHEFTFTVQDGIDAIEDVIYHTETYDVTTIRASTPMFLMSRKIKSLGVKMVISGEGSDEIFGGYLYFHKAPNKEELHRETCQKIKALHQYDCLRANKATSAWGLEARVPFLDKEFINEAMSIDPEWKMIRPDLGRIEKWMLRKAFDDEEQPFLPKHILYRQKEQFSDGVGYSWIDGLKAHAESNVTDKMMSNAKFIYPHNTPTTKEAYCYRMIFERFFPQNSAILTVPGGPSVACSTAKAVEWDAQWSGNLDPSGRAALGVHLSAYEQEHLPATIMAGTSKKPRMIEVAAPGVAIES

SEQ ID NO: 406 - protein, 717 aa, Zea mays
MATADRTRTFMKDVKRVIIKVGTAVVTRGDDGRLAVGRLGCLCEQVKELNVLGYEVILVTSGAVGVGKQRLKYRKLVNSSFADLQKPQMELDGKACAAVGQSGLMALYDMLFTQLDVSSSQLLVTDSDFENPNFRERLCETVESLLDLKVVPIFNENDAISTRKAPYEDSSGIFWDNDSLAGLLAIELKADLLVLLSDVDGLYSGPPSEPGSKIIHTYIKDKHYSGITFGDKSRVGRGGMTAKVKAAFVASNSGTPVVITSGFASQSIVRVLQGEKIGTLFHKDASLWEPSKDVSAREMAVAARECSRRLQNLSSDERKKILLDIADALEQNEDLIRTENEADVSAAQDAGYQKSLVDRLTLKPEKIASLAKSIRTLANMEDPINQILKRTEVAEDLVLEKTSCPLGVLLIVFESRPDALVQIASLAVRSGNGLLLKGGKEAMRSNTVLHKVITGAIPDNVGQKLIGLVTSRDEIADLLKLDDVIDLVIPRGSNKLVSQIKASTKIPVLGHADGICHVYIDKSADMNMAKRIVMDAKTDYPAACNAMETLLVHKDLIKAPGLDDILLSLKTEGVAIYGGPVAHEVLCIPKADSFHHEYSSMACTIEFVDDVQSAINHIHRYGSAHTDCIITTDDKVAETFLRQVDSAAVFHNASTRFSDGARFGLGAEVGISTGRIHARGPVGVEGLLTTRWIMRGSGQVVNGDKNVAYTHKNLPLQ

SEQ ID NO: 407 - protein, 132 aa, Bacillus subtilis
MGQSFNAPYEAIGEELLSQLVDTFYERVSSHPLLKPIFPSDLTETARKQKQFLTQYLGGPPLYTEEHGHPMLRARHLPFPITAERADAWLSCMSKAMDQVGLEGDIREFLYGRLELTARHMVNQSEAEDRSS

SEQ ID NO: 408 - protein, 236 aa, Zea mays
MTRRYWNINLKEMIEAGVHFGHGIKKWNPKMAPYISAKRKGTHIINLARTARFLSEACDLVFDAASQGKSFLIVGTKKRAADLVASAAIRSRCHYVNKKWFSGMLTNWSITKTRLSQFRDLRAEEKMGKFHHLPKRDAAILKRKLSTLQRYLGGIKYMTRLPDIVIVLDQQKEYIALQECAILGIPTISLVDTNCDPDLANISIPANDDTMTSIRLILNKLVFAISEGRSLYIRNR

SEQ ID NO: 409 - protein, 155 aa, Escherichia coli
MYIMELTTRTLPARKHIALVAHDHCKQMLMSWVERHQPLLEQHVLYATGTTGNLISRATGMNVNAMLSGPMGGDQQVGALISEGKIDVLIFFWDPLNAVPHDPDVKALLRLATVWNIPVATNVATADFIIQSPHFNDAVDILIPDYQRYLADRLK

SEQ ID NO: 410 - protein, 388 aa, Glycine max
MGKREKQKQRHEKGHRGRGSFNYLQEDRDFDDTPRPSPSEEECADDSNEEKEEEEEEEGHENQSHDMPSKFLLYQQSVQSPKGDISYLQKFFLMYVGGRMPLHLQEDFCGTALLSTEWLRSDSRRTVVGLDLDLEALNWCMESNIPKVGADGFSRMSLFHGNVLQPLQSKLVKIDPQQLVSDISLSQNEENLQTDVPESDAPTGSVAQDDKYTKRNIILPGRDIVCAFNYSCCCLHKRAELVLYFKHAREALSTKGGIFVMDLYGGTSSEHKLRLQRRFPNFTYVWEQAEFDIIQRKTRISLHFHMKKEQRKLRHAFSYSWRLWTLPEIRDCLEEAGFRSVHFWVREMPDTTEIMRTEGFGAGKNVKYEEATSFQQQDSWNAYIVGVA

SEQ ID NO: 411 - protein, 574 aa, Zea mays
MEAAADEERPLIQYLAPEDDEASSRYTSDGTLDINKQRALKKSTGNWRACFMILGTEFAECLAFYATAKNLVTYLTAELGETNIDAATNVSTWIGSCYLTPLIGAFLADTYWGRYKTMIVFLLLYIVGMLTLTASAWLPLAMEDDSPDNSGLRRATAYLGLYLVSLGTGGIKPCTAALGADQFDGGDAAERVTKASFFNWYYFCTNIGSLLSGTVLVWVQENIGWGVGFTVQTVFMLFGLAVFVAGRKVYRYKKLGGSPLTRVAQVVVAAVRNCHLVLPDDTSALYHDKLLPTEPNFRIESARQFRFFDKAAIITGEKGAAAPTSPWRLCTVSQVEELKMLLRLLPVWASMVLFFAVSAQTVTTFIEQARVMDNRIGPFTIPPASIATFDVISVMVCVPVYDAVLVPLARRATGNDRGLSQLHRLSIGIALSVVVMVYAALLEGRRLALARANMPAMNIAWQAPMFAVHGAAAVFATVGVLEFFYDQSPDGMKSLGNALALLSMAAGSYFNSLALSAVGSITARGGERGWLPDDLNKGHMDYFFWMMAALGTLNLLHFLHYCNRRYRGNNNNTS

SEQ ID NO: 412 - protein, 425 aa, Zea mays
MPSITHYVLDRLLETRSPVHVQKVVPKPPPPPPDKATPVPVSTARTRSSLASLYATPENTTLPDLPSSFPGTWSPYLINHKRRGASLARTFSQGDAGREVSQPNLPVMLPALPRGCEPTQVQEPEFVFQQAGNGQAEGESAVEEALNGKSVMLQKGKGSVIAEIEQEQPEFEFCQSLEALVKPVNVRRPLNGEAPKICESDTFEWRKPSSPLGTSVGTPGAEFYDAFEEISSDGGTRSSRGMDDDLREMRLSLLMEIERRTQTEEALEIWQQEWKNLSHHLSLVALSLPSPSIAEDSDCLKVDPGAELCQQITVSQLVAAAIARGFARAEVESEMETMIATKNFEIGRLSDRVQYYEAANREMSQRNQEAIEMSRQQRKGRKKRQKWFWASVGLAVTLGATAIAWSYVTPSQPQASADPSSAASQ

SEQ ID NO: 413 - protein, 707 aa, Unknown
  Synechocystis sp. PCC 6803
MERIDIHPTHTANGYKLRCGQPFPFGATIVPGGVNFSIYSSHSTACTLVLFEKRAPQPFVEIPFPESFRIGNVYCMVVFDLDFENLEYGYRMEGPNNFQQGHWFDPSKVLLDPYAKVVSGRDVWGTQPNWDDIYQHRGRLSFDDFDWENDSPLDVPLEDMVIYEMHVRGFTKDPSSGVKENHRGTFAGILSKIPYLQELGVNTIELMPIFEFDEFEHSRYHPETGEFLVNYWGYSTVNFFAPKAGYAATGKFGMQIDELKNLVKELHKVGISVILDVVFNHTAEGNERGPTISFRGLDNKTYYMLTPEGYYFNFSGTGNTLNCNNPIVRGMVLDCLRYWTAEFHIDGFRFDLASILGRDPWGYPLANPPLLETLAFDPILARSKLIAEAWDAGGLYQVGSFPSYGRWAEWNGKYRDTVRKFIKGDAGVIGEMAQRLQGSPDLYQGAGRPPSTSINFVTAHDGFTLADLVAYNGKHNYANGENGNDGANDNYSWNCGVEGPTDNPDILRLRARQMRNAIAILLVSQGVPMLLMGDEMGKTQDGNNNTYCHDSPFNWLNWHLLEQNQAWFRFVKHCIAFRLAHPVLRNSEHFQNCDYLGVGFPDISWHGVKPWHADWSADSRVLAFMLCGRHAKGGRVKDNQIYVAMNMHYESLWFELPAPPVGTTWHVFANTGAQPPEDIHPPGQEPPLSSQSSLLIGDRSVVILLAK

SEQ ID NO: 414 - protein, 268 aa, Bacillus halodurans
MASSMLSSATMVASPAQATMVAPFNGLKSSAAFPATRKANNDITSITSNGGRVNCMQVWPPIGKKKFETLSYLPDLTDSGGRVNCMQAMVKHDIEKVLISEEEIQKKVKELGAELTSEYQDTFPLAIGVLKGALPFMADLIKHIDTYLEMDFMDVSSYGNSTVSSGEVKIIKDLDTSVEGRDILIIEDIIDSGLTLSYLVELFRYRKAKSIKIVTLLDKPSGRKADIKADFVGFEVPDAFVVGYGLDYAERYRNLPYIGVLKPAVYES

SEQ ID NO: 415 - protein, 162 aa, Arabidopsis thaliana
MVRKQFQQAKTGIEALKSMDANNYLKKVGLGRDDMFFWKQVGKALLCTYTIFGMAWIYNETSPLGWWTLKPRPKEERELAHLYERREFPYPGDTEAMEDFVAKGGMIGTAIGPKGIVESEGEADNYQKEMEKKKFDKEAQKLWLRMRNEVITELQEKGHNLE

SEQ ID NO: 416 - protein, 423 aa, Zea mays
MAQAVVPAMQCRVGVKAAAGRVWSAGRTRTGRGGASPGFKVMAVSTGSTGVVPRLEQLLNMDTTPYTDKVIAEYIWVGGSGIDIRSKSRTISKPVEDPSELPKWNYDGSSTGQAPGEDSEVILYPQAIFKDPFRGGNNVLVICDTYTPQGEPLPTNKRHRAAQIFSDPKVAEQVPWFGIEQEYTLLQKDVNWPLGWPVGGFPGPQGPYYCAVGADKSFGRDISDAHYKACLYAGINISGTNGEVMPGQWEYQVGPSVGIEAGDHIWISRYILERITEQAGVVLTLDPKPIQGDWNGAGCHTNYSTKTMREDGGFEEIKRAILNLSLRHDLHISAYGEGNERRLTGKHETASIGTFSWGVANRGASIRVGRDTEAKGKGYLEDRRPASNMDPYIVTGLLAETTILWQPSLEAEALAAKKLALKV

SEQ ID NO: 417 - protein, 423 aa, Zea mays
MAQAVVPAMQCRVGVKAAAGRVWSAGRTRTGRGGASPGFKVMAVSTGSTGVVPRLEQLLNMDTTPYTDKVIAEYIWVGGSGIDIRSKSRTISKPVEDPSELPKWNYDGSSTGQAPGEDSEVILYPQAIFKDPFRGGNNVLVICDTYTPQGEPLPTNKRHRAAQIFSDPKVAEQVPWFGIEQEYTLLQKDVNWPLGWPVGGFPGPQGPYYCAVGADKSFGRDISDAHYKACLYAGINISGTNGEVMPGQWEYQVGPSVGIEAGDHIWISRYILERITEQAGVVLTLDPKPIQGDWNGAGAHTNYSTKTMREDGGFEEIKRAILNLSLRHDLHISAYGEGNERRLTGKHETASIGTFSWGVANRGCSIRVGRDTEAKGKGYLEDRRPASNMDPYIVTGLLAETTILWQPSLEAEALAAKKLALKV

SEQ ID NO: 418 - protein, 356 aa, Zea mays
MACLTDLVNLNLSDTTEKIIAEYIWIGGSGMDLRSKARTLPGPVTDPSKLPKWNYDGSSTGQAPGEDSEVILYPQAIFKDPFRRGNNILVMCDCYTPAGEPIPTNKRYSAAKIFSSPEVAAEEPWYGIEQEYTLLQKDTNWPLGWPIGGFPGPQGPYYCGIGAEKSFGRDIVDAHYKACLYAGINISGINGEVMPGQWEFQVGPSVGISSGDQVWVARYILERITEIAGVVVTFDPKPIPGDWNGAGAHTNYSTESMRKEGGYEVIKAAIEKLKLRHKEHIAAYGEGNERRLTGRHETADINTFSWGVANRGASVRVGRETEQNGKGYFEDRRPASNMDPYVVTSMIAETTIVWKP

SEQ ID NO: 419 - protein, 573 aa, Unknown
  Synechocystis sp. PCC 6803
MFTTPLPPQKRLSTQTEAIAKNITAIRSLDWDRDRFDIEFGLQNGTTYNSYLIQADKVALVDSSHEKFRQLYLDLLQGLIDPQRIDYLIVSHTEPDHSGLVKDILQLNPRITVVATKVALQFLDNFVHQPFERIQVKSGDRLDLGQGHDLEFVSAPNLHWPDTMLTYDPATEILFTCDVFGMHYCSDAVFDIDLGKIAPDYQFYYDCLMGPNARSVLAAMKRMDNLGTISTVANGHGPLLRHNVGELLHRYRHWSESQSKAEKTVVVFYVADYGYGDRLSQAIAKGITKTGVGVDMVDLSSADPQEIQELVGHASGVVLGMPPLQANADLSTNFGAVLAAMQPKQVFGLYESYGGDDEPIDPLRTKFLDLGLREAFKVIKVKDTPSESTYQLCDESGTDLGQNLIQAAKIKQLKSLDSDLEKAIGRISGGLYIITAQKGEVKGAMLASWVSQASFNPPGFTVAVAKDRAIESLMQVGDRFVLNILEEGNYQILMKHFLKRFPPGADRFAGVKTQTASNGSPILTDALAYLECEVASRMECSDHWIVYSQVTNGRVAKAEGLTAVHHRKVGNYY

SEQ ID NO: 420 - protein, 647 aa, Zea mays
MMGGGLMMDQSVVFPGVHNFVDLLQQNGDKNLGFASLMPQTSSGDQCVMGEGDLVDPPPDSFPDAVEDDSDDDVEDIEELERRMWRDRMKLKRLRELQQSRGKDPMASGGGLADGSSKPRQSQEQARRKKMSRAQDGILKYMLKMMEVCRAQGFVYGIIPEKGKPVSGASDNLRAWWKEKVRFDRNGPAAIAKYQADNAVPGAENELASGAASPHSLQELQDTTLGSLLSALMQHCDPPQRRYPLEKGVPPPWWPTGDEEWWPELGIPKDQGPPPYKKPHDLKKAWKVSVLTAVIKHMSPDIEKIRRLVRQSKCLQDKMTAKEISTWLAVVKQEEELYLKLHPGARPPASTGGIASAISFNTTSSEYDVDIVDECKGDEAGNQKTAVTDPTSFNLGAAILSDKFLMPTPMKEETADVEFIQKRNAPAPAEPELMLNNRVYTCNNVQCPHSDYSYAFLDRNARNSHQYTCKYNDPITQSAENKPLPAPPQPQAFQPAFSQANQAVNNLDFSLPMDGQRSIAELMNMYDTNFMTSKTMSSSDSVTIMERPNAMPQRIQMDEGFFGQGNGVFDDVNSMMQNQQQNQAPPVVQQQQQQFFIRDDTPFMSQMGDITSTAEFRFGSGFNMSSTAAAADYPGAAQKNDGTNWFY

SEQ ID NO: 421 - protein, 585 aa, Hordeum vulgare
MCGILAVLGCADDTQGKRVRVLELSRRLKHRGPDWSGMHQVGDCYLSHQRLAIIDPASGDQPLYNEDKSIVVTVNGEIYNHEQLRAQLSSHTFRTGSDCEVIAHLYEEHGENFIDMLDGVFSFVLLDTRDNSFIAARDAIGVTPMYVGWGIDGSVWISSEMKGLNDDCEHFEIFPPGHLYSSKEGGFKRWYNPPWFSEVIPSVPYDPLALRKAFEKAVTKRLMTDVPFGVLLSGGLDSSLVAAVTVRHLAGTKAAKRWGTKLHSFCVGLEGSPDLKAAKEVANYLGTMHHEFTFTVQDGIDAIEDVIYHTETYDVTTIRASTPMFLMSRKIKSLGVKMVISGEGSDEIFGGYLYFHKAPNKEELHRETCQKIKALHQYDCLRANKATSAWGLEARVPFLDKEFINEAMSIDPEWKMIRPDLGRIEKWVLRKAFDDEEQPFLPKHILYRQKEQFSDGVGYSWIDGLKAHTESNVTDKMMSNAKFIYPHNTPTTKEAYCYRMIFERFFPQNSAILTVPGGPSVACSTAKAVEWDARWSGNLDPSGRAALGVHLSAYEQEHLPATIMAGTSKKPRMIKVAAPGVAIES

SEQ ID NO: 422 - protein, 479 aa, Escherichia coli
MSIVVKNNIHWVGQRDWEVRDFHGTEYKTLRGSSYNSYLIREEKNVLIDTVDHKFSREFVQNLRNEIDLADIDYIVINHAEEDHAGALTELMAQIPDTPIYCTANAIDSINGHHHHPEWNFNVVKTGDTLDIGNGKQLIFVETPMLHWPDSMMTYLTGDAVLFSNDAFGQHYCDEHLFNDEVDQTELFEQCQRYYANILTPFSRLVTPKITEILGFNLPVDMIATSHGVVWRDNPTQIVELYLKWAADYQEDRITIFYDTMSNNTRMMADAIAQGIAETDPRVAVKIFNVARSDKNEILTNVFRSKGVLVGTSTMNNVMMPKIAGLVEEMTGLRFRNKRASAFGSHGWSGGAVDRLSTRLQDAGFEMSLSLKAKWRPDQDALKLCREHGREIARQWALAPLPQSTVNTVVKEETSATTTADLGPRMQCSVCQWIYDPAKGEPMQDVAPGTPWSEVPDNFLCPECSLGKDVFEELASEAK

SEQ ID NO: 423 - protein, 354 aa, Zea mays
MATAAASSLLKSSFAGSRLPAATRTTPASLVVATGPRGAGAGPICASMSMSSSNPPYDLTSFRFSPIKESIVSREMTRRYMTDMITYADTDVVIVGAGSAGLSCAYELSKDPAVSIAIVEQSVSPGGGAWLGGQLFSAMVVRKPAHLFLDELGVAYDEAEDYVVIKHAALFTSTVMSLLLARPNVKLFNAVAVEDLIVRGGRVGGVVTNWALVSMNHDTQSCMDPNVMEAKVVVSSCGHDGPFGATGVKRLQDIGMISAVPGMKALDMNTAEDEIVRLTREVVPGMIVTGMEVAEIDGAPRMGPTFGAMMISGQKAAHLALKALGRPNAVDGTMSPPLREELMIAYKDDEVVDA

SEQ ID NO: 424 - protein, 403 aa, Oryza sativa
MDNALRFADSSSLRSSDPGKDLLVVAQTTADRKCKSSALENNAVMENNLSENSKGTATGHAESCPSHFVEINLEKQHHLNGYTNHKLNEKDIFNHSNSSAFSRYGNKRIESSAQRPFPPSFRVVHQQPVYDKNPQSSRVLLSCEHNTRESTVQAQVPLDRSTEGAAILCSSSVREDAGTSSSSPRKDSLTHPSYGFIPVPIPVGAAIPYHYGAIMQPMYYPQGAFMHCDSAAINKTAIQHVSCQSNYHENLGKPPQIDEHKQPEENHQLHHSRQILRESGEPVDLAKAHMERINQSASCSQDIRKGSGCTGSGETDANTNTVIALESGNESGVQNCSNNVLDGDRSRREAALLKFRMKRKDRCFEKKVRYHSRKKLAEQRPRVKGQFVSQKLKSAITTEAETD

SEQ ID NO: 425 - protein, 607 aa, Arabidopsis thaliana
MDTKIGSIDDCKPTNGDVCSPTNGTVATIHNSVPSSAITINYCDATLGRHLARRLVQAGVTDVFSVPGDFNLTLLDHLMAEPDLNLIGCCNELNAGYAADGYARSRGVGACVVTFTVGGLSVLNAIAGAYSENLPLICIVGGPNSNDYGTNRILHHTIGLPDFSQELRCFQTVTCYQAVVNNLDDAHEQIDKAISTALKESKPVYISVSCNLAAIPHHTFSRDPVPFSLAPRLSNKMGLEAAVEATLEFLNKAVKPVMVGGPKLRVAKACDAFVELADASGYALAMMPSAKGFVPEHHPHFIGTYWGAVSTPFCSEIVESADAYIFAGPIFNDYSSVGYSLLLKKEKAIVVQPDRITVANGPTFGCILMSDFFRELSKRVKRNETAYENYHRIFVPEGKPLKCESREPLRVNTMFQHIQKMLSSETAVIAETGDSWFNCQKLKLPKGCGYEFQMQYGSIGWSVGATLGYAQASPEKRVLAFIGDGSFQVTVQDISTMLRNGQKTIIFLINNGGYTIEVEIHDGPYNVIKNWNYTGLVDAIHNGEGNCWTAKVRYEEELVEAITTATTEKKDCLCFIEVILHKDDTSKELLEWGSRVSAANSRPPNPQ

SEQ ID NO: 426 - protein, 499 aa, Glycine max
MSQPLTTNSVLVEEAAADGDSSAAAPPLFDYHRIDQKLLQNIVYDALVWSTLNCLLVGDKSVQRSGRVPGVGLVHLPLSLLPGPFPESHWKQGCELAPIFNELVDRVSLDGKFLQESLSRTKNADEFTSRLLDIHSKMLQINKKEDIRMGIVRSDYMIDEKTKSLLQIEMNTISTSFALIGCLMTGLHKSLLSQYGKFLGLNSNRVPANNAVDQSAEALAKAWSEYNNPRAAILVVVQVEERNMYEQHYISALLREKHHIRSIRKTLTEIDQEGKILPDGTLSVDGQAISVVYFRAGYTPKDYPSESEWRARLLMEQSSAIKCPTISYHLVGTKKIQQELAKPGVLERFVENKDHIAKLRACFAGLWSLEDSDIVKKAIENPELFVMKPQREGGGNNIYGDELRETLLKLQEAGSQEDAAYILMQRIFPATSPAILVRDGNWDTGHVISEAGIFGTYLRNKDKIIINNESGYMVRTKISSSYEGGVLPGFGVVDTVYLT

SEQ ID NO: 427 - protein, 276 aa, Arabidopsis thaliana
MATTTAAAASGIFGIRIQDPRPGTGRVQARFGFSFGKKKPAPPPKKSRQVQDDGDRLVWFPGANPPEWLDGSMIGDRGFDPFGLGKPAEYLQYDFDGLDQNLAKNVAGDIIGIIQESSEIKPTPFQPYTEVFGIQRFRECELIHGRWAMLGTLGAIAVEALTGIAWQDAGKVELVEGSSYLGQPLPFSLTTLIWIEVLVVGYIEFQRNSELDPEKRIYPGGYFDPLGLAADPEKLDTLKLAEIKHSRLAMVAFLIFALQAAFTGKGPVSFLATFNN

SEQ ID NO: 428 - protein, 92 aa, Oryza sativa
MSSRRSRSRQSGSSRITDEQISDLVSKLQDLLPEARLRSNDRVPSSRVLQETCNYIRSLHQEVDDLSERLSELLATSDMSSAQAAIIRSLLM

SEQ ID NO: 429 - protein, 206 aa, Arabidopsis thaliana
MALSPNSSSLDLTISIPSFSPSPSLGDHHGMRDFDINQTPKTEEDREWMIGATPHVNEDDSNSGGRRRKKLRLTKEQSHLLEESFIQNHTLTPKQKKDLATFLKLSQRQVEVWFQNRRARSKLKHTEMECEYLKRWFGSLKEQNRRLQIEVEELRALKPSSTSALTMCPRCERVTDAVDNDSNAVQEGAVLSSRSRMTISSSSSLC

SEQ ID NO: 430 - protein, 133 aa, Zea mays
MASFTASASTVSAARPALLLKPTVAISAPVLGLPPMGKKKGGVRCSMETKQGNVSVMGAGVSAAATAALTAVMSNPAMALVDERMSTEGTGLPFGLSNNLLGWILFGVFGLIWTFFFVYTSSLEEDEESGLSL

SEQ ID NO: 431 - protein, 325 aa, Zea mays
MEATAVPRALSLLGPSLSTAQLLPWMRMNCLRVAVGGGVRRQGGVVWAKKTRRGRDDVAEERVDTHSFAPKAVLLRKKMVREDGQVSPEFADANEEKLYDFLNIQLKSDMKRIQRRNLLSTMLSAWTILLLGPGQVSLAETTGGAFREYIDTFDGYTFLYPKNWIQVRGAGADIFFRDPMVLDENMSVEISSPSSSRYTSVEDLGPPEKAAEKVLGQYLTEFMSTRLGVRRESNVLSASSKVADDGKLYYEVEVNIKSYASNNELAVMPQDRVQSLEWDRRYLSVLGVENKRLYELRLQTPEQVFMQEEEDLRRVMDSFRVIKAA

SEQ ID NO: 432 - protein, 172 aa, Arabidopsis thaliana
MASISLSSSTVPSLNSKESSGVSAFASRSISAVKFQFPVRRVRTGDLKFPSLSSTTRCTPRRIEAKKQTFDSFEDLLVNSDKPVLVDYYATWCGPCQFMVPILNEVSETLKDKIQVVKIDTEKYPSIANKYKIEALPTFILFKDGEPCDRFEGALTAKQLIQRIEDSLKVKP

SEQ ID NO: 433 - protein, 538 aa, Arabidopsis thaliana
MLDSLVSKLPSLSTSDHASVVALNLFVALLCACIVLGHLLEENRWMNESITALLIGLGTGVTILLISKGKSSHLLVFSEDLFFIYLLPPIIFNAGFQVKKKQFFRNFVTIMLFGAVGTIISCTIISLGVTQFFKKLDIGTFDLGDYLAIGAIFAATDSVCTLQVLNQDETPLLYSLVFGEGVVNDATSVVVFNAIQSFDLTHLNHEAAFHLLGNFLYLFLLSTLLGAATGLISAYVIKKLYFGRHSTDREVALMMLMAYLSYMLAELFDLSGILTVFFCGIVMSHYTWHNVTESSRITTKHTFATLSFLAETFIFLYVGMDALDIDKWRSVSDTPGTSIAVSSILMGLVMVGRAAFVFPLSFLSNLAKKNQSEKINFNMQVVIWWSGLMRGAVSMALAYNKFTRAGHTDVRGNAIMITSTITVCLFSTVVFGMLTKPLISYLLPHQNATTSMLSDDNTPKSIHIPLLDQDSFIEPSGNHNVPRPDSIRGFLTRPTRTVHYYWRQFDDSFMRPVFGGRGFVPFVPGSPTERNPPDLSKA

SEQ ID NO: 434 - protein, 336 aa, Zea mays
MAEHLLSTAVHDTLPGSYVRPEPERPRLAEVVTGARIPVVDLGSPDRGAVVAAVGDACRSHGFFQVVNHGIHAALVAAVMAAGRGFFRLPPEEKAKLYSDDPARKIRLSTSFNVRKETVHNWRDYLRLHCHPLDEFLPDWPSNPPDFKETMGTYCKEVRELGFRLYAAISESLGLEASYMKEALGEQEQHMAVNFYPPCPEPELTYGLPAHTDPNALTILLMDPDVAGLQVLHAGQWVAVNPQPGALIINIGDQLQALSNGQYRSVWHRAVVNSDRERMSVASFLCPCNHVVLGPARKLVTEDTPAVYRNYTYDKYYAKFWSRNLDQEHCLELFRT

SEQ ID NO: 435 - protein, 316 aa, Zea mays
MMTSWLLGRRGPSGFSWSSTADQVTQGISAAGLTAIVTGASSGIGAETARTLALRGAHVIMAVRSLPAAQAVKDAVLAQAPGAKLDVMELDLSSMASVRAFASQFIDRGLPLNILINNAGVMAIPFALSKDGIEMQFATNHVGHFLLTHLLLDTMKRTSHESNLEGRIVNVSSEGHRLAYREGIRFDKINDESVYSSIGAYGQSKLANILHANELARRFEEDNVNITANSLHPGSIITNLLRYHSILDVLHRTLGKLVLKNAEQGAATTCYLALHPHVKGVSGKYFCDCNLYEPSANAKDMELAKRLWDFGVELIT

SEQ ID NO: 436 - protein, 398 aa, Unknown
  Synechocystis sp. PCC 6803
MPSRPLGRSFTTSFSMNLRYLWSGKQILIGGGLIPLLFGAAVSAQSPSQTNPSNLPDVTPLLAQRSATDDRRQFNELLRQGKAYVDNGNFPQAIAIYQQAAMLDGENAELFGSMGYLYARQGQFAEASRSFQQALRVNPNNPDYYDGLGFSYARQGLLNEAASAYATAISLGPSSRESVKYRLALGIIMLQQGDYNRVRQLYNEIHSLQSDNEEAAVMMGAALLQSSEYEQLITFNNQALRLFPNRSELTLQLGKAYLAQGDLVAARRALEPRLNPDWRSFSLYLTWAELLEREGNFAGALDAYKQALRNEPTAIAAKIGTGRMYLELDNPAEAVWVFRDLTRLQPSNADFYYLLGEAYAVDEKIDLAKKSFGEAKKLYQAQGNTAGSDRTQEKLDNL

SEQ ID NO: 437 - protein, 481 aa, Brassica napus
MEKKSMFIEQSFTDHKSGDMNKNFDDDGRQKRTGTWMTGSAHIITAVIGSGVLSLAWAIAQLGWVAGPAVLMAFSFITYFTSTMLADCYRSPDPVTGKRNYTYMEVVRSYLGGRKVMLCGLAQYGNLIGITIGYTITASISMVAVKRSNCFHKNGHNVKCSTSNTPFMIIFACIQIVLSQIPNFHNLSWLSILAAVMSFSYASIGVGLSIAKVAGGGVHARTALTGVTVGVDVTGSEKVWRTFQAVGDIAFAYAYSTVLIEIQDTLKASPPSENKAMKRASLVGVSTTTFFYMLCGCVGYAAFGNNAPGNFLTGFGFYEPFWLIDFANVCIAVHLVGAYQVFCQPIFQFVESQSAKRWPDNKFITGEYKMNVPCGGDFGISLFRLVWRTSYVVVTAVVAMIFPFFNDFLGLIGAASFWPLTVYFPIEMHIAQKNMKKFSFTWTWLKILSWACFLVSLVAAAGSVQGLIQSLKDFKPFQAPE

SEQ ID NO: 438 - protein, 665 aa, Glycine max
MKSMENDDNADLNNQNNWLGFSLSPQMHNIGVSSHSQPSSAAEVVPTSFYHHTAPLSSYGFYYGLEAENVGLYSALPIMPLKSDGSLYGLETLSRSQAQAMATTSTPKLENFLGGEAMGTPHHYECSATETMPLSLDSVFYIQPSRRDPNNNQTYQNHVQHISTNQQQQQQELQAYYSTLRNHDMILEGSKQSQTSDNNNLHVQNMGGDDAVPVPGLKSWEVRNFQASHAHESKMIVPHVEENAGESGSIGSMAYGDLQSLSLSMSPSSQSSSVTSSHRASPAVVDSVAMDTKKRGPEKVDQKQIVHRKSIDTFGQRTSQYRGVTRHRWTGRYEAHLWDNSCKKEGQSRKGRQVYLGGYDMEEKAARAYDLAALKYWGPSTHINFPLENYQNELEEMKNMTRQEYVAHLRRKSSGFSRGASMYRGVTRHHQHGRWQARIGRVAGNKDLYLGTFSTQEEAAEAYDIAAIKFRGANAVTNFDITRYDVEKIMASSNLLSSELARRNRETDNETQCIDQNHNKPSAYEDTQEAILMHQKSCESENDQWKMVLYQSSQQLEQNPPTIESDRTNQSFAVALDNMFHQEVEESSKARTHVSNPSSLATSLSSSREGSPDRTSLPMLSGMPSTASKLLATNPNNVNSWDPSPHLRPALTLPQMPVFAAWTDA

SEQ ID NO: 439 - protein, 373 aa, Arabidopsis thaliana
MVKSTDGGGGSSSSSSVAPFLRKCYDMVDDSTTDSIISWSPSADNSFVILDTTVFSVQLLPKYFKHSNFSSFIRQLNIYGFRKVDADRWEFANDGFVRGQKDLLKNVIRRKNVQSSEQSKHESTSTTYAQEKSGLWKEVDILKGDKQVLAQELIKVRQYQEVTDTKMLHLEDRVQGMEESQQEMLSFLVMVMKNPSLLVQLLQPKEKNTWRKAGEGAKIVEEVTDEGESNSYGLPLVTYQPPSDNNGTAKSNSNDVNDFLRNADMLKFCLDENHVPLIIPDLYDDGAWEKLLLLSPSRKKTKKQENIVKKGKDDLTLEEEEEDGTMELDKSYMLKLISEEMEKPDDFEFGQLTPERSRNLEILTEQMELLASN

SEQ ID NO: 440 - protein, 426 aa, Saccharomyces cerevisiae
MSHQNQLIPQAYISNFHNRLTNEDDGIPIFTMAQQTRQHKRAKVVNYAEYDNDLFDEFNMNGSNFNNADTHYKDNAVSHENTPALTNGVTMDGSEYNVLENMNGADSIISNNKYDAGSNMVVESLSGLNSNNNASNGPSNKAQAQDIGNAVLPDLQDQHHNPFNILRYPKIRDTFINGKVVSPYRLNTDQETKANANSGEAIMIPITLDIEHMGHTIKDQFLWNYNDDSISPEEFASIYCKDLDMTSATLQTQIANIIKEQLKDLENIAATEIMSDLHVIINLTCNLQDRFFEDNFQWNLNDKSLTPERFATSIVQDLGLTREFIPLISQSLHETILKIKKDWVDGHLIQDHVPNDAAFGYLSGIRLDIDELGSNWCPRVEILTKEEIQKREIEKERNLRRLKRETDRLSRRGRRRLDDLETTMRM

SEQ ID NO: 441 - protein, 587 aa, Saccharomyces cerevisiae
MANRLLIYGLILWVSIIGSFALDRNKTAQNAKIGLHDTTVITTGSTTNVQKEHSSPLSTGSLRTHDFRQASKVDIRQADIRENGERKEQDALTQPATPRNPGDSSNSFLSFDEWKKVKSKEHSSGPERHLSRVREPVDPSCYKEKECIGEELEIDLGFLTNKNEWSEREENQKGFNEEKDIEKVYKKKFNYASLDCAATIVKSNPEAIGATSTLIESKDKYLLNPCSAPQQFIVIELCEDILVEEIEIANYEFFSSTFKRFRVSVSDRIPMVKNEWTILGEFEARNSRELQKFQIHNPQIWASYLKIEILSHYEDEFYCPISLIKVYGKSMMDEFKIDQLKAQEDKEQSIGTNNINNLNEQNIQDRCNNIETRLETPNTSNLSDLAGALSCTSKLIPLKFDEFFKVLNASFCPSKQMISSSSSSAVPVIPEESIFKNIMKRLSQLETNSSLTVSYIEEQSKLLSKSFEQLEMAHEAKFSHLVTIFNETMMSNLDLLNNFANQLKDQSLRILEEQKLENDKFTNRHLLHLERLEKEVSFQRRIVYASFFAFVGLISYLLITRELYFEDFEESKNGAIEKADIVQQAIR

SEQ ID NO: 442 - protein, 544 aa, Sinorhizobium meliloti
MKEAPWFSSSVIYGIDVRRFSDGNGDGIGDFIGLKERVSYLHYLGIDCVWLSPFFRSPFADNGYDVSDYYSIDPVLGTLDDFLDFLHAAGEQGIRVVVDLVANHTSSEHPWFQAARRDARCRFRDYYVWSESPPPVAPDNKTAFPGEESSVWTYDDLAQAYYFHKFRHFQPDLNIANPAVRDELLRVVDYWLTLGVDGFRVDAAPFVIGETGIEHADPRDPQGFLREMRKLVDGRRQDGLLLGEADLAPEKLRSYFGDGKLDLLFNFVLCAAFAASLAGQKADPIGQALSIMPEPPPHRGWANFLRNLDELNLDRLPEDIREETFAAFAPDEEMRIYGRGIRRRLAPMLDGNRARIELAFSLLLSSPGVPLILYGDEIGLGEDLSRPGREPVRVPMQWNAGSNAGFSTAQRAKLVQPPVTDGPFSFKRVNVEAQREDPGSLLNRVRAMILARRRHELFNRGRPVMLHTGDPALFALAYSDGTELFVVLHNLSDGKRRAELELPGAIDARLNDILGEGEVELSGQRLAIGLGPFGYVWLHSGKKD

SEQ ID NO: 443 - protein, 356 aa, Zea mays
MPCVQKVQAASLSVRTRVATTAPVATPGSSTAAKDGKKTVRQGVVVITGASSGLGLAAAKALAETGKWHVVMACRDFLKAAKAAKGAGMADGSYTIMHLDLASLDSVRQFVDSFRRAGMPLDSLVCNAAIYRPTARTPTFTADGYEMSVGVNHLGHFLLARLLLDDMQKSDYPSRRLIILGSITGNTNTLAGNIPPKAGLGDLRGLAAGLRGQNGSAMIDGSESFDGAKAYKDSKICNMLTMQELHRRYHEETGITFASLYPGCIATTGLFREHIPLFRLLFPPFQKFVTKGFVSEAESGKRLAQVVSDPSLTKSGVYWSWNKDSASFENQLSQEASDPEKAKKLWEISEKLVGLA

SEQ ID NO: 444 - protein, 426 aa, Zea mays
MAPEPEDDIMNEKNPRPLDEDDIALLKTYGLGPYSTSIKKVEKEIKEMAKKINDLCGIKESDTGLAPPSQWDLVSDKQMMQEEQPLQVARCTKIISPNTDDAKYVINVKQIAKFVVGLGDKVSPTDIEEGMRVGVDRNKYQIQIPLPPKIDPSVTMMTVEEKPDVTYNDVGGCKEQIEKMREVVELPMLHPEKFVKLGIDPPKGVLCYGPPGTGKTLLARAVANRTDACFIRVIGSELVQKYVGEGARMVRELFQMARSKKACIVFFDEVDAIGGARFDDGVGGDNEVQRTMLEIVNQLDGFDARGNIKVLMATNRPDTLDPALLRPGRLDRKVEFGLPDLEGRTQIFKIHTRTMNCERDIRFELLARLCPNSTGADIRSVCTEAGMYAIRARRKTVTEKDFLDAVNKVIKGYQKFSATPKYMVYN

SEQ ID NO: 445 - protein, 505 aa, Oryza sativa
MEAFVPGGAGAAAAAVGGFVAAAALAERAGVIAPRKRPNAPPAVPGLPIIGNLHQLKEKKPHQTFAKWAEIYGPIYTIRTGASSVVVLNSTEVAKEAMVAKFSSISTRKLSKALTVLTRDKSMVATSDYCDFHKMVKRYVMSSMLGTSAQKQFRDIRDMMIHNMLSTFHKLVKDDPHAPLIFRDVFKDELFRLSMIQSLGEDVSSVYVDEFGRDISKEEIYNATVTDMMMCAIEVDWRDFFPYLSWVPNKSFETRVFTTETRRTAVMRALIKQQKERIVRGEAKTCYLDFLLAENTLTDEQLMMLVWEALIEAADTTLVTTEWAMYELAKNPDKQERLYQEIREVCGDETVTEEHLPRLPYLNAVFHETLRRHSPVPLIPPRFVHEDTKLAGYDVPAGTEMVINLYGCNMNRKEWESPEEWVPERFAGGRLEVADMYKTMAFGAGRRACAGSLQATHIACAAVARFVQEFGWRLREGDEEKVDTVQLTAYKLHPLHVHLTRRGRM

SEQ ID NO: 446 - protein, 137 aa, Arabidopsis thaliana
MADSTKAGLKKPAFTKVDQLRPGTSGHNVNVKIVSTKMVLQKGRADGPQARQLRISECIVGDETGVIVFTARNDQVDLMKEGSTVTLRNAKIDMYKGSMRLAVDKWGRVEVTEPASFKVKEDTNMSLIEYELVNVVE

SEQ ID NO: 447 - protein, 157 aa, Arabidopsis thaliana
MEKVVDLFGVGEANSQKLLEGGKDLSEIQQGLFIGSVAEANNKDFLKSSNITHVLTVAVALAPPYPDDFVYKVIEVYFDECYSFIDQAIQSGGGVLVHCFMGMSRSVTIVVAYLMKKHGMGFSKAMELVRSRRHQAYPNPGFISQLQQFEKSIQGNA

SEQ ID NO: 448 - protein, 327 aa, Arabidopsis thaliana
METDSMECVSSTGNEIHQNGNGHQSYQFSSTKTHGGAAAAAVVTNIVGPTATAPATSVYELLECPVCTYSMYPPIHQCHNGHTLCSTCKVRVHNRCPTCRQELGDIRCLALEKVAESLELPCKFYNLGCPEIFPYYSKLKHESLCNFRPYSCPYAGSECGIVGDIPFLVAHLRDDHKVDMHAGSTFNHRYVKSNPREVENATWMLTVFHCFGQYFCLHFEAFQLGMGPVYMAFLRFMGDEEDARSYSYSLEVGGSGRKLTWEGTPRSIRDSHRKVRDSNDGLIIQRNMALFFSGGDRKELKLRVTGKIWKEQHSPDSGLSIPNLSSS

SEQ ID NO: 449 - protein, 280 aa, Arabidopsis thaliana
MASTFRLSISFLTLILFSLWVVEAHTSRKLISIKEKEGQDISHLLKDGEFDDPSLYMYFTLNDLKLGTKLLIYFYKNDLQKLPPLLTRQQADLIPFTKSKLDFLLDHFSITKDSPQGKAIKETLGHCDAKAIEGEHKFCGTSLESLIDLVKKTMGYNVDLKVMTTKVMVPAQNSISYALHNYTFVEAPKELVGIKMLGCHRMPYPYAVYYCHGHKGGSRVFEVNLVTDDGRQRVVGPAVCHMDTSTWDADHVAFKVLKMEPRSAPVCHFFPLDNIVWVTK

SEQ ID NO: 450 - protein, 327 aa, Cucurbita ficifolia
MSAEHIVGSAADAAAKKPEIENGVSASQPDSISSVIPGWFSEISPMWPGEAHSLKVEKVLFQGKSDYQNVLVFQSSTYGKVLVLDGVIQLTERDECAYQEMITHLPLCSIPNPKKVLVIGGGDGGVLREVARHSSVEQIDICEIDKMVVDVSKEFFPRVAVGFEDPRVTLHIGDGVAFLKAVPEGTYDAVIVDSSDPIGPAQELFEKPFFASVAKALRPGGVVCTQAESIWLHMHIIEDIVTNCRQIFKGSVNYAWTTVPTYPSGVIGFMLCSTEGPPLDFKHPVNPVEVNGIDTVKSPLKFYNSEIHTAAFCLPSFAKKIIDSKAK

SEQ ID NO: 451 - protein, 327 aa, Cucurbita ficifolia; identical to SEQ ID NO: 450

SEQ ID NO: 452 - protein, 180 aa, Brassica napus
MEKVVDLFGVGEANTQKLLEGGNDLSQIQQGLFIGSVAEANNKDLLKASNVTHVLTIAVALSPPYPDDFVYKVIEVVDRSETDLTVYFDECYSFIDQAIESGGGVLVHCFMGISRSVTIVVAYLMRKHGIGFSKAMEIVKSRRPQALPNFGFVSQLQQFEKSIKVHDEASSSVDNKEIVA

SEQ ID NO: 453 - protein, 387 aa, Arabidopsis thaliana
MDAEKKSAHFRQISSYKPQLLVLSSIQENPSSKISEKANIKADNDAEIGVFGAEKYFSMKLDHVDSTADITKQHEKENTHDHPNANPNPNPNPHPHPHPQLTKTTSSRSKTSRHGTPSVRSESSCNSQTFLMRINNHNENKQRKMNDTSISFGGFRCYGPCSGVKTVHTDPKNSCKSRNSDRDFVAYDARKHNDKPRLHFEAKKADFHAQEKISLPIQRSDIAMNLERKLSLLTWDAIPNQLSTKNNNHNNNGNNSSMSSNTQEEETASVASSDLFEIENITSSVYEPSEASIGWSVVTGSMADQSVISDFDMMKRVTRNGPVVKTKPVIGEKVRSAGFLSGCKSHKAVSVVDSSRKVKETAKVDHHEMSHQKKFKTEIRIQDLSFL

SEQ ID NO: 454 - protein, 253 aa, Arabidopsis thaliana
MASSAVSLQSISMTTLNNLSCNQQFHRSSLLGSSKSFQNLGISSNGSDFSYPSSFTAKKNLTASRALSQNGNIENPRPSKVQELSVYEINELDRHSPKILKNAFSLMFGLGDLVPFTNKLYTGDLKKRVGITAGLCVVIEHVPEKKGERFEATYSFYFGDYGHLSVQGPYLTYEDSFLAITGGAGIFEGAYGQVKLQQLVYPTKLFYTFYLKGLANDLPLELTGTPVPPSKDIEPAPEAKALEPSGVISNYTN

SEQ ID NO: 455 - protein, 226 aa, Arabidopsis thaliana
MSQCVDGIKHLCTSVLGCFDLDLYKQSGGLGDPELLARDTVFSVSEIEALYELFKKISSAVIDDGLINKEEFQLALFKTNKKESLFADRVFDLFDTKHNGILGFEEFAHALSVFHPNAPIDDKIHFSFQLYDLKQQGFIERQEVKQMVVATLAESGMNLKDTVIEDIIDKTFEEADTKHDGKIDKEEWRSLVLRHPSLLKNMTLQYLKDITTTFPSFVFHSQVEDT

SEQ ID NO: 456 - protein, 463 aa, Zea mays
MSGVGSGRPPAAQKILQSLRPPLSFATPSRSPFAAPDDYHRFPTPAAATAPAATSGGVGAGAPPRDTIEEGLFIRTPLKRKATSEENDAAAEPSDCIITSPMPTSVSGKTVKASKAKAKNSKTGPQTPTSNVGSPLNPPTPVGTCRYDSSLGLLTKKFINLLKQAPDGILDLNNAAETLEVQKRRIYDITNVLEGIGLIEKTLKNRIRWKALDDSSVQLDNGISALQAEVENLSLQEQALDERISDMREKLRGLTEDENNKRWLYVTEDDIKGLPSFQNETLIAIKAPHGTTLEVPDPDEAGDYLQRRYRIVLRSTMGPIDVYLVSQFDEKFEELGGVATPVKHSSVPRHQPAEDFNTYAGQSSTPMDVAHDVQHGQKIPQDPSALHDFGGMTRISPSDVHTDSDYWLLTEGDVSMTDMWKTGQEVQWDQMDFLSEDVVTPRAHNQQPVTVDGPHMEVPSMDP

SEQ ID NO: 457 - protein, 175 aa, Arabidopsis thaliana
MQSLQDKASVLSGVDQAEAFAIDESNLFDKLGLQTFINLSTNFYTRVYDDEEEWFQSIFSNSNKEDAIQNQYEFFVQRMGGPPLYSQRKGHPALIGRHRPFPVTHQAAERWLEHMQNALDDSVDIDQDSKIKMMKFFRHTAFFLVAGNELKNQNEKPKHKPQCACKHAANKPAEE

SEQ ID NO: 458 - protein, 519 aa, Oryza sativa
MQFSSVFPLEGKACVSPIRRGGEGSASDRLKIGDSSSIKHDRAVRRMCLGYRGTKNGAQCVLTSDAGPDTLHVRTSFRRNFADPNEVAAVILGGGTGTQLFPLTSTRATPAVPIGGCYRLIDIPMSNCFNSGINKIFIMTQFNSASLNRHIHRTYLGGGINFTDGSVEVLAATQMPGEAAGWFQGTADAVRKFIWVLEDYYKHKAIEHILILSGDQLYRMDYMELVQKHVDDNADITLSCAPVGESRASDYGLVKFDSSGRVIQFSEKPKGTDLEAMKVDTSFLNFAIDDPTKFPYIASMGVYVFKRDVLLNLLKSRYAELHDFGSEILPRALHEHNVQAYVFADYWEDIGTIRSFFDANMALCEQPPKFEFYDPKTPFFTSPRYLPPTKSDKCRIKDAIISHGCFLRECTIEHSIVGVRSRLNSACELKNTMMMGADLYETEDEISRLLSEGKVPIGVGENTKINNCIIDMNARVGRNVVITNSEGVQESDRPEEGYYIRSGIVVILKNATIKDGKVI

SEQ ID NO: 459 - protein, 304 aa, Zea mays
AVFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGQ

SEQ ID NO: 460 - protein, 192 aa, Zea mays
MSSAPLQIAPVPEHVCYVHCNFCNTILAVSVPSHSMLNIVTVRCGHCTSLLSVNLRGLIQSLPVQNHHYSQQQENFTVQNMGFTENYPEYAPSYRMPTTLSAKGDLDHMLHVRAPEKRQRVPSAYNRFIKEEIRRIKACNPDISHREAFSTAAKNWAHFPNIHFGLGPCESSNNLDEATGAMCHPQKVQDLY

SEQ ID NO: 461 - protein, 840 aa, Zea mays
MAAAVALRGGSSDSGGFDKVPGMDSGKYVRYTPEQVEVLERLYIDCPKPSSSRRQQLLRECPILSNIEPKQIKVWFQNRRCRDKQRKESSRLQAVNRKLTAMNKLLMEENERLQKQVSQLVHENAHMRQQLQNTSLANDTSCESNVTTPPNPIRDASNPSGLLAIAEETFTEFLSKATGTAIDWVQMPGMKPGPDSVGIVAISHGCRGVAARACGLVNLEPTKGIEILKDRPSWFRDCRSLEVFTRFPAGNGGTIELIYMQMYAPTTLVPARDFWTLRYTTTMEDGSLVVCERSLSGSGGGPNAASTQQFVRAEMLPSGYLVRPCEGGGSVVHIVDHLDLEAWSVPEVLRPLYESSRVVAQKMTTVALRHLRQIAQETSGEVVYALGRQPAVLRTFSQRLSRGFNDAISGFNDDGWSVMGGDGIEDVVIACNSTKKIRNTSNAGITFGAPGGIICAKASMLLQSVPPAVLVRFLREHRSEWADYNIDAYLASSLKTSACSLPGLRPMRFSEGQMIMPLAHTVENEEILEVVRLEGQPLTHDEALLSRDIHLLQLCTGIDEKSVGSSFQLVFAPIDEHFPDDAPLISSGFRVIPLDVKTDGVSSGRTLDLASSLDVGSAAPQASGDASPDDCNLRSVLTIAFQFPYEMHLQDSVAAMARQYVRSVISAVQRVSMAISPSQSGLNAGHRMLSGFPEAATLARWVCQSYHYHLGMELLNQSDGAGEALLKMLWHHPDAVLCCSFKEKPMFTFANKAGLDMLETSLVALQDLTLDKIFDESGRKALFSDISKLMEQGYAYLPSGVCMSGMGRHVSFDQAVAWKVLGEDSNIHCLAFCFVNWSFV

SEQ ID NO: 462 - protein, 526 aa, Zea mays
MVGGGEGDRVGGGVGVGGGQQFVDRSKVRILLCDGDASSSREVLRLLCNCSYHVTCAKSPRQVINILNYEGGEIDIILAEVDLPVSKCFKMLKYIARNKDLRHIPIISRQPSYSEPLMSNRDEVSVVVKCLRLGAAEYLVKPLRTNELLNLWTHVWRRRRMLGLPEKNFFNDNFELVLSEPSDANTNSATLLSDETDDRPKENTNQETGTSNQLEYESNPSVAERDQRDKIGAPGSALDASQSSTPGRMFSRPIKTNLKVAESSAFLAYVKSSTPATSSFDSGLQRGDSRLDSLDNHGNCSSATDRSDTGTDVNIRNKEAFEMPVQYPMVCFSSSSMHMERSNEGHNDTSGTPPAYHFPFYYPGMVEHNMALSSVQNFQANINSAQAHTPPAMLHQYNVFSQCHSLPMISPFQFNTSGMSMHSSHLPTQNVWSSASSTPTPDETCNRSERRAAALAKFRQKRKERCFDKKVRYVNRKKLAETRLRVRGQFVRHASNMDIISTGDDISEDEDDDPTSREVDMISSPE

SEQ ID NO: 463 - protein, 499 aa, Arabidopsis thaliana
MEKQSIRNTCSSSLMLSSPSSFWVRGACIGRGCFGAVSTAISKTNGEVFAVKSVDLATSLPTQSESLENEISVFRSLKPHPYIVKFLGDGVSKEGTTTFRNLYLEYLPNGDVASHRAGGKIEDETLLQRYTACLVSALRHVHSQGFVHCDVKARNILVSQSSMVKLADFGSAFRIHTPRALITPRGSPLWMAPEVIRREYQGPESDVWSLGCTIIEMFTGKPAWEDHGIDSLSRISFSDELPVFPSKLSEIGRDFLEKCLKRDPNQRWSCDQLLQHPFLSQCHNSSPTESSPRCVLDWVNSGFDLEEEEEEVGRSEFEDAAKAIICNLATTGGVIWESDGWVEVRCHASEEEGTTMEYSGSTRVESEYNTSSDPNDDVAGDSAIIDVSMSQNLPPGNGGSAAALPYEFVVVLHLLMEIMVYTTCIFREIVLTMYLLYQYNQSNKLETLSFNHSLKFCLFAHVIRIGQNYLLRGEMRSSVLITSHCLILITLVYSQIVVF

SEQ ID NO: 464 - protein, 452 aa, Arabidopsis thaliana
MASGVFEDEAEGTITINEYIERLDAEELAADLVLGGDEGDECTFPKGYMKRQAIFSCITCTPEGNAGICTACCLSCHDGHELLELWTKRNFRCDCGNSKFGTLACKLLPSKDIENSENSYNHNFKGLYCTCDRPYPDPNVEEQVEMIQCCLCEDWFHEEHLGLTPSDSVGSQIPRDEESEPIYEDFICQNCSPACSFLTLYPENLWVVAKVDSTGSANACSETIELDKNHMDSEPGQPENGTDAEKSVVGKCSETISDSEPGQPENGTEAEKSVVQKCSEKIDESEAGQPENSTEAEKFVVRKCSEKIDGSENVPAAGCVIRTDLNSCPEFEKKPLFLTKNWRNILCRCEKCLEMYKQRKVSYLLDAEDTIVEYEKKAKEKRTEKLEKQEGEALDLLNNLDHVSKVELLHGIKDFQDGLQGLMESAGPSKAITSADIEQMFSKLKNKRKRME

SEQ ID NO: 465 - protein, 516 aa, Zea mays
MGFTEEFLRQMEPRMQQAFVDMRELEKGAIANPDEGRMVGHYWLRDPALAPNSFLRNKIETALDKILAFSQDVISGKILSPSGRFTSILSIGIGGSALGPQFVAEALAPDNPPLKIRFIDNTDPAGIDHQIAQLGPELATTLVIVISKSGGTPETRNGLLEVQKAFRDAGLQFSKQGVAITQENSLLDNTARIEGWLARFPMFDWVGGRTSEMSAVGLLPAALQGIDIKEMLVGAALMDEETRNTVVKANPAALLALCWYWASEGIGKKDMVVLPYKDSLLLLSRYLQQLVMESLGKEFDLDGNRVNQGLTVYGNKGSTDQHAYIQQLREGVHNFFVTFIEVLRDRPAGHDWELEPGVTCGDYLFGMLQGTRSALYANDRESISVTVQEVTPRAVGALIALYERAVGIYASLVNINAYHQPGVEAGKKAAGEVLALQKRVLTVLKEAICENPTEPLTLDEIADRCHCPEDIEMIYKIIQHMAANDRALIAEGSCGSPRSVKVYLGECSVDEDMQAA

SEQ ID NO: 466 - protein, 370 aa, Zea mays
MSTVFMTQLPRTLRLMEGEQDQGLFPASTFHVAKDPPILFPFMITSPVHVDQLQGQSSYGDQHLGQHVLSESTQQFTDRTMISGSEVFPRRPSPFGQTIQSIDGDMIQPSAYDPYDIVENQRTEGLSGGGWTVSSSSSSPPAKMKIMRKATSEYPEGGAARKPRRRAQAHQDESQLLTMQQQAMGVVVRVCSDCNTTKTPLWRSGPRGPKSLCNACGIRQRKARRAMVAAAAAAAASNGGAPPQAVSGVATQQQPKPKPARKEKRSDAADRSLPFKKRCKMVVVDHAAGAAAATATPEAAAARSTKDQADHVSGDKQVVAPAAAMRSLDQSEIATPPPSAVSSFHAAFPADEITDAAMLLMTLSCGLVRS

SEQ ID NO: 467 - protein, 154 aa, Oryza sativa
MAASSSLDLVKTMAASGFLLRCPAAPSAVPLWGRSGRGGGGGLAFSASSSNGAAVPSSLSDSEKKGPVVMEIPLDKIRRPLMRTRANDPAKVQELMDSIRVIGLQVPIDVLEVDGVYYGFSGCHRYEAHQRLGLPTIRCKVRRGTKETLRHHMR

SEQ ID NO: 468 - protein, 127 aa, Saccharomyces cerevisiae
MSLQSNSVKPTEIPLSEIRRPLAPVLDPQKIDAMVATMKGIPTASKTCSLEQAEAAASAGELPPVDVLGVRVKGQTLYYAFGGCHRLQAYDRRARETQNAAFPVRCRVLPATPRQIRMYLGSSLDIE

SEQ ID NO: 469 - protein, 475 aa, Agrobacterium tumefaciens
MERLAKLPVFWGLEGKRVVLTGGSDGAAWKAELLLACGAQLDLYCEESGLSESLATLVAKSPMLTWHDRCWDADIFKGAELALADCEAEEEAGRFYHAARAAGVPVNVIDKPEFCQFQFGSIVNRSPVVVSISTDGAAPILAQAIRRRIETLLPLSLKDWGALAQTIRERVNLRLAPGAARRSFWEKFVDRAFTERLDEGSEERLLKDVATRTGLAESGRGFVTLVGAGPGDAELLTLKAVRALQAADVILFDDLVSAEVLELARREAKRMLVGKRGGRESCKQEDINDMMIRFAKAGRRVVRLKSGDPMIFGRAGEEIAALEAENIPVEVVPGITAASAMASRLGVSLTHRDHAQSVRFVTGHSRQGKLPENIDWQSLSNPSVTTVFYMGGRTAADIQSCLLAHGMPASTPVVVMISVSRVNEQRWCGSLAQLVAAVERLGVNEPVLIGVGDAFRSASVNGGEQTAAAPFQKAG

SEQ ID NO: 470 - protein, 889 aa, Oryza sativa
MAASVEYKLAPHPWASNAPSSNLDLFPSGGGKRRSGSETDSDDEDSIPPDWRSLYHPRLEVAEPAVKDPRDEATSDAWVRRHPALVRLTGKHPFNSEPPLPRLMSHGFITPAPLHYVRNHGAVPKADWSTWAVEVTGLVKRPARLNMEQLVTGFEAVELPVTLVCAGNRRKEQNMVRQTVGFNWGPGAISTSVWRGVRLRDVLRWCGVMGASAGAANVCFEGAEDLPGGGGCKYGTSLRREVAMDPAHDVILAYMQNGEPLTPDHGFPVRVIVPGFIGGRMVKWLKRIIVASSESESYYHYRDNRVLPSHVDAELANAEAWWYKPEYMINELNINSVITTPGHDEVLPINALTTQRPYTMKGYAYSGGGRKVTRVEVTLDGGETWQVCNLDHPERPTKYGKYWCWCFWSVDVEVLELLAAKEIAVRAWDESLNTQPEKLIWNLMGMMNNCWFRVKTKTCRPHKGEIGLVFEHPTQPGNQAGGWMARQKHLETSESAVSTLKRSTSTPFLNTATTQYTMSEVRRHTTPESAWIIVHGHVYDCTGFLKDHPGGADSIMINAGTDCTEEFDAIHSDKARGLLEMYRIGELIVTGSDYSPQSSSADLTSIVESPTAAAAPAVPVSTVALSNPREKVKCRLMDKKSLSYNVRLFRFALPSPDQKLGLPVGKHVYVCASIGGKLCMRAYTPTSSVDEVGYIELLIKIYFKGEDPKFPDGGLMSQYLDYLPLGATIDIKGPIGHIEYAGRGAFTVNGERRFARRLAMVAGGTGITPVYQVIQAVLWDQPDDGTEMHVVYANRTEDDMLLREEIDRWAAAHPARLKVWYVVSKVARPEDGWEYGVGRVDERTLREHLPPGDGETLALVCGPPAMVECTVRPGPEKMGYDLDKSCLVF

SEQ ID NO: 471 - protein, 270 aa, Arabidopsis thaliana
MELSSASAILSHSSSAAQLLRPKLGFIDLLPRRAMIVSSPSSSLPRFLRMESQSQLRQSISCSASSSSSMALGRIGEVKRVTKETNVSVKINLDGTGVADSSSGIPFLDHMLDQLASHGLFDVHVRATGDVHIDDHHTNEDIALAIGTALLKALGERKGINRFGDFTAPLDEALIHVSLDLSGRPYLGYNLEIPTQRVGTYDTQLVEHFFQSLVNTSGMTLHIRQLAGENSHHIIEATFKAFARALRQATETDPRRGGTIPSSKGVLSRS

SEQ ID NO: 472 - protein, 313 aa, Arabidopsis thaliana
MGNCLSASTLPTEPNAPKSVEEGVKVFTVADLKKATNDFGNQMELGESLGYINPKTLSPAKKGVGMAVAVKKIYLANEQAFQDWLVDVEFLRHNSHPSLVKLIGYCYDRDMLFIVSEYFPNGSLGSYISRDSRPKSLPWETRLKISIGAAQCLAFLHSRKQAGLYRRYLTASKILLDSDFNARVSYFGKPKVSLDELVYTIGFSNVAPRYQYPPPEYILSGMSNMAGDVYSFGVILLKMLTGLGKDLTISAKREIKNKKYNIVEMIDPDLKNSYPLEAGRLMCELIKQCLEVDPKMRPTMQEVLDNLNAIAQI

SEQ ID NO: 473 - protein, 340 aa, Oryza sativa
MGANGNDVVAAAAAGESPMGAARVVAEGGATVFRGADYSLPRTTVALALWLGGIHFNVFLVLASLFLSPLRVAAMVVAFQLLFMLIPLNDKDKLGRKIARFICRYAMGYFPISLHVEDYKCFDPNRAYVFGFEPHSVLPIGVAALADLVGFMPLPKIKVLASSAVFYTPFLRQIWTWLGLIPATRKNFQSYLGAGYSCIIVPGGVQEILHMDHDSEIAFLKSRKGFVKIAMQSGCPLVPVFCFGQSYAYKWWRPKGKLFVKIARAIKFTPIVFWGRYGTPIPFPTPMHVVVGRPIEVEKNSQPTIDEINEVHEQFTVALQDLFDKYKTETGYPGLHLRVL

SEQ ID NO: 474 - protein, 335 aa, Saccharomyces cerevisiae
MHSHHSHSGDYSAHGTDPLDSVVDQVVNLNFHTYCLTEHIPRIEAKFIYPEEQSLGKNPEEVITKLETSFKNFMSHAQEIKTRYADRPDVRTKFIIGMEIESCDMAHIEYAKRLMKENNDILKFCVGSVHHVNGIPIDFDQQQWYNSLHSFNDNLKHFLLSYFQSQYEMLINIKPLVVGHFDLYKLFLPNDMLVNQKSGNCNEETGVPVASLDVISEWPEIYDAVVRNLQFIDSYGGAIEINTSALRKRLEEPYPSKTLCNLVKKHCGSRFVLSDDAHGVAQVGVCYDKVKKYIVDVLQLEYICYLEESQSPENLLTVKRLPISQFVNDPFWANI

SEQ ID NO: 475 - protein, 128 aa, Glycine max
MANFVLQFSNTLRSFAVSASSNSNGAPPGGSGSSSGGGGGPVILELPLDKIRRPLMRTRANDQNKVLELMDSIKEIGLQVPIDVLEVDGVYYGFSGCHRYEAHQRLGLPTIRCKIRRGTKETVRHHLR

SEQ ID NO: 476 - protein, 396 aa, Oryza sativa
MSNPESNPPPPSATSCPPPGSAAHAGHAPLCRSCGAPTTTPVPPPWSASSDSPPPAYRPIRMPAINAPTNTAAIVLSPVPQPLPVPPASPPFAFQVPAKRITSPDDIARFHASVHGRHFLGFVAALSASVHGRKLSDPLPSPPSPVVSALLELISALSAFVASTPPLPHNSRYGNPAFRLWHEKLSDSANQLIAPIMATAGSPDLAGAEAELAPYLLDSFGNATRIDYGTGHETNFAAFLYCLARLGLITEADYPAVVLRVFAAYLDLMRTLQDTYLLEPAGSHGVWGLDDYHFLPFIFGAAQLIDHKYMKPKSIHNPDILDNFSKEYMYLACVAYVKKVKKGPFAEHSPMLDDISGVPHWKKVNSGLLKMYKAEVLEKVPIMQHFLFGSLIKWED

SEQ ID NO: 477 - protein, 281 aa, Saccharomyces cerevisiae [sequence omitted]

SEQ ID NO: 478 - protein, 809 aa, Arabidopsis thaliana
METSSIEINELPLATKTQTPPASVEPIPMETSSIDELPSSDSNATDNIEAVGEKRKRADEDEKTNLESSDTKITTPSPWWKTSLCSYFRREASCSHGNECKYAHGEAELRMKPDNTWDPTSERGKKAKAMKMSEHEEKEEDEVLFTEQMMESIDGDEGGGGSVSVVDLSLSKCLVHLPNKWQSDELKKFLGEQGVLYKSAKKRRGMIVGFVTFENAEQLQSGVEILDGKTVNSSNLKIADVLPRTFDKNDARKSVKSARDAVTPLAYLSYADQLEQKKTSIGQMLKKLARNARKACPNGNSLPQWVLTSRDRGGLACNLEGIIESPITNGYRNKCEFSVGLSLQGKPTVGFSLGSFCAGVTAVEEPVDCPNVSKIASQYASIFQKFIENSKFQVWNRFQHSGFWRQLTVREGRKPGVFSNDEDAITRIAEVMLMVQVCLTGSDEAEVATEFEELAKAFAEGARASSPTLPLTVLVVQNHSGISNVAPPDAPLQVLAIPISDNGTDQEQTTNVLTEARIHDHINNLRFSISPTAFFQVNTVTAEKLYSIAGDWADLGPDTLLFDVCCGTGTIGLTLAHRVGMVIGIEMNASAVADAERNATINGISNCKFICSKAEDVMSSLLKQYLDVTQMEEAKPLSNANDDLNKQIPSTEEMTNSEHVADQNLPPSNTQVEELQDNEQKDSSSLEPEKTTKPQFKNVVAIVDPPRSGLHPAVIKALRTHPRLKRLVYISCNPETLVANAIELCTPSFDEPDRGNKNYRGRKKIGIAALARHRAKSMPTSEAFRPVKAMAVDLFPHTDHCEMVMLLER

SEQ ID NO: 479 - protein, 111 aa, Zea mays
MAAARGARLRAQATHNVKLITPDGEVQLKMPGDVYILDHAEERGLDLPYSCRAGACSSCVGKIVSGSVNQFDQSFLDDDQVAEGFVLTCIAYPTSDLVIQTHKEDALVESY

SEQ ID NO: 480 - protein, 506 aa, Zea mays
MAKGGAVVGTAVVVCAAAAAAVGVAVVLSRRRSRRREAEDERKRKAAAVIEEVEQRLSTPTALLRGIADAMVEEMERGLRAEPHAPLKMLISYVDNLPTGDEHGLFYALDLGGTNFRVIRVQLGGRDRRVVKQQYEEVSIPPHLMVGTSTELFDFIAAELEKFVRTEGEDFHLPDSKQRELGFTFSFPVHQTSISSGTLIKWTKGFCINGTVGEDVVAELSRAMERQGLDMKVAALVNDTVGTLAGGRYADNDVVAAVILGTGTNAAYVEHANVIPKWTGLLPRSGNMVINMEWGNFRSDKLPRSEYDKSLDFESLNPGEQIYEKMISGMYLGEIVRRILLKLAHDASLFGDVVPPKLEQLFILRTPDMSAMHHDTSHDLKHLGAKLKDILGVPDTSLEARYITLHVCDLVAERGARLAAAGIYGILKKLGKDKLLGDFSQQRTVVAIDGGLYEHYKKFSACLEATLTDLLGEEVASSVVVKLANDGSGIGAALLAASHSQYAEAA

SEQ ID NO: 481 - protein, 516 aa, Zea mays
MANPLAGLQDHLKLARDYALEGLYDTSIIFFDGAIAQINKHLTTLDDALIRTKWMNCKKAISEEVEIVKQLDAQLKSLKEAPGTRRSSSPPIRSNKSFVFQPLDEYPTSSPAPFDDPDVWAPPRDTPTRRPTRGQSSARKSSQDGAWARGSSRTGTPSRSAKPNGIKGGAVKSTASNSSVRKGKQSSNKADSTSSDAEEGKSKKGQYEGPDMDLAAMLERDVLDSTPGVRWDDVAGLSEAKRLLEEAVVLPLWMPEYFQGIRRPWKGVLMFGPPGTGKTLLAKAVATECGTTFFNVSSATLASKWRGESERMVRCLFDLARAYAPSTIFIDEIDSLCTSRGASGEHESSRRVKSELLVQIDGVNNSSTTDDGQPKIVMVLAATNFPWDIDEALRRRLEKRIYIPLPDFESRKALININLRTVQIAADVNIDEVARRTEGYSGDDLTNVCRDASMNGMRRKIAGKTRDEIKNMSKDEIAKDPVAMCDFVEALVKVQKSVSPSDIEKHEKWMAEFGSA

SEQ ID NO: 482 - protein, 423 aa, Zea mays
MAQAVVPAMQCRVGVKAAAGRVWSAGRTRTGRGGASPGFKVMAVSTGSTGVVPRLEQLLNMDTTPYTDKVIAEYIWVGGSGIDIRSKSRTISKPVEDPSELPKWNYDGSSTGQAPGEDSEVILYPQAIFKDPFRGGNNVLVICDTYTPQGEPLPTNKRHRAAQIFSDPKVAEQVPWFGIEQEYTLLQKDVNWPLGWPVGGFPGPQGPYYCAVGADKSFGRDISDAHYKACLYAGINISGTNGEVMPGQWEYQVGPSVGIEAGDHIWISRYILERITEQAGVVLTLDPKPIQGDWNGAGAHTNYSTKTMREDGGFEEIKRAILNLSLRHDLHISAYGEGNERRLTGKHETASIGTFSWGVANRGASIRVGRDTEAKGKGYLEDRRPASNMDPYIVTGLLAETTILWQPSLEAEALAAKKLALKV

SEQ ID NO: 483 - protein, 423 aa, Zea mays; identical to SEQ ID NO: 482

SEQ ID NO: 484 - protein, 460 aa, Arabidopsis thaliana
MESDLGKLFIGGISWDTDEERLRDYFSNYGDVVEAVIMRDRATGRARGFGFIVFADPCVSERVIMDKHIIDGRTVEAKKAVPRDDQQVLKRHASPIHLMSPVHGGGGRTKKIFVGGLPSSITEEEFKNYFDQFGTIADVVVMYDHNTQRPRGFGFITFDSDDAVDRVLHKTFHELNGKLVEVKRAVPKEISPVSNIRSPLASGVNYGGGSNRMPANSYFNNFAPGPGFYNSLGPVGRRFSPVIGSGRNAVSAFGLGLNHDLSLNLNPSCDGTSSTFGYNRIPSNPYFNGASPNRYTSPIGHNRTESPYNSNNRDLWGNRTDTAGPGWNLNVSNGNNRGNWGLPSSSAVSNDNNGFGRNYGTSSGLSSSPFNGFEGSIGELYRGGSVYSDSTWQQQQLPSQSSHELDNLSRAYGYDIDNVGSDPSANDPETYNGSYNVGNRQTNRGNKKIHLNKTCNLDTF

SEQ ID NO: 485 - protein, 572 aa, Nostoc punctiforme
MVAIAENVQHRLTIQTVEIAPNTTAIRSLDWDRDRFDIEFGLQNGTTYNSYLIRGEQTVLIDTSHQKFRDLYLETLKGLVNPKTIDYIIVSHTEPDHSGLVEDVLQLAPRATVLASKVALQFLEGLVHDPFSKRVVKTGDRIDIGKGHEMEFVSAPNLHWPDTIFSFDRKTQILYTCDAFGMHFCDDRTFDEDLEAIEADFRFYYDCLMGPNARSLLNAMKRMGDLGKINIIANGHGPLLYHHLDVLTGCYENWSQRQAKAETTVGLFFVSDYGYGERLGHAIAEGILKTGVGVEVLDLSTAESQEIQELAGRAAGIIIGMPPSTAAAAQASISSVLAVAKNKQFVGLFECYGGDDEPIDTLRRKFIDSGIKEAFPAIRIREAPTASTFQLCEEAGKDLGQLLVRDRNIKQIKSLDVNMEKALGRISSGLYIVTTKKDNASSAMLASWVTQASLQPLGLTIAVAKDRAIDSLMQVGDRFVLNVLEEGNYQELKKHFLKRLHPGADRFAGVKTQTAKNGSPILTDALAYMECEIQSSMECSDHWILYCTVQEGRVSKNDGLTAVRHRKVGNYY

SEQ ID NO: 486 - protein, 520 aa, Zea mays
MAEGEFKPAAMQVEAPAEAAAAPSKPRFRMPVDSDNKATEFWLFSFARPHMSAFHMSWFSFFCCFLSTFAAPPLLPLIRDTLGLTATDIGNAGIASVSGAVFARVAMGTACDLVGPRLASAAIILLTTPAVYYSAVIDSASSYLLVRFFTGFSLASFVSTQFWMSSMFSPPKVGLANGVAGGWGNLGGGAVQLIMPLVFEAIRKAGATPFTAWRVAFFVPGLLQTLSAVAVLAFGQDMPDGNYRKLHRSGDMHKDSFGNVLRHAVTNYRAWILALTYGYCFGVELAVDNIVAQYFYDRFGVKLSTAGFIAASFGMANIVSRPGGGLLSDWLSSRFGMRGRLWGLWVVQTIGGVLCVVLGAVDYSFAASVAVMILFSMFVQAACGLTFGIVPFVSRRSLGLISGMTGGGGNVGAVLTQLIFFHGSKYKTETGIKYMGFMIIACTLPITLIYFPQWGGMFLGPRPGATAEDYYNREWTAHECDKGFNTASVRFAENSVREGGRSGSQSKHTTVPVESSPADV

SEQ ID NO: 487 - protein, 464 aa, Arabidopsis thaliana
MDHDLEIFPLLSYVLHHSDPASHAPPSLAIQQSLANRYPLLTNPYVISSLIESIPSTITQTLFVFGSLGPRPDPLAVSSARSKIREIKENDSLSPEDAAKEEQVYAAVVSLEEVHEGYEKQLRDLEEEIGRVYASAVESLSGGDEVNEEVLAVIKDAEDGGVVERIDLSDHELKLLPDALGKIVGLVSLNVSRNNLRFLPDTISGLEKLEELDLSSNRLVFLPDSIGLLLNLRILNVTGNKLTLLPESIAQCRSLVELDASFNNLTSLPANFGYGLLNLERLSIQLNKIRFFPNSICEMRSLRYLDAHMNEIHGLPIAIGRLTNLEVMNLSSNFSDLIELPDTISDLANLRELDLSNNQIRVLPDSFFRLEKLEKLNLDQNPLEYPPQEMVNQSAEAVREFMRKRWEEMVEEEQLRSVIEAEKQQGGATGWLSWGSSIVTSLFSGGTHGGAAKKPKNSFLDEQL

SEQ ID NO: 488 - protein, 517 aa, Arabidopsis thaliana
MAMAMALRRLSSSIDKPIRPLIRSTSCYMSSLPSEAVDEKERSRVTWPKQLNAPLEEVDPEIADIIEHEKARQWKGLELIPSENFTSVSVMQAVGSVMTNKYSEGYPGARYYGGNEYIDMAETLCQKRALEAFRLDPEKWGVNVQPLSGSPANFHVYTALLKPHERIMALDLPHGGHLSHGYQTDTKKISAVSIFFETMPYRLDESTGYIDYDQMEKSATLFRPKLIVAGASAYARLYDYARIRKVCNKQKAVMLADMAHISGLVAANVIPSPFDYADVVTTTTHKSLRGPRGAMIFFRKGVKEINKQGKEVLYDFEDKINQAVFPGLQGGPHNHTITGLAVALKQATTSEYKAYQEQVLSNSAKFAQTLMERGYELVSGGTDNHLVLVNLKPKGIDGSRVEKVLEAVHIASNKNTVPGDVSAMVPGGIRMGTPALTSRGFVEEDFAKVAEYFDKAVTIALKVKSEAQGTKLKDFVSAMESSSTIQSEIAKLRHEVEEFAKQFPTIGFEKETMKYKN

SEQ ID NO: 489 - protein, 304 aa, Zea mays
MGSEADCDRIRGPWSPEEDDALRRLVERHGARNWTAIGREIPGRSGKSCRLRWCNQLSPQVERRPFTAEEDAAIVRAHARLGNRWAAIARLLPGRTDNAVKNHWNCSLKRKLAAASAPAGSSDVEARPTKRVSLSPDSPSGSGSGSGSGSGSGSGSDRSDLSHGAGQVYRPVARSGGFEPADCAMSRPLEEEEEEKEDPLTSLSLSLPGTDQRFHHDRAHSQFQELPASPPSPSPPPPPVLSAYPFSPVFMEAMQELIRTEVQRYMASVGVRAGCGAAGGADLCMPQLVDGVMRAAAERVGRMQ

SEQ ID NO: 490 - protein, 184 aa, Arabidopsis thaliana
MEKSTRTLFITIVITSMLLGFGNSDLAQDREECTNQLIELSTCIPYVGGDAKAPTKDCCAGFGQVIRKSEKCVCILVRDKDDPQLGIKINATLAAHLPSACHITAPNITDCISILHLPRNSTLAKEFENLGRIEDNYNSTSPTQIHKDGTGGGKAEPVKSNGWKEKSWLGVELLIYLLVSLIFF

SEQ ID NO: 491 - protein, 188 aa, Arabidopsis thaliana
MRNKHENPKKRRIQVLSSDDESEEFTREVPSVTRKGSKRRRRDEKMSNKMRKLQQLVPNCHKTDKVSVLDKTIEYMKNLQLQLQMMSTVGVNPYFLPATLGFGMHNHMLTAMASAHGLNPANHMMPSPLIPALNWPLPPFTNISFPHSSSQSLFLTTSSPASSPQSLHGLVPYFPSFLDFSSHAMRRL

SEQ ID NO: 492 - protein, 278 aa, Arabidopsis thaliana
MTREFELENNYQLCDEIGRGRFGTITRCFSPATKEFYACKTIDKRVLIDALDRECIETEPRIMAMLPPHPNIIRIFDLYETEDSLAIVMELVDPPMTIYDRLISAGGRLSESESASYAKQILSALAHCHRCDVVHRDVKPDNVLVDLVSGGVKLCDFGSAVWLGGETAEGVVGTPYYVAPEVVMGRKYDEKVDIWSAGVVIYTMLAGEPPFNGETAEDIFESILRGNLRFPPKKFGSVSSEAKDLLRKMICRDVSRRFSAEDALRHSWMMNVGNLQSN

SEQ ID NO: 493 - protein, 543 aa, Arabidopsis thaliana
MFTSGNVTARVFERQIRTPPPGASVNRARHFYENLVPSYTLYDVESPDHCFRKFTEDGLFLISFSRNHQELIVYRPSWLTYSTTDDSTTTLPPLPRRASKFDSFFTQLYSVNLASSNELICKDFFLYHQTRRFGLFATSTAQIHDSSSPSNDAVPGVPSIDKITFVLLRLDDGVVLDERVFLHDFVNLAHNMGVFLYDDLLAILSLRYQRIHLLQIRDSGHLVDARAIGYFCREDDELFLNSSSQAMMSQDKSKQQSLSGSKEDDTGENGLRHSLSQPSGSNSFLSGVKQRLLSFIFREIWNEESDNVMRVQSLKKKFYFHFQDYVDLIIWKVQFLDRQHLLIKFGSVDGGVTRSADHHPAFFAVYNMETTDIVAFYQNSAEDLYQLFEQFSDHFTVSSSTPFMNFVTSHSNNVYALEQLKYTKNKSNSFSQFVKKMLLSLPFSCQSQSPSPYFDQSLFRFDEKLISAADRHRQSSDNPIKFISRRQPQTLKFKIKPGPECGTADGRSKKICSFLFHPHLPLAISIQQTLFMPPSVVNIHFRR

SEQ ID NO: 494 - protein, 167 aa, Zea mays
MAISLATAYISPCFTPESSNSASPSRTLSSVRLPSQIRRFGSVQSPSSSTRFAPLTVRAAKKQTFNSFDDLLQNSDKPVLVDFYATWCGPCQLMVPILNEVSETLKDIIAVVKIDTEKYPSLANKYQIEALPTFILFKDGKLWDRFEGALPANQLVERIENSLQVKQ

SEQ ID NO: 495 - protein, 512 aa, Zea mays
MDAAAVHKRKRPEEADPSAGELDLSAADAVEVLDLRAAKRLLLAFERRLRDNLEARMKYPDDPARFADSEIALHAETDRLRLLAGAPELFPDLVPIGLASSLASLLTHDNVDLAAAAASLLADLTDSEDPSDLAAVQALADALVDANALDLLVHNLSRFSETDPDEAEAVHNTLAVLENLLDLRPNLADKVCGGTKLLRWLLSRVKAREFDANKQYASEILAILLQNSPANQKRLGQINGVDALLQAVAMYKSRDPKTSDEEEMLENLFDCLCCVLMPLENKERFVKAEGVELMIIIMKQKKLAYSSATRTLDFAMTKFPPACERFVDVLGLKTAFAAFMGKIPVNKKNKKESYQEELEERIISLIASLFGGITKGSRRMRLLGKFVENECEKIDRLMELYTRYSDRVKEETERLDSLDLEDLEMDDDERYNRKLEAGLYTLQLIALILGHIWHSGNSQMRARVELLLKQNKLTKQDVKSILEEYHDNIGDLDGPEEKERAQVRTKEIIDAL

SEQ ID NO: 496 - protein, 141 aa, Oryza sativa
MAATSLSPPTVAGLRLAPSPRVRSPSVAFRAAPARRRSVAARAELSPSLVISLSTGVSLFLGRFVFFNFQRENVAKQVPEQNGKTHFDAGDERAKEFAGLLRSNDPVGFNLVDVLAWGSLGHIVAYYILATCSNGYNPNFF

SEQ ID NO: 497 - protein, 335 aa, Zea mays
MARQSAASMLATTTPLLLSVLANIAVVESIGVSYGMSGDNLPPASTVIGMYKDNGIPLMRIYAPDQAALQAVGGTGIRVVAGAPNDVLSSLAASPAAAASWVRNNIQAYPKVAFRCVCVGNEVEGGAAQSLVPAMENVRAALVAAGLDGIKVTTSVSQAILGGYKPPSAAEFTDEAQGFMGPVLRFLARTGAPLMASVYPYFTYATNPAAMDLSYALFTAPGTVLQDGAYEYQNLFDATVDSFYVAMANHGGSGVTLVVSESGWPSAGGVAASPENAAIYNQNLINHVGRGTPRHPGAIETILFSMFNENLKQSGVEQNWGLFYPNMQRVYPISF

SEQ ID NO: 498 - protein, 555 aa, Zea mays
MMSPASERSLIIQSDDDDDARSGHDVEEPEQDSDSSSSSSSCATPRRGPSSPPYIQQWPQSYRQSIDILSSVQSPNLSFLGTPTLSRLSNSFLAITDSFRSKAPETISSFIKPLLGPTPSDEQQRQHEGTRKSSEYLVPSRRSSLQQIPEDQKPPVGGHGASHDQNCSYTQGVMNGINVLCGVGILSTPYAIKQGGWIGLAILCTFALLAWYTGVLLRHCLDSKEGLKTYPDIGHAAFGSTGRIVISIILYVELYACCIEYLILEGDNLSKLFPNAHLTIGSMTLNSHVFFAILTTIIVMPTTWLRDLSWLSYISAGGVIASILVVICLFLVGVVNDFGFENEGTALNAPGIPIAIGLYGYCYSGHGVFPNIYSSLKNRNQFPSILFTCIGLSTFLYAGAAVMGYKMFGEATESQFTLNLPDNSVISKIAVWTTVANPITKYALTIIPLAMSLEELLPPNQQKYSTIIMLRSSLVISTLLIALSVPFFGLVMALVGSLFAMLVTYILPCACFLAILKTKVGWHQIAACSFIIVVGVCCAYVGTYSSLSKIIQNYA

SEQ ID NO: 499 - protein, 565 aa, Rhodopseudomonas palustris
MRILLIHPNYHSGGAEIAGHWPPAWAPYLAGALKANGFADIKFVDAMTEEISNEGLAKIISDYQPDLVGATSITPSIYAAEEALKVAKQVNPKIVTMLGGVHATFMYQQVLSEAPWVDVIVRGEGEEIVVELARAVASGNWPANRSEIKGLAYTEGSNGESQIVATAAAPTVKDLDAIKPDWGVLNWNLYRYIPMNTRVAIPNMARGCPFTCSFCSQWKFWRDYRVRDPKKVVDEIQELVEKYDVGFFILADEEPTINRKKFIQFCEELIARGLNKKVQWGINTRVTDILRDEQLLKFYNEAGLMHVSLGTEAAAQLKLDLFNKETKISDNKKAIRLLREAGIVVEAQFIVGLDSETPETLEETYRMAMDWKPDLANWSMYTPWPFTPLFKELSDKVEVFDFAKYNFVTPIVKPAAMERGELLDRVMNNYRRFYMYKAFFSYPWSGTGRRRRYLLGCLKAFLKAGFERKFYDLGRVGYWGPQSKKKVDFQFDTTRKISHAQMADWEANADRSRKAAASQMAIVSACGGGTDQMEESEADAKAALAKTVTSRVADSTHDAGSVTRH

SEQ ID NO: 500 - protein, 916 aa, Oryza sativa
MAASVQPRQFGHLEPGSAPVRGAASSNGAKAYPPANGIPRRADSPVRGCGFPPLVSPPPRKPPSDGSDDEEEEQEDWRELYGSHLQLEVEPPVRDARDEGTADAWIERNPSLIRLTGKHPLNCEPPLARLMHHGFITPAALHYVRNHGAVPRGDWSTWTVDVTGLVKRPMRLTMDELVNGFPAVEIPVTLVCAGNRRKEQNMVQQTVGFNWGAAGVSTSVWRGARLRDVLRRCGIMPSKGGALNVCFEGAEDLPGGGGSKYGTSITRQWALDPSRDIMLAYMQNGEPLLPDHGFPVRAIIPGCIGGRMVKWVKRIIVTTAESDNYYHYKDNRVLPSHVDAELANADAWWYKPEYIINELNVNSVITTPGHDEILPINGITTQRGYTMKGYAYSGGGKRITRVEVTLDGGETWLVCVLDLPEKPTKYGKHWCWCFWSVEVEVLDLLGAKEIAVRAWDQSHNTQPEKLIWNLMGMMNNCWFKVKVNVCRPHKGEIGLVFEHPTQPGNQTGGWMARQKHLETAEAAAPGLKRSTSTPFMNTTDGKQFTMSEVRKHSSQDSAWIVVHGHVYDCTAFLKDHPGGADSILINAGTDCTEEFDAIHSDKAKALLDTYRIGELITTGAGYSSDNSVHGASNLSQLAPIREAIKAPAPVALSSPRDKVPCQLVDKKELSRDVRLFRFALPSSDQVLGLPVGKHIFVCASIEGKLCMRAYTPTSMVDEVGHFDLLIKVYFKNEHPKFPDGGLMTQYLDSLPVGAYIDVKGPLGHVEYTGRGEFVINGKPRNARRLAMIAGGSGITPMYQVIQSVLRDQPEDTTEMHLVYANRTEDDILLRDELDRWAAEYPDRLKVWYVIDQVKRPEEGWKYGVGFVTEEVLREHVPEGGDDTLALACGPPPMIKFAVSPNLEKMKYDMANSFIVF

SEQ ID NO: 501 - protein, 750 aa, Arabidopsis thaliana
MPWWSKSKDEKKKTNKESIIDAFNRKLGFASEDRSSGRSRKSRRRRDEIVSERGAISRLPSRSPSPSTRVSRCQSFAERSPAVPLPRPIVRPHVTSTDSGMNGSQRPGLDANLKPSWLPLPKPHGATSIPDNTGAEPDFATASVSSGSSVGDIPSDSLLSPLASDCENGNRTPVNISSRDQSMHAPRASRIQSGAVTPLHPRAGGSTTGSPTRRLDDNRQQSHRLPLPPLLISNTCPFSPTYSAATSPSVPRSPARAEATVSPGSRWKKGRLLGMGSFGHVYLGFNSESGEMCAMKEVTLCSDDPKSRESAQQLGQEISVLSRLRHQNIVQYYGSETVDDKLYIYLEYVSGGSIYKLLQEYGQFGENAIRNYTQQILSGLAYLHAKNTVHRDIKGANILVDPHGRVKVADFGMAKHITAQSGPLSFKGSPYWMAPEVIKNSNGSNLAVDIWSLGCTVLEMATTKPPWSQYEGVPAMFKIGNSKELPDIPDHLSEEGKDFVRKCLQRNPANRPTAAQLLDHAFVRNVMPMERPIVSGEPAEAMNVASSTMRSLDIGHARSLPCLDSEDATNYQQKGLKHGSGFSISQSPRNMSCPISPVGSPIFHSHSPHISGRRSPSPISSPHALSGSSTPLTGCGGAIPFHHQRQTTVNFLHEGIGSSRSPGSGGNFYTNSFFQEPSRQQDRSRSSPRTPPHVFWDNNGSIQPGYNWNKDNQPVLSDHVSQQLLSEHLKLKSLDLRPGFSTPGSTNRGP

SEQ ID NO: 502 - protein, 220 aa, Zea mays
MGTPETSREPCPDRILDDVGGAFGMGAVGGSAFHFIKGIYNSPNGMRMSGGAQAVRMNAPRVGGSFAVWGGLFSTFDCAMVYARQKEDPWNSIIAGAATGGFLSMRQGMGAAGRSALMGGVLLALIEGAGLMLNRVLANPPLPAEDPNLTAAMGDNPFPGLPQAPPVVAPPEVASSSGAGGWFGGLIGRKDEEKKSSAGKSEILESFDTPSSPIPSFEYK

SEQ ID NO: 503 - protein, 579 aa, Arabidopsis thaliana
MVSKECCRNEIRAAIRQLSDRCLYSAAKWAGEQLVGIEQDPSNFTPANTRFQRGSSSIRRRFSTNESISTPLPSVGFSQAATPLPEEDEAIDGDIYLLAKSYFDCREYRRASHMLRDQVSKKSLFLRYYALYLAGEKRKEEEMIELEGPLGKSDAINRELVSLERDLSALRRTGAIDSFGLYLYGVVLKEKGNESLARASLVESVNSYPWNWSAWSELQSLCTSIEILNSLNLNNHWMKEFFLGNAYQELRMHTESLAKYEYLQGIFSFSNYIQAQTAKAQYSLREFDQVEIMFEELLRNDPYRVEDMDLYSNVLYAKEACAALSYLAHKVFLTDKYRPESCCIIGNYYSLKGQHEKAVMYFRRALKLNKKYLSAWTLMGHEYVEMKNTPAAIDAYRRAVDINPTDYRAWYGLGQAYEMMGMPFYALHYFRKSIFFLPNDSRLWIAMAKCYQTEQLYMLEEAIKCYKRAVNCTDTEGIALNQLAKLHQKLGRNEEAAYYFEKDLERMDAEGLEGPNMFEALVFLATHFKNHKKFEEAEVYCTRLLDYSGPEKEKAKSLLRGIRMAQTGFPSMDLEHFPI

SEQ ID NO: 504 - protein, 138 aa, Zea mays
MQVAATAVRFSAVLPVKGRPAAKSTVVVRVPASRRSVRAAAVVAAEAAEIDYNSSFSVFPMEACDLLGGDACSAQMYPETKLASAAAAASRRVEEVERDYLSYDEPRTVFPGEACDDLGGEFCEAPYQAGVSRELAHA

SEQ ID NO: 505 - protein, 600 aa, Oryza sativa
MEIGAVENGGVVGGEVVAGKRGKTPQGWKCMPFIIATETFEKVATIGVVANLTVYLVKRFNIGQIEAANITNIFFGTLNFAPLLGAFISDVYLGRFKTLAYGCFASLLGMLGMTLYASLPALKPPICHEKTRLGGGCNSPSTLQLSVLYLSLGFLIIGGGAIRPCSLPFGVDQFDKTDEEGRKGLNSYYNWYYGTSTAALVLSMIVIIYIQNNVSWPIGFGIPTLLMFLAIIMLFLGTNLYVHVQPEGSIFAGIAQVLVASFKKRNLKLPCPHDINQQGLMLYNPPSKGNRVFRLPLTSQFRFLNKGAIVMGDDINVDGSARNSWELCNVQQIEEVKCLIRIVPVCISGVLCFVALAQQFTYIILQTFTMDCHFGTHFEIPAGSVVSISLIALTLFIPIYDRILVPIARGFTGVESGITLLQRQGIGLAISPISMVVAGLVERKRRNSALSNGGISPMSVLWLAPQLVLMGIAEAFNAVGQIEFYNKQFPENMQTLAGSLFFCTIAGANYLSTALANIMRKVTTRDGHSSWLTDNINLGKLDYYFYFIALMGVLNLIYFLICSHFYQYKVMSLHSEESIKIPTKEEEATEIDIDTDAPSK

SEQ ID NO: 506 - protein, 354 aa, Zea mays
MAAPATPRPSLILPRASSHSHSQPSAGGLTSYRVTASHRRRGDFVFVVNPLGANGRTGKQWKQLLPLLRTRLADQCNICECITSGPSHAIDVTREAIKDGVDAVIAVGGDGTLHEVVNGFFWEGSPVCALDRGPDHSTALGLIPLGTGSDFARTFGWTNDPHDAIDRIVRGVKSKLDVGVMEGPNREPHFFVNVADIHLSAKAGYFASMYKSFGNLCYVFGALRAFWGHNNQDMRIKVNGGEWRTVHNVTALCIGNAKYFGGGMKITPTADPFSGNLEVVILQDFKWYDFILKLHRLYGGTHLSVNGVSSMRVQSIEVAEVAASGGVFVQSDGEHFGFLPTKFSVLPRAVDFFC

SEQ ID NO: 507 - protein, 437 aa, Zea mays
MALVQFNGALVPQLGEKPRLLSSSPAIAKATYSDARFLTPKTGSRGRGKHLLSPSYSLHSQTSSEQLNHVPSSRFRQKRGSRFIVRAEADFYSVLGVSRNASKSEIKSAYRKLARSYHPDVNKDPGAEQKFKDISNAYEVLSDDEKRSIYDKYGEAGLKGAGMGTGDYSNPFDLFESLFEGFGGMGGMGGGRAARNRPMQGDDESYNLVLNFKEAVFGVEKEIEITRLEGCNTCDGSGAKPGTKATTCKTCGGQGQVVSSTRTPLGIFQQVSTCNTCGGTGEFSTPCNTCGGDGRVRRTKRISLKVPAGVDSGSRLRVRSEGNAGRRGGPPGDLYVFIDVLSDPVLKRDGTNILYTCKVSYIDAILGTTVKVPTVDGTVDLKIPSGTQPGTTLVMSKKGVPLLGKSNARGDQLVRVQVEIPKRLSSDEKKLIEELQT

SEQ ID NO: 508 - protein, 883 aa, Arabidopsis thaliana
MPWWSKSKDEKKKTNKESIIDAFNRKLGFASEDRSSGRSRKSRRRRDEIVSERGAISRLPSRSPSPSTRVSRCQSFAERSPAVPLPRPIVRPHVTSTDSGMNGSQRPGLDANLKPSWLPLPKPHGATSIPDNTGAEPDFATASVSSGSSVGDIPSDSLLSPLASDCENGNRTPVNISSRDQSMHSNKNSAEMFKPVPNKNRILSASPRRRPLGTHVKNLQIPQRDLVLCSAPDSLLSSPSRSPMRSFIPDQVSNHGLLISKPYSDVSLLGSGQCSSPGSGYNSGNNSIGGDMATQLFWPQSRCSPECSPVPSPRMTSPGPSSRIQSGAVTPLHPRAGGSTTGSPTRRLDDNRQQSHRLPLPPLLISNTCPFSPTYSAATSPSVPRSPARAEATVSPGSRWKKGRLLGMGSFGHVYLGFNSESGEMCAMKEVTLCSDDPKSRESAQQLGQEISVLSRLRHQNIVQYYGSETVDDKLYIYLEYVSGGSIYKLLQEYGQFGENAIRNYTQQILSGLAYLHAKNTVHRDIKGANILVDPHGRVKVADFGMAKHITAQSGPLSFKGSPYWMAPEVIKNSNGSNLAVDIWSLGCTVLEMATTKPPWSQYEGVPAMFKIGNSKELPDIPDHLSEEGKDFVRKCLQRNPANRPTAAQLLDHAFVRNVMPMERPIVSGEPAEAMNVASSTMRSLDIGHARSLPCLDSEDATNYQQKGLKHGSGFSISQSPRNMSCPISPVGSPIFHSHSPHISGRRSPSPISSPHALSGSSTPLTGCGGAIPFHHQRQTTVNFLHEGIGSSRSPGSGGNFYTNSFFQEPSRQQDRSRSSPRTPPHVFWDNNGSIQPGYNWNKDNQPVLSDHVSQQLLSEHLKLKSLDLRPGFSTPGSTNRGP

SEQ ID NO: 509 - protein, 381 aa, Zea mays
MAAPEAPACYVGIARQSAAFRLMKQMGWEEGEGLGKDKQGIKGHVRVKNKQDTLGVGVDSPHNKWVYDTTQFDNILKKLKVQSANPVQEEVAAVESDSPDITPKKDKSAKHEVTKVTRPQGRYKKRERGKSVNSYSATDLQGILVRKNEDNSKVDQKLEPTCLDEPDPIICLDAVSQADDVNWWGHKFGFLSGGFLGAKSRKNKSSQKDLANVRQTFAEEDQENLYNLVQDKATSGKQGLGIKGLPMKVAGQRWKGNKTSFVDSDDDNSAQSDEYSEIEENGDEEEHISASESIDTDKNADKELLVDARPKTKVKKLCKRILRQAPSQSMKLKDLKVAVEEHSNVVFSSFSGRREALLFLKKKLQGSRKFNVDGKKVQLVS

SEQ ID NO: 510 - protein, 564 aa, Zea mays
MEPCNTVPSGVSWEVRPDVDASEEKNEKQESCSTTVDEAHEQGKTEGQIEIQVASSMDMISDEAFTADNQEHGIGESNVTSVEQVTEEEKPASEDEVKEPPLVNSTALLYDTTSSGDSSGLKQYTASTDQNLYAESNTGSSPASTEDIDISTLAVESEVAAENDGPINSQVHETVALENVEMKDDVSSAENEHNRSSSPVIHLEDPLVSLKDVEQHGPTPTKDFVVPNTEDQQEARDISLQVQAVDSMKDCGEVPDGTIEASTNDDELELGTSADVEKNDQPTLLEPRSESVSVPELSVLDESDDKMQCGVSGKDEEAHVEEKTVTIAVDKVTGGSANFEDPLCEASRKEPDIEKSHPSLGEEEDDTIGGTVFPGSGSCELSCPQDGGIAVYEGPEMVSPESQTDARKENIHSDVAETDECTKTQKAALAGTEGENSAEDSGVPVSEMDKCNEMPKDAPTLTAAGANPAEDEASLKDLSVQTENKASSASPAPDDPKASDEKTLAEENQKLKELLQKLLASGNDQMGVITDLSEKVKVLERRLARKKRPKVRVHKPSRHASCVH

SEQ ID NO: 511 - protein, 507 aa, Oryza sativa
MAPMAGGGGVPWGDRARVVGAQIRSRFRVGVAPVDRRWLWRRGDGRVASEAVRQWTERVRSLWQREKSTDQISSSPGTSQVAAAAKPSSSALRFYRKKVGKEVDGIEDSVIFRSLQALAVPLIGNACHIFMHGLNSVQIYGAEKLQQALQERPKGKPLLTVSNHVAAMDDPFVIASILPPSVMLEAQKLRWTLCASDRCFTNPILSTFFRSVKVLPVSRGDGIYQKGMDMALSKLNNGGWVHIFPEGSRSKDGGKTVAPAKRGVGRLVMDADSLPVVIPFVHTGMQDIMPVGKRIPRAGKRVIVVVGDPINFNDLIIDNSDETQHISRGILYDKATERIGQRLQELKAEVDRLAAEQKSELQHHHARDTVNYGTRLWQQVDWEAFGMESSMLSPEPSDVQEPLKKAKPVLHLESEHAKPELHLEPEQAKHELHTEQCVPAAPSAEICSNFGVPLFFRQHTDPSELMGFAARGLLKNGRFMEEEGYRELQRQGAMNMFWGSQANNTVL

SEQ ID NO: 512 - protein, 245 aa, Zea mays
MGTEADAAAVDSLRSQIPFQTDGELILPPRDVGLVLVDLCNGFCTVGAGNLAPVAPNKQISKMVEEAARLSKLFCDRNLPIFAFLDTHYPDKPEPPYPPHCIIGTGEENFVPDLEWLEKEPNVTIKRKSCIDGYISCIEEDGSSVFVDWVGKYQIKTVLVLGICTDICVLDFASSTLAARNIDRVPPLRDVVIYSEGCATYDLPVEIAMNIKGALAHPQDLMHHIGLYMAKGRGAKVVDRVVIEP

SEQ ID NO: 513 - protein, 188 aa, Zea mays
MASPARRLLQTNSVQYPTLPAADPPSPLAVDSDVVVILAALLCALICVVGLASVARCARSRAAPAAARRGLRKKALRALPSLAYEDAVAARAADGAAEVLAECAICLSEFAPREEVRVLPQCGHAFHVACIDTWLAAHSSCPSCRRVLVVGDASSKRPPQPKRCRKCEAAMDEPSSSSGSAGDTPAGS

SEQ ID NO: 514 - protein, 615 aa, Zea mays
MAALATSQLVATRAGLGVPDASTFRRGAAQGLRGARASAAADTLSMRTSARAAPRHQQQARRGGRFPSLVVCASAGMNVVFVGAEMAPWSKTGGLGDVLGGLPPAMAANGHRVMVVSPRYDQYKDAWDTSVVSEIKMGDGYETVRFFHCYKRGVDRVFVDHPLFLERVWGKTEEKIYGPVAGTDYRDNQLRFSLLCQAALEAPRILSLNNNPYFSGPYGEDVVFVCNDWHTGPLSCYLKSNYQSHGIYRDAKTAFCIHNISYQGRFAFSDYPELNLPERFKSSFDFIDGYEKPVEGRKINWMKAGILEADRVLTVSPYYAEELISGIARGCELDNIMRLTGITGIVNGMDVSEWDPSRDKYIAVKYDVSTAVEAKALNKEALQAEVGLPVDRNIPLVAFIGRLEEQKGPDVMAAAIPQLMEMVEDVQIVLLGTGKKKFERMLMSAEEKFPGKVRAVVKFNAALAHHIMAGADVLAVTSRFEPCGLIQLQGMRYGTPCACASTGGLVDTIIEGKTGFHMGRLSVDCNVVEPADVKKVATTLQRAIKVVGTPAYEEMVRNCMIQDLSWKGPAKNWENVLLSLGVAGGAGPLISRVVQRCWDIFLYMLFRLCDMDKYV

SEQ ID NO: 515 - protein, 387 aa, Zea mays
MIPSVRISPGYAAFSGSSLRLKLHSIPSISSLKPSKYVVSSLKPLYLAPPDGPHTSELKSWRQPLEFRCAASAADDKESKTQVVPVQLEGAQRLKISIYFATWWALNVIFNIYNKKVLNAFPYPWLTSTLSLACGSAMMLFSWATRLVEAPKTDLDFWKVLFPVAVAHTIGHVAATVSMSKVAVSFTHIIKSAEPAFTVLVSKFLLGETFPVPVYLSLLPIIGGCALAAVTELNFNMVGFMGAMISNLAFVFRNIFSKRGMKGKSVSGMNYYACLSIMSLVILTPFAIAMEGPQMWAAGWQKAVAEVGPNVVWWIAAQSVFYHLYNQVSYMSLDQISPLTFSIGNTMKRISVIVSSIIIFRTPVRPVNALGAAIAILGTFLYSQAKA

SEQ ID NO: 516 - protein, 272 aa, Glycine max
MAEAGSSINRGARWSLNGTTALVTGGTRGIGHAIVSDLAAFGAAVHTCSRTQTELNKCLQEWQSLGFQVTGSVCDVSSPSQREKLIEEVTSILNGKLNIYVNNVGTNFRKPTIEYTAEEYSQLMTVNLDSSFHLCQLAYPLLKASENGSIVFISSVAGVVSLGTGAVYAASKAAINQLTKNLACEWAKDNIRSNCVVPWATRTPLVEHLLRDQKFVDDIMSRTPIKRIAEPEEVSSLVTFLCLPAASYITGQVICVDGGLTVNGFQTSMRIT

SEQ ID NO: 517 - protein, 377 aa, Arabidopsis thaliana
MAVSFVTTSPEEEDKPKLGLGNIQTPLIFNPSMLNLQANIPNQFIWPDDEKPSINVLELDVPLIDLQNLLSDPSSTLDASRLISEACKKHGFFLVVNHGISEELISDAHEYTSRFFDMPLSEKQRVLRKSGESVGYASSFTGRFSTKLPWKETLSFRFCDDMSRSKSVQDYFCDALGHGFQPFGKVYQEYCEAMSSLSLKIMELLGLSLGVKRDYFREFFEENDSIMRLNYYPPCIKPDLTLGTGPHCDPTSLTILHQDHVNGLQVFVENQWRSIRPNPKAFVVNIGDTFMALSNDRYKSCLHRAVVNSESERKSLAFFLCPKKDRVVTPPRELLDSITSRRYPDFTWSMFLEFTQKHYRADMNTLQAFSDWLTKPI

SEQ ID NO: 518 - protein, 642 aa, Zea mays
MMGGGLLVDQSVVFPGVHNFVDLLQQNGDKNLGFGSLMPQTSSGDQCVMGEGDLVDPPPDSFPDAGEDDSDDDVEDIEELERRMWRDRMKLKRLRELQQTRGKDSLASGAGLADGSSKPRQSQEQARRKKMSRAQDGILKYMLKMMEVCRAQGFVYGIIPEKGKPVSGASDNLRAWWKEKVRFDRNGPAAIAKYQADNAVPGAENELASGAASPHSLQELQDTTLGSLLSALMQHCEPPQRRYPLEKGVPPPWWPTGDEEWWPELGIPKDQGPPPYKKPHDLKKAWKVSVLTAVIKHMSPDIEKIRRLVRQSKCLQDKMTAKEISTWLAVVKQEEELYQKLNPGARPPASTGGIASAISFNTSSSEYDVDIIDECKGDEAGNQRTAVTDPTAFNLGASILSDKFLVPTPMKEETGDVEFIQKRNAPAAAEPELMLNNRVYTCNNVQCPRSDYSYGFLDRNARNSHQYTCKHKDPTSQSTENKPPSAPPQPQAFQPAFSQPNQALNSLDFSLPMDGQRSIAELMNMYDNNFVPNKNPSSDSVAVMERPNAMPQQRIQLDEGFFVQGNGAFDDVNNSMMQQQQQQAPVQQQQQFFIRDDTPFVSQMGDIAASAPELRFGPGFSMSSSVDYPGAAQRNDGTNWFY

SEQ ID NO: 519 - protein, 413 aa, Glycine max
MGELGDMEENEWQMVQTKGNQFVVNDQPFYVNGFNTYWLMVFAADESTRGKVTEVFKHASSVGMSVCRTWAFNDGQWRALQKSPSVYDEDVFKALDFVVSEARKYKIRLILSLVNNWEAYGGKPQYVKWGNAAGLNLTSDDDFFSHPTLRSYYKAHVKTVLNRVNTFTNITYKEDPTIFAWELMNEPRCTSDSSGDVLQDWIKEMAFYVKSIDPKHLVEIGLEGFYGPSTPQKYQFNPNSYAHEVGTDFIRNHQVLGVDFASVHIYPDSWISQSVADSHLPFIKTWMEAHIEDAEKYLGMPVVFAEFGVSAKAPGYNSTYRDNLINTVYKTILNSTKKGGSGAGSLVWQLFPDGTDYMDDGYAIVLSKSPSTSSIISLQSTRLALFNSLCSKKCRWGCKKRNVLEKVLYHDEL

SEQ ID NO: 520 - protein, 424 aa, Zea mays
MGLLPTDRMDSLFSPRCQWVNGPIIVGAGPSGLAVAACLREQGVPYVMLERADCIASLWQRRTYDRLKLHLPKQFCELPRMPFPDHYPEYPTRRQFIDYLEDYAARFEIRPEFSTTVVLARYDETSGLWRVTTSAPAGANGGDVEYIGRWLVVATGENAEAVVPDIPGLGGFHGKVTHVSDYKSGEAYAGKRVLVVGCGNSGMEVSLDLSDHGARPAMVVRDAVHILPREVLGKSTFELAVLLRRWLPLWLVDKIMVILAWLVLGNLARLGLRRPAAGPLELKETHGRTPVLDTGALARIRAGDIAVVPAVARFRKGGQVELADGRTLDFDAVILATGYRSNVPQWLESSNDSFNKEGYPKTAFPHGWKGQSGLYAVGFTRRGLLGASTDAVRIAKDLGNVWREETKPTKRAGACHRRCISVVF

SEQ ID NO: 521 - protein, 389 aa, Arabidopsis thaliana
MVIAAAVIVPLGLLFFISGLAVNLFQAVCYVLIRPLSKNTYRKINRVVAETLWLELVWIVDWWAGVKIQVFADNETFNRMGKEHALVVCNHRSDIDWLVGWILAQRSGCLGSALAVMKKSSKFLPVIGWSMWFSEYLFLERNWAKDESTLKSGLQRLSDFPRPFWLALFVEGTRFTEAKLKAAQEYAASSELPIPRNVLIPRTKGFVSAVSNMRSFVPAIYDMTVTIPKTSPPPTMLRLFKGQPSVVHVHIKCHSMKDLPESDDAIAQWCRDQFVAKDALLGKHIAADTFPGQQEQNIGRPIKSLAVVLSWACVLTLGAIKFLHWAQLFSSWKGITISALGLGIITLCMQILIRSSQSERSTPAKVVPAKPKDNHHPESSSQTETEKEK

SEQ ID NO: 522 - protein, 409 aa, Arabidopsis thaliana
MIKQSKKKRNKKKRIITIEINDFPGGPDGFELVSRFCYHNGEILIDVSNVSTLYCCSVFLGMSEKFCFSNLFLQTEKFLEEVFYGSWSDIVSCLKNCEQVFFQADSYGLVDKLIFAALNKISQNSDDFSSSSLSSFASSLSPEMAKNTSESDGRYISRSVACGRSNEWWFEDMTNLSPKIILKLVMIIGAYKTNIKSLVLTRFLLHYLKTKLQTKSRTTTELMRNKLEYSDLADTAVRGVISAGTRTFSCRKLFWILRVLSSFSLSRESRIGLETLIGEMLEQATLDDLLISARGSRESGFYNVDLVIRLLKVFVKNREEEEEESRERNMKEIGKLIDKYLREISPDQNLKVPKFLGVAESLPDSARDCFDGVYRAIDIYLQVSFFFLLSYKFYYYFFVFLEFLHQLND

SEQ ID NO: 523 - protein, 648 aa, Zea mays
MAPHLLAVAVAVAAIIATVSLLAPGAAAYPWPVCGTSNDFEPNSTYQANLNLLAAMLPNNVSASPVLYATAVVGAVPEQVWGMGLCRGDANASSCLACLTQAFQDLPNDCSYNKDAAIYYDPCTLHYSDVHTLADDDTGPTTMSYNINNNANVTSDPARFERLLAALVNATAEHAASNSTRRFATGEADADFDRQFPKVYALAQCTPDQTPAQCRKCLAGLISQSLDGFQNNIGGRVLWVNCTWRYETSPFFNGPAMVRLASSSSPPAAAAAGGGERKYSVFIVVLAVVLPTLAALNLVFCFCFWRRPAPQAKQSQPMYSTEAEDVETVDSMMIDVSALRAATGNFDESNKLGEGGFGAVYKGVLPDGDEIAVKRLSKSSTQGVEELKNELALVARLRHRNLVRLVGVCLEQQERLLVYEFVPNRSLDLVLFGTDTREPLSWEQRYRIINGIARGLQYLHEDSQLKVVHRDLKASNILLDVEMNPKISDFGLARIFGRDRTQAVTSRVVGTYGYLAPEYLMRGNYSVKSDAFSFGVMVLEIVTGRKNNGSSHKSGDLLTTVWEHWEAGTVAELVDPSLGGSFPEGDVLRCIHIGLLCVQGDPAARPVMSSVVTMLGTDTVTLQAPSKPGFFARKSGTSTTVSADDGSI

SEQ ID NO: 524 - protein, 318 aa, Zea mays
MGKASKDKRDIYYRKAKEEGWRARSAFKLLQIDQEFNIFHGVKHVVDLCAAPGSWSQVLSRNLYVPAKQSSDCKEGDLPLIVAIDLQPMAPIEGVIQVQGDITNARTADVVIRHFDGCKADLVVCDGAPDVTGLHDMDEFVQSQLILAALAIVTHVLKVGGKFVAKIFRGKDTSLLYCQLKLFFSQVTFAKPKSSRNSSIEAFAVCENYSPPEGFKEEDLYHLLEKVGTPSGAGDLDCRSGWLEGPNKVYIPFLACGDLSGYDSDRSYPLPSSTDGGSYRSLDPVQPPIAPPYKTALQMKKASSHGAGADAIKPSADS

SEQ ID NO: 525 - protein, 214 aa, Zea mays
MKRETMPSWLELLLATQFFTTCANHLLASRNECNLFCTQCETKPAAFCNYCRSSDHSTHRVIQIRRSSYHDVVRVSEIEDILDVSDVQTYVINSARIVFLNERPQLRASSVPICKAPTSSTHSCETCSRVLLDAFRFCSLGCNLRGLNMEAGMQAMVGNNPRSNGMDHVARIDNVGSSTTNDQNSCNDKNYEEPPPKRVARHRRKGIPQRAPFF

SEQ ID NO: 526 - protein, 603 aa, Artificial Sequence
  Chimeric synthetic protein from Escherichia coli and Solanum tuberosum
MVRPVETPTREIKKLDGLWAFSLDRENCGIDQRWWESALQESRAIAVPGSFNDQFADADIRNYAGNVWYQREVFIPKGWAGQRIVLRFDAVTHYGKVWVNNQEVMEHQGGYTPFEADVTPYVIAGKSVRITVCVNNELNWQTIPPGMVITDENGKKKQSYFHDFFNYAGIHRSVMLYTTPNTWVDDITVVTHVAQDCNHASVDWQVVANGDVSVELRDADQQVVATGQGTSGTLQVVNPHLWQPGEGYLYELCVTAKSQTECDIYPLRVGIRSVAVKGEQFLINHKPFYFTGFGRHEDADLRGKGFDNVLMVHDHALMDWIGANSYRTSHYPYAEEMLDWADEHGIVVIDETAAVGFNLSLGIGFEAGNKPKELYSEEAVNGETQQAHLQAIKELIARDKNHPSVVMWSIANEPDTRPQGAREYFAPLAEATRKLDPTRPITCVNVMFCDAHTDTISDLFDVLCLNRYYGWYVQSGDLETAEKVLEKELLAWQEKLHQPIIITEYGVDTLAGLHSMYTDMWSEEYQCAWLDMYHRVFDRVSAVVGEQVWNFADFATSQGILRVGGNKKGIFTRDRKPKSAAFLLQKRWTGMNFGEKPQQGGKQ

SEQ ID NO: 527 - protein, 386 aa, Zea mays
MDASPTPPLPLRAPTPSIDLPAGKDRADAAANKAAAVFDLRREPKIPEPFLWPHEEARPTSAAELEVPVVDVGVLRNGDGAGLRRAAAQVAAACATHGFFQVCGHGVDAALGRAALDGASDFFRLPLAEKQRARRVPGTVSGYTSAHADRFASKLPWKETLSFGFHDGAAAPVVVDYFTGTLGQDFEPVGRVYQRYCEEMKELSLTIMELLELSLGVERGYYREFFEDSRSIMRCNYYPPCPVPERTLGTGPHCDPTALTILLQDDVGGLEVLVDGEWRPVRPVPGAMVINIGDTFMALSNGRYKSCLHRAVVNRRQERQSLAFFLCPREDRVVRPPASAAPRQYPDFTWADLMRFTQRHYRADTRTLDAFTRWLSHGPAAAAPCT

SEQ ID NO: 528 - protein, 304 aa, Glycine max
MLEGHQLLGFGFFVIGLWHLFNHIKLHALSSKSYTSTLWFPTTISRYLELHFIMASCTIFIAMELFIAPIHHQPLDPDGTIPTTHLHNFEHSSMAMAFLVYAIFAIVLDRIKCTKAQHELTHLLGAIAFTQQFLLIHLHSRDHMGPEGQYHFLLQLLIIISLSTTLMGIGFPKSFLVCFVRSVSIIFQGVWLMVMGFLLWTPGFQAKGCSMHLDESDEYVVRCSDHESLHRAISLVNIQFSFLLILVTIFAMSFYLILVRRYGGEKVEYVFLTKEEHYREEDGFVKPNNDVESQSQEKSMQEQI

SEQ ID NO: 529 - protein, 229 aa, Glycine max
MASASGEAPPPQPTSTEAAPASGSSAPAISAAAPQPGGSSPAPPSRYESQKRRDWNTFLQYLQNHKPPLTLARCSGAHVIEFLKYLDQFGKTKVHITGCPYYGYPNPPAPCACPLKQAWGSLDALIGRLRAAYEENGGRPESNPFGARAVRIYLREVREGQAKARGIPYEKKKRKRTTVVMVSSGGGGSSGAVASPSGGGDTAIGGGAGSSASLTSSATATANDTTTTV

SEQ ID NO: 530 - protein, 310 aa, Glycine max
MLEGHQLLGFGFFVIGLWHFFNHIKLHALSSKSYSSTLWFPTKISRYLELHFIMASCTIFIASELFIAPIHHQPLDPDGTIPTTHLHNFEHSFMAMAFLVYAIFAIVLDRKCIKAQHELTNLLGALAFTQQFLLIHLHSRDHMGPEGQYHFLLQLLIIISLSTTLMGIGFPKSFLVCFVRSVSIIFQGVWLMVMGFLLWTPGFQAKGCFMHLEESDEYVVRCSDDESLHRAISLVNIQFSFLLIVVTIFGMSFYLILVKRYGEKVEYVFLTKEEHYGEEDGFVKPKVTIHLDNNIHVESQSQEKSMREQI

SEQ ID NO: 531 - protein, 363 aa, Cucurbita ficifolia
MTFPTSAIGFEGYEKRLEVSFFEPGIFADPRGMGLRALSKAQLDEILTLAECTIVDSLSNDYLDSYVLSESSLFVYPYKFIIKTCGTTKLLLSIPALIKLADSLSLNVKSVRYTRGSFIFPGAQSFPHRSFSEEVAVLDGYLAKLGLHGSAYVMGSPDETRKWHVYSACAKMGSRSYNPVYTLEMCMTGLDKEKASVFFKTDTSSAAAMTENSGIRKILPKSDICDFEFDPCGYSMNAIEGDAESTIHVTPEEGFSYASFEAAGYELDDLDLCKVIGRVLACFQPSDFSVALHSDVVGEDLKDLLCLDLKGYEGGEKSCEMLGENGSVIYQSFKNRGDYASSPRSILMKCCWREDEADEEVEK

SEQ ID NO: 532 - protein, 221 aa, Zea mays
MARRASLLLAAALLVAVAAAAVPPTCERIECPPYVVVDSANGFEIRRYTDAMWITTAPIEDISFVAATRTGFLQLFDYIQGKNAYNETIEMTAPVLTRVSPSDGPFCASAFAVSFYVPAKNQADPPPAEGLRVDRWAGARYAAVRRFGGFVADADVGEQAARLEASLQGTRWAAAVNDARRADPASPYTVAQYNSPFEFTGRVNEIWMLFDAADADDDASM

SEQ ID NO: 533 - protein, 458 aa, Zea mays
MEPRRISASPRPCSGRRVVARKRPRQEAVVSSVRKLQRREISSRRDRTFTMSAAQERFRNIQLQEEFDTHDPKENASLLPYLRKRSKIIEIVAARDIVFALSQSGVCAAFSRETNRRICFLNGSPDEVIRSLFYNKNNDSLITVSVYGSENFSALRCRTTRIEYVRRGQPDAGFPLFESESLKWPGFVEFDDVNGRVLTYSAQDSTYKVFDLKNYTLLYLVSDKNVQEIKISPGIMLLIYARTSSSVPLKILSIDDGTVLKSFSHLLHRNKKVDFIEQFNEKLLVKQEGENLQILDVRNFQLTEVSRTEFMTPSAFIFLHELQLFLTFRNRAVSVWNFRGELVTSFEDHLLWHPDCNTNNIYITSDQDLIISYCKADSTDSSSEENAGSINISSILSGKCLAKINTGNSNACKERKKVWKFRNTVSEALEDITALYYDEDRDEIYTGNRHGLVHVWSS

SEQ ID NO: 534 - protein, 149 aa, Zea mays
MAPKAEKKPAAKKPAEEEPAAEKATAGKKPKAEKRLPAGKSAGKEGGEKKGKKKAKKSVETYKIYIFKVLKQVHPDIGISSKAMSIMNSFINDIFEKLAAEAAKLARYNKKPTITSREIQTSVRLVLPGELAKHAVSEGTKAVTKFTSS

SEQ ID NO: 535 - protein, 154 aa, Zea mays
MAPKAEKKPAAKKVAEEEPSEKAAPAEKAPAGKKPKAEKRLPAGKSAGKEGGDKKGRKKAKKSVETYKIYIFKVLKQVHPDIGISSKAMSIMNSFINDIFEKLAAEAAKLARYNKKPTITSREIQTSVRLVLPGELAKHAVSEGTKAVTKFTSS

SEQ ID NO: 536 - protein, 136 aa, Zea mays
MARTKQTARKSTGGKAPRKQLATKAARKSAPATGGVKKPHRFRPGTVALREIRKYQKSTELLIRKLPFQRLVREIAQDFKTDLRFQSSAVAALQEASEAYLVGLFEDTNLCAIHAKRVTIMPKDIQLARRIRGERA

SEQ ID NO: 537 - protein, 151 aa, Glycine max
MSDGGKRQGGRALPPPPRGPPPPPPSRPRLEPVDREKTCPLLLRVFTKIGSHHSMEDFAVRGKEPKDEVQIYTWKDATLRELTDLVKEVAPAARRRNAKLSFAFVFPDKNGRFKVQEVGKTLSYGNGRLDDGKALAELGFEIGDYLDVAIL

SEQ ID NO: 538 - protein, 125 aa, Glycine max
MAKFNVVQKKRRALIAEKKRQLHGDPLTGKLKIKDQPLSLSGKRKRKLFKKWRRDQKDALQNGLVTMEDVQMAVAEGDTKDAPRPSAKIHLKKKTLKLKQLKRKGKNKRKSDVPAADVSADAMVE

SEQ ID NO: 539 - protein, 124 aa, Glycine max
MAKFNVVQKRRRALIAEKKRQLHGDPLTGKLKIKDQPLSLSGKRKRKLFKKWRRDQKDALQNGLVTMEDVQMAVAEGDTKDTPRPSPKIHLKKKALKLKQLKRKGKNKRKSDVPADVSADAMVE

SEQ ID NO: 540 - protein, 957 aa, Klebsiella oxytoca
MTKPVLVLVGHGMVGHHFLEQCVDRRLHQRYRIVVFCEERYAAYDRVHLTEYFTGRSAESLSLVEGDFFAQHGIELRLSESVASIDREARVVRDAFGHETHWDKLVLATGSYPFVPPVPGHHLEGCFVYRTLDDLDQIAARAATARRGVVIGGGLLGLEAANALKQLGLETHVVEFAPNLMAVQLDNGGAAMLREKISQLGVGVHTSKATTEIVRNEQGLQLNFADGSSLAADMLVFSAGIRPQDRLARSGGLEVGERGGICIDNQCRTSDPDVLAIGECALWENKIYGLVAPGYQMARAAAATLAGEEGCFSGADMSTKLKLLGVDVASFGDAQGRTPGCQSYQWTDGPQQIYKKIVVSAEGNKLLGGVLVGDASDYATLLQMMLNGMALPNHPESLILPALEGSAPKALGVAALPDSAQICSCHNVSKGDICQVVNGGAGDMAAIKSCTKAATGCGGCSALVKQVMEYQLAEQGVEVKKDICEHFAWSRQEIYHLVRVNHIRTFEQLITRYGRGHGCEICKPLAASVLASCWNEYLLKPAHLPLQDTNDRYFANIQKDGTYSVVPRMAAGEVTPDGLIAIGQIAKRYQLYSKVTGGQRIDLFGARLEQLPAIWRELAEAGFETGHAYGKSLRTVKSCVGSTWCRYGVQDSTGLAVTLEHRYKGLRAPHKIKMAVSGCTRECAEAQSKDIGIIATEKGWNLYVCGNGGMKPRHADLFASDLDEATLIRSIDRLLMFYIRTADRLQRTSTWMDNLEGGVDYLRAVILEDSLGIGEELEQEMARVVESYQCEWQTTLNDPQRLALFRSYVNSDEPDEAVQRQTLRGQPQLAPFAAQAEPALPSRPWQAICDLDAIPQQAGIGARLGERQIALFRFGDQVYALDNLEPGSEANVLSRGLLGDAGGEPIVISPLYKQRIRLRDGRQCDDGELAVRAWPVKVENGKVWVGNQQLLARAEAS

SEQ ID NO: 541 - protein, 634 aa, Zea mays
MDGCDCIEPLWPTDDLLVKYQYISDFFIALAYFSIPLELIYFVKKSSFFPYRWVLIQFGAFIVLYGATHLINLWTFTTHTKTVAMVMTIAKISTAVVSCATALMLVHIIPDLLSVKTRELFLKNKAEELDREMGLIRTQEETGRHVRMLTHEIRSTLDRHTILKTTLVELGRTLGLEECALWMPSRSGSSLQLSHTLRHQITVGSSVPMNLPVVNQVFSSNRAIIIPHTSSLARVRPLAGRYVPPEVAAVRVPLLHLSNFQINDWPELSAKSFAIMVLMLPSDSARKWHVHELELVEVVADQVAVALSHAAILEESMRARDLLMEQNVALDLARREAEMAIRARNDFLAVMNHEMRTPMNAIIALSSLLLETELTPEQRLMVETVLKSSNLLATLINDVLDLSKLEDGSLELEIKAFNLHAVFKEVMGFIKPIASIKRLSVSVMLAPDLPLCAIGDEKRLMQTILNISGNAVKFTKEGHITLVASIVKADSLREFRTPEFHPTASDEHFYLKVQVKDTGCGVSPQDLPHVFTKFAHPQSGGNRGFNGSGLGLAICKRFVSLMGGHIWIDSEGTGRGCTATFVIKLGVCDNTNTYQQQLVPLVWPSSADSNLSAPKVLPDGRGSVSLKSRYQRSV

SEQ ID NO: 542 - protein, 866 aa, Klebsiella oxytoca
MTETRTTCPYCGVGCGIIASLNADGQVTVRGDEQHPANFGRLCVKGAALGETVGLTGRLLFPEVDGGRATWAQALAAAGSRLREIIDEHGPQAVAFYASGQLLTEDYYVANKLMKGFIGAANIDTNSRLCMSSAVTGYKRALGADVVPCSYEDVENSDLVVLVGSNAAWAHPVLYQRLAQAKRDNPQMRVVVIDPRRTATCDIADRHLALAPGSDGGLFVGLLNAIAARDVICGDFSDAPQALAIAQDWDINHVAQFCGLPRQQIADFYSEFIAAPRAITLYTMGINQSASGSDKCNAIINVHLASGKYGRPGCGPFSLTGQPNAMGGREVGGLATMLASHMNFETDDLRRLARFWGTERLAQTPGLAAVDLFAAIGRGEVKAVWIMGTNPVVSLPDSHVVSKALAACPLVIVSDVAAATDTGRFAHIRFPALAWGEKSGTVTNSERRISRQRAFMAPPGEARADWWIVARVAQALGFGSAFAWQHPHEVFSEHAALSGYENDGQRAFDIGGLADLSREAWEALEPVRWPVSRSQASWDLLKGWHRSGKLRMIPVTPQPTRAVTDAFYPLILNSGRIRDQWHTMTRTGAVPRLMQHINEPVVEVAPADATRYQLLEGELARVRSPNGVMVAKVIVSNGQRPGSLFVPMHWNDQFARQGRVNNLLSAVTDPHSGQPESKQAAVAIAAWLPAWKGELFSRLSVPLPASLHWRRRASQGIIHLSLAGDIASREWLIEWCQRKGWQLQTAKGGSIWNLLAWQGEELMLGWWSDVNEPRVDAEWISAAFRSPPPNATQRHALLSGRKGSDEVPRGRIICSCFSVGERAIDEAIATGCRTPAALGAKLKCGTNCGSCIPELKALLAAKLAQA

SEQ ID NO: 543 - protein, 687 aa, Arabidopsis thaliana
MEFLGDSQNHDSSETEKKNKKKKRFHRHTPHQIQRLESTFNECQHPDEKQRNQLSRELGLAPRQIKFWFQNRRTQKKAQHERADNCALKEENDKIRCENIAIREAIKHAICPSCGDSPVNEDSYFDEQKLRIENAQLRDELERVSSIAAKFLGRPISHLPPLLNPMHVSPLELFHTGPSLDFDLLPGSCSSMSVPSLPSQPNLVLSEMDKSLMTNIAVTAMEELLRLLQTNEPLWIKTDGCRDVLNLENYENMFTRSSTSGGKKNNLGMEASRSSGVVFTNAITLVDMLMNSVKLTELFPSIVASSKTLAVISSGLRGNHGDALHLMIEELQVLSPLVTTREFCVLRYCQQIEHGTWAIVNVSYEFPQFISQSRSYRFPSGCLIQDMSNGYSKVTWVEHGEFEEQEPIHEMFKDIVHKGLAFGAERWIATLQRMCERFTNLLEPATSSLDLGGVIPSPEGKRSIMRLAHRMVSNFCLSVGTSNNTRSTVVSGLDEFGIRVTSHKSRHEPNGMVLCAATSFWLPISPQNVFNFLKDERTRPQWDVLSNGNSVQEVAHITNGSNPGNCISVLRGFNASSSQNNMLILQESCIDSSSAALVIYTPVDLPALNIAMSGQDTSYIPILPSGFAISPDGSSKGGGSLITVGFQIMVSGLQPAKLNMESMETVNNLINTTVHQIKTTLNCPSTA

SEQ ID NO: 544 - protein, 889 aa, Zea mays
MAKSSADDAELRRACAAAVAASGARGEEVAFSIRVAKGRGIFEKLGRLAKPRVLALTVKQSSRGEANKAFLRVLKYSSGAVLEPAKLYKLKHLTKVEVISNDPSGCTFVLGFDNLRSQSVAPPQWTMRNIDDRNRLLFCILNMCKEILSYLPKVVGIDIVELALWAKENTLTIDNQVSTQDGQETSVATQTERKVTVTVENDLVSQAKEEEEDMEALLDTYVMGIGEADAFSERLKQELVALEAANVYQLLESEPLIEEVLQGLDAASATVDDMDEWLRIFNLKLRHMREDIASIESRNNGLEMQSVNNKGLMEELDKLLERLRIPQEFAASLTGGSFEESRMLKNVEACEWLTGAIRSLEVPNLDPCYVNMRAVREKKAELEKLKTTFVRRASEFLRNYFSSLVDFMISDKSYFSQRGQLKRPDHADLRYKCRTYARLLQHLKSLDKSCLGPLRKAYCHSLNLLLRREAREFANELRASTKAPKNPAVWLEGSGGSGHNGSSSDTSQVSDAYSKMLTIFIPLLVDESSFFAHFMCFEVPALVPAGSPNANKSKSGGNDPDDDLGLMDPDGNDLKPDSTSAELGTLNEALQELLDGIQEDFYAVVDWAYKIDPLRCISMHGITERYLSGQKADAAGFVRKLLDDLESRISVQFSRFIDEACHQIERNERNVRQTGILAYIPRFAVLASRMEQYIQGQSRDLIDKAYTKLVSTMFATLEKIAQSDPKTADIVLIENYAAFQNSLYDLANVVPTLAKFYHQASESYELACTRHISSLIYLQFERLFQFNRKVDELTYTIAAEEIPFQLGLSKTDLRRVLKSSLSGIDKSISAMYRRLQKTLTSDELFPSLWDKCKKEFLDKYESFVQMVTRIYGNEPIMSVNEMKDVLAGF

SEQ ID NO: 545 - protein, 501 aa, Zea mays
MPPRTAPAATSTPPRKVPLRKLLRAASVACGVQFGWALQLSLLTPYVQELGIPHAFASLVWLCGPLSGLLVQPLVGHLSDRIGPAASPLGRRRPFIAAGAACIAAAVLTVGFSADLGRLFGDDVTPGSTRLGAICVYLVGFWLLDVGNNGTQGPCRAFLADLTENDPRRTRIANAYFSLFMALGNILGYATGAYSGWYSIFPFTVTESCGISCANLKSAFLLDIIVLVITTYTTVTSVQEPQTFGSDEAQNPGAEQEAFLWELFGSLRYFTLPIWMVLIVTALTWMAWFPFTLFDTDWMGREIYRGSPDNPGETQRYHDGVRMGSFGLMLNSVVLGFTSVVLEKLCRKWGAGLVWGVSNILMTLCFLAMLVITYVAKNMDYPSSGAPPTGIVVASLVVFTILGAPLAITYSIPYAMAASRVENLGLGQGLAMGILNLAIVIPQVIVSLGSGPWDQLFGGGNAPAFAVAAGASFIGGLVAILGLPRARIASSSSRRRGGTHR

SEQ ID NO: 546 - protein, 395 aa, Zea mays
MERSQRQSPPPPSPSSSSSSVSADTVLVPPGKRRRAATAKAGAEPNKRIRKDPAAAAAGKRSSVYRGVTRHRWTGRFEAHLWDKHCLAALHNKKKGRQVYLGAYDSEEAAARAYDLAALKYWGPETLLNFPVEDYSSEMPEMEAVSREEYLASLRRRSSGFSRGVSKYRGVARHHHNGRWEARIGRVFGNKYLYLGTFDTQEEAAKAYDLAAIEYRGVNAVTNFDISCYLDHPLFLAQLQQEPQVVPALNQEPQPDQSETGTTEQEPESSEAKTPDGSAEPDENAVPDDTAEPLTTVDDSIEEGLWSPCMDYELDTMSRPNFGSSINLSEWFADADFDCNIGCLFDGCSAADEGSKDGVGLADFSLFEAGDVQLKDVLSDMEEGIQPPAMISVCN

SEQ ID NO: 547 - protein, 767 aa, Zea mays
MVVGTALLRGVSSAWILLFLSSLLLSPSAASVDFGHCGGCDDADDGALSSTYNILQCQKVSDFLIAAAYFSIPLELLYFATCSDLFPLKWIVLQFGAFIVLCGLTHLITVFTYEPHSFHLVLALTVAKFLTALVSFATAITLLTLIPQLLRVKVRENFLMNKARELDREVGRMKRKEEASWHVRMLTQEIRKSLDRHTILYTTMVELSKALELQNCAVWMPDETRSTMILTHQLRERDIMDPQKHSIPIDDPDVQEIKATKDAKVLGPDSALGVSSRSKHEAGPVAAIRMPMLRVSNFKGGTPEVMQTSYAILVLVLPNDGSLGWGRRELEIVEVVADQVAVALSHAALLEESQLMREKLAEQHRDLLQAKDEAMRAGDARNSFQTAMYDGMRRPMHSILGLVSMMQQESMNPEQRLVMDAIAKTSSVASTLMNDVMQTSTMNCEHLSLVRRPFNLHSFIKEVVGVVRCLTGCKGVEFEFQVENSLPERIIGDEKRVFHIVLHMVGTLTDRCNAGCISLYVNVHNEVEDRHNHDWMLRRANFSGGYVCVKFEIRIRKSKGYLLSSSSSQISQGSKPNNSEMGLSFNMCKKIVQMMNGNIWSVSDSKSIGETIMLVLQFQLEPVTPVSGASSDLYRSSAIPNFNGLRVLLADSDCTNRAVTHRLLEKLGCRVLSVASGVQCISSFAAESSFQLVVLDLDMQTMDGFEVARAIRKFSSNSWLPLIIALAARIDDNIRDRCQRSGVNGLIQKPVTLAALGDELYRVLQNN

SEQ ID NO: 548 - protein, 426 aa, Zea mays
MLLSVPIQMALNPSFRFRAKSTDNDAQDWDLQRAIGLMEVGDARNGSAAAALTKGGADDAARKPLPPCCVKAKARVPETEANCHDTVVSGWFTEPRSRFGKTSKVQYFNNPMWPGEAHSLKVEKILFQGKSPYQEILVFESSTYGNVLVLDGIVQLTDKDECAYQEMVTHLPLCSIPAPKNVLVVGGGDGGVLREIARHDSVETIDICEIDQLVIDVCKEFFPNLSIGFKDPRVRLHVGDAVDFLRNSPEGKYDAIIVDSSDPIGPAQALVEKPFIQTIARALKPGGVLCNLAESMWLHTHLIQDMLAICRQTFKGAVHYAWTSVPTYPSGVIGFLLCAKEGRAVNFLTPVNPIEKIEGTTKAGRELRFYNSEIHRAAFVLPTFVRRELEAYTTPSTSAENEKPKESVSEPQKIKILSNNAILTAS

SEQ ID NO: 549 - protein, 173 aa, Zea mays
MSRSVEPLIVGRVIGEVLDSFNPCVKMIVTYNSNKLVFNGHEIYPSAVVSKPRVAVQGGDLRSFFTLVMTDPDVPGPSDPYLREHLHWIVTDIPGTTDASFGRQIISYESPRPSIGIHRFIFVLFKQQGRQNVTVPSFRDHFNTRQFAEENDLGLPVAAVYFNAQRETAARRR

SEQ ID NO: 550 - protein, 157 aa, Zea mays
MSRSVEPLIVGRVIGEVLDSFNPCVKMIVTYNSNKLVFNGHEIYPSAVVSKPRVAVQGGDLRSFFTLVMTDPDVPGPSDPYLREHLHWIVTDIPGTTDASFGRQIISYESPRPSIGIHRFIFVLFKQQGRQNVTVPSFRDHFNTRQFAEENDLGLPV

SEQ ID NO: 551 - protein, 492 aa, Arabidopsis thaliana
MSDLQANKDAAAVNRQSSSSSADLNGPSPMRKMISVASIAAGIQFGWALQLSLLTPYVQLLGVPHKWSSFIWLCGPVSGLLVQPSVGYFSDRCKSRFGRRRPFIAMGALLVAVAVVLIGYAADFGHSMGDKVDEPVKMRAVVIFALGFWILDVANNTLQGPCRAFLGDLAAGDAKKTRTANAFFSFFMAVGNVLGYAAGSYTNLYKIFPFTMTKACDIYCANLKSCFFLSITLLLVVTIIALWYVEDKQWSPKADSDNEKTPFFGEIFGAFKVMKRPMWMLLIVTALNWIAWFPFLLYDTDWMGREVYGGDSKGDDKMKKLYNQGIHVGGLGLMLNSIVLGFMSLGIEGISRKMGGAKRLWGAVNIILAVCLAMTVLVTKKAEEHRRIAGPMALPTDGIRAGALTLFALLGIPLAITFSIPFALASIISSSSGAGQGLSLGVLNMTIVIPQMVVSFGVGPIDALFGGGNLPGFVVGAIAAAISSVVAFTVLP

SEQ ID NO: 552 - protein, 199 aa, Triticum aestivum
MSPATSSAVGTLSGGLLPHGAHRRRPLPTARLLPPRWSRLQVNAARHRRLATPPRAQSAPSPGYLPDSEFYKIEAILRPWRVSHVSSGLLEMGIRGVTVSDVRGYGAQGGSTERYEGSEFSEDTFIAKVKMEIVVCKEQVEPVIDKIIEKARTGEIGDGKIFLIPVADVVRVRTGERGVHAERMIGGLSDKLPPVITIS

SEQ ID NO: 553 - protein, 957 aa, Klebsiella oxytoca; identical to SEQ ID NO: 540

SEQ ID NO: 554 - protein, 104 aa, Arabidopsis thaliana
MGIQLIGLSQAKQKLQRSLSARIASLLATSGTNNVPKGHVAVYVGETYHRKRFVIPISYLNHPLFQGLLNLAEEEFGFDHPMGGLTIPCTEDYFTALASILSGS

SEQ ID NO: 555 - protein, 339 aa, Zea mays
MPNLECRMYEQRFPEVDAAVMIQVKHIADMGAYVSLLEYNNIEGMILFSELSRRRIRSISSLIKVGRQEPAIVLRVDRDKGYIDLSKRRVSEEEAHACEDRYNKSKLVHSIMRHVAETLEVDLEPLYQRIGWPLYRKYGHAFEAFKLIVADPDAILDVLTYEEKEVGPDGQEVAKVVPAVTPEVKDSLVKNIRRRMTPQPLKIRADIEMKCFQFDGVLHIKQAMKKAEAAGNDNCPVKIKLVAPPLYVLTTQTLDKDQGISVLTDAVKACTAEIEKYKGKLVVKEPPRAVSEREDKLFLDQIDSLMEQNAEVDGDVDSEEEEDTGMGNVDLTNSGVTAY

SEQ ID NO: 556 - protein, 496 aa, Arabidopsis thaliana
MTDYNYIDNMQGLITITLTASFPQLHPASCNSQDPLSCGGPNKLQIGVLLLGLCFLSVGSGGIRPCSIPFGVDQFDQRTEEGVKGVASFFNWYYMTFTVVLIITQTVVVYIQDQVSWIIGFSIPTGLMALAVVMFFAGMKRYVYVKPEGSIFSGIAQVIVAARKKRKLKLPAEDDGTVTYYDPAIKSSVLSKLHRSNQFRCLDKAAVVIEGDLTPEGPPADKWRLCSVQEVEEVKCLIRIVPIWSAGIISLAAMTTQGTFTVSQALKMDRNLGPKFEIPAGSLSVISLLTIGIFLPFYDRVFVPFMRRITGHKSGITLLQRIGTGIVFTIFSMIVAGIVERMRRIRSINAGDPTGMTPMSVFWLSPQLILMGLCEAFNIIGQIEFFNSQFPEHMRSIANSLFSLSFAGSSYLSSFLVTVVHKFSGGHDRPDWLNKNLNAGKLDYFYYLIAVLGVVNLVYFWYCARGYRYKVGLPIEDFEEDKSSDDVEMTSKKSME

SEQ ID NO: 557 - protein, 339 aa, Zea mays
MPNLECRMYEQRFPEVDAAVMIQVKHIADMGAYVSLLEYNNIEGMILFSELARRRIRSISSLIKVGRQEPAIVLRVDRDKGYIDLSKRRVSEEEAHACEDRYNKSKLVHSIMRHVAETLEVDLEPLYQRIGWPLYRKYGHAFEAFKLIVADPDAILDVLTYEEKEVGPDGQEVAKVVPAVTPEVKDSLVKNIRRRMTPQPLKIRADIEMKCFQFDGVLHIKQAMKKAEAAGNDNCPVKIKLVAPPLYVLTTQTLDKDQGISVLTDAVKACTAEIEKYKGKLVVKEPPRAVSEREDKLFLDQIDSLMEQNAEVDGDVDSEEEEDTGMGNVDLTNSGVTAY

SEQ ID NO: 558 - protein, 151 aa, Arabidopsis thaliana
MAPKAGKKPAEKKPAEKAPAEEEKVAEKAPAEKKPKAGKKLPKEAVTGGVEKKKKRVKKSTETYKIYIFKVLKQVHPDIGISSKAMGIMNSFINDIFDKLAQEASKLARYNKKPTITSREIQTAVRLVLPGELAKHAVSEGTKAVTKFTSS

SEQ ID NO: 559 - protein, 1037 aa, Arabidopsis thaliana
MERARRLAYRGIVKRLVNDTKRHRNAETPHLVPHAPARYVSSLSPFISTPRSVNHTAALGRHQQTRSISVDAVKPSDTFPRRHNSATPDEQTHMAKFCGFDHIDSLIDATVPKSIRLDSMKFSKFDAGLTESQMIQHMVDLASKNKVFKSFIGMGYYNTHVPTVILRNIMENPAWYTQYTPYQAEISQGRLESLLNFQTVITDLTGLPMSNASLLDEGTAAAEAMAMCNNILKGKKKTFVIASNCHPQTIDVCKTRADGFDLKVVTSDLKDIDYSSGDVCGVLVQYPGTEGEVLDYAEFVKNAHANGVKVVMATDLLALTVLKPPGEFGADIVVGSAQRFGVPMGYGGPHAAFLATSQEYKRMMPGRIIGISVDSSGKQALRMAMQTREQHIRRDKATSNICTAQALLANMAAMYAVYHGPAGLKSIAQRVHGLAGIFSLGLNKLGVAEVQELPFFDTVKIKCSDAHAIADAASKSEINLRVVDSTTITASFDETTTLDDVDKLFKVFASGKPVPFTAESLAPEVQNSIPSSLTRESPYLTHPIFNMYHTEHELLRYIHKLQSKDLSLCHSMIPLGSCTMKLNATTEMMPVTWPSFTDIHPFAPVEQAQGYQEMFENLGDLLCTITGFDSFSLQPNAGAAGEYAGLMVIRAYHMSRGDHHRNVCIIPVSAHGTNPASAAMCGMKIITVGTDAKGNINIEEVRKAAEANKDNLAALMVTYPSTHGVYEEGIDEICNIIHENGGQVYMDGANMNAQVGLTSPGFIGADVCHLNLHKTFCIPHGGGGPGMGPIGVKNHLAPFLPSHPVIPTGGIPQPEKTAPLGAISAAPWGSALILPISYTYIAMMGSGGLTDASKIAILNANYMAKRLEKHYPVLFRGVNGTVAHEFIIDLRGFKNTAGIEPEDVAKRLMDYGFHGPTMSWPVPGTLMIEPTESESKAELDRFCDALISIREEIAQIEKGNADVQNNVLKGAPHPPSLLMADTWKKPYSREYAAFPAPWLRSSKFWPTTGRVDNVYGDRKLVCTLLPEEEQVAAAVSA

SEQ ID NO: 560 - protein, 271 aa, Zea mays
MDHEEIKDIVRKFPAFAYYSVDRKIKPLVELLLELGVKNSSIPGIIKKRPQLCGISMSDNLKPMMAYLESIGVDKAQWSKVITRFPALLTYSRNKVQTTVSFLAELGVSEKSIGKILTRCPHIMSYSVDDNLRPTAAYFRSIGADAASLIQKSPQAFGLNVEAKLRPTTEFFLARGFSVEEVGVMANRFGIVHTLSLEENLLPKYEFFLAMEYPRCELVKFPQYFGYSLDRRIKPRYARMTGCGVRLILNQMLSVSDARFEKILEKKTARL

SEQ ID NO: 561 - protein, 221 aa, Saccharomyces cerevisiae
MARRPARCYRYQKNKPYPKSRYNRAVPDSKIRIYDLGKKKATVDEFPLCVHLVSNELEQLSSEALEAARICANKYMTTVSGRDAFHLRVRVHPFHVLRINKMLSCAGADRLQQGMRGAWGKPHGLAARVDIGQIIFSVRTKDSNKDVVVEGLRRARYKFPGQQKIILSKKWGFTNLDRPEYLKKREAGEVKDDGAFVKFLSKKGSLENNIREFPEYFAAQA

SEQ ID NO: 562 - protein, 221 aa, Arabidopsis thaliana
MGRRPARCYRQIKGKPYPKSRYCRGVPDPKIRIYDVGMKRKGVDEFPFCVHLVSWEKENVSSEALEAARIACNKYMVKSAGKDAFHLRIRVHPFHVLRINKMLSCAGADRLQTGMRGAFGKALGTCARVAIGQVLLSVRCKDNHGVHAQEALRRAKFKFPGRQKIIVSRKWGFTKFNRAEYTKLRAMKRIVPDGVNAKFLSNHGPLANRQPGSAFISATSE

SEQ ID NO: 563 - protein, 222 aa, Glycine max
MGRRPARCYRQIKNKPYPKSRFCRGVPDPKIRIYDVGMKKKGVDEFPFCVHLVSWEKENVSSEALEAARIACNKYMAKFAGKDAFHLRVRVHPFHVLRINKMLSCAGADRLQTGMRGAFGKPQGTCARVAIGQVLLSVRCKDSNSHHAQEALRRAKFKFPGRQKIIVSRKWGFTKFSRSDYLKFKSENRIVPDGVNAKLLGCHGPLANREPGRVFLDTATSS

SEQ ID NO: 564 - protein, 485 aa, Glycine max
MLREKRESALKMGKFSSSYSTSDFVHFGVLLPFLLLSQLFFQLAWCGSIVKFLPGLEGPLPFVLETGYVGVGESEDVQAFYYFIESENNPKEDPLMLWLTGGPGCSAFSGLVIEIGPIAFKNEEYNGSLPNLVLRPHSWTKVSSIIFVDLPVSTGFTYATTEFATQRSDWIQVHQVHQFLRKWLIEHPNFLSTDVYIGGDSYSGITIPAIVQEISLGNEKGLQPWINLQGYLLGNPATTRRHENYRISFAHGMGLISDELYRSLQKNCKGEYINVDTKNVLCSRNIETFNEVTSGLSMVNILDPSCDWLDTETSWRRSLLKKYPRKNFLNTHLKLPSLNCRSYAYFLCGYWANDDSVRSALHIRKGTIGKWRRCTFNIPNKEDISSSYEYHVNLSRKGYRSLIYSGDHDMKIPFLETQAWISSLNYSIVDDWRQWHTDGQVAGYTRTYSNRMTFATVKGGGHTAPEYKPEECLAMFRRWISNKAL

SEQ ID NO: 565 - protein, 314 aa, Glycine max
MMASPTSPRVLFLSLFVTLSMILHLSSARKLSESDPQLQFQYHRGPLLTGKISVNLIWYGKFKPSQKAIVADFITSLSSSKPLTAQPSVATWWKATDKYYKNSFPKLALSLGSQIVDENYSLGKSLTTNQILKLASKGPQRNAINIVLTSAEVAVEGFCSSRCGTHGSSVGARVNGKRYKFAYMWVGNSETQCPGQCAWPFHQPIYGPQNPAPLVAPNNDVGLDGMVINVASLLAGTVTNPFGNGYFQGPKEAPLEAGSACTGVYGKGAYPGYAGNLLVDPTTGASYNANGVNGRKYLLPALVDPKTSSCSTLV

SEQ ID NO: 566 - protein, 464 aa, Glycine max
MVTCAVKGGCPSDYIAIALSILSITVLLLWSIFPFLVHKVPRTKGSGFWLPVIQVVASFNLLLSIVMSNNFLKMGKRHWLRSCYLWGVWVEGPLGFGLLLSCRITQASQLYFIFVKRRLPLIRSYIFLPLILLPWIAAGGVIHSMKPLSSRCHMKAQWTIPVVCLHSLYIAILVGVTAAVHHIEFRFDELKDLWRGILVSVVSIAVWVTAYILNEIYDNISWIEVASRFLLLVVASILVVAFFSISSSQPLLSQISLRRRESREFRTMSQALGIPDSGVLAESEPISRIDPNEPLDKLLLNKRFRQSFMAFADSCLAGESVHFFDEVYELSKIPEDDCVKRIYMARHIIEKYIVAVAAMEVNISHRSRQEILSTSNLTRPDLFHNALNEIIQLMRTNLARDYWSSMFFLKFQEDSNVRSNEYELEQITGWNFSPRLSSVHGTDDPFHQDHLLKSSGCSNDTTNL

SEQ ID NO: 567 - protein, 177 aa, Zea mays
MQEEPGRRPVPPFAGVDLRRPKGYPVAVAKEERPAPGGDPCPRCGSRDTKFCYYNNYNTSQPRHLCKSCRRYWTKGGSLRNVPVGGGTRKSSSSSSSSSAAAAATTTTTSTSPGAAPKATKRSKNSKRRRVAPAPDPAAPGTDASTADVASTAPSTVAASEKPSATEHAAAAVATRS

SEQ ID NO: 568 - protein, 516 aa, Arabidopsis thaliana
MALLLVSSSSSYALRVTIFLSFFFFLCNGFSYPTTSSLFNTHHHRHHLAKHNYKDALTKSILFFEGQRSGKLPSNQRMSWRRDSGLSDGSALHVDLVGGYYDAGDNIKFGFPMAFTTTMLSWSVIEFGGLMKSELQNAKIAIRWATDYLLKATSQPDTIYVQVGDANKDHSCWERPEDMDTVRSVFKVDKNIPGSDVAAETAAALAAAAIVFRKSDPSYSKVLLKRAISVFAFADKYRGTYSAGLKPDVCPFYCSYSGYQDELLWGAAWLQKATKNIKYLNYIKINGQILGAAEYDNTFGWDNKHAGARILLTKAFLVQNVKTLHEYKGHADNFICSVIPGAPFSSTQYTPGGLLFKMADANMQYVTSTSFLLLTYAKYLTSAKTVVHCGGSVYTPGRLRSIAKRQVDYLLGDNPLRMSYMVGYGPKFPRRIHHRGFSLPCVASHPAKIQCHQGFAIMNSQSPNPNFLVGAVVGGPDQHDRFPDERSDYEQSEPATYINSPLVGALAYFAHAYGQL

SEQ ID NO: 569 - protein, 87 aa, Zea mays
MSSGGRRGRISDDEINELISKLQALLPESSRRRNASRSSASKLLKETCAYVKSLHREVDDLSERLSGLMETMDNDSPQAEIIRSLLR

SEQ ID NO: 570 - protein, 275 aa, Arabidopsis thaliana
MATTTAAAAGIFGIRIQDPRPGTGRVQARFGFSFGKKKPAPPPKKSRQVQDDGDRLVWFPGANPPEWLDGSMIGDRGFDPFGLGKPAEYLQYDFDGLDQNLAKNVAGDIIGIIQESSEIKPTPFQPYTEVFGIQRFRECELIHGRWAMLGTLGAIAVEALTGIAWQDAGKVELVEGSSYLGQPLPFSLTTLIWIEVLVVGYIEFQRNSELDPEKRIYPGGYFDPLGLAADPEKLDTLKLAEIKHSRLAMVAFLIFALQAAFTGKGPVSFLATFNN

SEQ ID NO: 571 - protein, 232 aa, Zea mays
MLRLSRFLPSACRRGFDLKESLWSGSLTFQQAVSTAATNLDGNLSGKKFASYTVFKGKAALSIHPILPSFSKLESGGSRVSKNGSVMLTFFPAVGQRKYDYTKKQLFALSPTEVGSLISLGPAESCEFFHDPSMKSSNEGTVKKSLSITPLGSDSGYFVNITVVNSAERTNDRLSVPITKAEFAVIRTTLSFALPHIMGWDQALTNHHPAPAPPASSRPTVERPHPDSEWER

SEQ ID NO: 572 - protein, 135 aa, Arabidopsis thaliana
MIREFSSLQNDIINIQEHYSLNNNMDVRGDHNRKNTSFRGSAPAPIMGKQELFRTLSSQNSPRRLISASYFSLESMVVLVGLTASLLILPLILPPLPPPPFMLLLIPIGIMVLLMVLAFMPSSNSKHVSSSSTFM

SEQ ID NO: 573 - protein, 450 aa, Zea mays
MAAVAAAPRPQLPMLSGGGGAALSSLTLQTLAFISPLPISRCHRCVLRSNASSSPSPPPSQEEAAAAEVVPTAESCVNLGLQLFSKGRVKDALEQFENALELNPTSIEAQAALYNKACCHAYREESKKAAECLREALRDYNLKFGTILNDPDLAPFRASPEFKELQEEALRGGEDIGSGFRRDLKLISEVQAPFRGVRRFFYVALTAAAGISTFFTIPRLVLAVRGGDGAPDLLETAGNAAINIGGIVVLVALYFWENKKEEKQITQISRNETLSRLPVRLSTNRIIELVQLRDITRPVILAGSKASVTRALQRAERYRTELLKRGVLLIPVIFGASQKDQTKPRGFGARRAAASVPSVGGDFEKRTESIAAKSRLKTEVRFKADIVSPEQWESWIRDQQVSEGVTPGEDVYIILRLDGRVRRSGIGMPNWNDILQELPRLEDLMSKLER

SEQ ID NO: 574 - protein, 92 aa, Glycine max
MSSRRSRQHSGSTRISDDQIIELVSKLRQLVPEIRNRRSDKVSASKVLQETCNYIRSLHREVSDLSERLSQLLTTIDADSAEAGIIRSLLNQ

SEQ ID NO: 575 - protein, 99 aa, Glycine max
MMAAGGRNSNFGASDVYGLSASRGPTPRPSNYDEDGGKPKFHYHAGGTGHYPAPNPGMFSPSNGSKSVAAANANANAKRPNGQAQLKPEDGNRDLHMFV

SEQ ID NO: 576 - protein, 92 aa, Glycine max
MSSRRSRQHSGSTRISDDQIIELVSKLRQLVPEIRNRRSDKVSASKVLQETCNYIRGLHREVSDLSERLSQLLTTIDADSAEAGIIRSLLNQ

SEQ ID NO: 577 - protein, 136 aa, Zea mays
MARTKQTARKSTGGKAPRKQLATKAARKSAPATGGVKKPHRFRPGTVALREIRKYQKSTELLIRKLPFQRLVREIAQDFKTDLRFQSSAVAALQEAAEAYLVGLFEDTNLCAIHAKRVTIMPKDIQLARRIRGERA

SEQ ID NO: 578 - protein, 372 aa, Zea mays
MAHLISSAIAGAGNLVADGISGVTGVASQVVEGVEDTLGSIVEAIDQGVKDEDQLDLPKYVCFKGDNGLYLSARTVEGHPYLQFASEDIGDPSVRFITYNHKVNGKRVVRFKSNHLGKFWRRSPNWIWADTDDTSTNNSDTLFEVIKIDEDGVYALRNLGNNHFCHRLTYDGKESCLNATIPTIRKEAHIKIEEAVLSRKISNIEYHLKGAKIFDKKAKTLITREAVNGTSTDSKTTITLKYSVIKGKLWDSSKSMKLGVTTTIEAGVPVVLPATIEVQSEFNSTYSWGESIIEKEEYSNAYEVVVPAYSVVTVSVLATQGICQVPFSYTQEDVLTTGERKVFKFDDGIFRGVNSFGFKSEVTERKLSKDDD

SEQ ID NO: 579 - protein, 143 aa, Zea mays
MVHGTLEVLLVGAKGLENTDYLCNMDPYAILKCRSQEQKSSIATGKGTTPEWNENFIFTVSDRTTDLVIKLMDSDTGTADDFVGEATIPLEAVYTERSIPPTLYNVVKGEKYCGEIKVGLTFTPEDTRQRGLPEDFGGWKQSS

SEQ ID NO: 580 - protein, 1002 aa, Zea mays
MAMAPSTAAASTLLPVLLLIATATQCTAADSFSSQDAAALLNLSAAVADPSGYLSTHWTPDTAVCSWPRVSCDATDTRVISLDLSGLNLSGPIPAAALSSFPYLQSLNLSNNILNSTAFPDEIIASLKSLRVLDLYNNNLTGSLPAALPNLTDLVHVHLGGNFFSGSIPRSYGQWSRIRYLALSGNELTGEIPEELGNLTTLRELYLGYYNNFTGGIPPELGRLRALVRLDMANCGISEEIPPELANLTSLDTLFLQINALSGRLPTEIGAMGSLKSLDLSNNLFVGEIPASFASLKNLTLLNLFRNRLAGEIPEFIGDLPNLEVLQLWENNFTGGIPTNLGVAATRLRIVDVSTNKLTGVLPSELCAGQRLETFIALGNSLFGDVPDGLAGCPSLTRIRLGENFLNGTIPAKLFTLPNLTQVELHNNLLSGELRLDGGKVSSSIGELSLFNNRLTGQVPTGIGGLLGLQKLLLAGNMLSGELPPEVGKLQQLSKADLSGNLLSGAVPPAIGRCRLLTFLDISSNKLSGSIPPELGSLRILNYLNVSHNALQGEIPPAIAGMQSLTAVDFSYNNLSGEVPSTGQFGYFNATSFAGNAGLCGAFLSPCRSVGVATSALGSLSSTSKLLLVLGLLALSVVFAGAAVLKARSLKRSAEARAWRLTAFQRLDFAVDDVLDCLKEENVIGKGGSGIVYKGAMPGGAVVAVKRLPAIGRAGAAHDDYGFSAEIQTLGRIRHRHIVRLLGFAANRETNLLVYEYMPNGSLGEVLHGKKGGHLQWATRFKIAVEAAKGLCYLHHDCSPPILHRDVKSNNILLDADFEAHVADFGLAKFLRGNAGGSECMSAIADSYGYIAPEYAYTLKVDEKSDVYSFGVVLLELIAGRKPVGEFGDGVDIVHWVRTVTGSSKEGVMKIADPRLSTVPLYELTHVFYVAMLCVAEQSVERPTMREVVQILADMPGSTSTTSIDVPLVIEPKEEDGGPEKKQQQQQEGPHDSPPQQDLLSI

SEQ ID NO: 581 - protein, 691 aa, Zea mays
MEASAGSSPPHSQKNPPEHGGDMGGAPAEEIEGEAADDFMFAEDTFPSLPDFPCLSSPSSSTFSSNSSSNSSSAYTNTAGRAGGEPSEPASAGEGFDALDDIDQLLDFASLSMPWDSEPFPGVSMMLENAMSAPPQPVGDGMSEEKAVPEGTTGGEEACMDASEGEELPRFFMEWLTSNRENISAEDLRGIRLRRSTIEAAAARLGGGRQGTMQLLKLILTWVQNHHLQRKRPRDVMEEEAGLHGQLPSPVANPPGYEFPAGGQDMAAGGGTSWMPHQQAFTPPAAYGGDAVYPSAAGQQYSFHQGPSTSSVVVNSQPFSPPPVGDMHGANMAWPQQYVPFPPPGASTGSYPMPQPFSPGFGGQYAGAGAGHLSVAPQRMAGVEASATKEARKKRMARQRRLSCLQQQRSQQLSLGQIQASVHLQEPSPRSTHSGPVTPSAGGWGFWSPSSQQQVQNPLSKSNSSRAPPPSLEAAAVAPQTKPAPAGARQDDIHHRLAAASDKRQGAKADKNLRFLLQKVLKQSDVGSLGRIVLPKKEAEVHLPELKTRDGISIPMEDIGTSRVWNMRYRFWPNNKSRMYLLENTGEFVRSNELQEGDFIVIYSDVKSGKYLIRGVKVRPPPAQEQGSGSSAGGKHRPLCPAGPERAAAAGAPEDAVVDGVSGACKGRSPEGVRRVRQQGAGAMSQMAVSI

SEQ ID NO: 582 - protein, 285 aa, Glycine max
MVSQWNDCSCHRRHSWDRVFIILSFSIQLTFSFLIITHFKFCFRHSIVSDLAAFGAAVHTCSRTQTELNKCLQEWQSQGFQVTGSLCDVSSPPQREKLIQEVASTFNGKLNIYVNNVGINIRKPTIEYTAEEYSQIMTVNLDSSFHLCQLAYPLLKASEKGSIVFISSVAGVVSLGTGAVFAASKAAINQLTKNLACDWAKDNIRSNCVVPWATRTPVVEHLFKDQKFVDDIMSRTPIKRIAEPEEVSSLVTFLCLPAASFITGQVICVDGGLTVNGFQPSMRIT

SEQ ID NO: 583 - protein, 462 aa, Glycine max
MFCNFHIILLIALALLVQISSQLGSKVEVLPGFEGPLPFELETGYVGLGEKDDDMQVFYYFVKSENDPQKDPLMLWLTGGPGCSSFSGLAFQIGPLRFKIEEYDGSVPNLILRPQSWTKVCNIIFVDLPFGTGFSYAKNLTAQRSDWKLVHHTHQFLRKWLIDHPEFLSNEFYMGADSYSGIPAPAIVQEISNGNEKGLQPRINLQGYLLGNPITTRNEGNDQIPFAHGMGLISDELYASLQRNCKGEYENRDSRNVLCLRDLKHYDECLSGINTFYILDRYCKSDSPKKHEAQWRRSLTQKFEASLNSHLRVPDIRCQIFGFFLATQWANDESVRKSLHIREGTIGKWERCYTTDFEEQIFSSFEFHVNLSAKGYRSLIYSGDHDAVVPFMSTQAWIRALNYSIVEDWRPWLLEDQVAGYTRIYSNQMTFATVKGSGHTAPEYKPEEGFAMFSRWIANMPL

SEQ ID NO: 584 - protein, 770 aa, Zea mays
MDTPDRPRAAAAAGFEDSPVFNFINNLSPIPPPKPLDSAHNVQLFKSSDLAPVSSIFASPHVNPVKETKVLIRDESVHLPQELHSPSSVRTRIDTSGSFRMIRCKDIVSDNCNITCQLNEASIDSSDHTSNSTGQLTQSIQDAAGSMESDKDQCDANKTDLTISQECTGLEGMNLDESGPDKMDSSHSGIVVHENQLSEQNNDEPAAYNEGYIITHQSTSDMLTLAIPSGTETQPVNDTQMADNPYSCESLLDDQSSGYCTQNSVHEPHLYWTGAVEGSAVSYTPQTLPGALQSQLMPCNKLSEPKDYVPTEQNALSQHLRGMRRRSLFNEKAGISNKGVDKTSDHHPVNSTTPKCKTISGDNSKPLRTPPCALPGIGLHLNALATIPKEKIVPREIQSTINESSNLIGPAGSSPAPFEQNIINDDFTQTTDVATAEASSQGSPKKKRHKFDNGDGTSCKRCSCKKSKCLKLYCECFAAGVYCSEPCSCIGCQNNQSHMETVLSTRQQIESRNPLAFAPKVIHTSEPGMDLGDFSNKTPASARHKRGCNCKKSSCLKKYCECFQGGVGCSVSCRCEGCKNAFGKREGASVLGIGEPKQGLEEKDVCVKEEKSEIDKQLVVYQTTDAAPAENVLTTPSMVECRPLACLPPASSKKSSKKPRSSTKLTGHPSRPCNLQAPPKTDVVLSPFENYAEMVLGDSTSDILKGNSSPHTSVKVVSPNKKRISPPRMGIGLSPICRSGRKLILKSIPSFPSLGGDVNNEDPKAKLPAP

SEQ ID NO: 585 - protein, 266 aa, Zea mays
MPPPAPLFLSLASTPPPALMPVHHPRAPQSLSLVPAVASSRKAAAVLACPVASPRHSDYFDPRAPPPPRGDGGYGRPPNGAQDGRVFTSYSIYKGKAALSFDPRPPLFVPLDSGAYKVAKEGFVLLQFAPAVATRQYDWTRKQVFSLSVWEIGTLLTLGPTDSCEFFHDPFKGRSEEGKVRKVLKIEPTPDGNGRFFNLSVQNRLINVDESIYIPITKGEFAVIVSTFNYIIPHLMGWSTFVSSIKPEESRPYSRPQSTSEYEWRR

SEQ ID NO: 586 - protein, 162 aa, Zea mays
MAMRALPLTPSRSSSFGAHQTRPSGGGPRSVRAYAKGDEEGDKQSLFGSITEALDFSQVRSEKDAELLYEARESTRGGGRMTREQYGALRRKIGGTYQDFFKSYVEVDGQYVEEGWVDKTCKICKKDTRGEPRQVDKLGRYAHVACLENPKPTNFFAKIFAR

SEQ ID NO: 587 - protein, 516 aa, Arabidopsis thaliana
MALLLVSSSSSYALRVTIFLSFFFFLCNGFSYPTTSSLFNTHHHRHHLAKHNYKDALTKSILFFEGQRSGKLPSNQRMSWRRDSGLSDGSALHVDLVGGYYDAGDNIKFGFPMAFTTTMLSWSVIEFGGLMKSELQNAKIAIRWATDYLLKATSQPDTIYVQVGDANKDHSCWERPEDMDTVRSVFKVDKNIPGSDVAAETAAALAAAAIVFRKSDPSYSKVLLKRAISVFAFADKYRGTYSAGLKPDVCPFYCSYSGYQDELLWGAAWLQKATKNIKYLNYIKINGQILGAAEYDNTFGWDNKHAGARILLTKAFLVQNVKTLHEYKGHADNFICSVIPGAPFSSTQYTPGGLLFKMADANMQYVTSTSFLLLTYAKYLTSAKTVVHCGGSVYTPGRLRSIAKRQVDYLLGDNPLRMSYMVGYGPKFPRRIHHRGSSLPCVASHPAKIQCHQGFAIMNSQSPNPNFLVGAVVGGPDQHDRFPDERSDYEQSEPATYINSPLVGALAYFAHAYGQL

SEQ ID NO: 588 - protein, 335 aa, Glycine max
MADESVVESPVKRQRDDDEENEVSVSMDVEGGKDPLSNGLSSVIPGWFSEISSMWPGEAHSLKVEKILFQGKSEYQNVMVFQSSTYGKVLVLDGVIQLTERDECAYQEMITHLPLCSIPNPKKVLVIGGGDGGVIREVAHHSSVEKIDICEIDKMVVDVSKQYFPDVAVGYDDPRVTLHIGDGVAFLKEVPEGTYDAVIVDSSDPIGPAQELFEKPFFSSVAKALRPGGVVCTQAESIWLHMDIIEDIVANCRQIFKGSVNYAWTTVPTYPSGMIGFMLCSTEGPPVDFKHPVNPIDENESQKSVRPLKFYNSEIHTAAFCLPSFAKRKIGSKAN

SEQ ID NO: 589 - protein, 128 aa, Zea mays
  misc_feature (82)..(82): Xaa can be any naturally occurring amino acid
  misc_feature (116)..(116): Xaa can be any naturally occurring amino acid
MSGRGKGGKGLGKGGAKRHRKVLRDNIQGITKPAIRRLARRGGVKRISGLIYEETRGVLKIFLENVIRDAVTYTEHARRKTXHRHGRRLRAQAAGPHPLRIWRLRGQGCPPASAGXWQKSWVAVTKWS

SEQ ID NO: 590 - protein, 461 aa, Arabidopsis thaliana
MDPCPFIRLTIGNLALKVPLAAKTTSSVVHPSSSPCFCKIKLKNFPPQTAAIPYIPLETTQFPEIQTLAATFHLSSSDIQRLASRSIFTSKPCLKILIYTGRAGAACGVHSGRLLAKVSVPLDLSGTQSKPCVFHNGWISVGKGAGKSSSSAQFHLNVKAEPDPRFVFQFDGEPECSPQVVQIQGNIRQPVFTCKFSCRHTGDRTQRSRSLPTETSVSRSWLNSFGSERERPGKERKGWSITVHDLSGSPVAMASIVTPFVASPGTDRVSRSNPGSWLILRPGDCTWRPWGRLEAWRERGGATDGLGYRFELIPDGSSGAGIVLAESTISSHRGGKFSIELGSSPSSSSPTSVVNRSRSRRGGSSGSGGGASPANSPRGGSGDYGYGLWPWNVYKGFVMSASVEGEGKCSKPCVEVSVQHVSCMEDAAAYVALSAAIDLSMDACRLFNQRMRKELCHESLS

SEQ ID NO: 591 - protein, 255 aa, Oryza sativa
MGRQPCCEKVGLKKGPWTADEDQKLVTFLLSNGHCCWRLVPKLAGLLRCGKSCRLRWTNYLRPDLKRGLLSEEEEKLVIDLHEQLGNRWSKIAARLPGRTDNEIKNHWNTHIKKKLKKMGLDPVTHRPVMSLAQPDPLKQQQQQHEPSVSGGTGADDKEEEEEETPTSAQPQGVACAASSASAVSSSCSSSAPASAATPGADVDWPGLFEVDAILDIDWAGLLSACGDDGGCSAIGVDMLFDQCSDVGFDQDVWM

SEQ ID NO: 592 - protein, 1037 aa, Arabidopsis thaliana
MERARRLAYRGIVKRLVNDTKRHRNAETPHLVPHAPARYVSSLSPFISTPRSVNHTAAFGRHQQTRSISVDAVKPSDTFPRRHNSATPDEQTHMAKFCGFDHIDSLIDATVPKSIRLDSMKFSKFDAGLTESQMIQHMVDLASKNKVFKSFIGMGYYNTHVPTVILRNIMENPAWYTQYTPYQAEISQGRLESLLNFQTVITDLTGLPMSNASLLDEGTAAAEAMAMCNNILKGKKKTFVIASNCHPQTIDVCKTRADGFDLKVVTSDLKDIDYSSGDVCGVLVQYPGTEGEVLDYAEFVKNAHANGVKVVMATDLLALTVLKPPGEFGADIVVGSAQRFGVPMGYGGPHAAFLATSQEYKRMMPGRIIGISVDSSGKQALRMAMQTREQHIRRDKATSNICTAQALLANMAAMYAVYHGPAGLKSIAQRVHGLAGIFSLGLNKLGVAEVQELPFFDTVKIKCSDAHAIADAASKSEINLRVVDSTTITASFDETTTLDDVDKLFKVFASGKPVPFTAESLAPEVQNSIPSSLTRESPYLTHPIFNMYHTEHELLRYIHKLQSKDLSLCHSMIPLGSCTMKLNATTEMMPVTWPSFTDIHPFAPVEQAQGYQEMFENLGDLLCTITGFDSFSLQPNAGAAGEYAGLMVIRAYHMSRGDHHRNVCIIPVSAHGTNPASAAMCGMKIITVGTDAKGNINIEEVRKAAEANKDNLAALMVTYPSTHGVYEEGIDEICNIIHENGGQVYMDGANMNAQVGLTSPGFIGADVCHLNLHKTFCIPHGGGGPGMGPIGVKNHLAPFLPSHPVIPTGGIPQPEKTAPLGAISAAPWGSALILPISYTYIAMMGSGGLTDASKIAILNANYMAKRLEKHYPVLFRGVNGTVAHEFIIDLRGFKNTAGIEPEDVAKRLMDYGFHGPTMSWPVPGTLMIEPTESESKAELDRFCDALISIREEIAQIEKGNADVQNNVLKGAPHPPSLLMADTWKKPYSREYAAFPAPWLRSSKFWPTTGRVDNVYGDRKLVCTLLPEEEQVAAAVSA

SEQ ID NO: 593 - protein, 578 aa, Zea mays
MASSTAASPLTCHHLGSVGARPRLPSLSISLRRRSSSSSKPTSLSHSLPSKHSLAPPPAASASSRRGLTPVPASASAAAAPAPDPVPVPAPAPAPAPAPAAPPKKPALQGAAIKPLLASIATGVLIWLIPPPAGVPRNAWQLLAIFLSTIVGIITQPLPLGAVALLGLGAAVLSRTLTFAAAFSAFGDPIPWLIALAFFFARGFIKTGLGSRVAYAFVAAFGSSSLGLGYSLVFAEALLAPAIPSVSARAGGIFLPLVKSLCEACGSRAGDGTERRLGAWLMLTCFQTSVVSSAMFLTAMAANPLSANLTAATIGEGIGWTLWAKAAIVPGLLSLVLVPLILYVIYPPEVKASPDAPRLAKERLAKMGPMSKEETIMAGTLLLTVGLWIFGGMLNVDAVSAAILGLAVLLISGVVTWKECLAESVAWDTLTWFAALIAMAGYLNKFGLISWFSETVVKFVGGLGMSWQLSFGVLVLLYFYSHYFFASGAAHIGAMFTAFLSVASALGTPSLFAAMVLSFLSNLMGGTTHYGIGSAPVLYGAGYVPLAQWWGYGFVISVVNIIIWLGVGGFWWKIIGLW

SEQ ID NO: 594 - protein, 319 aa, Zea mays
MDLVVESVVHGRLPVRPSRFPLLPGSLPSTTVALSAAFSGRPCPPIVRRNAPAVVPFAKKKRNEYIEDPPDEEVADDFTDEMEEDFDDAKEDEGDVMDDDEEYEDDYDFEDDFESDDEQDLYAGDGGAGGGISLAGAWWDKEALALAEQVSASFNDDLKIYAFKTAANLTIRVRIEKMSTRYGSPTIDDIEAYTIAYRAKLDEAESAGKIPKNISLEVSSPGVERVIRIPEELERFKERAMYVRYTTASDEATTPQEGDGVLTLISYDMDLRECTWGIADVKINRQQSGKGRPLSKKQREWRLQTPFESLKLVRLYSEC

SEQ ID NO: 595 - protein, 381 aa, Zea mays
MATAAAASRVAVSAPVFGSDGGARSSGIKGNNNVSFGSKSWVGGTLAWESSCSVRPRHASKVLCMSVQQASRSKVSVAPLHLESAKEPPLNTYKPKEPFTATIVSVESLVGPKAPGETCHIVIDHGGNGPYWEGQSYGVIPPGENPKKPGAPQNVRLYSIASTRYGDNFDGRTGSLCVRRAVYYDPETGKEDPSKNGVCSNFLCNSKPGDKIQLTGPSGKIMLLPEEDPNATHIMIATGTGVAPFRGYLRRMFMEDVPNYRFGGLAWLFLGVANSDSLLYDEEFTSYLKQYPDNFRYDKALSREQKNRSGGKMYVQDKIEEYSDEIFKLLDGGAHIYFCGLKGMMPGIQDTLKKVAERRGESWDQKLAQLKKNKQWHVEVY

SEQ ID NO: 596 - protein, 794 aa, Arabidopsis thaliana
MVHSESSILSSLRGGDGGGIPCSKDELAINGSYTDPMGRRKSKRFKVAAESEFSPDFGSITRQLRSRRMQKEFTVETYETRNVSDVCVLSSQADVELIPGEIVAERDSFKSVDCNDMSVGLTEGAESLGVNMQEPMKDRNMPENTSEQNMVEVHPPSISLPEEDMMGSVCRKSITGTKELHGRTISVGRDLSPNMGSKFSKNGKTAKRSISVEEENLVLEKSDSGDHLGPSPEVLELEKSEVWIITDKGVVMPSPVKPSEKRNGDYGEGSMRKNSERVALDKKRLASKFRLSNGGLPSCSSSGDSARYKVKETMRLFHETCKKIMQEEEARPRKRDGGNFKVVCEASKILKSKGKNLYSGTQIIGTVPGVEVGDEFQYRMELNLLGIHRPSQSGIDYMKDDGGELVATSIVSSGGYNDVLDNSDVLIYTGQGGNVGKKKNNEPPKDQQLVTGNLALKNSINKKNPVRVIRGIKNTTLQSSVVAKNYVYDGLYLVEEYWEETGSHGKLVFKFKLRRIPGQPELPWKEVAKSKKSEFRDGLCNVDITEGKETLPICAVNNLDDEKPPPFIYTAKMIYPDWCRPIPPKSCGCTNGCSKSKNCACIVKNGGKIPYYDGAIVEIKPLVYECGPHCKCPPSCNMRVSQHGIKIKLEIFKTESRGWGVRSLESIPIGSFICEYAGELLEDKQAESLTGKDEYLFDLGDEDDPFTINAAQKGNIGRFINHSCSPNLYAQDVLYDHEEIRIPHIMFFALDNIPPLQELSYDYNYKIDQVYDSNGNIKKKFCYCGSAECSGRLY

SEQ ID NO: 597 - protein, 201 aa, Methanopyrus kandleri
MNSVRTADVKRTTKETEVEVSVNLDGSGRAKVDTGLPFFDHLLHQFAFHGRIDVEIKARGDLEVDDHHTVEDVGICLGKALNEALGDREGIRRIAWALVPMDEALVECAVDISGRPYFVLKGYRPRRNRIGSPPLSTENVSHFWKSFCDHAGVTMHVVVRWWDNDHHAIEAMFKAVGRALGAAKEIVGDGVPSTKGTLRRG

SEQ ID NO: 598 - protein, 105 aa, Thermococcus kodakarensis
MKKVEAVLRPEDFETVKKALKSAGYVSLTAYPVQGRGVQGGIPPYDLLPKMKIEIVVPDKDVDDVIGIIVRHARRGIPGDGKIFVLPVYDVVRIRTGERGEEALH

SEQ ID NO: 599 - protein, 112 aa, Aquifex aeolicus
MKKIEAIIKPFKLDEVKDALVEIGIGGMTVTEVKGFGQQKGHTEIYRGTEYVIDFLPKVKIEVVVRDEDVEKVVETIVKTAQTGRVGDGKIFIIPVEDVIRIRTGERGEQAI

SEQ ID NO: 600 - protein, 56 aa, Arabidopsis thaliana
  misc_feature (53)..(53): Xaa can be any naturally occurring amino acid
TCARVAIGQVLLSVRCKDNHGVHAQEALRRAKFKFPGRQKIIVSTKWGFTKFXRAE

SEQ ID NO: 601 - protein, 189 aa, Oryza sativa
MGAHTIILIQSLCLIISFFFLMGVSAQKVSVPSNSMLNIVTVRCGHCTSLLSVNLRGLVQALPAEDHLQDNLKMHNMSFRENYSEYGSSSRYGRVPMMFSKNDTEHMLHVRPPEKRQRVPSAYNRFIKEEIRRIKANNPDISHREAFSTAAKNWAHFPNIHFGLGSHESSKKLDEAIGAPSPQKVQRLY

SEQ ID NO: 602 - protein, 368 aa, Desulfitobacterium hafniense
MKIKVSRIFLSVTMLIFLSIVGTGCSEAAVPAESAKRFPYNPNMGVSYEGKELQEIWIAGGCFWDVDAYLSRIYGVADVTVGYANGNTENPTYEDVCYRDSGHAETAYVRYDPERVDLETILEYFFKIIDPTSLNRQGNDVGTQYRTGIYYQNELDREIILKVITEEQNKYKKPIVTEVLPLAHFYEAEEYHQDYLVKNPHGYSHIDFSPLEEQKLVNIDPGLYNKPSDDVLRKTLTDLQYAVTQKDATERSFANDYWDHHEQGLYVDVVTGEPLFASKDKFDSGTGWPSFTRPIAPEVIIEKEDSTLGMKRIEVRSRAGDSHLGHLFNDGPPEDGGLRYCINSAALRFIPLSELKEEGYGQYLSRIE

SEQ ID NO: 603 - protein, 563 aa, Cryptococcus neoformans
MSIERADCSLPYEKSSAEKDSGPHVYQGEAIVYPNDGSENVIPREEETHRALSPRQLSMIALGGAIGTGLVIGSGTSLARSGPASLFISYVVMGTVCCGVMMALGEMSTKYPSKKGFAGHATRCVDPAFGFCTALVYLCKYLIISPNQIVAGSLVIRYWNDSINGAAWVTIFIVFVIAINCLGVKWFGEIEFWLSFTKIITLTGLILLALIIDLGGVPGQERIGFRYWEHGRAFKAYKATGDLGKFLGFVNALVLALFAYIGTELIGVTVGEAKNPRKTVPSAIRKTFLRIIFFYVLSSLLVGMIVDSSSPLLAQAAKKGTSGGASASPFVVAIESAGIKVLPAIINACILIFTISAANSDQYIASRTLYGMAKDGSMPRIFTKCTSRGVPWVAFIFTAMFMGLAYLVASSDALSVFNYFVNSVTIFGGLTWISILSSHVAFMRGMKAQGISRDSLPYKSPFQPYFTYCSLFLTCLVCFFKGFDGFMPWDYKSFITNYIGIPIYVFAYIGFKVIRKTKAVKMWEMDLTTGAREFHDLNEETEEEQQYKSMSFKQKVIYQIKNW

SEQ ID NO: 604 - protein, 325 aa, Nitrosomonas europaea
MSTSERPPSPSSMAEDFAVEPLSPDFGFYLRTTELLAERHSPVQHIEIVQTPLFGRAMRIDGCFMTSEQDEFFYHEPMVHLPAITHGDPRQALVVGGGDGGTAYNLLRYPNMERVVLAELDRDVIDMARTWLPKVHRGAFEDPRLELHLGDGRAFTGNCKNQFDQIVLDLTDPFGPAISLYTRDFYRACRRALKPGGVLSLHIQSPIYRSPIMARLLASLRDVFGVVRPYLQYVPLYGTLWAMAMASDSADPLSLSATEIDARLTQNGLIDLKLYSGGTHHALLNLPPFVQTLLSEPAYPIDDGNSLDDINLDPREAGKLKLIQT

SEQ ID NO: 605 - protein, 204 aa, Viburnum urceolatum
YNKPVKGRKINWMKAGILESDRVFTVSPYYAEELVSGVDKGVELDNFIRKTGITGIVNGMDTQEWNPATDKYVGVKYDITTVMDAKPLLKEALQAEVGLPVDKNIPLIGFIGRLEEQKGSDILAAAIPKFIEQNVQIVVLGTGKKYMEKQLEQLEILYPDKARGVAKFNVALAHMIIAGADFMMIPSRFEPCGLIQLHAMRYGT

SEQ ID NO: 606 - protein, 118 aa, Calonectria pteridis
RSTGGKAPRKQLASKAARKSAPSTGGVKKPHRYKPGTVALREIRRYQKSTELLIRKLPFQRLVREIAQDFKSDLRFQSSAIGALQESVESYLVSLFEDTNLCAIHAKRVTLQSKDIQL

SEQ ID NO: 607 - protein, 487 aa, Thermosynechococcus elongatus
MTGVLDRPYTMADWRGGTESLTQEYDYWIEEVEGTVPTDLVGTLYRNGPGLLERGGVPLAHPFDGDGMICAFRFEKGRVHFRNRYVRTAGFLEEEKANRLLYRGVFGTQKPGGWFANFLDTRVKNIANTHVIYWAGKLLALWEASLPHRLDPVTLETIGLDNLGGLLRERDAFAAHPRFDPQTQRLVNFGVQPGLNTRIRLYEFDANGQCVSQPTFQIPGFAFIHDFALTPNYAIVFQNPVQFNPLPYLLGLRGAAQCLQFNAQEPTRVWLLPRRGGPPQMLTMPPCFVFHHANAYEVGDEIHVESIAYSHFPNLEPGMDFREVNFAALPASLLWRIQLNPKTKAVDWQVVSDRPCEFPVVHPAKVGQPYRYTYLAAGHDPKTNAPLQALWRCDRQTGEEQFWSAAPRGFVSEPIVVPRGLQKGDFLWQGAQGEEDGWLLQVVYDASCHKSQLLIFDAAAISAGPVARLHLKHHIPYGLHGSFTTAV

SEQ ID NO: 608 - protein, 204 aa, Viburnum utile
YNKPVKGRKINWMKAGILESDRVFTVSPYYAKELVSGVDKGVELDNFIRKTGITGIVNGMDTQEWNPSTDKYVGVKYDITTVMDAKPLLKEALQAEIGLPVDKNIPLIGFIGRLEEQKGSDILAAAIPKFIEQNVQIVVLGTGKKYMEKQLEQLEILYPDKARGVAKFNVALAHMIIAGADFMMIPSRFEPCGLIQLHAMRYGT

SEQ ID NO: 609 - protein, 377 aa, Aspergillus aculeatus
MKLSHMLLSLASLGVATALPRTPNHNAATTAFPSTSGLHFTIDGKTGYFAGTNSYWIGFLTNNDDVDLVMSQLAASDLKILRVWGFNDVNTKPTDGTVWYQLHANGTSTINTGADGLQRLDYVVTSAEKYGVKLIINFVNEWTDYGGMQAYVTAYGAAAQTDFYTNTAIQAAYKNYIKAVVSRYSSSAAIFAWELANEPRCQGCDTSVLYNWISDTSKYIKSLDSKHLVTIGDEGFGLDVDSDGSYPYTYGEGLNFTKNLGISTIDFGTLHLYPDSWGTSYDWGNGWITAHAAACKAVGKPCLLEEYGVTSNHCAVESPWQQTAGNATGISGDLYWQYGTTFSWGQSPNDGNTFYYNTSDFTCLVTDHVAAINAQSK

SEQ ID NO: 610 - protein, 204 aa, Viburnum dentatum
YSKPVKGRKINWMKAGILESDGVFTVSPYYAEELISGVEKGVELDNTIRKTGITGIANGMDTQEWNPATDKYVGVKYDITTVMDAKPLLKEALQAEVGLPVDRNIPLIGFIGRLEEQKGSDILAAAIPKFIEQNVQIVVLGTGKKNMEKQLEQLEILYPDKARGVAKFNVALAHMIIAGADFMLIPSRFEPCGLIQLHAMRYGT

SEQ ID NO: 611 - protein, 211 aa, Triticum aestivum
  misc_feature (64)..(65): Xaa can be any naturally occurring amino acid
MATGGDHAAEELVSVEMPAPEGWTKKFTPQSRGRSEIVFVSPTGEEIKNKRQLNSYLKANPGGXXKEDVKPAEADAPPAPAVEDKEDAKPAEADAPPAPAVEDKEDAKPAEADAPPAPAVEDKEDAKPAEADAPPAPVVEDKEDPKQAEADAAPAPAVEDKKEDVKPSEADAAPLVSSEEVKTEEAPPVSLEGAKTEEVDPPASKPTENSV

SEQ ID NO: 612 - protein, 988 aa, Glycine max
  misc_feature (297)..(297): Xaa can be any naturally occurring amino acid
MISVQGDLHRHHHHYHHQPQLPGSADTSRQQFTADRVEPFSVKQEPASLTLLPLRGHDSSEVDEDVHLSLAHQMYKTGNYKQALEHSNTVYERNPLRTDNLLLLGAVYYQLHDFDMCVAKNEEALRIEPHFAECYGNMANAWKEKGNIDLAIRYYLIAIELRPNFADAWSNLASAYMRKGRLTEAAQCCRQALAINPLMVDAHSNLGNLMKAQGLVQEAYSCYLEALRIQPTFAIAWSNLAGLFMESGDFNRALQYYKEAVKLKPSFPDAYLNLGNVYKALGMPQEAIACYQHALHXRPNYGMAYGNLASIYYEQGQLDMAILHYKQAVACDPRFLEAYNNLGNALKDVGRVEEAIQCYNQCLTLQPKHPQALTNLGNIYMEWNMVAAAAQYYKATLNVTTGLSAPYNNLGIIYKQQGNYVDAISCYNEVLRIDPLAADGLVNRGNTYKEIGRVSDAIQDYIRAIAVRPTMAEAHANLASAYKDSGHVEAAVKSYKQALILRPDFPEATCNLLHTYQCVCCWEDRDKMFKEVEAIIRRQINMSVIPSVQPFHAIAYPLDPMLALEISRKYAAHCSVIASRFSLPPFNHPAPIPIKREGGYERLRVGYVSSDFGNHPLSHLMGSVFGMHNRKNVEVFCYALSVNDGTEWRQRIQSEAEHFVDVSAMSSDAIAKMINEDKIHILVNLNGYTKGARNEIFAMQPAPIQVSYMGFPGTTGATYIDYLVTDEFVSPLRYANIYSEKIVHLPHCYFVNDYKQKNQDVLDPNCPHKRSDYGLPEDKFIFACFNQLYKMDPEIFNTWCNILKRVPNSALWLLRFPAAGEMRLRAYAAAQGVQPDQIIFTDVAMKNEHIRRSSLADLFLDSPLCNAHTTGTDILWAGLPMVTLPLEKMATRVAGSLCLATGLGDEMIVSSMKEYEDRAVSLALNRPKLKALTNKLKAVRLTCPLFDTARWVRNLERSYFKMWNLHCSGQRPQHFKVTENDLECPYDR

SEQ ID NO: 613 - protein, 84 aa, Triticum aestivum
PYKVIKNWNYTGLVDAIHNGEGNCWTAKVTCEEELMAAIATATEEKKDCLCFIEVVAHKDDTSKELLEWGSRVSAANSRPPNPQ

SEQ ID NO: 614 - protein, 165 aa, Cucumis melo
MELPVEEDNDDEFSPLNLIRYHLLQDSHSFSTLRDFGFKLEFEDFEYVKPSEEEEEEPPIQSPKRHPERQSPRSSSPDGGRRYRGVRRRPWGKFAAEIRDPSRKGSRVWLGTFDSDVDAARAYDSAAFKIRGRKAKLNFPLDAGKSDPPPGNGRKKKRRETNLNA

SEQ ID NO: 615 - protein, 831 aa, Oryza sativa
MDSGKYVRYTPEQVEALERVYAECPKPSSSRRQQLLRDCPILANIEPKQIKVWFQNRRCRDKQRKEASRLQAVNRKLTAMNKLLMEENERLQKQVSQLVHENAYMKQQLQNPSLGNDTSCESNVTTPQNPLRDASNPSGLLTIAEETLTEFLSKATGTAVDWVPMPGMKVDCQLLRFTLPASNDPGPDSFGIVAVSHGCRGVAARACGLVNLEPTKIVEILKDRPSWFRDCRSLEVFTMFPAGNGGTIELVYMQMYAPTTLVPARDFWTLRYTTTMEDGSLVVCERSLSGSGGGPSTASAQQFVRAEMLPSGYLVRPCEGGGSIVHIVDHLDLEAWSVPEVLRPLYESSRVVAQKMTTAALRHIRQIAQETSGEVVYALGRQPAVLRTFSQRLSRGFNDAISGFNDDGWSVMGGDGIEDVIIACNAKKVRNTSTSANAFVTPGGVICAKASMLLQSVPPAVLVRFLREHRSEWADYNFDAYSASSLKTSSCSLPGLRPMRFSGSQIIMPLAHTVENEEILEVVRLEGQALTHDDGLMSRDIHLLQLCTGIDEKSMGSCFQLVSAPIDELFPDDAPLISSGFRVIPLDMKTDGTPAGRTLDLASSLEVGSTAQPTGDASMDDCNLRSVLTIAFQFPYEMHLQDSVATMARQYVRSIVSSVQRVSMAISPSRSGLNAGQKIISGFPEAPTLARWICQSYQFHLGVELLRQADDAGEALLKMLWDYEDAILCCSFKEKPVFTFANEMGLNMLETSLVALQDLSLDKIFDEAGRKALYNEIPKLMEQGYVYLPGGVCLSGMGRHVSFEQAVAWKVLGEDNNVHCLAFCFVNWSFV

SEQ ID NO: 616 - protein, 467 aa, Burkholderia mallei
MEGSQTGLGTGLKQRHVTMLSIAGVIGAGLFVGSGHAIVEAGPAALIAYAIAGLLVVLVMRMLGEMAVAQPDSGSFSTYADRAIGHWAGFTIGWLYWWFWVLVIPIEATAAATILNAWFPGVATWIFALGITSVLTVTNLFSVKNYGEFEFWFALIKVVAIVVFLAIGGAAIVGLLPGSNVSGAARLVNAGGFMPNGVGAVLAAMLTTMFSFLGTEIVTIAAAESEHPERQIVRATNSVIWRISLFYLGSIFVVAALVPWNDALLPAHGSYQRAMELIGVPHAKGIIDVIVLVSVASCLNSALYTASRMIFSLSTRGDAPAFLRRTDASGTPRAAVLASTAFGFLTVIANYVMPEQVFGFLLATSGAIALLVYLVIAISQLRMRSTLDATGERLPLRMWCFPWLTWAVIVFICGVLVVMLLREDHRMEVGATAVLALAVVVASRMNRRARGGDEPTPAASRVSANLR

SEQ ID NO: 617 - protein, 122 aa, Arabidopsis thaliana
  misc_feature (114)..(114): Xaa can be any naturally occurring amino acid
VSKGAKEEEKKKEVVRVSSMLSSAAGVTSRAQATRVVPLTGWKSSVAFRVTGKTNKDIISMASKGGRVSCMKVWPPMGKKKLETLSYLPDLSDVEWVKEVDYLLRQPRWISLGXIELEHGLV

SEQ ID NO: 618 - protein, 448 aa, Arabidopsis thaliana
MKDQLGFRIVLCSAVFIILTQNRALADLDSESHEVNSESVGEEQWEMVQRKGMQFTLNGQPFYVNGFNTYWMMTLAADNSTRGKVTEVFQQASAVGMTVGRTWAFNDGQWRALQKSPSVYDEEVFKALDFVLSEARKYKIRLILSLVNNWDAYGGKAQYVKWGNASGLNLTSDDDFFTNPTLRNFYQSHVRTVLNRVNTFTNITYKNDPTIFAWELMNEPRCPSDPSGDKLQSWIQEMAVFVKSLDAKHLVEIGLEGFYGPSAPARTRFNPNPYAAQVGTDFIRNNQVLGIDFASVHVYPDSWISPAVSNSFLEFTSSWMQAHVEDAEMYLGMPVLFTEFGVSAHDPGFNTSFRDMMLNTVYKMTLNSTRKGGAGAGSLVWQVFPQGAEFMDDGYAVYLTRAHTASKIISLQSKRLAIFNSLCSWRCRWGCKKKNQTALDALLSHDEL

SEQ ID NO: 619 - protein, 446 aa, Oryza sativa
MAAAGAGSSEVAARVLLQRYQPFAPPPGEYHQFGSGGAAAAGDMTEAVLIRTPLKRKHDREENEAAESNDWMMSPGYTNPAGSPVPTPLSGKGSKAFAKSKAAKGQKSCPQTPLCASSPGNPVTPVGGCRYDSSLGLLTKKFLNLLKGAPGGIVDLNNAAETLEVQKRRIYDITNVLEGIGLIEKKLKNNIRWKGIDDSRPGEVSDDMSILQADIEALSLQEHSVDQQISEMRDKLRGLTEDENNQKWLYVTEDDIKSLPCFQNQTLIAIKAPHGTTLEVPDPDEVNDYPQRRYRIVLRSTMGPIDVYLVSQFEEMSGMETPPRTVQPVSMDSLENPRTPLAAEPNKAAESQPNIQDGLLMPSDAPSSSQDIGGMMKIVPSELDTDADYWLLSDAGVSITDMWKTAPEVEWEGIEKFNAEDFLEVSTPRQQDKPSSDIMDGDSCIS

SEQ ID NO: 620 - protein, 324 aa, Pseudomonas syringae
MQLGIIGLGRMGGNIARRLMLNGHTTVVYDRDEASRNALANDGSVAVAGLKEMVDALDKPRAIWVMLPAGAPTEETIQTLSQLLDADDVIIDGGNTFYKDDIRRAQELTEKGLHYVDVGTSGGVWGLERGYCMMIGGEAAVVERLDPLFATLAPGLGSIERTKGRTSTDDRAERGYIHSGPAGSGHFVKMIHNGIEYGMMQAFAEGFDLLKQKNSEHLPAEQRFDLNTADIAEVWRRGSVVSSWLLDLTADALATDPQLDAFSGSVADSGEGRWTIEAAIEQAVPVPVLSSALFARFRSRQASSYADKMLSAMRFGFGGHKEPK

SEQ ID NO: 621 - protein, 168 aa, Zea mays
MAAASSATSVHDFTVKDSSGKDVDLSVYRGKVLLIVNVASQCGLTNSNYTQQAQLYDKYKNQGFEILAFPCNQFGGQEPGTNEEIAQFACTRFKAEYPIFDKVDVNGNNAAPIYKFLKSSKGGLFGDSIKWNFSKFLVDKEGRVVDRYAPTTSPLSIEKDIKKLLGSS

SEQ ID NO: 622 - protein, 284 aa, Oryza sativa
MSYFLDDKWLYYSYCRLIREAHKKGANIVLVQELFEGQYFCQAQRLDFFQRAKPYKGNPTIIRFQKLAKELEVVIPVSFFEEANNAHYNSVAIIDADGTDLGLYRKSHIPDGPGYQEKFYFNPGDTGFKAFKTKYATIGVGICWDQWFPECARAMVLQGAEILFYPTAIGSEPQDNNLDSREHWKRVMQGHAGANLVPLVASNRIGRETVETEHGESTITFFGNSFIAGPTGEIVKLANDKDEDVLVAEFDLDEIKSTRHGWGIFRDRRPDLYKVLLTLDGEKS

SEQ ID NO: 623 - protein, 227 aa, Brassica napus
  misc_feature (176)..(176): Xaa can be any naturally occurring amino acid
LPIWFAASIYYLTITQQMTYPVFQALQSDRRLGSRGFVIPAATYVVFLMTGMTVFIIFYDRVLVPTLRRITGIDTGITLLQRIGTGIFFAFVSLIVSGFVEERRRTFALTKPTLGMAPRKGEISSMSAMWLIPQLALAGIAEAFGAIGQMEFYYKQFPENMRSFAGSIFYVGAGVXSYLGSFLIAMVHRTTQNSAGGNWLAEDLNKGRLDYFYFMIAGILAVNFAYF

SEQ ID NO: 624 - protein, 486 aa, Corynebacterium glutamicum
MPTNNAPQVAINDIGSAEDFLAAIDATIKYFNDGDIVEGTVVKVDRDEVLLDIGYKTEGVIPSRELSIKHDVDPDEVVEVGDQIDALVLTKEDKEGRLILSKKRAQYERAWGAIEELKEKDEPVTGTVIEVVKGGLIIDIGLRGFLPASLVEMRRVRDLDPYIGQELEAKIIELDKNRNNVVLSRRAFLEQTQSEVRSEFLHQLQKGQVRKGVVSSIVNFGAFVDLGGVDGLVHVSELSWKHIDHPSEVVTVGDEVTVEVLEVDLDRERVSLSLKATQEDPWRVFARTHAVGQIVPGKVTKLVPFGAFVRVEEGIEGLVHISELAQRHVEVPDQVVAVGEEVMVKVIDIDLERRRISLSLKQADEDYTEEFDPSKYGMADSYDEQGNYIFPEGFDAETNEWLEGFDEQRQAWEARYAESERRFTAHTAQIERRRQQAEEAAAEAPAGNYSTDSAEDAPAAEAVEESAGSLASDEQLAALREKLAGN

SEQ ID NO: 625 - protein, 202 aa, Brassica napus
MGVYETEKPTKDAAVVETQSPEDFDQPSPLRKIISVASIAAGLQFGWALQLSLLTPYVQLLGIPHKWSSLIWLCGPVSGMIVQPIVGYHSDRCTSRFGRRRPFIAAGAALVAVAVFLIGYAADIGHKMGDKLEQKSPRVRAIGIFAFGFWILDVANNTLQGPCRAFLADLSAGDAKRTRVANGFFSFFMGVGNVLGYAAGLF

SEQ ID NO: 626 - protein, 526 aa, Ashbya gossypii
MSFSDEEDFDDIYGDDNKQNSETAVAAGKRKADGEAGAGPTSKEEAARGADNSGASAAETTTTPASWLDQLAALQVLSSNLNQLQQSTNNNSNNNTNSSDSTSNDSNKGNVPDQMLARGMPDLSQLQQLQQTMNQLQQQAAPLTQQQQQEAKQVKADLSRDINKMFIGGLNWETTEDNLREYFSKYGNVTEVKIMRDGTTGRSRGFGFLSFADASSVDEVVKTQHILDGKVIDPKESDPTGRARKAGKIFVAGIGPDVRPKEFEEFFSQWGSIIDAQLMLDKDTGRSRGFGFITYDSPDAVDRVCQNKFIEFKGKRIEIKRAEPRQVQKQRTTNASPTGQPFSLNTSQAPQPPQQQFQMMANPMMANPLFNPQAMADYYAKMQEYYQQSGIDYSQMYQQQMQQMQQMMSMMTGGNAPAGGMPAGANGAGGNGDDTNGVPTIGEDSSSTSSGKDNNDKESSNNRHDSYGNRDRERSPDARRGHRNYNDREEGGHGFRRENRDRGFRGRERRGGGYGRDRRGYHPYSR

SEQ ID NO: 627 - protein, 319 aa, Bordetella bronchiseptica
MSTPKHAKVLILGSGPAGYTAAVYAARANLSPALITGLAQGGQLMTTTEVDNWPADVQGVQGPDLMQRFLQHAERFNTEILFDHIAKVDLSRRPFTLTGDTGNLYTCDALIIATGASAKYLGLASEQAFMGRGVSGCATCDGFFYRNKDVVVIGGGNTAVEEALYLSNICRKVTLIHRRDKFRAEPILVDKLMDKVANGNMELKLFHTLDEVLGDDSGVTGVRIRSTETDATEDLDVAGCFVAIGHQPNTGIFEGQLEMKDGYIITKSGLSGMATMTSVPGVFAAGDVQDHVYRQAITSAGTGCMAALDAQRWLENAGQ

SEQ ID NO: 628 - protein, 579 aa, Herminiimonas arsenicoxydans
MTSETNNAVGEELTGAEIVVRCLAEEGVEHVFGYPGGAVLYIYDAIYNQDKFQHILVRHEQAAVHAADAYSRSSKKVGVSIVTSGPGVTNAVTGLATAYMDSIPMVIISGQVPTHGIGLDAFQECDTVGITRPCVKHNFLVKDVRDLAATMKKAFYIATTGRPGPVLVDIPKDVSMHKCMFSYPKEVEMRSYKPVDKGHTGQIRKAVQLLLQAERPMIYTGGGVILANASEELTQLVDKLGFPCTNTLMGLGSYRASSDKFVGMPGMHGTYEANMAMQHSDVMIAIGARFDDRVIGNPKHFSSNPRKIIHIDIDPSSISKRVKVDIPIVGNVKEVLVELLAQLDAAEAKPNSVALSNWWKQINEWRKRDCLKFENSTTVIKPQSVIQKVWDVTKGDAFVTSDVGQHQMWAAQYYPFDKPRRWINSGGLGTMGVGLPYAMGVQMANPDATVACITGEASIQMCIQELATCKQYHLTPKIILLNNRFLGMVRQWQQLEYGSRYSESYMDSLPDFDKLVEAYGHVGMTIENPADVDGALKEAFAMKDRLVFMNFITDQTENVWPMVKAGQGLTEMLLGSEDL

SEQ ID NO: 629 - protein, 189 aa, Oryza sativa
MSTSSGPKEAPANNPGLQAPSEKDPATKGYFMQQTMFRVKDPKVSLDFYSRVMGMSLLKRLDFPEMKFSLYFLGYEDVESAPTDPVKRTVWTFGQRATLELTHNWGTENDPEFKGYHNGNSDPRGFGHIGVTVHDVYKACERFERLGVEFVKKPDDGKMKGIAFIKDPDGYWIEIFDLNRIGAVTAEAS

SEQ ID NO: 630 - protein, 1126 aa, Candida albicans
MVLNDFDLKTEALNERTTLHTSQNASSKNGSNKESVLAKYEETNQNDEIEGFENLNDLSFSKYSKFSKASIIVGSDPKSRTTTLDSPFAKKLKEDLNVEFTSDNTKPYYPTVYPIYEFDNNDENSDSPFLDYQNEKGNIPQKLSGQKLRKQQQQQQQQSEAEENFKQSNQYARLQSTPKHQRTSSVKVSLTPAQKFEKRTSTRSHNALDNFELTTLVGNGAFASVYRAVNLKTNQVIAIKQIRIEKDQDVGVLMGEIDLLKILKHRNIVKYHGFVKTATSLNVLLEYCEGGSLRQLYKKLKKGLPEYQIINYVRQILEGLNYLHEQGVVHRDVKAANVLLTDKGDVKLADFGVATKVTSQHLTVVGTPNWMAPETVLGGEGICTASDIWSLGATIIELFTTNPPYHDLNAMATLHAIGTDEHPPLPKNMSTLAKDFLLECFQKQANLRISAKLLLKHKWLNQTATAKTSMATLLRQPSRELRSIKIYSESNDENWDEDFEEIKVSKFQNSTSSIIELKPDNTEKQFKLTEYSKKDLLTLFADEKEDTSGNFEFETIGPNKLAVVAESMDESDPFLNIDIENFDTNELEVQSKMEYLVVRLSRKLEQVHLGYEDAVPALVKVTGRMLHLVKKYPVSHDTLIRDHGVLSLLELLESFQDIPSQQQLWYHCLSILNHVFESDLGTLENFCFLGGIPTVAHFRSATYEVQVRLQVAKFIGILNLSEKALSMFVSCGGLRLVSKFVEEDFDTTPTFPLIAIESIHNILAKDLSRSKSDLCRILSKHGVIFWLVVLLNRLVKYDQKPSIKNVSKEQVEITIERIIDIIKYFSQSETKVRISIGSIDLFKLIFKLFDNLKLSHQLTLLKFVKSMSCISEVLKNLYHAEILEFLVKLLKSYIPSKGNYKEIINVLAPILYNSLALNHRRESEFVNLGGLPYLKTLSIINLPFRQFILPIICEFVHCDASVVNELKKNDIVKIYYNLLLDPYWQSNALDSLHCWYKLEPSYIDLNSPMAVDCLVGGFLLPKVSNLESTLEIYFKLLTNNLPLTRDMSNMNVINSILIKLSLHDKKNPVIQLSYLKVLKCLINYLVDSKSSLPFAKPVVNTLQSLKSRQSSLLIEEVTTELLSVLK

SEQ ID NO: 631 - protein, 173 aa, Populus nigra
MSRAMEPLTVGRVVGDVVDIFTPSVRMTVTYNSNKQVANGYEFMPSVIAYKPRVEIGGEDMRTAYTLIMTDPDAPSPSDPYLREHLHWMVTDIPGTTDVSFGKEIVSYETPKPVVGIHRYVFILFKQRGRQTVRPPASRDCFNTRMFAGENGLGLPVAAVYFNAQRETAARRR

SEQ ID NO: 632 - protein, 637 aa, Nicotiana tabacum
MMESCDCIEALLPNDDLLVKYQYLSDFFIAFAYFSIPLELIYFVHKSACFPYRWVLMQFGAFIVLCGATHFISLWTFFMHSKTVAVVMTIAKILTAAVSCITALMLVHIIPDLLSVKTRELFLKARAEELDKEMGLIIRQEETGRHVRMLTHEIRSTLDRHTILKTTLVELGRTLDLAECALWMPCQGGLNLQLSHNLNNLLPLGSTVPINLPIINEIFSSPGAIQIPHTNALARMRNTAGRYIPPEVVAVRVPLLHLSNFHINDWPELSARSYAVMVLILPMNGLRKWRDHELELVQVVADQVAVALSHAAILEESMRAHDQLMEQNIALDVARQEAEMAIHARNDFLAVMNHEMRTPMHAVIALCSLLLETDLTPEQRVMIETILKSSNLLATLINDVLDLSRLEDGILELENGTFNLHGILREAVNLIKPIASLKKLSITLALALDLPILAVGDAKRLIQTLLNVAGNAVKFTKEGHISIEASVAKPEYARDCHPPEVYPMPSDGQFYLRVQVRDSGCGISPQDIPFVFTKFAETRNTSNRSSGGEGLGLAICRRFIQLMKGNIWIESEGLGKGTTVTFVVKLGVCNHPNALPLLPMAPRGRLNQGSDDLFRYRQFRGDDGGMAVTVQRYQRSL

SEQ ID NO: 633 - protein, 168 aa, Oryza sativa
  misc_feature (154)..(154): Xaa can be any naturally occurring amino acid
MALVEDNNAVAVSFSEEQEALVLKSWAILKKDSANIALRFFLKIFEVAPSASQMFSFLRNSDVPLEKNPKLKTHAMSVFVMTCEAAAQLRKAGKVTVRDTTLKRLGATHLKYGVGDAHFEVQGVKFALLDTIKEEVPADMWSPAMKSAWSEAYXHLVAAIKQEMKPAE

SEQ ID NO: 634 - protein, 318 aa, Trifolium repens
MENFPIVDMGKLNTEERKSTMEKIKDACENWGFFELVNHGISIEMMDKVEKLTKDHYKKCMEQRFKEMVSSKGLECVQSEINDLDWESTFFLRHLPFSNISEIPDLDDDYRKIMKEFAQKLENLAEELLDLLCENLGLEKGYLKKVFYGSKGPNFGTKVSNYPPCPKPDLIKGLRAHTDAGGIILLFQDDKVSGLQLLKDDQWIDVPPMRHSIVINLGDQLEVITNGKYKSVMHRVIAQTDGARMSLASFYNPSDDAIISPAPTLLKENETTSEIYPKFVFDDYMKLYMGLKFQAKEPRFEAMMKAMSSVDVGPVVSI

SEQ ID NO: 635 - protein, 481 aa, Nitrosomonas europaea
MRFSSTSPPQETRVAIIEHGITQELHIERTSSRGIVGNIYNGRVSRVLPGMQSAFIDIGLERAAFLHVADIHESSQNDHHKPIEQLLSEGSNILVQVVKDAIGVKGARLSTQVSLAGRLLVYLPQESYIGVSQRIEDNSERESLRQKLQNILPPDSTGGYIIRTMAETAEEPELQADIVYLHKLWQDIQKKSLTISSPSLLYQDLDLSLRVLRDFVNADTYRVRVDSRETFQKLTTFAHEYMMSDLEKISHYIGERPLFDLYGVEQEIEKSLARRVDLKSGGYVIIDQTEALTTMDVNTGGFVGIRNFDDTIFKTNLEAAQVIARQLRLRNLGGIIIIDFIDMDREEHRAAVLAEFNKALQKDRTKMTVNGFTALGLVEMTRKRTRESLAQILCETCPTCQGRGEIRTAQTICYEILRELLRESRQFDAKEFRILASQPVIDLFLDEESQSLAQLGDFIARPIGLQVGASYTQEQYDVILI

SEQ ID NO: 636 - protein, 521 aa, Neisseria gonorrhoeae
MKHRTFFSLCAKFGCLLALGACSPKIVDAGTATVPHTLSTLKTADNRPASVYLKKDKPTLIKFWASWCPLCLSELGQAEKWAQDAKFSSANLITVASPGFLHEKKDGEFQKWYAGLNYPKLPVVTDNGGTIAQNLNISVYPSWALIGKDGDVQRIVKGSINEAQALALIRNPNADLGSLKHSFYKPDTQKKDSAIMNTRTIYLAAAASGAWKPISNASTAWLTRYRYANGNTENPSYEDVSYRHTGHAETVKVTYDADKLSLDDILQYYFRVVDPTSLNKQGNDTGTQYRSGVYYTDPAEKAVIAAALKREQQKYQLPLVVENEPLKNFYDAEEYHQDYLIKNPNGYCHIDIRKADEPLPGKTKAAPQGQRLRRGQRIKNRVTPNSNAPDRRAIPSDQNSATEYAFSHEYDHLFKPGIYVDVVSGEPLFSSADKYDSGCGWPSFTRPIDAKSVTEHDDFSFNMRRTEVRSRAADSHLGHVFPDGPRDKGGLRYCINGASLKFIPLEQMDAAGYGALKGEVK

SEQ ID NO: 637 - protein, 222 aa, Glycine max
MGRRPARCYRQIKNKPYPKSRFCRGVPDPKIRIYDVGMKKKGVDEFPFCVHLVSWEKENVSSEALEAARIACNKYMAKFAGKDAFHLRVRVHPFHVLRINKMLSCAGADRLQTGMRGAFGKPQGTCARVAIGQVLLSVRCKDSNSHHAQEALRRAKFKFPGRQKIIVSRKWGFTKFSRSDYLKFKSENRIVPDGVNAKLLGCHGPLANREPGRAFLDTATGS

SEQ ID NO: 638 - protein, 222 aa, Brassica napus
  misc_feature (69)..(69): Xaa can be any naturally occurring amino acid
MGRRPARCYRQIKGKPYPKSRYCRGVPDPKIRIYDVGMKKKGVDEFPFCVHLVSWEKENVSSEALEAAXRIACNKYMVKSAGKDAFHLRIRVHPFHVLRINKMLSCAGADRLQTGMRGAFGKALGTCARVAIGQVLLSVRCKDNHGAHAQEALRRAKFKFPGRQKIIVSRKWGFTKFNRADYTRLRQSKRIVPDGVNAKFLSNHGRLANRQPGSAFISATSD

SEQ ID NO: 639 - protein, 317 aa, Unknown
  Sulfitobacter sp. EE-36
MSIAVLGAGAFGTALAISLAGKGAVTLWARHAQGMGQSRENTARLPGCPLPEGLFVTEDLAEAAKAQTLLAAVPMQKLRGFLRDHAAALDGKTIVACCKGIELNTGLGPVAVIREVLPHATAAILTGPSFAADIARGLPTALTLACADKTTCATLQQSLTTANLRLYRTSDTVGAELGGALKNVVAIACGAAIGAGLGESARAAVMTRGFAEMQRLAAHHHADPVTLAGLSGFGDLTLTCTSTQSRNYRLGLALGRGEPFDSATTVEGAATARAVDALAHDNGLDLPITAAVAGLVENRLDVASAMKALLTRPLKEE

SEQ ID NO: 640 - protein, 545 aa, Azospirillum brasilense
MKLAEALLRALKDRGAQAMFGIPGDFALPFFKVAEETQILPLHTLSHEPAVGFAADAAARYSSTLGVAAVTYGAGAFNMVNAVAGAYAEKSPVVVISGAPGTTEGNAGLLLHHQGRTLDTQFQVFKEITVAQARLDDPAKAPAEIARVLGAARALSRPVYLEIPRNMVNAEVEPVGDDPAWPVDRDALAACADEVLAAMRSATSPVLMVCVEVRRYGLEAKVAELAQRLGVPVVTTFMGRGLLADAPTPPLGTYIGVAGDAEITRLVEESDGLFLLGAILSDTNFAVSQRKIDLRKTIHAFDRAVTLGYHTYADIPLDGLVDALLERLPPSDRTTRGKEPHAYPTGLQADDGPIAPMDIARAVNDRVRAGQEPLLIAADMGDCLFTAMDMIDAGLMAPGYYAGMGFGVPAGIGAQCVSGGKRILTVVGDGAFQMTGWELGNCRRLGIDPIVILFNNASWEMLRTFQPESAFNDLDDWRFAEMAAGMGGDGVRVRTRAELKAALDKAFATRGRFQLIEAMIPRGVLSDTLARFVQGQKRLHAAPRE

SEQ ID NO: 641 - protein, 412 aa, Actinobacillus pleuropneumoniae
MQMLTLAQQAKIASIELAQFGNVQKNHALLTIAEQLEQRSAEILAANAKDIEFAKNQGISTAIIDRLLLNESRLQGIANDVRNVAKLADPVGQVIDGGVLNSGLKIERQRVPLGVILTIYEARPNVTIDVASLCLKTGNAVILRGGKETKFTNAVLVEVVQQALETAGLPKLAVQAVTDPDRALLLELLKLDRYIDMVIPRGGAGLHQFCKENSTIPVIVGGIGVCHMFVEKSADQEKALELIANAKTQRPSTCNTLETLLVEKAIAGEFLPKLANRMKALDVTLHTDDLQKTEGIEPLDDARMRQEWLSLDLNVVVIDNLTKAVEHIREYGSQHSEAILTSDYQLARQFVAQVDAAAVYINASTRFTDGGEFGLGAEVAVSTQKLHARGPMGLEALTTYKWVCEGDYLVRK

SEQ ID NO: 642 - protein, 204 aa, Viburnum jucundum
YNKPVKGRKINWMKAGILESDGVFTVSPYYAEELISGVEKGVELDNIIRKTGITGIANGMDTQEWNPATDKYVGVKYDITTVMDAKPLLKEALQAEVGLPVDRNIPLIGFIGRLEEQKGSDILAAAIPKFIEQNVQIVVLGTGKKNMEKQLEQLEILYPDKARGVAKFNVALAHMIIAGADFMLIPSRFEPCGLIQLHAMRYGT

SEQ ID NO: 643 - protein, 590 aa, Unknown
  Synechococcus sp. RS9916
MVTASLSSKDPSAVTPRLSLQCEAIAADTTTIRSLDWDRSRFDIEFGLRNGTTYNSFLVRGERTALIDTSHAKFRDSWIPLLQGEIDPKSIDVLIVSHTEPDHSGLIGDLIDLNPDIEIVGSKVAIQFLNNQVHRPFKSRAVKSGEELDLGTNPSSGVHHRFEFLSAPNLHWPDTIFSFDHGTGILYTCDAFGLHYCSDAVFDSDPGAIAPDFRFYYDCLMGPNARSVLQALKRMDGLPEINTIAVGHGPLLREHLQHWINDYREWSGQRSKGESYAAVCYLSQYGFCDRISQAIAHGIGKAEAQVQLVDLRATDPQELTALIGEAKAVVVPTWPANPDADLQSSIGTLLAALNSKQWVGVYDAFGGDDEPIDAVAGQLRGQGQKEAFAPLRIRQLPSGADYQRCEESGTDLGQLLTREKTIAAMKSLDGDLDKALGRLSGGLYVVTASQGEGDSLRRSAMVASWVSQASFSPPGLTVAVAKDRAIETLMQVGDRFVLNVLREDNHQPLLRHFLKRFRPGADRFEGMNVLEGVADGGPVLGDALAYLGCRVEQRLEGPDHWIIYAVVEQGNVADTEAVTAVHHRKVGNHY

SEQ ID NO: 644 - protein, 283 aa, Rhodospirillum rubrum
MTEWFSETLHPHWRQSFAADRVLLREQTAHQDLVILENQTFGRVMVLDGMVQLTERDEFVYHEMIAHVPLFGHGAARRVLIIGGGDGGTLREVLRHKTVERATMVEIDATVVEMARDHMPMVSDGAFDDPRAELIIADGIAFVAGAHQPYDVIIIDSTDPFGPAEGLFTPAFYGACRQLLTPGGVLVVQAGVPFLQPREIAHVNAALSAAFPEVAFYAIAVPTYVGGLMTLGWASEDAGKKVPDPAVLAARVAASGLAFGYYSPEGHAGAFALPPHIRAAARG

SEQ ID NO: 645 - protein, 113 aa, Oceanobacillus iheyensis
MKKLEAIIRPEKFQSLRDELSSIGIGGLTVTEVAGTGKQKGQTGVYRSTEFQIQLLSKLKVEMVIEESQLEEIVDIIIKSCKTGNIGDGKIFVSPVEEVIRIRTGERGMEAVL

SEQ ID NO: 646 - protein, 219 aa, Unknown
  Cichorium intybus x Cichorium endivia
MAGSEVVLLDTWVSLFGMRVRIALAEKDVHYERREEDLTNKSSLLLQMNPVHKKVPVLIHDGKPICESNIIVQYIDEAWQNNSPPLLPSDPYLKAQARFWADFIDKKIYDAGTRIWRRKGEEQEIAKKEFIDWMKVLEGQLGENSYLMGKSFGYVDIAMVPFYCWFYALEKIGNISIEKECPKLVAWAKRCMERESVSKTLPDPHKVYEYALELMKKLG

SEQ ID NO: 647 - protein, 204 aa, Viburnum triphyllum
YSKPVKGRKINWMKAGILESDGVFTVSPYYAEELISGVEKSVELDNIIRKTGITGIANGMDTQEWNPATDKYVGVKYDITTVMDAKPLLKEALQAEVGLPVDRNIPLIGFIGRLEEQKGSDILAAAIPKFIEQNVQIVVLGTGKKNMEKQLEQLEILYPDKARGVAKFNVALAHMIIAGADFMLIPSRFEPCGLIQLHAMRYGT

SEQ ID NO: 648 - protein, 500 aa, Taxus cuspidata
MDALSLVNSTVAKFNEVTQLQASPAILSTALTAIAGIIVLLVITSKRRSSLKLPPGKLGLPFIGETLEFVKALRSDTLRQFVEEREGKFGRVFKTSLLGKPTVILCGPAGNRLVLSNEEKLLHVSWSAQIARILGLNSVAVKRGDDHRVLRVALAGFLGSAGLQLYIGKMSALIRNHINEKWKGKDEVNVLSLVRDLVMDNSAILFFNIYDKERKQQLHEILKIILASHFGIPLNIPGFLYRKALKGSLKRKKILSALLEKRKDELRSRLASSNQDLLSVLLSFRDERGKPLSDEAVLDNCFAMLDASYDTTTSQMTLILKMLSSNPECFEKVVQEQLEIASNKKEGEEITMKDIKAMKYTWQVLQESLRMLSPVFGTLRKTMNDINHDGYTIPKGWQVVWTTYSTHQKDIYFKQPDKFMPSRFEEEDGHLDAYTFVPFGGGRRTCPGWEYAKVEILLFLHHFVKAFSGYTPTDPHERICGYPVPLVPVKGFPIKLIARS

SEQ ID NO: 649 - protein, 204 aa, Viburnum dentatum
YSKPVKGRKINWMKAGIIESDGVFTVSPYYAEELVSGVEKGVELDNIIRKTGITGIANGMDTQEWNPATDKYVGVKYDITTVMDAKPLLKEALQAEVGLPVDRNIPLIGFIGRLEEQKGSDILAAAIPKFIEQNVQIVILGTGKKYMEKQLEQLEILYPDKARGVAKFNVALAHMIIAGADFMMIPSRFEPCGLIQLHAMRYGT

SEQ ID NO: 650 - protein, 466 aa, Unknown
  Shewanella sp. MR-4
MSIASVASVFKGEHAVGSTVTVRGWVRTRRDSKAGISFLAVYDGSCFNPIQGVVPNSLENYDNEVLKLTAGCSVIVTGEIVESPGAGQAYELQVTQVEVTGWVEDPDTYPMAAKRHSIEHLRELAHLRPRTNIIGAVARVRNCLSQAIHRFYHENGFVWVSTPLITASDCEGAGEMFRVSTLDMENLPRTSDGKVDYDKDFFGKEAFLTVSGQLNGETYACALSKIYTFGPTFRAENSNTSRHLAEFWMVEPEVAFATLSDIANLAEGMLKYAFNAVLAERMDDLQFFAQHVDKTVIERLQSFVSSDFAQVDYTDAVEILQKCGREFEFPVSWGIDLSSEHERYLAEEHFKAPVVVKNYPKDIKAFYMRLNEDGKTVAAMDVLAPGIGEIIGGSQREERLDVLDMRLEEMDLNKEDYWWYRDLRRYGTVPHAGFGLGFERLVSYVTGVSNIRDVIPFPRAPRTANF

SEQ ID NO: 651 - protein, 320 aa, Vibrio angustum
MIKKIGVLTSGGDAPGMNAAVRGVVRAALTEGLEVYGIYDGYQGLYNNCIEKLDRKSVSDVINKGGTFLGSARFPEFREVEVREKAIENLKLHGIDALVVVGGDGSYMGAKKLTEMGYPCIGLPGTIDNDVAGTDYTIGYMTAMNTVIDAIDRLRDTSSSHQRISIVEVMGRHCGDLTLMSAIAGGCEYIITPETGLDKEKLLQHIREGIAKGKKHAIIAITELMTDVNELAKFIEAETGRETRATVLGHIQRGGQPTAFDRVLASRMGAYAVDLLQQGEGGRCVGIQCEQLVHHDIIDAIENMRRPVRNDLYELAEKLF

SEQ ID NO: 652 - protein, 204 aa, Viburnum hartwegii
YSKPVKGRKINWMKAGIIESDGVFTVSPYYAEELVSGVEKGVELDNIIRKTGITGIANGMDTQEWNPATDKYVGVKYDITTVMDAKPLLKEALQAEVGLPVDRNIPLIGFIGRLEEQKGSDILAAAIPKFIEQNVQIVVLGTGKKFMEKQLEQLEILYPDKARGVAKFNVALAHMIIAGADFMMIPSRFEPCGLIQLHAMRYGT

SEQ ID NO: 653 - protein, 241 aa, Arabidopsis thaliana
  misc_feature (59)..(59): Xaa can be any naturally occurring amino acid
  misc_feature (67)..(67): Xaa can be any naturally occurring amino acid
  misc_feature (195)..(195): Xaa can be any naturally occurring amino acid
MCLTYTTIFIILRFIARASKLYPDLVPSNTVPSIINLLSHEKSNIANYFFHLLQDLTYXNALYDNNXPSLLLINTLFKNNMLHLLVHNINPLSYSNPDEANAIYSTFTVIYNFVEIKPAISQFLFLIIKLFLLLLTKIKVKEFKRIIQYTFYFFAILFQNSTLNQKRLCQMNFIKAFLEFLSIYKSKYPITPYYXIHYKKSFFFFFLLFIPFFKKKKFLNSEDLDLIIIIIKKKKILKGLL

SEQ ID NO: 654 - protein, 368 aa, Oryza sativa
MDMASIECVSYSDSMDDDDDDGVGVGGVSHLPRPILVKPSSAAAAVNVVVVSAGSGGKAGGGGGGVGVVAGAPAVPPATSVHELLECPVCTNSMYPPIHQLGHWEPEELPSMLSVILLECQNGHTLCSTCKTRVHNRCPTCRQELGDIRCLALEKVAESLELPCKYYSLGCPEIFPYYSKLKHESQCNFRPYNCPYAGSECSVVGDIPFLVAHLRDDHKVDMHSGCTFNHRYVKSNPREVENATWMLTVFHCFGQYFCLHFEAFQLGVAPVYMAFLRFMGDENDARNYSYSLEVGANGRKMIWEGTPRSIRDSHRKVRDSHDGLIIQRNMALFFSGGERKELKLRVTGRIWKEQQNPDSGACIPNLFS

SEQ ID NO: 655 - protein, 468 aa, Burkholderia mallei
MQKGHSETDLHRGLGQRQMRLIALGAAIGVGLFLGSANAIKMAGPGIILSYIIGGAVIFVIMRALGEMAVHEPVAGSFSRYARNYLGPLAGYLTGWNYWFLWLVTCIAEITAVGIYMGIWFPDVPRWIWALAALATMGSVNLLTVKAYGEFEFWFALIKVVTIVVMIAVGIAMIAFGIGNHGVPMGISNLWAHGGFFPNGAQGVLMSMQMVMFAYLGVEMIGLTAGEAANPQKTIPGTINSVFWRILLFYGGALFVILSIYPWNEIGTQGSPFVMTFERLGIKTAAGIINFVVLTAALSSCNGGIFSTGRMLYNLAQQGHAPRTFGETTASGVPRRAILVSMAALLVGVLLNYLVPEKVFVWVTSISTFGAIWTWGVILVTQMKFRASLAPAEERALRFRMPFWPYASWVALAFLVLVIGLMAYFPDTRIALYVGPAWLVLLVVLYFVLKLEPEGGKATGLERRYGRG

SEQ ID NO: 656 - protein, 338 aa, Vibrio angustum
MTKNANNTISMAVLGAGSYGTALAIALSRNGANVILWGHNPEHIAQLEIDRANEAFLPGVHFPESLIVTSNLQDAVEGSRDLLVVVPSHVFGQVLLQVKPFLRSDSRVCWATKGLEPETGRLLKDVAVDALGSDIPLAVLSGPTFAQELAAGLPTAISVASPDAEFVADLQEKIHCDKTFRVYSNNDFTGMQLGGAVKNVIAIGAGMSDGIGFGANARTALITRGLAEMCRLGEALGAQPETFMGMAGLGDLVLTCTDNQSRNRRFGLALGAGKSVEQAQQEIGQVVEGYRNTKEVWQLAKRYGVEMPISEQIYQVLYQGKDAREAAKELLAREKKYE

SEQ ID NO: 657 - protein, 358 aa, Pseudomonas fluorescens
MSQFHRLTIKDLRNETRDAVSIAFEVPPHLQQQFHFTQGQHLVLRTELEGEEVRRSYSICTGVNDGELRIAVKRVAGGRFSAFANERLQPGHSLDVMPPAGRFHVELDPARRGHYLAVAAGSGITPILSIIRTTLQTEPHSRVTLLYGNRSSNSALFREQLEDLKNRYLQRLNLMFVFSRERQDIDLYNGRIDQDKCQQLFSRWLDVQQLEAAFICGPQAMTETVRDSLKAAGMPAERIHFELFHAGSDGHKRQARETASALDARHSRVTVISDGRALAFDLPRNSQSILDAGNAQGAELPYSCKAGVCSTCKCKVIEGEVEMDSNHALEDYEVAAGYVLSCQSFPLSDKVVLDFDQL

SEQ ID NO: 658 - protein, 161 aa, Brassica napus
STTQVPDFLNARINGRPVKEVITDHKWLEEGFTESVQKRGGLLIQKWGRSSAASTAVSIVDAIKSLVTPTPEGDWFSTGVYTNGNPYGIAEDLVFSMPCRSNGDGDYELVKDVEFDDYLRNRIAKSEAELLAEKKCVAHLTGDGIAFCDLGPVDTMLPGEV

SEQ ID NO: 659 - protein, 213 aa, Xylella fastidiosa
MSHSKSSQRWLKEHFSDPFVKKAQAEGMRSRAAYKLEEILKRDRILRPNMVVIDLGAAPGGWSQQIRKQMGDSGRVIALDIVKMAPLVGIEFLQGDFRDKAVLSQLEIMLKGQPVDLVLSDMAPNKSGIDVMDQPRMMYLAELAMDFADIHVKPGGSFLIKLFHGVGSDGYIRQLRHRYKKVAIRKPLASRKRSPEVYILGDGKLTQNEVSCS

SEQ ID NO: 660 - protein, 331 aa, Rhodopseudomonas palustris
MSLPEFSMRQLLEAGVHFGHQSHRWNPKMADYIFGVRNNIHIVDLTQTVPLLHRALQAISDTVAKGGRVLFVGTKRQAQDAVADAAKRSAQYFVNSRWLGGTLTNWKTISGSIRRLRHLEDVLSSADANAYTKKERLELQRERDKLNRSLGGIKDMGGLPDLIFVIDTNKEDIAIQEAQRLGIPVAAIVDTNCDPKGITYLVPGNDDAGRAIALYCDLVARAVIDGISRAQGDVGIDIGAAAQPLREDLPAAQATTFQGLPGPRGTPDDLKKLPGVSGAIEKKFNDLGIFHFWQLAELDQATAHQIGEELGLPSRADAWVAQAKSLTAEAE

SEQ ID NO: 661 - protein, 469 aa, Geobacillus kaustophilus
MAKQQIGVIGLAVMGKNLALNIESKGYSVAVYNRSREKTDEFLQEAKGKNIVGTYSIEEFVNALEKPRKILLMVKAGAPTDATIEQLKPHLEKGDIVIDGGNTYFKDTQRRNKELAELGIHFIGTGVSGGEEGALKGPSIMPGGQKEAHELVRPIFEAIAAKVDGEPCTTYIGPDGAGHYVKMVHNGIEYGDMQLIAEAYFLLKHVLGMDAAELHEVFADWNKGELNSYLIEITADIFTKIDEETGKPLVDVILDKAGQKGTGKWTSQNALDLGVPLPIITESVFARFLSAMKDERVKASKVLAGPAVKPFEGDRAHFIEAVRRALYMSKICSYAQGFAQMKAASEEYNWNLRYGDIAMIFRGGCIIRAQFLQKIKEAYDRDPALSNLLLDPYFKDIVERYQDALREIVATAAMRGIPVPGFASALAYYDSYRTAVLPANLIQAQRDYFGAHTYERVDKEGIFHTEWLK

SEQ ID NO: 662 - protein, 113 aa, Plasmopara halstedii
RSTGGKAPRKQLATKAARKSAPTAGGVKKPHRYRPGTVALREIRKYQKSTDLLIRKLPFQRLVREIAQDYKTDLRFQSTAILALQEASEAYLVGLFEDTNLCAIHAKRVTIMP

SEQ ID NO: 663 - protein, 406 aa, Haloarcula marismortui
MSRSPSLPERPRLELDPDMTPDERLEALREHFKEIVQVNEQLTEQLDAARDRQHDLTDEVDQLERENETLKTSSLYIATAEELTDDGVVVKQHGNNQEVLTEVSPSIRDGLEAGDRVAINDSFGVKQILDPETDARAQAMQVDGSPDVSYSDIGGLEEQIREVREAVEEPLVNAEQFREVGIEPPSGVLLHGPPGTGKTMLAKAVANETDATFIKMAGSELVRKFIGEGARLVRDLFELAAEREPAIIFIDEIDAIAAKRTESKTSGDAEVQRTMMQLLSEMDGFDERGEIRIIAATNRFDMLDRAILRPGRFDRLIEVPNPDVEGRERILEIHTQEMNLDDDVDLGAFATETDGLSGAELASLATEAGMFAIRDGRTTVQQADLHDALEKIEADDDASSVPVAFA

SEQ ID NO: 664 - protein, 182 aa, Aspergillus nidulans
MSNLQPSSSEPSIFEVGAFLPGGHNTDPALPENSPTAGFKLNHFMLRIRDPKRSLHFYMNLMGMRTVFTMNTGPWTIYYLGYPSTPQDRADLPAWSAKVGGDNRTLTSTLGLLELYHVHGSEKPISEGGYEISTGNEPPNLGFGHLGFTVPDVPKALERLRGAGVRVIKELSVSTRESIPLK

SEQ ID NO: 665 - protein, 180 aa, Capsicum annuum
MASSVMSTATVATGANAAQASMIASFNGLKSAASFPVTRKQDLDITSIASNGGRVQCMLVWPPINKKKYETLSYLPDLSDEQLLKEIEYLLQKGWVPCLEFETEHGFVYREHHRSPGYYDGRYWTMWKLPMFGCTDATQVLNEVQEAKKAYPQAWIRIIGFDNVRQVQCISFIAYKPEGY

SEQ ID NO: 666 - protein, 367 aa, Debaryomyces hansenii
MTAEYTKPVRRITNTEDLEIWNGSQAYSTILDFVQDLQDLVVGLTNDAQVTVSSSSEELLKVLDKVNEIIENNPVVHEKDISRFGKIEFRDFYDEICKKSFDILKPLVEKLEDDPRIELATYFNESWGNRTRIDYGSGHELNFIAFLACLQKLGIIKHEDYPCVIVRVFTKYMTVMRALQKLYWLEPAGSHGVWGLDDYHFLPFLFGSSQLATHPHMKPKLIHNEELVESFYKQYMYLECIHFINTIKTTPANQDQKLSLRWHSPMLDDILSAKSWAKIKEGMIKMYKAEVLGKLPIVQHFMFGSIIPCPDGVSEYHEHDDDSDCGHDHGGTVNTWGDCCGIKIPSALAASEMNKINNPNNKPIPFD

SEQ ID NO: 667 - protein, 559 aa, Legionella pneumophila
MCSIGEYLAKRLEELNISEYFAIPGDYNLILLDEVLKNEKLKMINCCNELNAGYAADGYARVKGVSALFVTYSVGGLSVVNAVAGAYAENLPILVISGGPNTNSIQDAEILHHTLATEDNLYVRDIFSRITAHVVCIRKPEQAAMQIDEAIAIAIAKKKPVYIEIACNIANYPISKPTQRAFNTYKISDSSSLAAAVEHAAEKLNSALKPSLIVGSKVRHCNAINSVSELAKCTGYAMAAMPDAKGFISEQHPNFIGIYWGPVSSSGCAEIIDSSDAYLLIGPNENDYTTVGYVWGINPHKSIKTTKGGVIIGETVYTNIFMNDFLRELSKKLKFNDASYKAYKRIAEETVVYPELDQPDAPLSSRYLFGQIQKMLSDKKALLAETGDSWFNCMRLSLPEGCPFEIQMQYGSIGWSVGALLGMQAALHNQKRVIACIGDGSFQMTAQEISTMIRYGYKPIIFLMNNACYTIEVQIHDGPYNVINNWRYAELVNVFRGEQSNAKSFIVKTNKELLTAIKQAEKTEALCFIEVFLDKDDCNKNLLEWGSRVANYNSRPPRR

SEQ ID NO: 668 - protein, 414 aa, Leifsonia xyli
MGAGKKIFGIVLAGGEGKRLMPLTTDRAKPAVPFGGQYRLIDFALSNLINSQLRQIVVLTQYKSHSLDRHISQTWRPDGMLNSYIASVPAQQRLGKRWFSGSADAILQSINLLRDEKPDIVVVVGADHVYRMDFGQMIRSHLDSGSSVTVAAIRQPVSLADQFGVIEVDPASPERIAAFREKPSDPVALPESPGEVLASMGNYVFTADALIAAVRRDADRPDSNHDMGGDIIPDFVARGEAGVYDFTNNEVPGSTDRDRYYWRDVGTIDSFFEAHQDLISALPVFNLYNRQWPIFSQVLNSPPAKIVRDGRGALGTTIDSIVSLGSVISGAHLERSVLGPWATVDSGAKVIDSVVFERALIEPNAFVGRAILDKDVVVAAGASIGVDPDRDRARGFTVTESGITVVGKGVHVVP

SEQ ID NO: 669 - protein, 503 aa, Yersinia pestis
MTQQNTKIPAQQGAQRLRRELKSRHLAMIAIGGSIGTGLFVASGATVSQAGPGGALLSYALIGLMVYFLMTSLGELAAFMPVSGSFSTYGSKYVEEGFGFALGWNYWYNWAVTIAVDLVAAQLVMNYWFPDAPGWIWSALFLGLMFLLNYISVKGFGEAEYWFSLIKVTTVVIFIIVGVMMITGIMKGGETAGWHNWTIGDAPFAGGFSAMIGVAMIVGFSFQGTELIGIAAGESKDPGKNIPKAIRKVFWRILLFYIFAILIISLIIPYTDPSLLRNDVKDISVSPFTLVFQNAGLLSAAAVMNAVILTAVLSAGNSGMYASTRMLFTLASEGKAPRIFAKLSKGGVPRNALYATTVVAGLCFLSSMFGNQTVYLWLLNTSGMTGFIAWLGIAISHYRFRRGYMMQGRDLNDLPYQSGFFPLGPIFAFVLCLIITLGQNYQAFLQDRIDWYGVTATYIGIPLFLVIWFGYKLSRGTRVVKYQEMEFPKWRDESEEHQKPTSR

SEQ ID NO: 670 - protein, 239 aa, Capsicum annuum
HEPKWNYDGSSTGQAPGEDSEVILYPQAIFRDPFRRGNNILVMCDAYTPAGEPIPTNKRHAAAKIFSHPDVVAEETWYGIEQEYTLLQREVNWPLGWPIGGFPGPQGPYYCGTGADKAFGRDIVDAHYKACLYAGINISGINGEVMPGQWEFQVGPAVGISSGDEVWVARYILERIAEIAGVVVSFDPKPIPGDWNGAGAHTNYSTKSMREDGGYEVIKKAIEKLSLKHKEHIAAYGEG

SEQ ID NO: 671 - protein, 326 aa, Pseudomonas fluorescens
MQLGIIGLGRMGGNIARRLMLNGHETVVFDRNTDFVSTLAAEGAKGVADLPALVAGLEKPRAVWVMLPAGAPTEDTIDTLSQLLEPGDVIIDGGNTYYKDDIRRARDLAQKGLKYIDVGTSGGVWGLERGYCMMIGGDAAEVLRLDPLFAALAPGMGTIPRTKDRVADDDRAERGYIHAGPAGSGHFVKMIHNGIEYGMMQAFAEGFDILKTKASESLPEDQRFDLNVADIAEVWRRGSVVSSWLLDLTADALAGDPKLDGFSGSVADSGEGRWTIEAAMEQSVPVPVLSNSLFSRYRSRGQGTYGDKLLSAMRFGFGGHVETGKK

SEQ ID NO: 672 - protein, 505 aa, Methylococcus capsulatus
MKNGNADVGLIGLAVMGQNLALNVADHGYTIAVYNRNYQRTQEFMAHCERAEPSRVRIRPCAELAEFVQAIARPRRIILLVKAGAGTDAVIGQLLPLLDPGDLVVDGGNAHWLDTIRRERELDAAGIRFIGSGVSGGEIGARFGPSLMPGGSAESWRLLEPVWQAIAAKVDPATGKPLEGAAPGRPVTGGEPCTALIGPNGAGHYVKMVHNGIEYIDMQLISEGYWLLKHLGGLESGAIASIFRDWNEGELSSYLIEITSDILQQQDPSGDGFLVDKVLDAAGQKGTGQWTAASALEQGVPANAIAEAVFARALSALKEERVAASVILQGPEVRLEADTVHLVEAVRDALYCAKICAYAQGFQLMAQAQKTYGWQLDFATIARIWRGGCIIRARFLQKITDAYGRDAALSNLMLDPYFRDALHRGQGHWREIVALAVRNGLPVPAFGSALAYFDGYRSASLPANLLQAQRDYFGAHTYERTDRPRGRFFHLDWPAPDRPEAEAGG

SEQ ID NO: 673 - protein, 278 aa, Triticum aestivum
  misc_feature (107)..(107): Xaa can be any naturally occurring amino acid
MVSADAARNVVGIIGNVISFGLFLSPTPVFWRIIKAKDVEEFKPDPYLATLLNCMLWVFYGLPIVHPNSILVVTINGIGLVIEGSYLIIFFLYSTNNKRLKMIGVLXPAEAAFMVAVVLGVLLGAHTHEKRSMIVGILCVIFGTIMYASPLTIMGKVIKTKSVEYMPFTLSLVNFLNGCCWLAYALIKFDLYVTIPNGLGAFFGLMQLILYGCYYKRTPKEEKSVELPTSNPAGSRQRLGHRGQISIGLQQQQQQTRRRQVILVRPAAEILALNILSS

SEQ ID NO: 674 - protein, 306 aa, Musa acuminata
MAIPVIDFSKLDGKERAETMARIANGCEEWGFFQLVNHGIPVELLERVKKVSSECYKLREERFKGSKPVQLLDTLVKEGDGQRLDNVDWEDVFVLRDDNEWPSNPPDFEETMKEYREEIRKLAEKMMEVMDENLGFEKGCIKKAFSGDGQHPPFFGTKVSHYPPCPRLDLVKGLRAHTDAGGVILLFQDDQVGGLQMLKDGRWIDVQPLADAIVINTGDQIEVLSNGRYKSAWHRVLATSHGNRRSIASFYNPSLKATIAPAAGAATEEAAPPALYPKFLFGDYMDVYAKQKYEPKEPRFEAVRAI

SEQ ID NO: 675 - protein, 221 aa, Gibberella zeae
MARRPARCYRYCKNKPYPKSRFNRGVPDPKIRIFDLGRKRANVDDFPLCIHLVSNEYEQLSSEALEAARICANKYLVKNTGKEGFHLRVRAHPFHVVRINKMLSCAGADRLQTGMRGAWGKPNGTVARVNIGQILMSVRTRDANRAIALEALRRSQYKFPGRQKIIVSKNWGFTPLRREEYLDKKAAGRVKVDGAYVQFLSNHGSLERNIRRFPDAFKSEA

SEQ ID NO: 676 - protein, 569 aa, Leifsonia xyli
MSFTAPITLPGLTLDPQWYRRSVFYEVMVRSFVDSNGDGSGDLAGLTSKLDYLQWLGIDALWLPPFFQSPLRDGGYDVSDFRAILPEFGTIDEFRDLVTKAHERNMRIIIDLPMNHTSDQHEWFQQSRSNPEGPFGDFYVWNETDDKYPDIRIIFVDTEDSNWAFDEARRQYYFHRFFSHQPDLNFENPAVHDAMFDIVRFWLDLGVDGFRLDAIPYLYESDEGNGEGEPPTHEFIKRLREVVDREYPGRMMVAEANQWPREVAAFFGSEEEPECHMAFDFPVMPRIFYALRSQQASELIHVLSETTDVPDGYAWGVFLRNHDELTLEMVSEEYRQAMYGWYAYDPRMRANIGIRRRLAPLLDNSRAELELAHALLFSLAGSPFLYYGDEIGMGDNIWLPDRDSSRTPMQWTPDRNAGFSSADPGKLFLPVVQSLVYHYNQVNVEAQLAQSRSLLHWVRNVIHVRKAHPVFGLGDMRVLPTNHESVLAFVRTYEGSGSHFGDQPEDVLCVFSFAHNPVSVTLEAPEFAGRTLYDLFGGAEFPTVAEDGRFTLTLGTQSFYWLHIEPRRD

SEQ ID NO: 677 - protein, 480 aa, Bacillus clausii
MSSQLDADNMKKPSKATYKYVVLGVLLLFLFASPFLPVPESMELRGWSALAVVTLGIGLWFTHLLPPAVTAMLLIVLFPLFGVLTFEQSAESLGKEVIWLIIAMLMMGAAVERTGLDKRIAFTILTLTKGNIRLVLLALIFVGFVLTFFLPNAIGRVVVLLPIALGVVQSLAGTGGPNVGKASMFAITYTPIICSVALITGATGSVYAASLFETMLGFEWRYLYWMAVMLPSTLAILLILWLALLWLFPVKAGKHAQGEAYFKQEKEKLGPMSFQEKTLLILYVLLITLWTTQSVHQLSISFSAVLIVIALYIPGIQLMEWKEAVAKVDWSIPLLFSAGFSMAEAFEAGGVVQWSSSLASAHLNGLPAFTLAVSLLLVVAAIRIGFTNLTAMIASLMPVALTFAAGSNVNPVWLGMICLAACSTGFLFPSQSVGTMMTYALGYYTSQELLKVGAILTLSVIVITLLAAFLYWPLIGLPVH

SEQ ID NO: 678 - protein, 613 aa, Unknown
  Synechococcus sp. RS9916
MTAASMHNQAAGERQVITLPVSDGLISLRGLSPQRLRFELEYALERGSTANSFLFAAGSDTTGQQRAAVLVHPPGAAYADVFLPALAAALPSNCSELLVVVGHVNPNRVALLRSLAEVYSQLTLICSNPGAKLLQELWQQRKPLPPGEVDNRPPLPALPPLQVIRQEQRLPLSHGHSLQLLPAPTPRWPGGLLAFEEQGGLLMSDKLFSAHVCTADWAESNRNATEEERRHFYDSLMAPMATQVDAVVERLEELDIRTIAPGHGPAIEASWRSLLSDYRRWGESQQKAALNVALLFASAYGNTAAIADALARGVSRTGVRVTSLNCEFTPADELVATIRSADAILIGSPTLGGHAPTPIVSALGTVLAEGDRSKPVGVFGSFGWSGEALDLLENKLRDGGFSFGFEPIRIKFSPDAATVRTLEETGTRFARDLQQEQRKQQRRSAGGLSESRSDPAVLALGRVVGSLCVLTARKGAGDAAQTGAMVASWVSQASFTPPGLTVAVAKDRAVEALLHKGDRFALNVLAEGRETGPMKQFLQPFAPGADRFAGLELDTSPNDQPLLPEALAWLDGEVKQRMECGDHWLIYAEVSHGGLVDGEGTTAVHRRRSGANY

SEQ ID NO: 679 - protein, 302 aa, Kluyveromyces lactis
MNVARIGIGQLCSSSNLKQNLEVVKSLIKKALDQDVKVLFFPEATDYLSRNAEHSKKLASQTPEFISELQSAICQLTKAAGKPIDISIGIHMPPSEVNTKNGDSRVKNVLLYINSNGEILQKYQKLHLFDVDVPNGPILKESNSVQPGSEIPSIINTPVGKLGSCICYDIRFPELSLKLRSKGAQILCFPSAFTMKTGEAHWELLGRARAIDTQSFVVMPAQQGEHDVYADEKPSDESAVKRISWGHSMIIDPWGRILSAADLTTHDPQLIIADLDIEAQDKIRRDMPLWAQRRRDIFGDFV

SEQ ID NO: 680 - protein, 345 aa, Thiobacillus denitrificans
MEMPLPVLVRISHCPIPPLGSQRTRAMSTQHHKLVILGSGPAGYSAAVYAARANLSPVVITGMQQGGQLMTTTEVDNWPADVDGVQGPELMDRFQRHAERFQTEIIFDQIHTAKLSEKPFTLIGDSATYTCDALIIATGASAMYLGLPSEQAFMGKGVSGCATCDGFFYKGQDVAVIGGGNSAVEEALYLANIARHVTLVHRRDTFKAEKILINNLMDKVKEGKITLALDSTLDEVLGDKTGVTGMRIKSTKDGATRDIALTGVFIAIGHKPNTGIFEGQLELEGGYIVTRGGNKGNATATSVEGVFAAGDVQDHIYRQAVTSAGTGCMAALDAERYLDALGKTK

SEQ ID NO: 681 - protein, 128 aa, Oceanobacillus iheyensis
MEQMEHRTIYEAIGGYRTMNNIVHAFYTRVEVHPDLKPIFPDDLTETIRRQMMFLTQFFGGPRLYEEERGHPMLRRRHLPFPITPTRRDAWLTCMAAALEEAEIKEPYRTAMMERLTLTANHMMNTPE

SEQ ID NO: 682 - protein, 112 aa, Clostridium longisporum
MKKIEAVIRPEKLEELKDALKKGNINGITVDQVMGCGQQHGWTEHYRGSEIMVNFLPKVEVKVIVDDSKVQEVINLIIDTVKTGEVGDGKIFVSDVSECIRIRTGEKGLDAL

SEQ ID NO: 683 - protein, 153 aa, Brassica napus
  misc_feature (136)..(136): Xaa can be any naturally occurring amino acid
MAISLPTAHVSPPKSCFSFSSSSKLSSHSSLRFGIRHERVNSRSSSRCACAPLTVRAKKQTFNSFDDLLLNSDKPLLVDFYATCPLCGPCQLMVPILNEVSETLRDKIAVVKIDTEKYPSLANKYQVEALPTFILXFKDGKLWDRFVSLYHLM

SEQ ID NO: 684 - protein, 540 aa, Unknown
  Shewanella sp. MR-4
MSELTWWRGAVIYQIYPRSLLDTNGDGVGDLRGIITKLDYIASLNVDAIWISPFFKSPMADFGYDISDYREVDPLFGSMQDFDELIEKAHQRGIKVIIDQVLSHTSDQHAWFCESRESRTNPKADWYVWADPKEDGTAPNNWLAIFGGCAWEWEPRRQQYYLHNFLRSQPDINFHNPDVRQAVLENVEFWLKKGVDGFRLDAITFCYHDEQLRDNPAKPKDKRQGRGFSEDNPYAYQYHYYNNDRPQTILFIEELRQLINRYPGAVTLGEVSAEDSLAVMAAYTKGEDRLHMAYSFELLTDDYSAAYIRQTVEALEASIGDGWPCWAIGNHDVQRVASRWGRGKQTHDMVKMLNAMLSSLRGRVCSYQGEELGLTEAPIEYHELQDPFGKTFWPMFKGRDGCRTPMPWEQHADFSGFSQVTPWLPVANAHRALAVDVQEADPASMLQGYRQFLAWRKGYPILIEGEIEFLDAPEPLLVFVRTLGEQKLLVCFNLLDTETQWVLDKLSIQQELTGHGLKTAQRVADTLTFSAYACFYALLN

SEQ ID NO: 685 - protein, 987 aa, Unknown
  Synechococcus sp. RS9916
MTQLEQRPQSAETAIKFSPFVQRHVGPNAADQQVMLQALGFADLDAFVRAVVPAAILDAEPPVASMPPGCGEAEALAELRQIGSQNKVRRSLIGLGYHDTATPALIKRHVLENPSWYTAYTPYQAEIAQGRLEALLNFQTLISELTGLPIANASLLDESTAAAEAMGLSFAVCKRPDAKRFLVDAAVLPQTWAVLQTRAEPLGVVLELAEPEAFRWDADVFGVLLQLPGRCGRLWDPKPLIEQAHAHGALATVAIDPFAQVLMAPVGDLGADIAVGSAQRFGVPMAGGGPHAAFFATRDAFKRQVPGRIVGQSRDAEGNPALRLALQTREQHIRRDKATSNICTAQVLLAVMASFYAVHHGPDGLAVIARRMVALRHQLESGLRQLGYPVAEQCRFDGLDVHCPQAPVVHRLASEQGYNLRVLPDGASPEQAEGFGISLDECSDSEELESLLGLLAAALGVTPPPPLERGADDETLSGAALAAALPGVPLRQTPWLQQPVFHQHRSETELLRYIQRLVSRDLSLVHSMIPLGSCTMKLNAAAELAPVSWHGFAALHPFAPAEQLAGFERMVTDLERWLAALTGFAGVSLQPNAGSQGEYAGLLVIRAWHQSRGEAHRDVCLIPTSAHGTNPASAVMAGLRVVAVACDEQGNVDLADLRAKAEQHADRLAALMVTYPSTHGVFEPGIRDICDCVHAHGGQVYLDGANLNAQVGLCRPGAFGADVCHLNLHKTFCIPHGGGGPGVGPIGVATHLLPFLPGHPLATCGGDQAISAVSAAPWGSAGILPISWMYLRLMGPHGLRQATAVALLSANYLARRLDAHFPVLFRGEGGLVAHECILDLRGLKRTAALEVDDIAKRLMDYGFHAPTVSWPVAGTVMVEPTESESLAELDRFCDAMIAIRAEAAAIESGAIDSLNNPLKRAPHTLAAVTADHWDRPYSREQAAFPLAGQRESKFWPHVARIDNAFGDRNLVCTCPSVEELAELPSAG

SEQ ID NO: 686 - protein, 204 aa, Viburnum stenocalyx
YSKPVKGRKINWMKAGIIESDGVFTVSPYYAEELVSGVEKGVELDNIIRKTGITGIANGMDTQEWNPATDKYVGVKYDITTVMDAKPLLKESLQAEVGLPVDRNIPLIGFIGRLEEQKGSDILAAAVPKFIEQNVQIVVLGTGKKYMEKQLEQLEILYPDKARGVAKFNVALAHMIIAGADFMMIPSRFEPCGLIQLHAMRYGT

SEQ ID NO: 687 - protein, 753 aa, Arabidopsis thaliana
MAVQPTRIGLAGLAVMGQNLALNIAEKGFPISVYNRTTSKVDETVERAKKEGNLPLYGFHDPESFVKSIQKPRVIIMLVKAGSPVDQTIKTLSAYLEKGDCIVDGGNEWYENTERREKAVAENGFLYLGMGVSGGEEGARNGPSMMPGGSYEAYKNIEDIVLKVAAQVRDSGPCVTYIGKGGSGNFVKMVHNGIEYGDMQLIAEAYDVLKSVGKLSNEELHSVFSDWNKGELESFLVEITADIFGIKDDKGDGHLVDKVLDKTGMKGTGKWTVQQAAELSVPAPTIESSLDARFLSGLKDERVQAAKVFKAGGFGDILTDQKVDKKQLVDDVRKALYASKICSYAQGMNLIRAKSIEKGWGLKLGELARIWKGGCIIRAIFLDRIKQAYDRNAELANLLVDPEFAKEIIERQSAWRRVVCLAINSGISTPGMSASLAYFDSYRRERLPANLVQAQRDYFGAHTYERTDVEGSFHTECVRRIASATSFPLERLKLISAAMEEKDWEGSPLSENEAGLLCYDDEEYQFGGPAPKLQFRWRDLIQDMIDLGMAEVEVKRGKLWTTTGIIRTGKTYCFIEEALYLSEIGELQLLGDEDDVVISLKDLYGEIAEGKYGCCWENYEVYRYLKGLGYILGRHGVPWTTKYAVNTTPSDEDESLCAAEFFQDRDSVTKLLSDMHICDARPVFDVYLPNSQFKKSSPGEPSFVTCFSGDSPPSKEEIKVLQKCIVSPLMFCHIAQGRATFFSFNSIDLLVLP

SEQ ID NO: 688 - protein, 318 aa, Oryza sativa
MDFPGDAEDFALEFIREHLLGGDAPVLPPAAVPAAAAYLPTSTMFLPQQQRGYAGLTPQEYVVDSAPAADQAAFRDDQPDPAADVMIMFGGERFPAVKPSSSSSPSLTVTVPPSSFGSWAPAAVPAVAATAAAVEDFRKYRGVRQRPWGKFAAEIRDPKRRGSRVWLGTYDTPVEAARAYDRAAFRMRGAKAILNFPNEVGTRGAELWATPPPTNKRKRQPEDDTAAADDVEVIGVANKAVKTEAPTSAYSSSSLSSMSRDTTATTSSAGTSTGSSEPTSFPVVTPSSWSWDQYWDGLPPLSPLSPHPALGFPQLTVS

SEQ ID NO: 689 - protein, 552 aa, Glycine max
MALAPPSVFALYIVIDLKIEIYMTISAMCGILAVLGCVDNSQTKRARIIELSRRLRHRGPDWSGIHCYEDCYLAHQRLAIVDPTSGDQPLYNEDKTVIVTYEEHGEEFVNMLDGMFAFILLDTRDKSFIAARDAIGITPLYLGWGHDGSTWFASEMKALSDDCERFISFPPGHIYSSKQGGLRRWYNPPWFSEDIPSTPYDPTLLRETFERAVVKRMMTDVPFGVLLSGGLDSSLVAAVVNRYLAESESARQWGSQLHTFCIGLKGSPDLKAAKEVADYLGTRHHELYFTVQEGIDALEEVIYHIETYDVTTIRASTAMFLMSRKIKALGVKMVLSGEGSDEIFGVFMALMIWQIKALHLYDCLRANKSTAAWGVEARVPFLDKEFINVAMSIDPEWKMIRPDLGRIEKWVLRNAFDDDKNPYLPKHILYRQKEQFSDGVGYSWIDGLKDHANKQVTDATMMAANFIYPENTPTTKEGYLYRTIFEKFFPKNAAKATVPGGPSVACSTAKAVEWDAAWSKNLDPSGRAALGIHDAAYDAVDTKIDEPKNGTL

SEQ ID NO: 690 - protein, 204 aa, Viburnum erubescens
YDKPVKGRKINWMKAGILESDRVFTVSPYYAEELVSGVDKGVELDNFIRKTGITGIVNGMDTQEWNPAMDKYVGVNYDITTVMDAKPLLKEALQAELGLPVDRNIPLIGFIGRLEEQKGSDILAAAIPKFIEQNVQIVVLGTGKKYMEKQLEQLEILYPDKARGVAKFNVALAHMIIAGADFMMIPSRFEPCGLIQLHAMRYGT

SEQ ID NO: 691 - protein, 240 aa, Glycine max
  misc_feature (5)..(6): Xaa can be any naturally occurring amino acid
  misc_feature (8)..(10): Xaa can be any naturally occurring amino acid
  misc_feature (13)..(16): Xaa can be any naturally occurring amino acid
  misc_feature (24)..(24): Xaa can be any naturally occurring amino acid
  misc_feature (29)..(29): Xaa can be any naturally occurring amino acid
  misc_feature (35)..(35): Xaa can be any naturally occurring amino acid
  misc_feature (52)..(52): Xaa can be any naturally occurring amino acid
  misc_feature (65)..(65): Xaa can be any naturally occurring amino acid
  misc_feature (109)..(109): Xaa can be any naturally occurring amino acid
SIISXXSXXXEEXXXXQEAHVDMXGCLMXREENRXKLTDEEIIDLIITIMYXGYETVSTTSMMAXKYLHDHPKVLEEIRKEHFAIRERKKPEDPIDGNDLKSMRFTRAXIFETSRLATTVNGVLRKTTHDMELNGYLIPKGWRIYVYTREINYDPFLYHDPLAFNPWRWLGNSLESQSHFLIFGGGTRQCPGKELGIAEISTFLHYFVTRYRWEEVGGGKLMKFPRVVAPNGLHIRVSPY

SEQ ID NO: 692 - protein, 461 aa, Arabidopsis thaliana
MDPCPFIRLTIGNLALKVPLAAKTTSSVVHPSSSPCFCKIKLKNFPPQTAAIPYIPLETTQFPEIQTLAATFHLSSSDIQRLASRSIFTSKPCLKILIYTGRAGAACGVHSGRLLAKVSVPLDLSGTQSKPCVFHNGWISVGKGAGKSSSSAQFHLNVKAEPDPRFVFQFDGEPECSPQVVQIQGNIRQPVFTCKFSCRHTGDRTQRSRSLPTETSVSRSWLNSFGSERERPGKERKGWSITVHDLSGSPVAMASIVTPFVAFPGTDRVSRSNPGSWLILRPGDCTWRPWGRLEAWRERGGATDGLGYRFELIPDGSSGAGIVLAESTISSHRGGKFSIELGSSPSSSSPTSVVNRSRSRRGGSSGSGGGASPANSPRGGSGDYGYGLWPWNVYKGFVMSASVEGEGKCSKPCVEVSVQHVSCMEDAAAYVALSAAIDLSMDACRLFNQRMRKELCHESLS

SEQ ID NO: 693 - protein, 446 aa, Escherichia coli
MSKQQIGVVGMAVMGRNLALNIESRGYTVSIFNRSREKTEEVVAENPGKKLVPHYTVKEFVESLETPRRILLMVKAGAGTDAAIDSLKPYLDKGDIIIDGGNTFFQDTIRRNRELSAEGFNFIGTGVSGGEEGALKGPSIMPGGQKEAYELVAPILTKIAAVAEDGEPCVTYIGADGAGHYVKMVHNGIEYGDMQLIAEAYSLLKGGLNLSNEELATTFTEWNEGELSSYLIDITKDIFTKKDEDGKYLVDVILDEAANKGTGKWTSQSSLDLGEPLSLITESVFARYISSLKDQRVAASKVLTGPQAKLAGDKAEFVEKVRRALYLGKIVSYAQGFSQLRAASDEYNWDLNYGEIAKIFRAGCIIRAQFLQKITDAYAENASIANLLLAPYFKNIADEYQQALRDVVAYAVQNGIPVPTFSAAVAYYDSYRAAVLPANLIQAQRD

SEQ ID NO: 694 - protein, 356 aa, Rhizobium leguminosarum
MPAARAALDDVWNPEDDDALVCLDVQQETHDVKTFTFASREGKRFAFKAGQYFLFDLERDGDAENRCYSISSSPHRTNAFSVTVKRVPGGKISNWLHDTLVPGATVKANGPLGHFVRPETSGRKLLLLSGGSGITPVMSILRELADSCEPADVVFMHAGRTPQDLIFRDELACIARRLKGLRLHFLPETVAGEPSWPGLTGRISKDYMRLAVPDIAERTVMCCGPAPFMAAARSIAAELGVPGSNYLEESFDAAVVDEAEIPAVQEAAAKVFQVTFSKQARSIDVSGDQSVLSCAKKSGVRIPSSCANGVCGTCKSKLTSGTVDMNHNGGIRQREIDAGFFLPCCSKPLSDLVIER

SEQ ID NO: 695 - protein, 92 aa, Arabidopsis thaliana
  misc_feature (47)..(47): Xaa can be any naturally occurring amino acid
MSNRRSRQTSNASRISDDQMIDLVSKLRQFLPEIHERRRSDKVSASXVLQETCNYIRKLHREVDNLSDRLSQLLDSVDEDSPEAAVIRSLLM

SEQ ID NO: 696 - protein, 642 aa, Clostridium acetobutylicum
MRKVMLAEKAGFCFGVKRAVDMALLTQKEYNKKIYTLGELIHNNDVVDKLKDNNVYPIGIEDIDNLKENDVILIRSHGISEEIYKILLSKGLTVINATCPFVTKIQEKVKKYNELGYDIVIVGDKYHPEVIGINGWCDNKAIISKQGENLENITSESKVCIVSQTTEKLENWEKVLKEVKNRAIEVISFNTICNATSERQKIAKDLSNKVDFMVVIGGKQSSNTTKLYEICKSNCNETIHVENSGEIPENILKNKNCVIGVTAGASTPDWIIEEAISKMSENQISNETNNEMADAMKFIAENEGKIYVGASVTGEIIQVSEKEVFLNINYKRDGVIPKSEIDDDGKDLKELFTVGDKIVAKIIKLKDADNYVVLSVKELQREQGYKEIKEAFENKTTLNVVVKEDVKGGIIASYKGIRIFIPASHVELFHVDNLKEYIGKSFDVAIIEYSTKKRQTKIVASRRALLSKEKEKVEETVWNKLEEGQVVEGEVKRLTDFGAFVEIEGVDGLLHVSEISWGRVEKPADVLKIGDKIKVYVLSVDKENKKLSLSVKKLTENPWNNVEEKYPVGSVVLGKVIRFADFGAFVKLEPGVDGLVHISEISHKRIAKPSDALNVGEEIKAKILEVSSEEKKIGLSIREVEE

SEQ ID NO: 697 - protein, 325 aa, Oryza sativa
MAESGQSIASDVTALIGNTPLVYLNKVVDGCEAQIAAKLEIMEPCSSVKDRIGYSMITDAEEKGLITPGKSVLIEPTSGNTGIGLAFMAAAKGYKLILTMPASMSMERRIILKAFGAELVLTDPLLGMKGAIQKADELAAKMPNSYILQQFENPANPKIHYETTGPEIWKATAGKVDILVSGIGTGGTVTGTGKYLKEQNPEIKIYGVEPTESAILSGGRPGPHKIQGIGAGFVPGVLDVNLLDEVVQVSSDEAISMAKQLALKEGLLVGISSGAAAVAAIRVAQRPENKGKLVVVVFPSFGERYLSSVLFESIKREAENMVFEP

SEQ ID NO: 698 - protein, 454 aa, Triticum aestivum
  misc_feature (349)..(349): Xaa can be any naturally occurring amino acid
  misc_feature (354)..(354): Xaa can be any naturally occurring amino acid
  misc_feature (363)..(363): Xaa can be any naturally occurring amino acid
  misc_feature (383)..(383): Xaa can be any naturally occurring amino acid
  misc_feature (391)..(391): Xaa can be any naturally occurring amino acid
AYLGDTIEQVCTKKQAGTGPEFPGYRRPTRPSVMAGDGIEDVIIACNSKKIRSNNTAPVRPLVPGGVGCAKASMLLQSVPPAVLVRFLREHRSEWADYNFDAYSASALKSSSCSLPGLRPMRFSGSQIIMPLAHTVENEEILEVVRLEGQALDEGLLSRDIHLLQFCTGIDEKSMGSCFQLVFAPIDELFPDDAPLISSGFRVIPLDMKTDGAPAGRTLDLASSLEAGSTTLQASGGADDCNLRSVLTIAFQFPYEMHLQDSVATMARQYVRSIVSAVQRVSMAISPSRSGLNAEQKIISGFPEAATLARWICQSYRFHLGVELFRQADEAGESLLRMLWDHEDAILCXSFKEXPVFTFANEXGITCGKHLSLPSNLVEKIVXCKRILDEXGRKALYSEIPKLMEQGFVYLPGGVCLSGMGRHVSFESAVAWKVVGEDNNVHCLAFCFVNWSFV

SEQ ID NO: 699 - protein, 478 aa, Pseudomonas fluorescens
MSLQEQQTDLRGGFKQEMQTRHIVMLALGGVIGTGLFLTSGYTVNQAGPLGAVIAYIIGALMVYLVMMCLGELAVQMPETGSFSTYATRFLGPGTGYTVAWLYWLTWTVAIGSEFTAAGILMARWFPETPVWIWSALFAMVVFLSNVVSVRLFAETEFWLSLVKVITVLAFLVVGGGAILGLLHIDQAHSIGLSNFTREGLFPTGFMPIAMTLLAVAFAFSGTELIGIAAGETRDPQRNVPRAIRTTVLRLAIFFVGTIFVLATLLPREQAGLVESPFVTVFTYIGIPYSADIMNFVIISALLSAANSGLYAASRMLWTLSDQGHLPKQFSALTRMGTPLNAIIVSMAGGAASLLSSVFAPDTIYLALVSISGLAVVVVWMSIAASQIAFRRHFVANGGDVRDLKFRVRGYPWVPLGALLCCALACVGIGFDPEQRVALYFGLPFIAWCYLVYYITRSSRQRRLSLAALARPSDALQG

SEQ ID NO: 700 - protein, 535 aa, Oryza sativa
  misc_feature (422)..(422): Xaa can be any naturally occurring amino acid
  misc_feature (447)..(447): Xaa can be any naturally occurring amino acid
  misc_feature (517)..(517): Xaa can be any naturally occurring amino acid
  misc_feature (525)..(525): Xaa can be any naturally occurring amino acid
MLSSMFLFLLPLSLLSFSLLGNLWAGAATSAGEGWSSVGLRLMLLGGATPFFYINIETVIITNMNYYPEGSNPVYFAVLVKYEDLDGDVVQVDLMESKSAYGGAIGVWTPMRESWGSASAVTSARPFVTNNVIPAIWSRIAPSLPPSPLPRRPRSALAHCRASPASVSPSARASPTPPSPRSPPHRPSRSRHLLLSGIPAAALVVACPNLNDLDFSNDHYGSTSGMRRRRRWPSCVGFWGGFGDGDGDRYSITFSAYIVVLRTQEAYVQILQQLHRSTSLEMDPHSHKKAHEGLIGDNPDAYAVTTYQPVLMVEPSAAAAFPPAPQVAPAYPVNPMQLPEHQQHAIQQVQQLQQQQKEQLQAFWADQMAEVEQMTEFKLPNLPLARIKKIMKADEDVKMIAGEAPALFAKACEMFILDMTLXRSWQPHRGGQEEGRCQRSDVEAVIXKKTDIFDFLVDIITDDKMKDDGMGSQAASMVSPYTSGGMGFSFDLYPNQHHLAYMWPPQEQQEQWPPQEXQQEQKQKXQDSDGGGQDE

SEQ ID NO: 701 - protein, 389 aa, Picrophilus torridus
MPVYIIGAGPGNEDLYTIGSIRIIEMADVIIYDHLVNPGILRFARRDCILVYAGKKPYSEKVPQEEINKMIFEYSKIYENVVRLKGGDPFIFGRGGEEVSFLIKNNVDFVIMPGISSSISVPEMDYVPLTYRGLNSGLIITTGHNVDNMIQNFDLKKLSLVIMMGTHNVEEILDKLSMVYDMNTNVSIIENGTYDFSNVYHGSIKSIDFNYNGNPGIIVIGDAARPLYKRRRSENTVILHCMDYYDLYPGFVKIRLGYPVLSSFSDSLFIGAEYVESFFRLLNEKKIDIRNIINIDSDEYGKKLLMRHGIFKFSSARKNFADIIEIKGTGLNEYYIDYIKKAQRIVFLDKSYMFYNDLHEIIKGKKILATGEAHSHIIDSNKMEFGDDL

SEQ ID NO: 702 - protein, 307 aa, Aspergillus oryzae
MPFSHHSHSGQFCPGHAKDSLEEVIQLAIAKKFQVFCLTEHMPRGKEDFYPEEIEAGNTETSLVANEAAYFQEAQRLREKYADQIKILIGFEIDWIRPESRTLIEASLARHPFEFFMGSVHHTLTIPIDYDREMYVQARDLAGGTDEQLFQVYFDEQYQMLQQLKPLVVGHFDLIRLKSDDPERSFTQWPAVWERILRNLDFVASYGGLLELNSAALRKGMSEPYPKAEICKEFLTRGGRFCLSDDSHGLDQVGLNFHRVLAFVENVGISTLHYLDLADEPAVDERFPRTQIRSIPLQELKKLAFWQ

SEQ ID NO: 703 - protein, 392 aa, Sulfolobus tokodaii
MSDELDSYRAKHYNSDDPIVRLLEEKIESLTKELEKLRQDLNWYKGELEKLLAPPYIEAIVLDILPDGKVIVRSSSGPNLIVNVSSNIDIKKLKPGSLVALTQRGSTIVEVLPEREDAYVKSFEVIEKPNVHYSDIGGLNEQINEIREVIELPLKNPELFKEIGIDPPKGVLLYGPPGTGKTLLAKAVATESNATFIQVVASEFAQKFVGEGARIVREVFELARRKAPSIVFIDEIDAIGAKRVDMGTSGEREIQRTLMQLLAEIDGFKPLDNVKIIAATNRLDILDPALLRPGRFDRLIEVPLPNFEGRKEIFRIYLQKMKTDGNIRYDILASMTEGFSGAEIKNVCTEAGYIAIRNGRKYVNMTDLITAIEKIKAKNNKAKNTDRTEKYV

SEQ ID NO: 704 - protein, 183 aa, Idiomarina baltica
MSRHFDQAKGLSEHHDPATHKFVFNQTMFRIKDPERTLKFYSEVLGMTLIKRLDFPEMKFTLYFMASISPEERSHWSTDHDERIVQTFGRPAMLELTHNWGDENDDNVSYHSGNQEPKGFGHIGFAVPDIDSACERFEELGVEFQKKPNDGNMKGIAFIKDPDGYWIEIFTPNRQPDLLREHL

SEQ ID NO: 705 - protein, 451 aa, Haloarcula marismortui
MPSGSCLYPPIDTPSMHVDIGAALASAADPGVERATLDDLDEQVAVAHERIEQGRNKGEFGYASLNLLEATDAETIHDAVAPVADAESVITVGIGGSALGAKTITEALAEDPGSHVVLDNVDPEHVRRTLDGLSLADTAINVVSRSGTTAETLANFLVVREAYEDRGVDWTERIVVTTGESGPLRALADQHDLPTLPVPEGVPGRFSALSAVGLVPPAILGIDIEGLLAGGQQAADDLAPSLYDSPAYAYGAMAYALEEAGATVNAVMPYAERLESFGEWFAQLWAESLGKDGRGQTPARALGATDQHSQLQLYRAGHRDKVVTFVRPRERADVSIPDPDHEDLSYLAGTDLGGLIDAEYEATVASLPAADRPALEVEIDRLDAESVGELLYAMEAACVLVGELADVETFTQPAVEWGKNATRALIRGEATDETAVIDERERLRIGETESL

SEQ ID NO: 706 - protein, 446 aa, Oryza sativa
MPHLLYCQCHFRPRVRPRVRLHAPFALLPMSFSKVYWDQAVELAPLFNELVDRVSLDGDFLQETLARTKEVDSFTGRLLDIHAKMMKLNKKEDVRLGLTRSDYMIDGATDQLLQVELNTISTSSNGLACGVCELHRNLIRQHERELGLDPESVVGNTAIAQHAEALAGAWAEFNNQSSVVLVVVQPEERYMYDQYWITVALREMYGVTTIRKTMAAIDAEGELRPDGTLTIDGLPVAVVYFRAGYTPNDYPSEAEWRARLLIECSSAIKCPSIAHHLVGTKKIQQELAKENVLERFLDNKADIEKVRKCFAGLWSLENDSIVMSAIESPELFVLKPQREGGGNNIYGDNLRETLISLKKDGSNELAAYILMQRIFPPASLCYLVRDGTCIRENAVSEFGIFGAYLRNKDRVIINDQCGYLMRTKAASLNEGGVVAGYAFLNSVFLT

SEQ ID NO: 707 - protein, 450 aa, Leifsonia xyli
MTPVLSTLLDDVLRRNAGEPEFHQATREVFGSLGPVIAAQPRYTQAAVLERLTEPERQLIFRVPWTDDEGNVRVNRGFRVEFNSALGPFKGGLRFHPSVTLGTVKFLGFEQIFKNALTGLPIGGGKGGSDFDPKGRSDAEVMRFCQSFMTELYRHLGEYTDVPAGDIGVGGREIGYLFGQYKRITNRYESGVLTSKGIGWGGSLVRTEATGYGSVFFAERMLATRGRDFTGVRVLVSGSGNVALYAIEKVHQLGGTVVACSDSSGVVYDRGGLDLDLLRQIKENERGRLSDYAARRAAGSEYRANGDIWAIAAQTPIDVALLAATQNELDATAAATLAQNGVIAVVEGANMPCTPEAVHLLRTAGVLFAPGKAANAGGVATSALEMQQNASRDAWSFEYAEGRLADIMANIHDSCAETAEKYGAPGDYVLGANIAGFVRVADAMLALGVI

SEQ ID NO: 708 - protein, 969 aa, Prochlorococcus marinus
MNPKSNTDLFIDRHLGLNDNDEKKMLQKLGFNNIDEFIHQVIPEDIQLKEKCSDVLPKGCSEIEALNELEEISNKNHKFRSLIGLGYYGTHTPKVIQRHVLENPRWYTAYTPYQAEIAQGRLEALFNFQTLICELTGFSIANASLLDEGTAASEAMTMSFSSRKNKSSNTFLVDENVFDHTFNVLLTRAKPLGIKLKRFNQKYFNNHDDVFGLLIQLPGKNGDLFDPTFLISQAHKAEIVVTSIIDPLAQVLIKPIAQFGVDIAVGSLQRFGVPMGFGGPHAAFFACTEKYKRLIPGRIVGQTLSKNGEQSLRLALQTREQHIRREKATSNICTAQSLLAIISSFYATYHGSLGLTKMAKRLVVLRRYLESLLSELGLKIPLGSRFDSFDIYCEESEKIHKEALKNGFNFRILPLGSSIEESKGFGISLDELTDKNEIHKIVNCVANGLGRKEDLTHITLNNCFQFEGIPLRNKEWMQQNVFENYQSETDLMRYIFKLAEKDFSLVDGMIPLGSCTMKLNSAAELSPISWANLSSIHPFAPANQTNGYSKIISDLEKWISDLIGLNSVSFQPNAGSQGEFAGLLAINSYFSSKGDLLRKKCLIPQSAHGTNPASAVMAGFDVVTIKCDSEGNISYEDLLNKVQEFDNTIGALMLTYPSTHGVFELKIREICDLIHSVGAFVYLDGANLNAQVGLCRPGDYGVDVCHLNLHKTFCIPHGGGGPGVGPVATSETLSPFLPSHSLKDNTFSQFGYSVSSSQHGSASILPISWMYIKMAGQRGLRKASSHAILSANYIANTLKNKFKILYKGQNNCVAHECILDFRELKSKTGLSVNDIAKRLIDYSFHAPTISWPVPETIMIEPTESESLTELNRFCEAMILISEEIEEIENNINLRNNNLISNAPHTINELIADNWNYPYSKEKAAYPYKGKFEHKFWSSVSRIDNAYGDRNLICSCNVNDKDFLDDKKCA

SEQ ID NO: 709 - protein, 288 aa, Glycine max
  misc_feature (24)..(24): Xaa can be any naturally occurring amino acid
MAEATQSNAELLEWPKKDKRRFLXHVVYRVGDLDRTIKFYTECFGMKLLRKRDIPEEKYANAFLGFGPEQSHFVVELTYNYGVTSYDIGTGFGHFAIATPDVYKLVEDIRAKGGNITREPGPVKGGKSVIAFVKDPDGYAFELIQRSSTPEPLCQVMLRVGDLERSIKFYEKTLGLRVVKKTDRPEYKYTVAMLGYAEEHETTVLELTYNYGVTEYTKGNAYAQVAIGTDDVYKSAEVVNIVTQELGGKITRQPGPVPGLNTKITSFLDPDGWKTVLVDNQDFLKELE

SEQ ID NO: 710 - protein, 429 aa, Corynebacterium diphtheriae
MTDDIRYQSLTELDPEVAAAITGELDRQRSTLEMIASENFVPRAVLQAQGSVFTNKYAEGYPGRRYYGGCENADIVEDLARNRAKEVFGAEFANVQPHAGAQANAAVLMALANPGDKIMGLSLAHGGHLTHGMHLNFSGKLYEVAAYEVEPDNFRLDMDKIREQALKEKPQVLIAGWSAYPRHQDFAAFRSIADEVDAKLWVDMAHFAGLVAAGLHPSPVPYADVVSTTVHKTLGGPRSGMILSKQEYAKKLNSAVFPGQQGGPLMHAIVAKAVAMKIAATEEFKDRQQRTLDGAQIIAERLTGADCKAAGVDVLTGGTDVHLVLVDLRNSQMDGQQAEDLLHEVGITVNRNAVPFDPRPPMVTSGLRIGTPALATRGFDAAGFTEVADIIATALAQGAGADTEQLRARVAKLAEQYPLYEGLEDWKLL

SEQ ID NO: 711 - protein, 305 aa, Streptococcus pyogenes
MYDTLIIGSGPAGMTAALYAARSNLSVAIIEQGAPGGQMNNTFDIENYPGYDHISGPELAMKMYEPLEKFNVENIYGIVQKIENFGDYKCVLTEDASYEAKTVIIATGAKYRVLGVPGEEYYTSRGVSYCAVCDGAFFRDQDLLVVGGGDSAVEEAIYLTQFAKKVTVVHRRDQLRAQKILQDRAFANDKVDFIWDSVVKEIKGNDIKVSNVLIENVKTGQVTDHAFGGVFIYVGMNPVTDMVKDLEITDQEGWIITDDHMRTSIPGIFAIGDVRQKDLRQITTAVGDGAIAGQGVYHYLESFPS

SEQ ID NO: 712 - protein, 299 aa, Idiomarina loihiensis
MQHALLVVNPKSRNGHSEVLTEAIDLLRNSGIEVEVCVTESASHMASCIENYREQDGVVIVAGGDGTISSALESIYKSNQTLAILPMGTANDFARSLGLPQDVVPAAQAIIDDERERINLAKVNGNYFVNVAHVGLGVEVTRELTSEMKKYFGVFAYLGAFTSVIKRNKSFKVAIKADDWEDSVIAIHLAVGNGRFYGGGNIVDEDSTLLDGQLNLFCLKPIRWWRLLLLGVNFRHGNLEKAERVVCKKARKISVKTSRPKRIQADGEFKTETPAEFEVIPKAIEVIVGDMPVPNKNKE

SEQ ID NO: 713 - protein, 409 aa, Thermococcus kodakarensis
MPRLWVEKLCTDPELYIIRVDDDQIRYFEATWDIPEGITYNAYLMKLDGAVVLFDTTKKEYTDLFMDALRKLVDPKEITHIIVHHTEPDHSGALPKVLEENGYRAQVIGTQFARNLLQGFYGDKVVENFKVVKDGEEMQIGGKTFRFIAVPWLHWPDTMITYVVEDRIIFSCDAGGGYSIPETIDDSDEEFVEKYLPHVTKYIVTVIGHYHKYIVQNIKKLKSLGIVESARMILPGHGLVWKRDPLRIFEHYERVGAGVSEKDKVLVIYDSMYGFVERRMEIVLDELRKHGKKPVVYRFTDKEAPAVSDILGEVPSAEALIIGASTYEAEIHPRIRYALYEIVDKANYEKPVLIVGAFGWGGVAGRKIETMITRSKFDHVATVESKGYPTPEDEEKLREAVRKLVQWTL

SEQ ID NO: 714 - protein, 241 aa, Coccidioides immitis
MRPSLRRWVVLSVVNYAAKPRSVVCSALSAHSTVVPQLLCQQRSHSTKVFESKMAASTREALRSNGIIPDVLDDFEPKYTLKVTYPSTKTEINLGDHISTKQAHDPPVYEFHPVSPTEGTEPNKAYSLVLTDPDAKSRQEPIWSEFCHWVVGNASNPRTSGGKSGGTSLEKYMPPSPPPGTGDHRYVFVLLKGDASNVGKLKAPKERKQWGYGKQRHGVRQWASEHGLEVVGANFFFAQHD

SEQ ID NO: 715 - protein, 204 aa, Viburnum sieboldii
YDKPVKGRKINWMKAGILESDRVFTVSPYYAEELISGIDKGVELDNFIRKTGITGIVNGMDTQEWNPATDKYVGVNYDITTVMDAKPLLKEALQAELGLPVDRNIPLIGFIGRLEEQKGSDILAAAIPKFIEQNVQIVVLGTGKKYMEKQLEQLEILYPDKARGVAKFNVALAHMIIAGADFMMIPSRFEPCGLIQLHAMRYGT

SEQ ID NO: 716 - protein, 198 aa, Triticum aestivum
  misc_feature (156)..(156): Xaa can be any naturally occurring amino acid
GPENRRTPMMASNPGEIPEYELNPGELQFRKGDEVLKGTYQVAKWNGTKVSVKIVDRETYSDQEAINSFRHELTVFEKVRHPNVVQFIGAVTQNIPMMIVSEYHANADLGSLIQRKGRLNGHKVLRYALDIARGMTYLHQCKPDPIIHCDLKPKCXNIFLDNGGLTKVGGFGLMRLSKMAPDKVKLMNHEAIVDTFSY

SEQ ID NO: 717 - protein, 566 aa, Oryza sativa
MEAGAADEETPLIQQLPPEEQCSQYTCDGTVNSDKKPALKQSTGHWRACFFILGAQFAETLCFFMVSKNLVMYLTSALHESNIDAAQSVSIWIGTSFFTPLIGAFLADTYWGRYWTTVISLFIIIIGMLIVTVSSSPLFLNSSYYNWNICRATVYTGLYLTAVGSGCMKPCIPAFGADQFDSADPVERLAKGSFFNWYYFSMNVGSLLSTTLLVWVVANIGWSVGFAIPMLLSGFGLALFFAGRKVYRYKKQGGSPLTRVSQVVVAAVRNHRLKLPDDSSLLHEVSKVTEDDYRTQLTTQFRFFDKAAILSDEISPAQWSPWRLCTVSQVEELKILLRMFPVWVSMVVFFVVTAQITSTLIEQGMAMDGRVGPFTLPAASIATFDVISVLVWVPVYDTVLVPLARRVTGKDRGISHLQRIGVGLALAAVAMAYSAVVEARRLGTAPAPVSIMWQAPSYLVLGVAEAFSVIGMMEFFYEQSPESMKSLCTALGQLAIAVANYLNSGVLVVVAAATTRGGGAGWIPDNLDEGHLDYFFWMMAVVSVLNLLHFLHCSIRYRANNNTLSS

SEQ ID NO: 718 - protein, 143 aa, Triticum aestivum
TRRRATLRRGLTFSTKETPIAIKLIAPPLYVMLTTSMEKAQGIALLEASIAAMDEEMKKHNGKLSVKHAPRATSTQEENQLASLLEQMEQEQREIDGDDEDDDDLGMGGDGSSQGGAAGGGGRDKSSSGPGTLLRVQGTPAGG

SEQ ID NO: 719 - protein, 578 aa, Oryza sativa
MEAADEERAPLLQPQPQPSRGDADSEYTGDGSVDVNNQPALKRSTGNWRACFMILGVEFSENLAYYGISKNLVTYLTKILHESKVNAARNSSAWSGACYLTPLFGAFLADTYWGKYRTVLTFLPIYILGLLTLMASTSLPSSMTSSDAGHQLHSVAVYLGLYLVAFGNGGVKPCTSAFGADQFDGGDAAELRRKGSFFNWYTFMINSGSLLASTVLVWLQDNVGWGISFVIVVVVMAFFLAVFFAGSRVYRYRPVRGSPLTGVCQVVVAAVRKWHLELPDDSSLLYEAQVADHRIKHTDQFRFLDKAAIVVTPSSLSGEKGNVAAAAAPVSRWRQCTVTQVEEVKMLVRMCPIWACLVLFFSVSSQMSSTLVEQGTAMDNRVGPFTIPPASLATFHSIGVLLWIPVYDVALVPLARRATGKPKGITQLQRIGVGLAVAALIMAYSALVEERRLAAARAGAARTSILWQVPAQLMHGMAVVFTSIGKSEFFYDQAPRSMRSMCTALGQLAIAAGNYLSAFLLAVVASATTRGGDPGWIPDDLNKGHLDYFFWLMAALLLLDLLLFVFCAMRYKGSTAAS

SEQ ID NO: 720 - protein, 388 aa, Thellungiella halophila
MISSIKPVSPSLTAIGGVRRSAPGKLRFSPLPIIRNFEKPNPFPLQVLSAQNFSNFSVSAAAQRRDVFKVGAYEADRSQPIEIGIEISDEQSRQKVKIGIYFATWWALNVVFNIYNKKVLNAFPYPWLTSTLSLACGSLMMLVSWVTRVAEAPKTDLDFWKTLFPVAVAHTIGHVAATVSMSKVAVSFTHIIKSGEPAFSVLVSRLFLGDTFPLPVYLSLLPIIGGCALAAVTELNFNMIGFMGAMISNLAFVFRNIFSKKGMKGKSVSGMNYYACLSMMSLLIVTPFAIAVEGPQVWAAGWQNAVSEIGPNFVWWVAAQSVFYHLYNQVSYMSLDQISPLTFSVGNTMKRISVIVASIIIFHTPIRPVNALGAAIAILGTFIYFQVE

SEQ ID NO: 721 - protein, 606 aa, Zea mays
MDTHIGSVNGAASNQTVGCPASAPGCPMASTPAQPAATLSAGEASLGRHLARRLVQVGVNDVFAVPGDFNLTLLDHLIAEPGLRLVGCCNELNAGYAADGYARARGVGACAVTFTVGGLSVLNAIAGAYSENLPVICIAGGPNSNDYGTNRILHHTIGLPDFSQELRCFQTVTCHQAVVNNLDDAHEQIDTAIATALRESKPVYLSISCNLPGLPHPTFSRDPVPFFLTPRTSNKMGLEAAVEATVEFLNKAVKPVLVAGPKLRVAKAGKAFVDMVDASGYAYAVMPSAKGLVPETHPHFIGTYWGAVSTAFCAEIVESADAYLFAGPIFNDYSSVGYSFLLKKEKAIIVQPERVIVGNGPAFGCVMMKEFLSELAKRVNKNTTAYENYKRIFVPEGQPLESEPNEPLRVNVLFKHVQKMLTGDSAVIAETGDSWFNCQKLKLPEGCGYEFQMQYGSIGWSVGALLGYAQGANHKRVIAFIGDGSFQVTAQDVSTMLRCEQNSIIFLINNGGYTIEVEIHDGPYNVIKNWNYTGFVDAIHNGLGKCWTSKVKSEEELTAAIETALGEKKDCLCFIEVIAHKDDTSKELLEWGSRVSAANSRPPNPQ

SEQ ID NO: 722 - protein, 563 aa, Xylella fastidiosa
MCSIFGIFNLQPSDNLQILRHQALECSQRQRHRGPDWSGVYVDVGAILVHERLAIVDPAGGAQPLFSEDGTLALAVNGEIYNHAVLKGTLQQPYAFQTHSDCEVINALYREETPTSFLNRLNGIFAFALWDKTTGRGLIARDPMGVVPLYWGHDQDGRLRVASEMKALVEHCPDVAQFPPGHWYDTTTGTLVKYYERPWKNYSAVEGVQVSLQELREAFERAVHRQLMTDVPYGVLLSGGLDSSLVAAVAARYARHRIETNDQSEAWWPRLHSFAIGLKDSPDLSAANVAAEALNTVHHGFEYTFQEGLDVLPEVIRHIETYDVTTIRASTPMFLLARRIKAMGVKMVLSGEGSDEIFGGYLYFHKAPNAREFHEELVRKLNALYYYDCLRANKAMMAWGVEPRVPFLDREFLDVAMRMDAQHKMVDKTSNGPQRMEKGILRAAFDGYLPPSILWRQKEQFSDGVGYGWIDGLKAHAETQVSDHALATAETRFQVNPPQTKEAYYYRSIFERFFPSPAAAETVPGGKSIACSSPAAIAWDASFATMADPSGRAVSGVHQQALL

SEQ ID NO: 723 - protein, 236 aa, Helianthus annuus
MTRRYWNINLEEMMEAGVHFGHGTRKWNPKMAPYISAKRKGIHITNLTRTARFLSEACDLVFDAASRGKQFLIVGTKNKEADSVAWAAIRARCHYVNKKWLGGMLTNWSTTETRLHKFRDLRTEQKTGGLSRLPKRDAAMLKRQLSHLQTYLGGIKYMTGLPDIVIIVDQHEEYTALQECITLGIPTICLIDTNCDPDLADISIPANDDAISSIRLILNKLVFAICEGRSGYIRNP

SEQ ID NO: 724 - protein, 241 aa, Arabidopsis thaliana
MATKQEALAIDFISQHLLTDFVSMETDHPSLFTNQLHNFHSETGPRTITNQSPKPNSTLNQRKPPLPNLSVSRTVSTKTEKEEEERHYRGVRRRPWGKYAAEIRDPNKKGCRIWLGTYDTAVEAGRAYDQAAFQLRGRKAILNFPLDVRVTSETCSGEGVIGLGKRKRDKSSPPEEEKAARVKVEEEESNTSETTEAEVEPVVPLTPSSWMGFWDVGAGDGIFSIPPLSPTSPNFSVISVT

SEQ ID NO: 725 - protein, 480 aa, Zea mays
MATPRLAAIFFSLLCCRAASSLRPPNLISNSSDGVITHLPGFQGPLPFHLQTGYVEVDEDNGVHLFYYFVRSEREDSPGDDPVVLWLTGGPGCSVLTGLAYEIGPLSFDLNGYVGGLPKLVYKQDSWTKVSNVIFLDSPVGAGFSYSHTEEGYKSSDTRAVNQILVFLKKWFDKYPQFFSSLLYIAGDSYSGMIVPTVTSEIARGKEEGSQPNLNLKGYLVGNPVTDFNFDGPSRIPFAHGMGLISDEIYEAYEKSCSVGDSRRQSIECINSLGAIDECIKGISPNHVLEPLCAFASPKPKLISSGAREMLQLPVPVHTEEEEEELRLSEISLQCRTAGYMMSSMWANDASVRQALGIHKGTVPSWSRCNYDIPYTNDIPSAVKYHLDVTTKGYRSLVYNGDHDMVVPFIGTQAWIRSLNFSTVDEWRPWFVDGQVAGFTRSYSNNLTFATVKGGGHTAPEYMPRQCFAMFVRWVSGDPL

SEQ ID NO: 726 - protein, 606 aa, Oryza nivara
MSALTTSQLATSATGFGIADRSAPSSLLRHGFQGLKPRSPAGGDASSLSVTTSARATPKQQRSVQRGSRRFPSVVVYATGAGMNVVFVGAEMAPWSKTGGLGDVLGGLPPAMAANGHRVMVISPRYDQYKDAWDTSVVAEIKVADRYERVRFFHCYKRGVDRVFIDHPSFLEKVWGKTGEKIYGPDTGVDYKDNQMRFSLLCQEAPRILNLNNNPYFKGTYGEDVVFVCNDWHTGPLPSYLKNNYQPNGIYRNAKVAFCIHNISYQGRFAFEDYPELNLSERFKSSFDFIDGYDTPVEGRKINWMKAGILESDRVLTVSPYYAEELISGIARGCELDNIMRLTGITGIVNGMDVSEWDPSKDKYITTKYDATTAIEAKALNKEALQAEAGLPVDRKVPLIAFIGRLEEQKGPDVMAAAIPELMQENVQIVLLGTGKKKFEKLLKSMEEKYPGKVRAVVKFNAPLAHLIMAGADVLAVPSRFEPCGLIQLQGMRYGTPCACASTGGLVDTVIEGKTGFHMGRLSVDCKVVEPSDVQKVATTLKRAIKIVGTPAYNEMVRNCMNQDLSWKGPAKNWENVLLGLGVAGSEPGVEGEEIAPLAKENVAAP

SEQ ID NO: 727 - protein, 426 aa, Unknown
  Candidatus Kuenenia stuttgartiensis
MDNVISVILGGGRGTRLYPLTKERSKPAVPLAGKYRLIDIPVSNSLNSGINKIYVLTQFNSASLHRHITRSYKFDNFSKGFIEVLAANQTIGSLDWYQGTADAVRQNLRFFDQPNIEYILILSGDQLYRMNYQHFIREHIKSGAEVTVSAIPSERRHAQALGLLKINEQGRIVGFSEKPKDEAVIDTLSLDASFFEKRGVEPKGRTLLASMGIYLFNIGVLKEVLKKSQKPDFGKEIIPEIIKERAVHAYLFDGYWEDIGTIKSFYEANLELATLSPRFNLYSEKNPIYTSPLSLPGAIINNCRIIKSIIADGCIIDSGEISDSVIGFRTRIEKNTTIRSSVLMGADYYETKENIRANKEKGIPNIGIGENTKIVGAIVDKNVHIGENVHIENTKKIETFDAENYMIRDSIIIIPKGSVIPSNTVI

SEQ ID NO: 728 - protein, 338 aa, Triticum aestivum
  misc_feature (261)..(261): Xaa can be any naturally occurring amino acid
MAAMTITTSSFLKTSFPGVCIPAATRTPSCAATRRTGAICNSISSCTPPYDLSSFKFSPMKESVASREMIRRYMTDMIADVNTDVIIIGTGSAGLSCAYELSKDPSVNIAIIQRSVSPGGSGWLGSQLFSAMVVRKPAHLFLDELNIEYDEQEDYVVIKHAALFTSTVLSRLLARPNVKLFNGVVVEDLVVKEHRVTGVVTNWALVSMNQDTHSQTQSHMDANVMEAKIVVSSCGHEGLFSANGKGVKRLEDIGMIKTVPXTGMEALDTNVSEDAIVGLTREVVPGMIVAGIEVAEIDGPQRMCPTFGATIISGQKAAHLALKALGRPNGIDSETVPA

SEQ ID NO: 729 - protein, 412 aa, Oryza sativa
MNALAATSRNFRQAARLLGLDSKLEKSLLIPFREIKVECTIPKDDGTLASFIGFRVQHDNARGPMKGGIRYHPEVDPDEVNALAQLMTWKTAVAAIPYGGAKGGIGCAPGELSTSELERLTRVFTQKIHDLIGAHTDVPAPDMGTNSQTMAWILDEYSKFHGHSPAVVTGKPIVSLGGSLGRDAATGRGVMYATEALLAEHGKSISGSTFVIQGFGNVGSWAARIIHEKGGKVIALGDVTGSIRNKNGLDIPALMKHRNEGGALKDFHDAEVMDSSELLVHECDVLIPCALGGVLNRENAPDVKAKFIIEAANHPTDPEADEILAKKGVTILPDIYANSGGVIVSYFEWVQNIQGFMWDEEKVNMELHKYMNNSFQHIKAMCKSHDCNLRMGAFTLGVNRVARATLLRGWEA

SEQ ID NO: 730 - protein, 451 aa, Oryza sativa
MAEPEFEQAYKELASTLESSTLFEKNPEYRKALEVVSVPERVIQFRVVWEDDSGKCQVNKGYRVQFNSALGPYKGGLRLHPTVNLSILKFLGFEQIFKNALTGLNMGGGKGGADFDPKGKSDNEIRKFCVAFMTELSKHIGADTDVPAGDINVGGREIGYMFGQYRRLRNQWEGVLTGKGLNWGGSLIRPEATGYGLVYYVDHMINYASGGKESFKGKKVAISGSGNVAQYAALKVIELGGTVVSLSDSKGSLIATEGKGFTPEDISQIAALKLKRQALTALEGHSYNYIEGARPWKHVGNVDVALPSATQNEVSQDEAEALIAAGCKFIAEGSNMGCTQEAIDAFENHRKSNKGSSIWYAPGKAANAGGVAVSGLEMAQNSQRLSWTNEEVDAKLAKIMKDCFENCLATAKEYITPAEGEFPSLVAGANVAGFKKVAAAMHDQGDWWGTA

SEQ ID NO: 731 - protein, 368 aa, Zea mays
MAAAAVVFDAEALSREEHIPAQFVWPTEERAPAGGVEEVAIPVVDLGEFLRRGVLPRGVAEACERHGVFQVVNHGVGAALLAEAYRCCDAFYALPLADKQRAQRRHGENHGYASSFTGRFHCCLPWKETLSFNCPAGAGTARAVVGYFVDVLGEDYRHMGEVYQEYCDAMTRLALDVTEVLAAALGLDRGALRGFFEGGDSVMRLNHYPACRQPHLTLGTGPHRDPTSLTLLHQDDVGGLQVRAGGGPWRAVRPCADAFVVNIGDTFAALTDGRHTSCLHRAVVSGGGARRSLAFFLNPPLDRVVRPPGALLQENKQAGRPRAFPDFTWREFLEFTQKHYRSDAGTMDAFVSWIAGGRRPHGGQEEGN

SEQ ID NO: 732 - protein, 520 aa, Glycine max
  misc_feature (487)..(487): Xaa can be any naturally occurring amino acid
MASACVTLKSNTHLANSEKGFLGERIKGGFNNSALVMNQLAIRSRSHKRVKHGVGVVSAVLTSNNAKESLTLQVPSFLRRRADPKNVISIILGGGPGTQLFPLTKRAATPAVPVGGCYRLIDIPMSNCLNSGINKIFVLTQFNSASLNRHIARTYFGNGINFGDGIVEVLAATQTPGEAGKNWFQGTADAVRQFTWVFENTNVENVLILAGDHLYRMDYMDLVQSHVDRNADITVSCAAVGDSRASDYGLVKVDDRGRIIQFSEKPNGDDLKAMQADTSLLGLSPQDALKSPYIASMGVYVFKTDVLLNLLKWRYPTSNDFGSEIIPAAVRDHDVQSYFFEDYWEDIGTIKSFYDANLALTEESHKFEFYDPKIPIYTSPGFLPPTKIDKCQIVDAIISHGCFLRECTVQHSIVGERSRLDYGVELLDTVMMGADYYQTESEIASLLAEGKVPIGIGRNTKIRNCIIDKNAKIGKDVIIANKDLALXGVQEADRPEDGFYIRSGITIIMEKATIEDGTVI

SEQ ID NO: 733 - protein, 407 aa, Halobacterium salinarum
MVMTDTVEDVELPYDDSASQQDKLEALEEQLSTLEEENEERDRLLDANAENNKYQQKLERLSHENKKLKQSPLFIATVQELTDEGAVIKQHGNNQEALTEVTDELRATLEPGSRVAVNNSLSVVRQLDDEADVRARVMEVDDSPDVGYEDIGGLDDQLREVRETVELPMKDPGLFETVGINPPSGVLLHGPPGTGKTLMAKAVASQTDASFIKMAGSELVHKFIGEGAKLVRDLFQVARDHEPAVVFIDEIDAIASKRTDSKTSGDAEVQRTMMQLLSEMDGFDERGDIRIIAATNRFDMLDRAILRPGRFDRLIEVPHPNVGGREKIFRIHTRAMNVADSVDFGELAADTGDLSGADVKAICTEAGMFAIRDDRTEVRMQDFQSAREKLDQDSEPAAATDVSRTFA

SEQ ID NO: 734 - protein, 338 aa, Thermococcus kodakarensis
MGGIKIEPKTAIFAGGCFWCMEEAFERLPGVIEAISGYTGGWVENPTYELVSTGETGHREAVKVIYDPSKISYERLLDVFWRNIDPTDPGGQFADRGEQYKTAIFYLDEEQRELAEESKRRLELSGIFDEPIATEILPAKEFYPAEDYHQGYYFRFEANYKGYKLYSGRLGFIKSVWEKNRHFRLFPEREGYWLGYVKPSDAELKRQLTPLQYRVTQLGDTEEPFHNEYWNNHEEGIYVDVVSGEPLFSLLDKYDSGTGWPSFTKPLEEWAVVEAGECEGFLCGREVRSRFAGSHLGHVFDEPTPTGKRYCINSAALRFIPRDELRRYGYTAYEGIFK

SEQ ID NO: 735 - protein, 492 aa, Mycobacterium avium
MTATISTPQYLLDQARRRFTPTLNTIPGMGAIEKRLLAHEWQTKVLAEPPAGSGLKPVLGDAGLPILGHIIELFRGGPDYALFLYRNHGPLIYLDSPIMPAVTALGPDATQAVFSNRNKDYSQKGWHPVIGPFFNRGLMMLDFDEHMYHRRIMQEAFTRSRLTGYVEHIDRVATDIVADWPTNDARFLFHPAMKELTLDIASLVFMGHEPGTDHDLVTKVNQAFTTTTRAGGAIIRQPIPPFKWWRGLRARQLLEDYFSERVKERRNATGNDMLTVLCHTEDDDGNSFTDDDIVNHMIFLMMAAHDTSTSTTTTMVYNMAAHPEWQERAREESTRLGDGPLDIEALEKLETLELIMNESLRMVTPLPFNMRQAVRDTELLGHYIPAGTNITIWPGMNHRLPELWTDPDKFDPERFAEPRAEHKKHRYAFAPFGGGAHKCIGMVFGQLEVKTVVHRLLRRYRLELARPGYQPRWDYGGMPIPMDGMPIVLRPL

SEQ ID NO: 736 - protein, 416 aa, Streptococcus pyogenes [sequence omitted]

SEQ ID NO: 737 - protein, 556 aa, Campylobacter jejuni
MSEVNKKVQDGVDDYLEEEDFGQLLEAFDKSREEATTEGVIVEIKNDEVYVDIGKKSEGILALSEIQGDNSKLLFNVGDSIKVAVMGSRGGRSLLSHKKALRKEKVIEFIKNYQENQDDIFTVKVVGKNKGGLIVVDENDVEFFLPKSQYGFKETNNIIGKTFKVKIIKIDKDEQSIIVSRKKTLDDERRKRKELINNVAQQEDLIEGIVKKITTYGMFVDVGGVDGLVHYSEISYKGPVNPGTLYKEGDKVPVKVIKYDKERKHLSLSIKAALPDPWSEIKDTLDIGDTIKVIVSNIEPYGAFVDLGNDIEGFLHISEISWDKNIKNPKDYINKGQEIDVEVIEINPNERRLRVSLRNLLSRPFDEFMKSYKIADVVEGEITSVTSFGAFVKLGGIEGLLHNEDASWDRNDKCKDKFSQGDKIKVKIIKIDEENQKISLSTKELSSSPVQEYAKIHKVGDIVKGAIRDIKDFGVFVELSKNVDALIHKEDISTSMLENLKIGDDIEAAIVFIDEKKNRIRLSVKNLVRIKEREVLNEINNDDKVTLGDIIKDQLA

SEQ ID NO: 738 - protein, 273 aa, Streptococcus pyogenes
MMKRQFEDVTRIVIKIGTSSLVLPTGKINLEKIDQLAFVISSLMNKGKEVILVSSGAMGFGLDILKMEKRPTNLAKQQAVSSVGQVAMMSLYSQIFAHYQTNVSQILLTRDVVVFPESLANVTNAFESLISFGIVPIVNENDAVSVDEMDHATKFGDNDRLSAVVAGITKADLLIMLSDIDGLFDKNPTIYEDAQLRSHVAVITQEIIASAGGAGSKFGTGGMLSKIQSAQMVFENKGQMVLMNGANPRDILRVLEGQPLGTWFKQIEEVRHD

SEQ ID NO: 739 - protein, 422 aa, Unknown
  Bradyrhizobium sp. BTAi1
MVDTELASSDGVPSPQAPRRGAVAFIFVTILLDMLALGLIMPILPKLIESFVANDTAQAARIFGLFGTAWALMQFVFSPVLGSLSDRFGRRPVILLSNFGLAADYVLMAMAPSLAWLFIGRLISGITSASISTAFAYIADLTPPERRAAIFGRMGAAFGAGFVLGPATGGLLGDIDPRLPFWAAAGLSFVNAVYGLLVLPESLGHERRSPFRWRTANPLGALQLLRSDRMLAGLSMVNFITQLAHVVLPSTFVLYATYRYGWDTRTVGLTLAIVGVCAMVVQGGAVGWIVRSLGERGALLLGLCSGTLGFLIFGLAPTGMLSWLGIPAMALWGVSGAAIQALMTRLVPADRQGQLQGATSSVQSMAQLAGPFLFTLTFAYFIGVTAPVHLPGAPFLLASMLLVVALAIALRTIRAATAAALS

SEQ ID NO: 740 - protein, 105 aa, Unknown
  Mycobacterium sp. MCS
MTADPMPAVPDGGAGTEVTIVLDRKTLSVAQVPGETLLESARRAGMSPPFSCEAGNCGTCIAKLTEGTATMRVNDALDDDEVADGYVLTCQAVPDTARVSVTYDD

SEQ ID NO: 741 - protein, 655 aa, Oryza sativa
MALVVVPPGQMLLYLLYGPVVGKVVQEWREQGRLPLGTSWCLHLILLLALRSLTYQLWFSYGNMLFFTRRRRVVDDGVDFRQIDTEWDWDNMVIMQTLIAAVLVTSRVFPATSDLSAWDLRGWAIAVVLHVAVSEPAFYWAHRALHLGPLFSRYHSLHHSFQATQALTAGFVTPLESLILTLVAWAPLAGAFMAGHGSVSLVYGHILLFDYLRSMGYSNVEVISHKTFQDFPFLRYLIYTPSYLSLHHREKDSNFCLFMPLFDALGGTLNPKSWQLQKEVDLGKNHRVPDFVFLVHVVDVVSSMHVPFAFRACSSLPFATHLVLLPLWPIAFGFMLLQWFCSKTFTVSFYKLRGFLHQTWSVPRYGFQVTRFIQASRLISIELYFIPSAKKGINEMIELAILRADKMGVKVLSLAALNKMSLNLTAGKFSERSNILTETVNEALNGGGTLFVRKHPDLRVRVVHGNTLTAAVILNEIPGDVAEVFLTGATSKLGRAIALYLCRKKIRVLMLTLSTERFMNIQREAPAEFQQYLVQVTKYQAAQNCKTWIVGKWLSPREQRWAPAGTHFHQFVVPPIIGFRRDCTYGKLAAMRLPEDVEGLGTCEYTMGRGVVHACHAGGVVHFLEGWDHHEVGAIDVDRIDAVWNAALRHGLTPA

SEQ ID NO: 742 - protein, 622 aa, Arabidopsis thaliana
MITAADFYHVMTAMVPLYVAMILAYGSVKWWKIFTPDQCSGINRFVALFAVPLLSFHFIAANNPYAMNLRFLAADSLQKVIVLSLLFLWCKLSRNGSLDWTITLFSLSTLPNTLVMGIPLLKGMYGNFSGDLMVQIVVLQCIIWYTLMLFLFEYRGAKLLISEQFPDTAGSIVSIHVDSDIMSLDGRQPLETEAEIKEDGKLHVTVRRSNASRSDIYSRRSQGLSATPRPSNLTNAEIYSLQSSRNPTPRGSSFNHTDFYSMMASGGGRNSNFGPGEAVFGSKGPTPRPSNYEEDGGPAKPTAAGTAAGAGRFHYQSGGSGGGGGAHYPAPNPGMFSPNTGGGGGTAAKGNAPVVGGKRQDGNGRDLHMFVWSSSASPVSDVFGGGGGNHHADYSTATNDHQKDVKISVPQGNSNDNQYVEREEFSFGNKDDDSKVLATDGGNNISNKTTQAKVMPPTSVMTRLILIMVWRKLIRNPNSYSSLFGITWSLISFKWNIEMPALIAKSISILSDAGLGMAMFSLGLFMALNPRIIACGNRRAAFAAAMRFVVGPAVMLVASYAVGLRGVLLHVAIIQAALPQGIVPFVFAKEYNVHPDILSTAVIFGMLIALPITLLYYILLGL

SEQ ID NO: 743 - protein, 586 aa, Securigera parviflora
MCGILAVLGCSDDSQAKRVRVLELSRRLKHRGPDWSGLHQHGDCFLAHQRLAIVDPASGDQPLFNEDQSIIVTVNGEIYNHEELRKQMPNHKFRTGSDCDVIAHLYEEHGENFVDMLDGIFSFVLLDTRDNSFIVARDAIGVTSLYIGWGLDGSVWIASELKGLNDDCEHFETFPPGHLYSSKEREFRRWYNPPWFSESIPSAPYDPLALRQAFEKAVVKRLMTDVPFGVLLSGGLDSSLVASITARHLADTKAAKQWGAKLHSFCVGLEGSPDLKAGKEVADYLGTVHHEFQYTVQDGIDALEDVIYHIETYDVTTIRASTPMFLMSRKIKSLGVKWVISGEGSDEIFGGYLYFHKAPNKEELHKETCRKIKALHKYDCLRANKSTFAWGLEARVPFLDKEFINVAMNIDPENKMIKLDEGRIEKWILRKAFDDEENPYLPKHILYRQKEQFSDGVGYGWIDGLKDHAAKHVTDRMMLNASNIYPFNTPTTKEAYYYRMIFERFYPQNSARLSVPGGASVACSTEKALEWDAEWSKNLDPSGRAALGVHVSAYENQLSSSVSKGVEPEKIIPKMEISPLGVAIQS

SEQ ID NO: 744 - protein, 158 aa, Staphylococcus epidermidis
MSIYDIAVENYDGSTYLLKRYKGKVLIIVNTATNCTLNDQFNKLEMLYKKYHKYGLEILSFPCNDFNNQEPELIKDIYRVYKYKFGITFPIHAKINVNGEHEHPLYTLLKCKQPGLFGSQIKWNFTKFVVDQQGNIVKRFLPCDNPNQMEKLIRQLLK

SEQ ID NO: 745 - protein, 217 aa, Zea diploperennis
IVNGMDVSEWDPSRDKYIAVKYDVSTAVEAKALNKEALQAEVGLPVDPNIPLVAFIGRLEEQKGPDVMAAAIPQLMEMVEDVQIVLLGTGKKKFERMLMSAEEKFPGKVRAVVKFNAALAHHIMAGADVLAVTSRFEPCGLIQLQGMRYGTCNVVEPADVKKVATTLQRAIKVVGTPAYEEMVRNCMIQDLSWKGPAKNWENVLLSLGVAGGEPGVE

SEQ ID NO: 746 - protein, 1027 aa, Unknown
  Saccharum hybrid cultivar
  misc_feature (168)..(168): Xaa can be any naturally occurring amino acid
  misc_feature (432)..(432): Xaa can be any naturally occurring amino acid
TRPASRCSTGGSHGRLLCWLLLACSWVAATTGQQTARTDPAEVAALNTILGRWGLKASAAWNISGEPCSGVAVDTTNVDDNPNINPAIKCDCTYNNATVCHITKLKVYALNVVGQIPAELQNLTYLNNLNLMQNYLTGPVPSFIGKFPMQYLSLAINPLSGTLPKELXNLTNLISWGISLNNFTGELLLELGNLTKLEQIYFAGSGFSGHFPTFSRLKNLKILWASDNDFTGKMPDFIGSLTQLEDLRFQGNSFEGPIPKSLSNLTKLTSLRIGDIVNGSSSLSFISNLTSLNVLILRNCRISDTLATVNFSNLAGLTLLDLSFNNLTGQIPQSILNLEKLGFLFLGNNSLSGSLPDVKSPSLNDLDFSYNQLSGSFPSWATQNNLELNLVANNFILGSSNNSILPSGLNCLQQDIPCFRGSPEYSSFAVDXGSTRSMEGLRYTFYEIDPTNIGAASYYVTGQTRWGVSNVGKFNEAPNGSYIIYSSQQFQNALDSELFQTARMSPSSLRYYGIGLENGNYTVELQFAEFAYPESPTWQSTGRRVFDIYIQGGLKEKNFNIRKTAGGKSYVAVYKKYNATVSKNFLEIHLFWAGKGTCCIPTQGYYGPMISALSVTPSFTPTVRNGVPKKKSKAGAIAGIVIGAAVLGLAALAGTFMLVQKRRRVAQQQEELYNMVGRPNIFSNAELKLATDNFSSKNILGEGGYGPVYKGKLPDGRIIAVKQLSQTSHQGKSQFVTEVATISAVQHRNLVKLYGCCIDSNTPLLVYEYHENGSLDRALFGNSGLSLDWPTRFEIILGIARGLTYLHEESSVRIVHRDIKASNVLLDTDLTPKISDFGLAKLFDEKKTHVSTKIAGTFGYLAPEYAMRGHLTEKADVFAFGVVALETVAGRSNTDSSLEENRVYLFEWAWELYERDKALDILDARIEEFDSEEALRVISVALLCTQGSPHQRPPMSRVVKMLTGDVEVTEVVTKPSYITEWQRRGGNTSYVTSDYSGDTTGEFSMQRETIAPLTPSPAMTGVIDDGR

SEQ ID NO: 747 - protein, 217 aa, Zea diploperennis
IVNGMDVSEWDPSRDKYIAVKYDVSTAVEAKALNKEALQAEVGLPVDRNIPLVAFIGRLEEQKGPDVMAAAIPRLMEMVEDVQIVLLGTGKKKFERMLMSAEEKFPGKVRAVVKFNAALAHHIMAGADVLAVTSRFEPCGLIQLQGMRYGTCNVVEPADVKKVATTLQRAIKVVGTPAYEEMVRNCMIQDLSWKGPAKNWENVLLSLGVAGGEPGVK

SEQ ID NO: 748 - protein, 429 aa, Burkholderia mallei
MDLHERTLDAPGAPAAAAHGAGSRLSREVWIILLTLAVDAVGLGVATPVLPDLLRAVGERPAHVPVMLGSLITCFYFMQFVFGPIVGALSDAWGRRPILLIALGGGALSYAIGATARSYGGLLAAHMLAGIAASSAAVATAYLADVTPPALRARRFALASSVLGLGLIAGPAFGGVLGALGPRVPFVAAGAIAALNFVSAACFLRESLPARRRVPVSWARANLFGSLRLVREDRVFRDLLAAVCLGMLAYGIYLSCFVLANAARLGWGPRENGLALAGLGLGITLTQTLLLPRLVARLGEHRTALVGFGAFVLAYGLYSRADSVALVAAALAVHALSLISDPSVRSLISVHAGPQRQGEYQGALVCLTGLASSIAPLVGGNLFAFFTRAGASTYFPGAPFLAAAVLYALAMLAVWRAMAGAARRRSASH

SEQ ID NO: 749 - protein, 217 aa, Zea diploperennis
IVNGMDVSEWDPSRDKYIAVKYDVSTAVEAKALNKEALQAEVGLPVDRNIPLVAFIGRLEEQKGPDVMAAAIPRLMEMVEDVQIVLLGTGKKKFERMLMSAEEKFPGKVRAVVKFNAALAHHIMAGADVLAVTSRFEPCGLIQLQGMRYGTCNVVEPADVKKVATTLQRAIKVVGTPAYEEMVRNCMIQDLSWKGPAKNWENVLLSLGVAGGEPGVE

SEQ ID NO: 750 - protein, 217 aa, Zea diploperennis
IVNGMDVSEWDPSRDKYIAVKYDVSTAVEAKALNKEALQAEVGLPVDRNIPLVAFIGRLEEQKGPDVMAAAIPQLMEMVEDVQIVLLGTGKKKFERMLMSAEEKFPGKVRAVVKFNAALAHHIMAGADVLAVTSRFEPCGLIQLQGMRYGTCNVVEPADVKKVATTLQRAIKVVGTPAYEEMVRNCMIQDLSWKGPAKNWENVLLSLGVAGGEPGVE

SEQ ID NO: 751 - protein, 264 aa, Chlorella vulgaris
  misc_feature (189)..(189): Xaa can be any naturally occurring amino acid
  misc_feature (256)..(256): Xaa can be any naturally occurring amino acid
LQPVLIRLGWHDAGTYSVEADKEHGWPLCGGTTGSIRFKEEMTHGCNAGLSLAYDLVKHVKDEFPEISWADLFQLASAVSIEACGGPFIPLRLGRKDANTKEDCTPDGRLPAAGAPFPDGAPTAAQHLRNTFYRMGLTDKDIVVLSGAHTVGRARPERRPFGKEHTKYTKNGPGSPGGSSWTVEWLKFXNRYFKDIKEQIDEELLVLPTDAAIFEDEGFRPHAEKYAEDQDAFFKDYVESHLKLSELGAKWEGEPXVLSPSNAA

SEQ ID NO: 752 - protein, 478 aa, Arabidopsis thaliana
MESQKPIFDLEKLDDEFVQKLVYDALVWSSLHGLVVGDKSYQKSGNVPGVGLMHAPIALLPTAFPEAYWKQACNVTPLFNELIDRVSLDGKFLQDSLSRTKKVDVFTSRLLDIHSKMLERNKKEDIRLGLHRFDYMLDEETNSLLQIEMNTISCSFPGLSRLVSQLHQSLLRSYGDQIGIDSERVPINTSTIQFADALAKAWLEYSNPRAVVMVIVQPEERNMYDQHLLSSILREKHNIVVIRKTLAEVEKEGSVQEDETLIVGGQAVAVVYFRSGYTPNDHPSESEWNARLLIEESSAVKCPSIAYHLTGSKKIQQELAKPGVLERFLDNKEDIAKLRKCFAGLWSLDDSEIVKQAIEKPGLFVMKPQREGGGNNIYGDDVRENLLRLQKEGEEGNAAYILMQRIFPKVSNMFLVREGVYHKHQAISELGVYGAYLRSKDEVIVNEQSGYLMRTKIASSDEGGVAAGFGVLDSIYLI

SEQ ID NO: 753 - protein, 115 aa, Triticum aestivum
  misc_feature (2)..(2): Xaa can be any naturally occurring amino acid
  misc_feature (22)..(22): Xaa can be any naturally occurring amino acid
  misc_feature (24)..(24): Xaa can be any naturally occurring amino acid
  misc_feature (26)..(26): Xaa can be any naturally occurring amino acid
  misc_feature (30)..(31): Xaa can be any naturally occurring amino acid
  misc_feature (41)..(41): Xaa can be any naturally occurring amino acid
  misc_feature (44)..(44): Xaa can be any naturally occurring amino acid
  misc_feature (47)..(47): Xaa can be any naturally occurring amino acid
  misc_feature (62)..(62): Xaa can be any naturally occurring amino acid
  misc_feature (65)..(65): Xaa can be any naturally occurring amino acid
  misc_feature (79)..(79): Xaa can be any naturally occurring amino acid
EXLVQRMGGPPLFSQRRGHPAXIXRXRPPXXTHRAAERWLXHMXQAXETTESINPDTKPKMXNFXRHTAYFLVAGNEMXRNAKCIYDGYWTMWKLPMFPTDATQVLNEVEEVKKE

SEQ ID NO: 754 - protein, 310 aa, Zea mays
MTGGQEVHARTHRPQKPALDGDAKSKTGCGRLLVLAPVGFGFALDPRRADEEALSSSRPAVGSPPRNRNPTVCTVACAVVCIGGITHSLLAIAHRYYGPCVTGTAHADALHAPLPPPCFLARLSYKTVPGRTRRRANPLTHCDADADAPHRPRPPGRAHPPSTPTHAGEPSQARQPPTSPPGPGLDQTQIQMHLLDDLRQDRGGAAAHTGSRSRKPPPPLAAAAAAAAGVPAGSSTAATATHLGPEAAALLACVTATLLLLPLVLPPLPPPPPLLLLVPVAIFAVLLLLVLLPSDARAAVATPTSSASYL

SEQ ID NO: 755 - protein, 320 aa, Anabaena variabilis
MRVARNITELVGRTPLVQLNRIPQEEGCVAQILVKMESMNPSSSVKDRIGVSMINAAEQEGLIAPGKTVLVEPTSGNTGIALAMAAAAKGYRLILTMPETMSGERRAMLRAYGAELELTPGMEGMSGAIRRAQEIVNTTPHAYMLQQFRNPANVKIHRETTAEEIWEDTDGQVDMIVAGVGTGGTITGVAEVLKARKPSFQAIAVEPANSPVLSGGKPGPHKIQGIGAGFVPQVLKTQLIDEVITVTDEEAIAYGRRLAREEGLLSGISSGAALCAAIRVAQRPENAGRLIVLIQPSFGERYLSTPLFQDLETKVTASIS

SEQ ID NO: 756 - protein, 424 aa, Zea mays
MGKHEFLTPKAIANRIKAKGLQKLRWYCQMCQKQCRDENGFKCHCMSESHQRQMQVFGMAPDRVVEGFSEEFLESFLSLIRRAHRHSRVAATVVYNEYIADRHHVHMNSTRWATLTEFVKFLGREGYCKVEDTPKGWFMTYIDRDSEQAVKERLKRKRIKSDMADDERQERMIARQIERAHKSLAKPNGGGAAEGEPESGSEGEYSGSDDDEQEPEDDSKEADKATGKIAIALQKAVPGPKVNPFDDKPKMKFGFDEEDGSGTRDQEKNELTKKMGKDVKAAEAKRSALDELMKEEEKAKERSNRKDYWLCPGIVVKVMSKSLAEKGYYKQKGVVKKVIDKYVGEIEMLESKHVLRVDQDELETVIPQIGGLVRIVNGAYRGSNARLLSVDTEKFCAKVQVEKGLYDGKVLRAVEYEDICKISS

SEQ ID NO: 757 - protein, 601 aa, Unknown
  Marine gamma proteobacterium HTCC2143
MTPWISDVDANCPLPEYPRPQMVRHTWLNLNGLWDYQITERDATVPTQFTGEILVPYAIESALSGVKKSLSPSQLLWYRRTFNTTKNSKHTKTLLHFEAVDWYCRCYINGQLVGDHQGGYLPFSFDITDYLIAEDNELVVSVWDPTDTHWQQKGKQVEQPNTIYYTATSGIWQTVWLETVNNKNYITDLKITPLVDKQAVLVTVTSTADGKVRGYTKNGGHTLSEAEGKTHADDNNHANVTLEIPVPSPRLWSPETPFLYDLVIDLYDGETVIDSVDSYFGMRSITTAQVSSGHTRILLNDQPTFLHGPLDQGYWPESGMTPATDNALIFDLEQTKALGFNMTRKHIKVESRRWYYHADRLGLIVIQDMVNGGKNSAGLAETLSTMAYGKKKSDTTNRFYQRAWREDPESRQDFENESLAMMDHLFNAPSLLIWVPFNESWGQFDAARIASEVKSRDPSRLVDHASGWFDQGAGDFCSRHTYVMKLKKPPRKDSRVYFISEYGGYNCQIDDHLWDASSKFGYKMLKNTHALEDAYTSLIRQQLIPLIAKGLGAAVYTQFSDVEIESNGLFSYDRKVLKISADIVKTLNNEIYDAFRHSERS

SEQ ID NO: 758 - protein, 483 aa, Neisseria meningitidis
MNYFPIFANLAGRPVLVVGGGAVAARKISLLLKAGAEVRVAAKHLNAELSALAAENKILWLAEEFRAEHIRTVFLIIAASSDQALNRRVFHLAESCQKPVNVVDDRDHCSFIFPSVIDRNPVQIAVSSSGSAPVLARLLRERLEALLPPSLGDMAEISGRWRDAVKGKLKSVTERRRFWEKQFNGRFAALVKNRQNTLAERELAKQLEQNYQGGFVSLVGAGPGDAGLLTLKGLQEIQQADVVLYDALVSDGILSLVRRDAERIFVGKRARGGRTPQEDTNALMVRLAREGRRVVRLKGGDPFVFGRGGEELETLARHQIPFSVVPGITAAVGATAYAGIPLTHRDYAQSAVFVTGHRKADAPDIEWQTLARSRQTLVIYMGALKAALIAERLQQHGRSPDTPAAVISQGTLPAQKTATGTLANLSELAETAPNPALIVIGEVVGLHEKLAWFGENAKKESNPAEHAYFALDGLGTGQEQQAA

SEQ ID NO: 759 - protein, 294 aa, Saccharomyces cerevisiae
TTPLVHVASVEKGRSYEDFQKVYNAIALKLREDDEYDNYIGYGPVLVRLAWHTSGTWDKHDNTGGSYGGTYRFKKEFNDPSNAGLQNGFKFLEPIHKEFPWISSGDLFSLGGVTAVQEMQGPKIPWRAGRVDTPEDTTPDNGRLPDADKDADYVRTFFQRLNMNDREVVALMGAHALGKTHLKNSGYEGPWGAANNCFTNEFYLNLLNEDWKLEKNDANNEQWDSKSGYMMLPTDYSLIQDPKYLSIVKEYANDQDKFFKDFSKAFEKLLENGITFPKDAPSPFIFKTLEEQGL

SEQ ID NO: 760 - protein, 51 aa, Brassica napus
  misc_feature (17)..(17): Xaa can be any naturally occurring amino acid
  misc_feature (27)..(27): Xaa can be any naturally occurring amino acid
  misc_feature (34)..(34): Xaa can be any naturally occurring amino acid
MIEQEYVSLLKSNDPVXFNIVDVLAWXSIGHIVXYYVLATSSNGYDPSFFG

SEQ ID NO: 761 - protein, 499 aa, Pisum sativum
MDTLTLSLGFLSLFLFLFLLKRSTHKHSKLSHVPVVPGLPVIGNLLQLKEKKPHKTFTKMAQKYGPIFSIKAGSSKIIVLNTAHLAKEAMVTRYSSISKRKLSTALTILTSDKCMVAMSDYNDFHKMVKKHILASVLGANAQKRLRFHREVMMENMSSKFNEHVKTLSDSAVDFRKIFVSELFGLALKQALGSDIESIYVEGLTATLSREDLYNTLVVDFMEGAIEVDWRDFFPYLKWIPNKSFEKKIRRVDRQRKIIMKALINEQKKRLTSGKELDCYYDYLVSEAKEVTEEQMIMLLWEPIIETSDTTLVTTEWAMYELAKDKNRQDRLYEELLNVCGHEKVTDEELSKLPYLGAVFHETLRKHSPVPIVPLRYVDEDTELGGYHIPAGSEIAINIYGCNMDSNLWENPDQWIPERFLDEKYAQADLYKTMAFGGGKRVCAGSLQAMLIACTAIGRLVQEFEWELGHGEEENVDTMGLTTHRLHPLQVKLKPRNRIY

SEQ ID NO: 762 - protein, 372 aa, Coccidioides immitis
MSQERKDDRPAASSEQDKHHEPGTPVAPSGFQGLLSLATPLTRFVLYPMDQLKLVGSNLRQMVSKKFDPEKDIIDQDGKVILITGGNAGLGKETVLQLAKHNPLRIYLAARNSSKAQAAIDDIQKQLPQHADIRHLPLDLSSFTSIRAAAREFTSSNERLDTLILNAGVMDPLPNRTEDGFEVDFGTNHLGHFLFTKLLLPTLTKTAQETKSAGKPADVRIIVVASMAWQMSPPLSTMLSTDSLLALNPPTRYGASKAANIAFASELARRYPELSCVSLHPGVIITGLYDSLMATNPVARVGLRIAKSITVDEKQGSLNHLWTAGSERGALRSGEYYTPVGVGGWKNKWAEDRELGRTLWEWSEEAIRDQKK

SEQ ID NO: 763 - protein, 283 aa, Prochlorococcus marinus
MKDMPTWIDEYHKGSRFGLNGKVLLKKNSKYQEILIIETDFYGKALMLDGCWMTSVRDEKYYHECLVHPALSSIDKKSHILIIGGGDGGTARECLKYSQVSKIDLVEIDEEVIKVSKTFLKEIGGGAWSDKRLAIHIDDGVKWVETTKDNSYDVIFIDCSDPSEFSNLLFTDSFYKECKRILTKKGILATQSESPESFENIHIHILKSLNKIFKLSETMYSFVPIYPSGIWSWTFASDEELNLSKVNYKEVMEIENNCDVWNLNFQNAAFKMMPNKIVKKLNS

SEQ ID NO: 764 - protein, 473 aa, Yarrowia lipolytica
MTQRVFESSTVRSITTLPQTINQIKTENKHILGTQDASPVTINGWIKSVQKLKNVAFLNISDGNCAQGVMAVLQPDQVTSDLTTGACVSVKGNLVSSQGKKQGLELQAESVKVTGTVDEYPIQKKFHKQEFLRTLPALRWRTSVNSSTLRYRSFCMAQMTNFFAENDFVQTNPPLLTSSDCEGAGEVFKVAGGGKGDKFFGDKPAYLTVSTQLHLEVLAAAVGRVWTFTPAFRAENSDTNRHLSEFWMAEAEISFIDDLEPLMDLAEGMVKSCLAPLMEEGNKARNDLLDARRSAEQKEELLDRWDMANCDFPRLTYKQAIKILNLQHLKEPFAHRPDYEVGLRSEHEKWLATEYFISPVFVTDYPKEQKPFYMKQSPHDSQTVACFDLLMPHIGEVIGGSVREDNYDTLLKNIETTGMDKSALEWYLELRKQGSTPHGGFGMGFERLISYATGIENIRDVTAFPRWVDNCSC

SEQ ID NO: 765 - protein, 361 aa, Thermococcus kodakarensis
MEIVIIGNGPGGVELAKELSGEHEVLIFEREEVPFYSKPMLSHYIAGLIEKEKLFIYPLDWYERKGINLKLGEEAKLIDRVRKVLVTDKGEYPYDILVIATGARAREPTVDGKEHLLTLRSIEDAEGIKALLEEHGEAVIIGGGFIGLELAGNLAKAGYGVKLIHRRDTFLGLDEELSSLIREKLEESGVEFHLGAELLKADENGLLTTRGYIEGKVKICAIGITPNVEIARRSGIHTGRGILIDDHFRTSAKDVYAIGDCAEYSGIICGTAKAAAGHAKVLANLLRGKEDRYPFELRSSVFKFGDLPIAIIGKTRGEGEWLDEHTKAFFQDGKLVGAVVIGDIRKAFSIEKELKKELYGA

SEQ ID NO: 766 - protein, 458 aa, Triticum aestivum
MPTITHYVLDPFLETGSLPNLQKLVPKPPPAAPLPPEKSSEKPIPVPVAPARTTTLPALYSTPESTPLPDSPSSFPGTWSPYLINHKRRGPGLIKTSSQGDVGSEGSLPKFPEGLPALPKRSEAFQVQESEFRFTQESDGVVNNGVEETLDEQNEGVQKGKVTLFGQDEQDQPEFEFQHESPDVLMRPVNVGRLVNVARLVNNGMPRNGENDAFLEPQDSQSVTSNSEAEDAGGQGWWKPSSPYGTSAGTPGAEFYDAFEEISSDGATRSSRCVDDEYREMRLSMLTEIEGRKQAEEVAETWQKEWKKLSHHLSLIALSLPSPTVAENDDDTSADPGAELCQQITVSQLVAAAIARGIARVEVESEMESVISAKNFEIARLSDRVQYYEAANREMSQRNQEAIEMSRQQRNKRKMRQKWFWGSVGIAVTLGTAAIAWSYMPASQSQAGDSNSTNTNSD

SEQ ID NO: 767 - protein, 421 aa, Physcomitrella patens
MGRKPCCEKVGLRRGPWTSEEDQKLVSHITNNGLSCWRAIPKLAGLLRCGKSCRLRWTNYLRPDLKRGIFSEAEENLILDLHATLGNRWSRIAAQLPGRTDNEIKNYWNTRLKKRLRSQGLDPNTHLPLEDSKLDDTEDDTDDEGGDSSDVTMSDASKSEKRSKKKSKPKETVKVRQPKGPKPAPQLKMCQSDEGPVLLKVPKAPKSPISVNPGPGCNYDDDSEHSSSSTVTTKSHEDHRDSSDFIKALTSVSSFPEAELWSCIKPITNSFSSTALLSEWDSYRAFDSSLFPSSYPQLNSGLPKLEDVNSKSSAVASPVQGMLPAYNPMGMEMQTRMQFSSQLTHEIGQNYGGIFQETCYPQPDMGMSWSMHAELSHCGTESLFATPNPANAPSNFEEVPQPSPCTTSQELQRLAALLDLI

SEQ ID NO: 768 - protein, 99 aa, Triticum aestivum
MAGKLYQLMARLHLAKGRASADVPKGHFAVYVGEQRKRFVIPTAYLRHPSFLVLLKRVEDEFGFDHRTGGGLTIPCSEGDFADIVGGCSSSSSPAVDYH

SEQ ID NO: 769 - protein, 549 aa, Desulfitobacterium hafniense
MSMFCFQCQETAKGTGCTIKGVCGKTADVANLQDLLLYVMKGIAINSLQARELGIVRQDVDKFVMEGLFATITNANFDNARFVALVREGLALRDSLKADIVKAGGVLPANLHDSATWTADSAEEFEQKAAQVGILATENEDVRSLRELLIYGLKGMAAYAEHAFALGYEDNSIFAFMMKGLAATTDDSLSADQLVALVLEAGKYGVDVMALLDKANTTSYGNPEITKVNIGVRNNPAILISGHDLRDLEDLLKQTEGTGVDVYTHGEMLPAHYYPAFKKYAHFVGNYGNAWWKQDKEFDSFNGAILLTTNCLVPPKDSYKDRLFTTSVVGYEGVKHIPAREAGKVKDFSAVIELAKTLPAPTEIETGEIVGGFAHNQVFAVADKVVEAVKSGAVKRFFVMAGCDGRMKSRDYYTEFAKALPQDTIILTAGCAKYKYNKLALGDIGGIPRVLDAGQCNDSYSLAVIALKLKEVFGLDDVNQLPISYNIAWYEQKAVIVLLALLYLGVKNIHLGPTLPGFLSPNVAKVLVENFGIAGITTVEDDVNLFMGA

SEQ ID NO: 770 - protein, 73 aa, Triticum aestivum
  misc_feature (59)..(59): Xaa can be any naturally occurring amino acid
KDALHLKYTSDPFHVLGMIKMLYRAGADRLRTAMWGALGNPHGVCTRVVIDQVLLSVSXKPNNAMHATEALCR

SEQ ID NO: 771 - protein, 491 aa, Oryza sativa
MGKEASAMVARRSTSRRDWRRWWWWLLPLACCFVCWVASSAATVAPAAGVAVTSLPGFDGPLPFSLETGYVEVNESTGVRLFYYFVQSEKDPDVDPLLLWLSGGPGCSSLSGLTHEIGPFQFAAKRYYSGGLPKIIYQPETWTKVSNIIFVDSPVGAGFSYAATQEGSKTSDTKTVKQLVIFLRKWLHDHPQFLLNPLYIGGDSYSGYIVPTLALAIDESNDSGDKPILNLMGYVAGNPRTERQFDEGGKIPFLHGMGLISNELYEHAKETCRGKYNAPGNARCEQSMKVIHDCTKDINMLHVLEPFCEDVGSPGIHNNEATDGMIRLMLESASAANDDIIEFKCRKASYVVLQIWANDKTVRESLGVHKGTVGEWIRCNFDVDYIADVYSTVEYHLTLMRKGYRALIYSGDHDCQVPFTGTQAWIRFLNLSVIDDWRPWYAAGQVAGFTRSYANNNLIYATVKGAGHTAPEYKPKECLEMFARWISGNTL

SEQ ID NO: 772 - protein, 378 aa, Corynebacterium efficiens
MARDYYGILGVDRNATDSEIKKAYRKLARKYHPDVNPSEEAAEKFREASVAHEVLTDPDKRRIVDMGGDPMEQGGGAGHPGGFGSGGLGDIFDAFFGGGAGSRGPRSRVQPGSDTLWRTSITLEEAFTGVKKDLTLDTAVLCSKCHGSGSASNAKPKTCGTCHGSGEIQEVQRSFLGNVMTSRPCHTCNGTGEVIPDPCDECAGDGRVRARRDIVADIPAGIQSGMRIRMAGQGEVGAGGGPAGDLYVEVMVRPHAVFTRDGDDLHASIRVPMIDAALGSELEVESLTGEEITVVIPAGTQPNQVITLEGEGMPRLRAEGRGDLMAHVDLFVPTEIDDRTRELLEQIRDYRRDNSSVHREGEEHGGLFDKLKSKFRNR

SEQ ID NO: 773 - protein, 289 aa, Arabidopsis lyrata
GKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSEIQDKEGIPPDQQRLIFAGKQLEDGRTLADYNIQKESTLHLVLRLRGGSF

SEQ ID NO: 774 - protein, 245 aa, Triticum aestivum
  misc_feature (73)..(74): Xaa can be any naturally occurring amino acid
  misc_feature (76)..(76): Xaa can be any naturally occurring amino acid
  misc_feature (78)..(78): Xaa can be any naturally occurring amino acid
IEQVCTKKQAGTGPEFPGYRRPTRPGGAKGGIGCSPGDLSISELERLTRVFTQKIHDLIGIHTDVPAPDMGTXXAXQXGIWILDEYSKFHGYSPAVVTGKPVDLGGSLGRDAATGKGVLFATEALLAEHGKGIAGQRFVIQGFGNVGSWAAQLITEAGGKVIAISDVTGAVKNSNGIDIAKLMKHSAENRGIKGFDGGDAVDPTSLLTEECDVLIPAALGGVINKDNADAHQAKYIIEAANHPTD

SEQ ID NO: 775 - protein, 148 aa, Triticum aestivum
  misc_feature (47)..(47): Xaa can be any naturally occurring amino acid
  misc_feature (59)..(59): Xaa can be any naturally occurring amino acid
  misc_feature (109)..(109): Xaa can be any naturally occurring amino acid
  misc_feature (129)..(129): Xaa can be any naturally occurring amino acid
APPPARERAAWPRAWETCGCFGVQPSPVKVCRGVPVPFFWLSAVGLXRGGVVVFSHCVXLVSWGLANVSCEALVAARFACFLCLALPAGLGAFLLRVRVPPFLVLRFSXLLSCAGAGWLPSVFWGAFGXPPGVCARFALGAVLLSVRW

SEQ ID NO: 776 - protein, 666 aa, Mycoplasma hyopneumoniae
MIFNYNTSLFRKNFRGESYWGPLGLIFNGNNFEFYLWSPNANRVHFAIYKDPEDKIPAEIIVMSKNNDVWFCQINASFHGYSYNLLIEHHDLKITEALDPYAFSIAPFDWRKNESPKAYLIDIFSEKTGKNPSKLEGFNKNPQIDAQIYQLHIRDFSSISKKTENKGTFIGALENDVFSYLNSLKFNFLQLLPIHSCYNFSQKNASILHKGDGNGHFSTYNWGYDPIGYFSINSSYSTDPIDPYLRIFEFKKFVDSAHKNKIGIVLDVDFSHTFKNSILEDVAHGHFYRDEAAVLPAGFPPLDTRKPMAFRLILDSLIFFTKYYKVDGFRFNLASFLDKKAITVIASELKKVNPNILLYGDFSNFSDLPSRNRLEKGKSGNSFNFGYLNDTIQTAIIGSGNPRDKGLILSKTSKKFAAYVSSIPGNIANFDFQNLPYSKKKYDLFANDISLNLAYLTCYNGPTLADKILSSTTRIGKREFIEVYRQALMMINFVQGKISLSAGTEFAFSRICDFSGGSYQNCYPNLNIKRPPFSFLAGKYLDFHSDKTTDFTNGLNFEILKNNEIKEKIFDFLAEINQFRQNSPFFRLDTNQKIKKQLKFETVDNNKGLIIFKITAKNKVIKVIHNFSHLSYEYDFKNFNILFSSKIKVIPNLIQKHQSILLIKNS

SEQ ID NO: 777 - protein, 581 aa, Chlamydophila caviae
MPKQSEYTWGSKKILDTIDCLAEDVVEFKDLLCSTHGITSSDEETTSEIQPGAILKGTVVDINKDFVVVDVGLKSEGVIPMSEFIDSSEGLVLGAEVEVYLDQTEDEEGKVVLSREKATRQRQWEHILAHCEEGSIVKGQIIRKVKGGLIVDIGMEAFLPGSQIDNKKIKNLDDYVGKVCEFKILKINIDRRNVVVSRRELLEAERISKKAELIEQINIGERRRGIVKNITDFGVFLDLDGIDGLLHITDMTWKRIRHPSEMVELNQELEVIILSVDKEKGRVALGLKQKEHNPWEDIEKKYPPGKRIVGKIVKLLPYGAFIEIEEGIEGLIHVSEMSWVKNVVDPSEVVNKGDEVEAIVLSIQKDEGKISLGLKQTEHNPWDNIEEKYPIGLHVHAEIKNLTNYGAFVELEPGIEGLIHISDMSWIKKVSHPSELFKKGSTVEAVILSVDKESKKITLGVKQLSSNPWNEIEEMFPTGSNISGVVTKITAFGAFVELQNGIEGLIHVSELSEKPFSKIEDIISIGDSVSAKVIKLDPDHKKVSLSVKEYLADKQHDHMDTDLNNLDLDDLVGSDKKKKGK

SEQ ID NO: 778 - protein, 311 aa, Chlamydophila caviae
MTHTKVIIIGSGPAGYTAAIYASRALLSPILFEGFFSGIAGGQLMTTTEVENFPGFPEGILGQKLMDNMKSQAAHFGTQILPKDVTSVNFTKRPFVIMSNEEKYTCDTCIIATGASAKRLEIPGASDNEFWQKGVTACAVCDGASPIFKNKDLYVIGGGDSALEEAMFLTRYGKRVYIVHRRDTLRASKVMIKKAEANEKITFLWNSEIVKISGDTVVRSVDILNNVSKEISSRDAAGVFFAIGHKPNTDFLAGQLALDEHGYIITDKGTSKTSVPGVFAAGDVQDKYYRQAITAAGSGCMAALEAERFLD

SEQ ID NO: 779 - protein, 1203 aa, Oryza sativa
MAPTAAAAGPSDDGLRKLEYLSLVSKVCSELETHIGVGDKVLAEFITELGRDSASVADFDTKLKANGADLPDYFVRTLLTIIHAILPPPSDSRNPSSASQPAAGGSKFPGLSRPDDPDRARNLRLELERDAEEAAATAAPAPARDDRGRRRDERGRDRGRDDRGRDDGGRDRDYERGGRDHDRSHGRDRDHGRDRDRDRACDGDRQRGRDYGRDRDQDRDHDRDREGERRRDRDKDRGRDIDRDMDRDHRRGRRYDDEEEPEQFGGRKEGALVNSSGEPELYQVYRGRVTRVMDTGCFVRLEDVRGGREGLVHISQMATRRVANAKEMVKRDQEVYVKVVSVKGQKLSLSMRDVDQDTGRDLLPIQRGGDDAPRANPSGGSASGVGVGSGKRLGLSGIMIAEEDEVAPPSRRPLKRMSSPERWEAKQLIASGVLDVRDYPMFDEDGDGMLYQEEGAEEEQEIELNEDEPAFLQGQSRFSIDMSPVKIFKNPEGSLSRAAALQTALIKERREVREQEQRAMLDSIPKDLNRPWEDPMPDTGERHLAQELRGVGLSAYDMPEWKKEAYGKALTFGQRSKLSIQDQRQSLPIYKLKKELIQAVHDNQVLVVIGETGSGKTTQVTQYLAEAGYTTRGKIGCTQPRRVAAMSVAKRVAEEFGCRLGEEVGYAIRFEDCTGPDTVIKYMTDGMLLREILVDENLSQYSVIMLDEAHERTIHTDVLFGLLKQLIKRRSDMRLIVTSATLDAEKFSGYFFNCNIFTIPGRTFPVEILYTKQPESDYLDAALITVLQIHLTEPEGDILLFLTGQEEIDHACQCLYERMKGLGKDVPELIILPVYSALPSEMQSKIFDPAPPGKRKVVVATNIAEASLTIDGIYYVVDPGFAKINVYNSKQGLDSLVITPISQASAKQRAGRAGRTGPGKCYRLYTESAYRNEMSPTTIPEIQRINLGLGALDEEGLLTKLGRKMAEFPLDPPLSKMLLASVDLGCSDEILTIIAMIQTGNIFYRPREKQAQADQKRAKFFQPEGDHLTLLAVYEAWKAKNFSGPWCFENFVQSRSLRRAQDVRKQLLTIMDRYKLDVVSAGRNFTKIRKAITAGFFFHAARKDPQEGYRTLVENQPVYIHPSSALFQRQPDWVIYHELVMTTKEYMREVTVIDPKWLTELAPRFYKSADPTKMSKRKRQERIEPLYDRYHEPNSWRLSKRRA

SEQ ID NO: 780 - protein, 1194 aa, Debaryomyces hansenii
MLNIKYTPEESPSPSRWGSSRGENYVLDKSSSGSNKRLSKNISKRDALEKYQEHDDGSSYMNDFDIEGSEDLNFSYSKFSRVSGISLISGDDSNRLNSISGSPFVKNIQTRLQDIKFEEERKLNSRDSGRPSTRLNRPKSSQGRDKLMYLIDEGTLKNANDENESPFLDHAPILKTPIEKIGSTFEDNFDLRPRNYDHLQNPKIRGSSEQLENNAANGSRIPISLTPDKRRQQRMSSVKVSLTPAQRFEKMPGTRLTNALENFQFSTLVGRGASANVFKGINLKTNQIVAIKQIILEKNQNVMELMGEIDLLKILKHPNIVKYHGFVKTSTSLNVFLEFCSKGSLRQLYQHTNHGLPEDQIIDFVRQILQGLHYLHEQGVVHRDVKAANVLITEDGFIKLADFGVATKVSSQHETVVGTPNWMAPETVLGGEGLCTASDIWSLGATIIELFTTNPPYHDLNPMATLHAIGTDDHPPLPKNISPLAKDFLLECFQKQPNLRISAKSLLRHKWVTKSTKEKHVLEVSSQLNSEKHIPNPVSIHNYSESNEENWENDFIDINLPRMKASSADLLHSPSNHNGNRSKVSKSELLNKFLDKNEDFGFELETPTMISKFEKTDDLQVNLESTNLEESPREEEEEDPFLEIDIEDFNTNELEVQSKMEFLTTKFSNRVDLCHSGNDEVISSLIKITGRMLHLIKKYNILHDVLIRDHGILSLLELLENAPELPKHQKLWFHTLSILNNIFEKNISQFENFCLLGGIPVVTHFRSSSYDPQVRLQVVKFIKFLNNSEKALSMFVSCGGLRVLSKFVEEDFDLTPEFPLTSIDCIYNILSKDLTRSKSNLCRILSKYGVIFWFVVLLNRLTKSHSKPAPDGVPQDQIYSTINKIIEIIKYFGQSETRVRVNISNSDLFKLLIKVYPNLQYQHQLVILKFFKSISQISDILKALYSADILEFLVRIMELYTPSREHYKEVINVVCPTLYNCCYLNHAREVDLVRLGAVPHLKALSKINLPFRQFVLPILCELVHCDDYVRQILVKQDILTVYFNLLIDPYWQSNALDSILSWSQQASDQVKLDTPKAINCFVGGFMLPKVSNLESTLDSYLKLITVDKAVCYLMVKESIINNILFKLNVHNKNPVVQLNLLRILKNLVNTGKKTRMLDNLDISQNLITTLNTLKSRKASVLVDELAMDIVSLVI

SEQ ID NO: 781 - protein, 344 aa, Candida albicans
MSPSTQQQVHESNQSQSNDSSSIGLRLNDNNIQPIEIELSSFKHDSITFHKQDSSYWFYEKSKQSFPGQSFGLQVEKILYHTKSSFQDILIFKSTNFGNVLVLNGIIQCTEKDEFAYQELITHLPIMSHPSPKKVLVIGGGDCGVIRELIKHVNDQTIQEITMVEIDDMVIKLSTKFLPEMAKYHNHPKVNLIIGDGFEFLKNSSKEKKYDVIITDSSDPDDGPAEEFFQINYFKLLLNALNEKGIVIMQSSENIWLNLPYLKELKSKAATVFSNVKYCQCYMPSYTSGQLGLIIATMDTGKDLVNPLRKFDHDKELKLFKYYNQHIHTNSFVLPTWADDYLNN

SEQ ID NO: 782 - protein, 217 aa, Zea diploperennis
IVNGMDVSEWDPSRDKYIAVKYDVSTAVEAKALNKEALQAEVGLPVDRNIPLVAFIGRLEEQKGPDVMAAAIPQLMEMVEDVQIVLLGTGKKKFERMLMSAEEKFPGKVRAVVKFNAALAHHIMAGADVLAVTSRFEPCGLIQLQGMRYGTCNVVEPADVKKVDTTLQRAIKVVGTPAYEEMVRNCMIQDLSWKGPAKNWENVLLSLGVAGGEPGVE

SEQ ID NO: 783 - protein, 285 aa, Xylella fastidiosa
MTTNDTWFTEHFQTTGSAIGFRVTGKLDEVQSPFQKIEIYNSTDWGKLMVIDGALMLTSRDNFLYHEMISHPALFTHTAPKCVVIIGGGDCGTLREVLKHPDIEQVTQCDIDEQVTRMAEKHFPELCTSNNDPRATLLFSDGVAYMADCPTNSVDVIIVDSTDPVGPAKGLFNRTFYESCFRALKNDGLLIQQSESPLALLELIKEMRHEMSKAGFKAFKTLPFPQPCYPTGWWSVTLSSKQPNANFAFRQTDAQTKPFDTLYYNAHLHHGVLVPPPFIAHALGE

SEQ ID NO: 784 - protein, 344 aa, Capsicum annuum
MDRVKGPWSPEEDELLQQLVQKHGPRNWSLISKSVEHRAFTPEEDETIIRAHARFGNKWATIARLLNGRTDNAIKNHWNSTLKRKCSSLSADEGNELADQIFENQQPPLKRSVSAGSAMPVSGFHFSPGSPSGSDSDSSLHVTSSSQSHVFKPVARTGGVFPQSIDISSPPVDPPTSLSLSLPGVDLAEFSNRSADSTQSKNPFQLLLPPMQIPPPPPPPPPPPPQATTVPFERVSAIQQSLQNPDFGKNAGGEQPDKVFVPFSQELLGVMQEMIKTEVRNYMMGVEQKQQFQQQQQHYQQQPQQFQQQNHQLPSGLGLGLCMQQASDGFRDRAANRMRLSKFD

SEQ ID NO: 785 - protein, 173 aa, Methanopyrus kandleri
MVNRPARIYREWKGPAYTRREYIKGVPDPKIQQFDMGNPAGDFDVEVSLVARERAQVTHNALEAARVAANRYLTKTVGRQNYHLKIRVYPHHVLRENPLATGAGADRVQEGMRLAFGKPIGTAARVREGQRVVTVRIDPENFEHAKEALRRAGMKFPFPFTIVVDKGEELVQD

SEQ ID NO: 786 - protein, 135 aa, Vibrio vulnificus
MSELTKTLLNIRSLRAFSRELTLEQLEEALDKLTTVVAERQEAEAEERAAKAEQEAKLAAIAEQIAKDGIDVEALISALAGETKVKSKGKRAPRPAKYKYVDTNGEEKTWTGQGRTPSAIQAQLDAGKSLEDFEI

SEQ ID NO: 787 - protein, 585 aa, Yarrowia lipolytica
MSQSSSENFESDSALATITMADLEKKVEQLSVSGPAIYVNDTKGVDESSASGAQDSPYKTPAFALYSHPDAQIKVFKAGAEGAEGAYEDISPSALKKAKKGVDGLVKKAEKAKQLEASKADREAAEAARLEAAKKITITEDKSLDKPKLIKIRDTTENRGPRVKLFGWVHRLRTQKGVAFLVLRDGTGYLQCVLQGDLANAFQTQNLTLESSVAIYGTLKEVPEGARAPGGHELVVDFYEIIGLAPSGDDAITNKVQEGADPSYLLDYRYLTVRGETLSAVMKVRASFLRSIRRVYDELGMTEITPPCMVQTQVEGGSTLFALDYYGEKAYLTQSSQLYLETVIPSVGDAYCIAESFRAERSHTRRHLSEYTHIEAELGFLDFETFLEHIEEVLCRTVDYVLADPVAGPLVQELNPGFKAPERPFMRMPYVDALEWLNEHNIPNEEGNKFTFGDDIAEAAERKMTDEIGKPIFLTRFPLEIKSFYMKKCVDDPRVTESVDVLMPNVGEITGGSMRIDDLDELMAGFKREGIDTAPYDFFIDLRKYGTFPHGGYGLGTERILAWLCDRFTVRECSLYPRFTGRCKP

SEQ ID NO: 788 - protein, 261 aa, Prochlorococcus marinus
MEINVPGIVYLVGAGPGDPELLTLKALRLIKSCDALVHDALVSPQIIKETNKKTEIFNVGKRAGLCSVPQADTNLLIVKLAKEGKNVVRLKGGDPFVFSRGGEEVSFLEKNGISVEIVPGITSGIAAPSNFGIPLTHREAGSSITFVTGHEDINKDKKTVNWRLLAKSSDGLVIYMGMRNIGFIVKELLIGGLDENTKCAVIQEATLNNQKCLISELKNLAETISNKGFSSPSIIVIGSIVGFKVNNYINNLSDAFFPEKK

SEQ ID NO: 789 - protein, 544 aa, Anabaena variabilis
MFCNQCEQTTRGDVCHQWGACGKSPEVDALQDLLVHCLRGLSQVALQAKSLGLATRETDEFTCEMLFSTLTNVNFSTSDFISFVNRAIALRESLKLQIQATGNAVIQSAINSFQPASDTQKQIQQGKDLEFEFISQSAKNVDIFSLKLTLLYGLKGVAAYAFHALELNQHDESLYIFFHEVLANLDAQDKSLQDWLDLTLKVGQMNLKAMELLDAGNTETFGHPTPTTVPLGHTVGKAILVSGHDLLALKAVLEQTSGTGIKVYTHGELLPAHGYPKLKQTHPHLYGHYGTAWQNQTHEFERFPGAIVMTTNCLMPPHETYKDKVFTLGPVGYPGLQHISIHDISLVIQKALELPGFTEDSEQKTVTTGFARNAVLGVADTVINAVKQGDIRHFFLVGGCDGAKPGRNYYSDLVEKIPNDCVVLTLGCGKFRFFDQNLGDIGGIPRLLDLGQCNDAYSAIQIAVALANTFEVNVNQLPLSMILSWYEQKAIAVLLTLLYLGIQNIRIGPTLPAFLTPNVVKLLSETFHLQLITTPEQDLAVCLG

SEQ ID NO: 790 - protein, 314 aa, Yarrowia lipolytica
MHSHHSHSGQYVQHAKDSLEECVQAAKDKKFDVFCLTEHMPRSRETDLYPEEIESKTTPVDLAKVFDDYVKHARQLQKDNTSNTEILVGFECESIRAECWDRAVELKKHYGLDLCVGSVHHVNGIPIDFSQGQWCDASDSVSDMIDDQTTPEHALYKKYYEIQWNMLQKLKPEVVAHFDLIRLYSTIREGFGATENYVRENWPDVWDQIIKNIDFIISYGGFIEVSSAPLRKGWNTPYPRPDICKAVINRGGRLCLSDDSHGVAQVGLNYKKTLEYLEGLGVKDLWFLTKKSGKVEAQKIEIVRAKEAGFWVSC

SEQ ID NO: 791 - protein, 374 aa, Gluconobacter oxydans
MPEPTNSSPAPLKTDLRRVDINPDFWYPLAWSKDLKRGKTIGRRFGRFPIALVRPEEGSVFALEDRCAHRQVPLSLGKVSGEAVQCCYHGWAYGRSGRCIDVPYLGKRKLPNGVKTYPCREAGGMIFIFPGDAEKAESVPLPSLAQVDNPAFKTRRFSPVVKCHYTFMHENLMDMNHQFLHRRQMGQIRARFLGQDAGENFIEARYSFARTGNQQPLAERLIFGKHHDDPNREQPVEEIVSIRTTYPYQSLKIHDKDGDLIMELFSVYVPNTADGMSTQCFGLLSVLRPKTPFLIDMIWPALGIFTHRIFEEDREIMELEQNAWRELGGDHNVEVFPIVRKLRDLLAQNGVAPGTDTVAQPEVSREQPADPVVV

SEQ ID NO: 792 - protein, 136 aa, Camellia sinensis
MARTKQTARKSTGGKAPRKQLATKAARKSAPATGGVKKPHRFRPGTVALREIRKYQKSTELLIRKLPFQRLVREIAQDFKTDLRFQSSAVAALQEAAESYLVGLFEDTNLCAIHAKRVTIMPKDMQLARRIRGERA

SEQ ID NO: 793 - protein, 299 aa, Campylobacter jejuni
MKVHEKVSELIGNTPIIHLKKFGINVFAKCEFLNPSHSIKDRAAFEMIKDALDSKKINQDTTIVEATSGNTGISLAMICADLGLKFIAVMPESMSLERRKMITLFGARLELTPANLGMKGAVDKANEILLNTPNSFMVSQFENISNKNAHRKNTALEILRDLDNELDIFVAGFGTGGTISGVGEILKEKLEKVHIVGVEPLNSPLLSKGEAGSHKIQGIGANFIPAILNKEVIDEVITVSNEDAINTAKELAKSGLMVGISSGANVFAASMLAKKFPDKRILTMLNDTAERYLSTDLFA

SEQ ID NO: 794 - protein, 462 aa, Yarrowia lipolytica
MTSLANLIYAQTLYKYAIDNSVKSVVVLPDIPQPIAEYMATQVPKHPLIQPDILSMTGGPSSLTAAHCQKWWRQMISSTKIAEKELALSSLAKLVDGFRHVLYNETVAGLKADEVKFKHLKEMERDKKIKAETERLEKERLEKERLQKEQQEKEQQARREALEASKEQEEASKAQQSMTKSDDEDVEMTDAVEELKENENSSKKEQAEVETTEADVESVKVKEEEKDTEVETEKKTVEAEAEAEAEAEAEAEAEEQNYKDEEEQADGAEADVESDAREAEESGSDKETTADVETDRGETEEPDESELDRVTETPEAGATPGSEERTRKRARSTTEDSDSRKRSRRNTSAAPSANRKFQNVAGNLLSNISSNKSASFFTHPVNPNSAPNYYELIFSPTDIRTIKAQVKDGRISSTSELEREVAKMFANAIMYNPWDSDVNLWAREMQQETDALLTLFRGAGGE

SEQ ID NO: 795 - protein, 352 aa, Oryza sativa
MAAAAIAAASLLPSSAFALRRLSSAANVSRFAQLKRFDRARRFAPAAAMSTSSGPKEAPANNPGLQAPSEKDPATKGYFMQQTSGRRVSWVKRDGWGSSGSLWAAVGQGGEDVAVLPRLWETRAAGQCQVWVGSSEWLGSGGWGGRFDMNNGITDGGGEAERGERGVVEEEGLWWREGTADRRFRCQAPSAETEAGCLMFRVKDPKVSLDFYSRVMGMSLLKRLDFPEMKFSLYFLGYEDVESAPTDPVKRTVWTFGQRATLELTHNWGTENDPEFKGYHNGNSDPRGFGHIGVTVHDVYKACERFERLGVEFVKKPDDGKMKGIAFIKDPDGYWIEIFDLNRIGAVTAEAS

SEQ ID NO: 796 - protein, 187 aa, Conopholis americana
FGHGTRKWNPKMAPYILAKRKGIHFSNLTRTARFLSEACDLVFDAASMGKQFLIVDTKKKAADSVEWAAIKARCHCVNKKWLCGMLTNWSTTETLLNKFRDLRMEQKTGRLNRLKKKDVAVVKRQLARLQAYLYGIKYMTRLPDIVIIVDQHEDYKALRECITLGIPTICLIDTNCDPDLADISIPA

SEQ ID NO: 797 - protein, 187 aa, Boschniakia hookeri
FGHVTRKWNTKMAPYISAKRKGIHITNLTRTARFLSEACGLVFDAASRGKQFLIVGTKNKAADSVAWAAIKARCHCVNKKWLGGMLTNWSTTETRLHKLRDLRMEQKTGRLNRLPKRDAAMVKRQLSRLQTYLGGIKYMTGLPDIVIIVDQHEEYTALRECITLGIPTICLIDTNCDPDLADISIPA

SEQ ID NO: 798 - protein, 640 aa, Unknown
  Chrysanthemum x morifolium
MMDSCDCFETQWPADELLVKYQYISDFFIAFAYFSIPLELIYFVQKSAFFPYRWVLMQFGAFIVLCGATHFINLWTFSSHSKTVAIVMTVAKLSTAFVSCVTALMLVHIIPDLLSVKTRELFLKQRAEDLDREMGLIIKQEGTGRHVRMLTHEIRSTLDRHTILKTTLIELGRTLDLEECVLWMPSTKGMILEVSHSLHNLIPFRSTVPINLPIITEVFNRAEAIRIPHNCPLARIRTPVGSYIPPEVVAVRVPLLHLSNFEIDNWPDNSAKSYAVMVLILPMNGVRKWRDHEMELVTVVADQVAVALSHAAILEESMRARDQLMEQNFALNLARQEAEMAIHARNDFLAVMNHEMRTPMHAIIALSSLLLETELTPDQRAMIETILKSSNLLAALVNDVLDLSRLEDGSLELESDVFNLHGLFKEVVALINPIASVKNTSMALNCDLDLPAFGIGDEKRLMQIILNVVGNAVKFTKGGHVSIQASILSPEYLQEWRTPEFCPTLTEGLFYLLVQVKDSGSGIKQQDIPHIFTKFSEPRSASNRSGGAGLGLAICKRFVNLMGGHIWIESGGLGKGTTVAFLVKLGLCNYPNDPTMQQLVPRTVPKARPHQGSGELIQHRQLDREGYQGAASFPLYNRSM

SEQ ID NO: 799 - protein, 174 aa, Glycine max
RITSPSVTTVNRAGGGMVAPFTGLKSMAGFPTRKTNDDITSIASNGGRVRCMLLFSPVGKKKFETLSYLPDLDDAQLAKEGEYVLRKGWIPWLEFELGHGFVYREHNRAPGYYDGRYWTMWKLAMFGCTDASQVLKELQEAKTAYPNGFIRIIGFDNVRQVQCISFIAYKPPGF

SEQ ID NO: 800 - protein, 272 aa, Glycine max
MADAAKGTYRASRWSLNGMTALVTGGTRGIGHAIVEDLCGFGATVHTCSRNQAELDKCLTEWRSKGFLVSGSVCDVSSQPHREKFIQEVTSIFNGKLNIYVNNVGVNYRKPTIEYTAEVYSQIMAVNLDSAYHLCQLAYPLLKASGMGSIVFISSIAGVVSLGTGSVYAACKAATNQLTKYLACEWAKDNIRSNCVVPATTNTPLVEHLLRNKKYVEEMLSRTPLGRIAEPEEVSALVAYLCLPAASYITGQVVLVDGGLSVNRFQTSMRIT

SEQ ID NO: 801 - protein, 570 aa, Fusarium oxysporum
MSNSNLQKPIDVAEYLFKRLYEVGVRSVHGVPGDYNLVALDYLPQCNLKWVGSVNELNAAYAADGYARVTKMAALITTFGVGELSAVNGVAGSYSEHIPVVHIVGCPSTISQRDQMLLHHTLGNGDFDVFANMSAQISCNVAKLNKPSEIAEQIDTALRTCWLRSRPVYIMVPTDMVQEKVEGARLDTSIDLSEPQNDPGNEDFVVDEILKAMYAAQRPVILVDSCAIRHRVVKEVHQLIDKLDLPVFVTPMGKGAVNEDHPNYGGVFAGDGSHPARAQSIVEGSDLLLTIGALKSDFNTTGFSYRTSQINSVDFHSTHCKVRYSTYPGVAMRGVLRKIIDRVDPKSMPAPSIPEVRNEVEKNTDDSEIITQAWLWPRVGEYLIPNDIVVTETGTANFGIWDTRFPRNVTALSQVLWGSIGWSVGACQGAALAAKDAGKEGRTILFVGDGSFQLTAQELSTMIRHHLKPTIFVICNDGFTIERFIHGMDAVYNDINNWKYKDLVSVFGGEKTCKTFQIKTKTELNELLTNKEFNAAECLQFVELYMPREDAPRALIMTAEASARNNAKKH

SEQ ID NO: 802 - protein, 880 aa, Unknown
  Mycobacterium sp. MCS
MGPSHEATSRQYTIPSLAPMSTSISNGPARNVVVVGHGMVGHRFVEALRARDDADAWRITVLAEETDAAYDRVGLTGYTEHWDRALLALAGNDYAGDDLVDLRLGQRVTSIDRAARTVKTADGTAFAYDALVLATGSYAFVPPVPGRDLPACHVYRTFDDLDAIRADAARARETSRAPVGVVIGGGLLGLEAANALRGFGLTAHVVERSPRLMSQQLDDAGGALLSRMIADLGIEVHLDVSTDAITPAQRNRPLRRSEEDDSLRVMLGDGSFIDAGVVVFAAGVRPRDELARDAGLVIAERGGVLTDLGCKTSDPSIYAVGEVAAIEGRCYGLVGPGYTSAEVVADRLLGGAAEFPEADMSTKLKLLGVDVASFGDAMGRTPDCLEVVVNDAVNQTYAKLVLSDDAKTLLGGVLVGDASAYGVLRPMVGEQLPGDPMALIAPAGSGGADGGLGVGALPAAAQICSCNNVTKGDVTDAIAGGCCDVPGLKACTKAGTSCGSCVPLLKQLLEAEGVEQSKALCEHFSHSRAELFEIVSATEIRTFSGLLERFGTGKGCDICKPTVASILASTSSEHILDGEQAALQDSNDHFLANIQRNGSYSVVPRVPGGDITPEQLILIGEIARDFDLYTKITGGQRIDLFGARVEQLPEIWRRLVEGGMESGHAYGKALRTVKSCVGSDWCRYGQQDSVQMAINLELRYRGLRAPHKIKMGVSGCARECAEARGKDVGVIATEHGWNLYVGGNGGMTPKHAQLLAGDLDDETLIRYVDRFLMFYIRTADRLQRTAPWVEQLGLDHLREVVCDDSLGLASEFEAAMARHVEGYACEWKGVLEDPDKLSRFVSFVNAPDVPDPTVTFTENAGRKVPVPIGMPSIRPLQETP

SEQ ID NO: 803 - protein, 187 aa, Orobanche colorata
FGHDIKKWNPKMAPYISAKRKGIHITNLIRTARFLSEACNLVFDAASMGKQFLIVGTKKQAASLVARAAKKAECHCVNKKWFGGMLTNWSLTEMRLYKFGDLKMKKKMGSLKSLPKKDAAVGKRQLSRLQKSLGGIKYMTKLPDIVIIVDQHEEYTALRECITLKIPTICLIDTNCDPDLATISIPA

SEQ ID NO: 804 - protein, 549 aa, Staphylococcus epidermidis
MKQRVGQYLMDAVYSAGADKVFGVPGDFNLAFLDDIIAHNDIKWIGNTNELNASYAADGYARINGIGAMVTTFGVGELSAVNGIAGSYAERVPVIAITGAPTRAVEQEGKYVHHSLGEGTFDDYRKMFEPITTAQAYITPDNATTEIPRVINTALQQRRPVHIHLPIDVALTEIEISNPFKPEVEPQKNVQSYINMVQDKLESASQPVIITGHEINSFHLHKELEQFVNQTQIPVVQLSLGKGAFNEENPYYMGIFDGSIAEQDIQDYVNQSDAILNIGAKLTDSATAGFSYQFDINEVIMLNHNEFKINDTCIEAFSLPNILNGLNKYIHYKNTNDFPQYERPQSHNYELSDQPLTQETYFNMMQDFLQQDDILIAEQGTSFFGAYDLALYKDNTFIGQPLWGSIGYTLPATLGTQIANPYRRNILLIGDGSLQLTVQSLSTMIRQNLNPVIFVINNDGYTVERMIHGMKEPYNDIRMWDYKSLPSVFGGDNVLVHDVNTSEELMLTFENIKSNSDRMHFVEVKMAVEDAPVKLSNIAKAFASQNKSS

SEQ ID NO: 805 - protein, 487 aa, Oryza sativa
HYRTSLYKKAGWYRSDNKREEEKKREEQPPRLVSGQRPSKTTSGAASASAAAAHSSSSYSSLASSRSRGGGGGGCGRSPAWPPPPPPEMDTPDRPPRAAATAAVEDSPVFNFINSLSPIPPPKPSDSAHNVQLFKSSDLAPVSSIFASPHVNPAKESKLPIREDSVQLSRESHSPNSVRTRTGATSSIIRMIRCKNIVSENCSITCYLNDSTSSKASQPIQLCGGSAESDTNQNTDGKKDPTTEQDRTDIEFVLLDQCGPEKMDSSQSGNNACENQLSEQDKDELGSFDGGYMFAHQPHSDMLRLAPPFESETQLVNETLQTDNVYCETLLTDGPSGSYTQNSAPDPHPYWAGAVEGCATDYTPQMLPGACQSQLVPNDQINNKLNEPSDYMPMEHNVSSQNLRGMRRRCLFNEKSGAANEGAKNSSARHSTNSTTPRRKISSSDNNLKTLRTPPCALPGIGLHLNALATVPKDKMVPHNDIQSSPG

SEQ ID NO: 806 - protein, 370 aa, Nicotiana plumbaginifolia
MDTSHKHIALQMAAIILLGLLVSSTEIVGAQSVGVCYGMLGNNLPPASQVVQLYKSKNIRRMRLYDPNQAALQALRGSNIEVMLGVPNSDLQNIAANPSNANNWVQRNVRNFWPAVKFRYIAVGNEVSPVTGTSSLTRYLLPAMRNIRNAISSAGLQNNIKVSTSVDMTLIGNSFPPSQGSFRNDVRSFIDPIIGFVRGINSPLLVNIYPYFSYAGNPRDISLPYALFTAPNVVVQDGSLGYRNLFDAMLDAVYAALSRAGGGSIEIVVSESGWPSAGAFAATTNNAATYYKNLIQHVKRGSPRRPNKVIETYLFAMFDENNKNPELEKHFGLFSPNKQPKYPLSFGFSDRYWDISAENNATAASLISEM

SEQ ID NO: 807 - protein, 493 aa, Unknown
  Vibrio sp. Ex25
MQTINVVWLKRDLRLTDHQPLTQALSSKHPTVLLYIVEPLLLNNPHYSERHWRFVWQSLQDMNETLKAYGHRITVLFGDALACFQSIQMQYQINAVFSHQEIGLNCTFERDKQIADWLHEQNITWFEFEHGAVIRGAKDRQGWDKHWDLVMRSSISPLDLQTNLLHSLDAESLGCAFSPPSSWLSKCKGMQTGGSQLAWKTLEDFFNRRGRDYYRSISSPTASRTACTRLSPYLAWGNISLREVYQYLLKHWQVVGFRRSLIALSSRLHWHCHFIQKFESEYDMEFYCVNRAYESLIKQSSTFDEEKLAAWKSGYTGIPLIDACMRCLHQTGYINFRMRAMLVSFLTHHMNMDWRTGVTHLAQLFLDFEPGIHYPQFQMQAGVTGTNTIRIYNPVKQAQEHDPDGAFIYKWVPELQMVPTPLLFEPWTMTQMETVMYHLKPDSRYLAPIVDLNSAAKDARERLWAWRKRADVKQEGKRILTRHVRPSKESRAR

SEQ ID NO: 808 - protein, 297 aa, Unknown
  Azoarcus sp. BH72
MTHSRLRNPRPGPLPGHVYLVGAGPGDPELLTLRGARLVEGADVVVYDNLVSPAIIDLAPARAERIYVGKKAADHTLPQDEINQLLVKLAGEGKRVVRLKGGDPFIFGRGGEEMEVLVAAGVTVEVVPGVTAAAGIAAYAGIPLTHREHAQSVVFTTGFLKDGALDLDWPMLARRGQTLVIYMGISRLAEICAQLVAHGLPATTPAGVIERGTTAAQRVVTADLMTLPARVTEAGIRPPALTIVGDVVGLYPRLAWFSAAPPEGEPHLPHAGCSAVHAGQVAEGLDGDAAAGRGDAC

SEQ ID NO: 809 - protein, 432 aa, Triticum aestivum
  misc_feature (23)..(23): Xaa can be any naturally occurring amino acid
  misc_feature (122)..(122): Xaa can be any naturally occurring amino acid
ASSGDGAGGGAGDAVPGGRAGQXAVPARQPAGRVWGVRRTARAASGFKVLALGPETTGVIQRMQQLLDMDTTPFTDKIIAEYIWVGGSGIDLRSKSRTISKPVEDPSELPKWNYDGSSTGQXAPGEDSEVILYPQAIFKDPFRGGNNILVICDTYTPQGEPIPTNKRHMAAQIFSDPKVTSQVPWFGIEQEYTLMQRDVNWPLGWPVGGYPGPQGPYYCAVGSDKSFGRDISDAHYKACLYAGIEISGTNGEVMPGQWEYQVGPSVGIDAGDHIWASRYILERITEQAGVVLTLDPKPIQGDWNGAGCHTNYSTLSMREDGGFDVIKKAILNLSLRHDLHIAAYGEGNERRLTGLHETASISDFSWGVANRGCSIRVGRETEAKGKGYLEDRRPASNMDPYTVTALLAETTILWEPTLEAEALAAKKLALKV

SEQ ID NO: 810 - protein, 476 aa, Anabaena variabilis
MTLQSFGVIGLAVMGENIALNVERNGFPIAVYNRSREKTDAFMAQRAGGRNVKAAFTLEEFVAALERPRKILVMVQAGKPVDAVIQQLKPLLDEGDIIIDGGNSWFEDTQRRTQELEPAGLRFLGMGVSGGEEGALNGPSLMPGGTQSSYEYLSPIFNKIAAQVDDGPCVTYVGPGGSGHYVKMVHNGIEYGDMQLIAEAYDLLKTAGGLDAKQLHEVFAQWNTTDELNSFLIEITANIFPYVDPDTKLPLVDLIVDAAGQKGTGRWTVQTALELGVSIPTITAAVNARIISSIRDERIAASKQLTGPSGKYDGDTKEFINKVRDALYCSKICSYAQGMALLSTASTTFNWNLNLSELARIWKGGCIIRAGFLNKIKKAFNENPALPNLLLAPEFKQTILDRQAAWREVIITAAKLGIPVPAFSASLDYFDSYRRDRLPQNLTQAQRDYFGAHTYLRTDKAGAFHTEWVPIAEAKK

SEQ ID NO: 811 - protein, 917 aa, Arabidopsis thaliana
MENSDMKRNSSTLLDLPVVKSSLVVEAIHMSRKKLGWYNESRRDSETVKARVEAGLSEVKKSVEELALLIKRSNRSAGFQEKDMEVLKMEEKYAEVMRVLEVVKEEVSRVKLDVSSVLIERVAAEEKVEELRFKTEGGLRLLESLKKEIEVANEEHLMVALGKIEALKGYKEIERQREGKAIKVLDLLVERNKRIKNMLEEAERSKDIEIELFETSTDVEMLETQLKLFKKMERRVQGRDSSSMSRSNRSFGRGKYSLSVLKEVTEGKKEELASVKVEIFRVMTVMDALRNEIIRARDETACLGKILREDDVKIEKLNSKILIEKSKLEVVSIAEERISSLAENFVGSLEKIKKSRNAAKKEEFLFKEEKTVTKAETQKTKLDIDKKESELNSKLDELEKVKHTEALVLEKLESLVEDMMESREMESEHCSTITISRFEYEYLSKHASQAEETAEKKVAAAAAWVEALKASTKSFLMKTETLMRESEMTKAEEEREVFRMERSLSTKRLVEGEIQKIKRNSEAEGYISPKPVGKFTPVQRGKPRRYSSVGTPTFFVIKKKKKVPRLAKFFSRRKQQDLGCWSLFAMVYLCDNFIDETGSHLDELWHIDIFGFLKLHLDYVLLLYRLNSVIRFLLRSAWLSRKRSASGSFVCMPHELHERTLVLAKLYIFKDFSSSVVKYNMRRPKSSHVRMEPVAPRSHNTMPMLDQFRSNHPETSKIEGVSSLDTALKVFWNNQREQLGNFAGQTHLPLSRVRKILKSDPEVKKISCDVPALFSKACEYFILEVTLRAWMHTQSCTRETIRRCDIFQAVKNSGTYDFLIDRVPFGPHCVTHQGVQPPAEMILPDMNVPIDMDQIEEENMMEERSVGFDLNCDLQIEDALVNILLENPFRKELHSSFNLRAILLASLLGLNRFVHRD

SEQ ID NO: 812 - protein, 316 aa, Bacillus clausii
MAEETIYDVIIAGAGPAGMTAAVYTSRANLNTLMLERGMPGGQMANTEDVENYPGFDHILGPDLSNKMFEHAKKFGAAYAYGDIKEIIDEGDTKRVIAGSKEYRAKAVIVSTGAEYKKLGIPGEQELSGRGVSYCAVCDGAFFKERELIVVGGGDSAVEEAVYLTRFAKKVTIVHRRDQLRAQKILQDRAFNNPKVDFIWNKVVTEINEKDGKVGGVTLKDTKTGEVSNMEADGVFVYIGMLPLNESVQNLGITNEEGYIVTNEEMETKVPGIFAAGDVREKSLRQIVTATGDGSIAAQNVQHYLENLSEAEKVEK

SEQ ID NO: 813 - protein, 604 aa, Oryza sativa
MCGILAVLGAADWSQAKRAHVLSCSRRLKHRGPDWSGLYQCEGNFLAQQRLAIVSPLSGDQPLYNADRTIVVVANGEIYNHKKIRKQFASKHTFSTGSDCEVIIPLYEEYGEDFVDMLDGVFAFVLYDTRTKTYMAARDAIGVNPLYIGRGSDGAVWISSEMKALNEDCVEFEIFPPGHLYSSAAGGLRRWYKPQWFAENVPATPYQPLLLREAFEKAVIKRLMTDVPFGVLLSGGLDSSLVAAVTKRHLIKTEAAEKFGAELHSFVVGLEGSPDLIAAREVADHLGTIHHEFHFTVQDGIDAIEEVIYHDETYDVTTIRASTPMFLMARKIKALGVKMVLSGEGSDELLGGYLYFHFAPNKEEFHKETCRKVKALHQYDCLRANKATSAWGLEVRVPFLDKEFINVAMSMDPEWKMYNADLGRIEKWVMRKAFDDEEHPYLPKHILYRQKEQFSDGVGYNWIDGLKAFTEQQVSDEMMKNAAKVYPHNTPVNKEAYYYRMIFERLFPQESARETVPWGPSIACSTPAAIEWVEQWKASHDPSGRLIASHNSASASANHTNHANANANGNSNGKANGNCAMAANGTNGVGLVVANGTANGKMEA

SEQ ID NO: 814 - protein, 235 aa, Alopecurus myosuroides
MAGGNDLKLLGTWPSPYAIRVKLALAHKGLSYEYAEEDLANKSELLLSSNPVHRKIPVLIHNGVPVCESNIILEYIDEAFAGRSILPADPYERAMARFWAAYVDDKLLAAWATMVFKGKTEEEKLEGKKALFAALETLEGALAKCSDGKDFFGGDTVGLVDMVLGSHLSFLKATEAMAGEEILRSDRTQLLAAWMARFSELDAAKAALPDVDRVVEFVKMRQARLAAAAAAASNN

SEQ ID NO: 815 - protein, 157 aa, Zea mays
  misc_feature (98)..(98): Xaa can be any naturally occurring amino acid
  misc_feature (101)..(101): Xaa can be any naturally occurring amino acid
  misc_feature (115)..(115): Xaa can be any naturally occurring amino acid
  misc_feature (123)..(123): Xaa can be any naturally occurring amino acid
  misc_feature (125)..(125): Xaa can be any naturally occurring amino acid
MASSMLSSAAVVTSPAQATMVAPFTGLKSSAAFPVTRKANNDITSIASNGGRVSCMKVWPPVGKKKFETLSYLPDLTEVELGKEVDYLLPAQWIPCVXFEXEHGFVYREHGSTPXYYDGRYWXMXKAPLFGCTDSAPVLRESKKCKRRPYRFLRIMD

SEQ ID NO: 816 - protein, 235 aa, Alopecurus myosuroides
MAGGDDLKLLGTWPSPYAIRVKLALAHKGLSYEYAEEDLANKSELLLSSNPVHRKIPVLIHNGVPVCESNIILEYIDEAFAGPSILPADPYERAMARFWAAYVDDKLLAAWATMVFKGKTEEEKLEGKKALFAALETLEGALAKCSDGKDFFGGDTVGLVDMVLGSHLSFLKATEAMAGEEILRSDRTQLLAAWMARFSELDAAKAALPDVDRVVEFAKMRQARLAAAAAAASNN

SEQ ID NO: 817 - protein, 345 aa, Unknown
  Vibrio sp. Ex25
MTQANTNNAYGKDIAMTVIGAGSYGTSLAISLARNGANVVLWGHEPEHMARLEADRANHAFLPGVDFPESLIIESDLEKAVQASRDLLVVVPSHVFGIVLNSCKPFLREDSRICWATKGLEPETGRLLKDVAYDIIGENYSLAVLSGPTFAKELAMGMPTAISVASPDAEFVADLQEKIHCSKTFRVYANSDFIGMQLGGAVKNVIAIGAGMSDGIGFGANARTALITRGLAEMSRLGAALGAKPETFMGMAGLGDLVLTCTDNQSRNRRFGLALGQGKDVDTAQEEIGQVVEGYRNTKEVWMLSQRMGVEMPIVDQIYQVLYQGKDARLAAQDLLARDKKAEGK

SEQ ID NO: 818 - protein, 54 aa, Unknown
  Acinetobacter sp. ADP1
MKKYQCIVCGWIYDEAEGWPQDGIAPGTKWEDIPDDWTCPDCGVSKVDFEMIEV

SEQ ID NO: 819 - protein, 608 aa, Ustilago maydis
MGEERKVSATSSAALAIRTSSTPSAGAQLPDPSLPAPNLGEDEVGFTAADLIAQQSKLEAQANEAIPFQFDTCTHERGYIRQPVYACKTCGGGGVCAGCSVSCHAEHELVELFNKRKFRCDCGTPNLYRQQEPNRATRLTRITEQLAYPEGAKPCILRKPGFSPQNDVNAYNHNFDGGFCYCERGKTYDPEKEDETMFQCIVCEEWLHESCTSLWPSPRPLDSKSNTEAVNDSDAAASFASRALAEAEAPLIDHDLFDLMICDACVRRPGNGLLRRYAGAKGWMILVPSQDAAQVAAHDSITKIQVPTEDELREGGGPYHDGRSWQIFGLEVEQERVLTQDDVAIAADGALLSSVADLARSTVAAASEVLQGTSALAEDASTKREGEPQKEGIGLANGSDERREGKRRAVEDAGEDEAKRVKVEDEKTRDVHMATETRSETEVNETIQQPLCTLPAALDVVASLSESKVDPWTPALSEPAAKELGVQQRYDIFLSEDFRDRICRCSTCLPQWEHLSHVLDTEETYAPPSDPQASVRDDDAASITSSTYDLGMAALRSMPREKMINSLHAYSKFRDALWEHLKPFAGTGKVVREEDVRAFFQKKLNAER

SEQ ID NO: 820 - protein, 473 aa, Ralstonia metallidurans
MKTLFLQAPSYDGFDGGAGSRYQAKREIKSFWYPTWLAQPAALVPDSRVLDAPADGLGVEQTLNIAVDYDLVIIHTSTPSFPTDARFAEQLKERRPDIMIGMVGAKAAVDPGGTLSATEAIDFVCREEFDYTCQDVAAGKPLAGIAGLSYRLPDGTIEHNPARPMIENMDELPFVAPVYKRDLKIQNYFIGYLMHPYVSIYTGRGCRSRCTFCLWPQTVGGHRYRTRSAQSVIDEVKWIKENMPEVREIMFDDDTFTDFKPRVEEIARGLGEIGLPWSCNAKANVPYNTLKIMKENGLRLLLVGYESGDDQILLNIKKGLRTDIARRFTEDCRKLGIQIHGTFILGLPGETRDTIEKTIEYAKEINPHTIQVSLAAPYPGTTLYKQAVDNGWLEENKVIHLVNDSGVQLAAISYPHLSREEIYHGVETFYKRFYFRPSKIWEIVREMAGSWNMTKRRLREGVEFFRFLRSHEA

SEQ ID NO: 821 - protein, 448 aa, Arabidopsis thaliana
MESDLGKLFIGGISWDTDEERLRDYFSNYGDVVEAVIMRDRATGRARGFGFIVFADPCVSERVIMDKHIIDGRTVEAKKAVPRDDQQVLKRHASPIHLMSPVHGGGGRTKKIFVGGLPSSITEEEFKNYFDQFGTIADVVVMYDHNTQRPRGFGFITFDSDDAVDRVLHKTFHELNGKLVEVKRAVPKEISPVSNIRSPLASGVNYGGGSNRMPANSYFNNFAPGPGFYNSLGPVGRRFSPVIGSGRNAVSAFGLGLNHDLSLNLNPSCDGTSSTFGYNRIPSNPYFNGASPNRYTSPIGHNRTESPYNSNNRDLWGNRTDTAGPGWNLNVSNGNNRGNWGLPSSSAVSNDNNGFGRNYGTSSGLSSSPFNGFEGSIGELYRGGSVYSDSTWQQQQLPSQSSHELDNLSRAYGYDIDNVGSDPSANDPETYNGSYNVGNRQTNRGIAA

SEQ ID NO: 822 - protein, 418 aa, Idiomarina baltica
MQKKDQTIAAFDAELWQAMNQEVERQEQHIELIASENYTSPRVLEAQGSQLTNKYAEGYPHKRYYGGCEYVDVVEDLAIARAKELFGAKYANVQPHSGSQANTAAFMALMEAGDTFLGMSLAHGGHLTHGAGVNFSGKLYNAVQYGISEETGEIDYNQVEELAKEHQPKVIVAGFSAYSGIVDWQRFRQIADEVGAYLLVDMAHVAGLVAAGVYPSPIPYADVVTTTTHKTLAGPRSGLILSGKDDEKLHKKLNSAVFPGNQGGPLMHVIAAKAVAFKEALEPEFKAYQEQVLKNANAMVKALQARGYKIVSNGTQNHLFLVDLIDKDITGKDADAALGRAYITVNKNAVPNDPRSPFVTSGLRLGTPAITRRGFKEAEAEQVANWICDVLDDINNEETIDRVRNDVKTLCAEFPVYK

SEQ ID NO: 823 - protein, 584 aa, Arabidopsis thaliana
MCGILAVLGCSDDSQAKRVRVLELSRRLRHRGPDWSGLYQNGDNYLAHQRLAVIDPASGDQPLFNEDKTIVVTVNGEIYNHEELRKRLKNHKFRTGSDCEVIAHLYEEYGVDFVDMLDGIFSFVLLDTRDNSFMVARDAIGVTSLYIGWGLDGSVWISSEMKGLNDDCEHFETFPPGHFYSSKLGGFKQWYNPPWFNESVPSTPYEPLAIRRAFENAVIKRLMTDVPFGVLLSGGLDSSLVASITARHLAGTKAAKQWGPQLHSFCVGLEGSPDLKAGKEVAEYLGTVHHEFHFSVQDGIDAIEDVIYHVETYDVTTIRASTPMFLMSRKIKSLGVKMVLSGEGADEIFGGYLYFHKAPNKKEFHQETCRKIKALHKYDCLRANKSTSAFGLEARVPFLDKDFINTAMSLDPESKMIKPEEGRIEKWVLRRAFDDEERPYLPKHILYRQKEQFSDGVGYSWIDGLKDHAAQNVNDKMMSNAGHIFPHNTPNTKEAYYYRMIFERFFPQNSARLTVPGGATVACSTAKAVEWDASWSNNMDPSGRAAIGVHLSAYDGKNVALTIPPLKAIDNMPMMMGQGVVIQS

SEQ ID NO: 824 - protein, 318 aa, Unknown
  Synechococcus sp. RS9916
MGWSTADIPDQQGRIALITGASSGLGLETARALHQKGATVVMACRSPRKAEAARQELLEMQGEGALDLVALDLADLASVGRCSDAIHQRYGRLDLLINNAGVMAPPRLVSRQGYELQWATNHLGHMALTTALLPLMEGQADARVVTVTSGAQYFGRIAWGDPNGEQRYDRWQAYGQSKLANVMFALELDQKLRKQGSTVRSLAAHPGLARTNLQPASITANGSRIEAFAYRLMDPLFQSAAMGALPQLHAATAPSAQGGEHYGPDGFGGLRGWPKQQPVAPAARDAAQRQRLWALSEALLQEATAPDKPRRSTDRAAG

SEQ ID NO: 825 - protein, 91 aa, Oryza sativa
MSRRSRSRASSAARITDEQIGDLVSKLQALLPEARLRSNDRVPSARVLQETCSYIRSLHREVDDLSERLAELLAAADVSTAQAAVIRGLLM

SEQ ID NO: 826 - protein, 612 aa, Corynebacterium efficiens
MQGRRDVENVSTLVGMTDTTPLSSDLIPESTARPVVDAEGFIIEHESEEYHTPTPAPGEQPWEKHDREWYKDAVFYEVLVRAFYDPDNTGSGTLKGLTEKLDYIQWLGVDCIWVPPFYDSPLRDGGYDIRNFREILPEFGTVEDFVELVDQAHRRGLRVITDLVMNHTSDQHPWFQQSRTDPDGPYGDFYVWGDDPEMYKEARIIFVDTEESNWTYDPVRKQYYWHRFFSHQPDLNYDNPAVQEAMLDVLRFWLDLGLDGFRLDAVPYLFEREGTNGENLPETHEFLKRCRRVIDEEYPGRIVLAEANQWPHDVVEYFGEKEKGDECHMAFHFPLMPRIFMGVRQGSRTPVSEILEHTPDIPKTAQWGIFLRNHDELTLEMVSEEERAYMYQQFAPEPRMRANVGIRRRLATLVDGDRNQLELLHGLLLSLPGSPVLYYGDEIGMGDNIWLPDRDGVRTPMQWSNDRNGGFSKADPERLYLPAIQNDRFGYAQVNVETQLKQENSLLQWIRNQIMIRKQYKAFGKGTYREIDSTNEAVLTFLREYKGQTILCVNNMSKLPQAVALDLSEFAGITPREVSGGQYFPTIGERQCVFTLAPHGFFWLDLTGEEEE

SEQ ID NO: 827 - protein, 328 aa, Prochlorococcus marinus
MTMTSPMPIAADITALVGCTPLVRLNRLPQVSGCHAEVLAKLESFNPTASVKDRIAGAMIHAAEEAGTIAPGRTVLVEPTSGNTGIALAMVAAARGYRLILTMPDTMSTERRAMLRAYGAELQLTPGSDGMTGSIELAKELVATIPEAYLLQQFDNPANPQVHERTTAEEIWNDCEGRLDGLITGVGTGGTLTGCARLLKQRNPSLRVFAVEPALSPVLAGGSPAPHRIQGIGAGFIPSVLDLSLIDEILPVSDDDAMEMGRRLAREEGLLSGVSSGAAVAAALQVGSRAEMVGKRLVVVLASFGERYLSTPMFSAASAVPAQRDGYL

SEQ ID NO: 828 - protein, 339 aa, Erwinia carotovora
MNASDASMTVIGAGSYGTALAITLARNGHRVVLWGHNPTHIQALQAARCNQAFLPDVPFPDSLQLETNLAHALAASRNVLVVVPSHVFGDVLRQLKPHLRADARIVWATKGLEAETGRLLQDVAREALGETIPLAVVSGPTFAKELAAGMPTAIALASPDSEFADDLQQLLHCGKSFRVYSNPDFIGVQLGGAVKNVIAIGAGMSDGIGFGANARTALITRGLAEMTRLGAALGADPTTFMGMAGLGDLVLTCTDNQSRNRRFGMMLGQGMDVQSAQDSIGQVVEGYRNTKEVLALAQRYGVEMPITEQLWQVLYCGKDAREAALSLLGRTRKDETAKL

SEQ ID NO: 829 - protein, 490 aa, Photorhabdus luminescens
MSDVVLSKNHINPFQSQLEELDSKLVPIEGEAPSELKGTFFRIGPGRLHRGDEYYNHPFDGDGMIFKVTFSDNGIFYRNRHVLTKEYLKEEEAQRLLYRSVGTVPKKLKLRMRFFIIKNPANTNIVYHSHKLLALWEGGMPHLINPVTLETISKYDFSGKLKARFSFLPKLNLREVPFTAHPKKIPNDDNLYGFGVTYGIGSKLTLYKIDSAGDMMVIRKISLKKRYLIHDFIVTKNYFLFFLGGPHINLKLSNVIGNESIIASMNSRESEDGRVLLVSRKCHDVKFYDAVPGFIFHFANGYEDADGNVIFDASFWRSFPVFTQNIFKNNSSELCRFTLCTASGNVDKEILFRGNTDFPAINPTVCGRQHRYAWFVCWEDSDSEGRSIIKFDCFDKSVLSHSFDNDLPEEPVFVAKPGAVKEDDGWLIFKVYVEKLHCTDIVVLNADDLSMVCRLRLPHHIPMGMHHCWINEVMLYPMDFKMHRDGKEAT

SEQ ID NO: 830 - protein, 706 aa, Medicago truncatula
MKRPRALSESGQRPFIIKSGGCSEEDQEIEKVEHKSRRKSDSVASFRPKSQRKSRSSMERISELPENANKNSHRHSFMGFRRKSQSIDESIDNEVIVDMSSESEDDDRDDSFEFDDKEKLREKRKGLDLATTLERIEKNFVITDPRLPDNPIIFASDSFLELTEYSREEILGRNCRFLQGPETDPATVRKIREAIDNQTEVTVQLINYTRTGKKFWNLFHLQPMRDHKGEVQYFIGVQLDGSQHVEPLHNCIKEDTAKEGEQLVKQTAENVGEAVRELPDANQKPDDLWLNHSKVVHPKPHRKDNDAWRAIQKIIENGEQISLKHFRPIKPLGSGDTGSVHLVELEGTGQYFAMKAMDKGVMLNRNKVHRACTEREILDMLDHPFLPALYASFQTKTHVCLITDYYPGGELFLLLDQQPTKVLKEDAVRFYAAEVLIALEYLHCQGIIYRDLKPENVLIQRNGHVSLTDFDLSCLTSCKPQLIIPANEDKKKRKKKKKKGQQKTQQIPTFMAEPMRASNSFVGTEEYIAPEIITGSGHTSAVDWWALGILLYEMLYGYTPFRGKTRQKTFANILHKDLKFPKSKPVSPQAKQLIYWLLHRDPKNRLGSLEGANEIKSHPFFKNVNWALIRCMKPPELDAPILLENDEKKEAKDIDPGTDKWVASLSSDSSEDDFVGDIAIPPFTWFREESILGQLKLGDLLKSLRN

SEQ ID NO: 831 - protein, 501 aa, Zea mays
MPPRTAPAATSTPPRKVPLRKLLRAASVACGVQFGWALQLSLLTPYVQELGIPHAFASLVWLCGPLSGLLVQPLVGHLSDRIGPAASPLGRRRPFIAAGAACIAAAVLTVGFSADLGRLFGDDVTPGSTRLGAICVYLVGFWLLDVGNNGTQGPCRAFLADLTENDPRRTRIANAYFSLFMALGNILGYATGAYSGWYSIFPFTVTESCGISCANLKSAFLLDIIVLVITTYTTVTSVQEPQTFGSDEAQNPGAEQEAFLWELFGSLRYFTLPIWMVLIVTALTWMAWFPFTLFDTDWMGREIYRGSPDNPGETQRYHDGVRMGSFGLMLNSVVLGFTSVVLEKLCRKWGAGLVWGVSNILMTLCFLAMLVITYVAKNMDYPSSGAPPTGIVVASLVVFTILGAPLAITYSIPYAMAASRVENLGPGQGLAMGILNLAIVIPQVIVSLGSGPWDQLFGGGNAPAFAVAAGASFIGGLVAILGLPRARIASSSSRRRGGTHR

SEQ ID NO: 832 - protein, 469 aa, Unknown
  Vibrio sp. Ex25
MSAPIAVATLFASQLFLVGAPLAAEDTGLIEPRNDTFEQNHPDQYHSWKATSESEHIEDALSEDPNMVILWAGYGFAKDYNKARGHFYALDDVRQTLRTGAPADENSGPMPMACWSCKSPDVARVIEERGEDGYFEGKWARLGSEIVNPIGCSDCHSTGSEAFKKGEPALALTRPYVERAFDTIGKNFDQQSRLDKQASVCAQCHVEYYFTGPTKAVKFPWDMGTNVADMEKYYDALNFKDWTHAVSKAPMLKAQHPGFETWRAGIHGKNKVVCVDCHMPKVTKEDGTVYTDHKVGNPFDRFEDTCAQCHTQTKEQLQGIVSTRKAQVLNMKLTAEKQIVAAHFEAGAAWEAGATEEEMQPILQDIRHAQWRWDYAIASHGVHMHAPEVALEVLGTAVDRAADARTKLVRLLATKGITDPVQIPDISTKAKAQQALGMDMEKMNADKKHFLETVAPEWDKAAAEREATY

SEQ ID NO: 833 - protein, 229 aa, Alopecurus myosuroides
MAGGDDLKLLGTWPSPYAIRVKLALAHKGLSYEYAEEDLANTSELLLSSNPVHKKIPALIHNGVAVCESNIIVEYIDEAFAGPSILPADPYERAIARFWAAYVDDKLFGAWATMLFSGKTEEEKLEGKNALFAALETLEGALAECSDGKDFFGGHTVGLVDMALGSHLSWLKATEVMAGEEILRSDRTQLLAAWMARFSELYAAKAALPDVDRMAKMRQERLAAAAAAA

SEQ ID NO: 834 - protein, 276 aa, Nicotiana tabacum
HIASGMEHARWWVQKNVKDFWPDVKIKYIAVGNEISPVTGTSYLTSFLTPAMVNIYKAIGEAGLGNNIKVSTSVDMTLIGNSYPPSQGSFRNDARWFTDPIVGFLRDTRAPLLVNIYPYFSYSGNPGQISLPYSLFTAPNVVVQDGSRQYRNLFDAMLDSVYAALERSGGASVGIVVSESGWPSAGAFGATYDNAATYLRNLIQHAKEGSPRKPGPIETYIFAMFDENNKNPELEKHFGLFSPNKQPKYNINFGVSGGVWDSSVETNATASLVSEM

SEQ ID NO: 835 - protein, 195 aa, Bacillus clausii
MARSYELTRTTGETDISLRLNLDGEGKADIETGVPFMEHMLDLFAKHGQFDLFVKASGDIEVDAHHTTEDLGICIGQAVKEALGTKEGIKRYGNAFVPMDETLAQVVVDLSNRPHLEFRADFPSQKVGTFDTELVHEFFWKLALEARMNLHIIVHYGHNTHHIIEAIFKACARALDEATAIDPRIKGILSTKGLL

SEQ ID NO: 836 - protein, 277 aa, Brassica napus
MGTIEKSVSQVNLTSSAIFTVSSSYPAASFSSSTTSSSSSSSTTYNSKRKASPRSSEILEDDDNVVKRRKISGGDKHPNYRGVRMRSWGKWVSEIREPRKKSRIWLGTYPTAEMAARAHDVASLAIKGTTAHLNFPELSGELPRPVTSSPKDIQAAATAAAVNWQESGANSLRVDNSDVAELAEAEPSRAVMAQALSGSVVYSSDVNTRDLSEISCSSTTSFADKDKEEDKLFDLPDLFSDEMIIRNDAFCYYSSAWQLCGADHGFRLEEPFFCLND

SEQ ID NO: 837 - protein, 244 aa, Glycine max
  misc_feature (85)..(85): Xaa can be any naturally occurring amino acid
MVSAAIARNVVGVIGNIISFGLFFSPAPTFYGIVKKKTVEEFKPDPYIATVLNCAFWVFYGMPFVHPNSILVVTINSVGLAFESXYLVFFFLFVESLKKLLIFLLIEVVFFAAVALITMLALHGTRQRSLVVGVLSDIFNVMMYVSPLTIMAKVIKTKSVKYMPFWLSLANFLNGACWTTYALIHPFDLYVLISNGIGAISGLIQLILYACYCSCKSKNDEDGDQDLKPSGFQLSNLNGRAAVV

SEQ ID NO: 838 - protein, 413 aa, Bacillus cereus
MDHLKRQDEKVFAAIEAELGRQRSKIELIASENFVSEAVMEAQGSVLTNKYAEGYPGKRYYGGCEHVDVVEDIARDRVKEIFGAEHVNVQPHSGAQANMAVYFTILEQGDTVLGMNLSHGGHLTHGSPVNFSGVQYNFVEYGVDAESHRINYDDVLAKAKEHKPKLIVAGASAYPRVIDFKRFREIADEVGAYLMVDMAHIAGLVAAGLHPNPVPHAHFVTTTTHKTLRGPRGGMILCEEQFAKQIDKSIFPGIQGGPLMHVIAAKAVAFGEALQDDFKTYAQNIINNANRLAEGLQKEGLTLVSGGTDNHLILIDVRNLEITGKVAEHVLDEVGITVNKNTIPFETASPFVTSGVRIGTAAVTSRGFGLEEMDEIASLIAYTLKNHENEAALEEARKRVEALTSKFPMYTDL

SEQ ID NO: 839 - protein, 329 aa, Nicotiana tabacum
LGNNLPNHWEVIQLYKSRNIGRLRLYDPNHGALQALKGSNIEVMLGLPNSDVKHIASGMEHARWWVQKNVKDFWPDVKIKYIAVGNEISPVTGTSYLTSFLTPAMVNIYKAIGEAGLGNNIKVSTSVDMTLIGNSYPPSQGSFRNDARWFTDPIVGFLRDTRAPLLVNIYPYFSYSGNPGQISLPYSLFTAPNVVVQDGSRQYRNLFDAMLDSVYAALERSGGASVGIVVSESGWPSAGAFGATYDNAATYLRNLIQHAKEGSPRKPGPIETYIFAMFDENNKNPELEKHFGLFSPNKQPKYNLNFGVSGGVWDSSVETNATASLVSEM

SEQ ID NO: 840 - protein, 463 aa, Pseudomonas syringae
MSSTANSSELEQGLKPRHITMLSIAGVIGAGLFVGSGHAIAEAGPAVLLAYAAAGTLVVLVMRMLAEMAVASPDTGSFSTYADRAIGHWAGFTIGWLYWWFWVLVIPLEANAAATILHAWFPNIAIWMFTLVITLLLTATNLFSVKNYGEFEFWFALIKVVAIIAFVVLGVAAIFGLLPTSNVSGVSHLFDTGGFLPNGMGAVLAAMLTTMFSFMGTEIVTIAAAESKNPGKQITKATNSVIWRIFLFYLVSIFIVVSLVPWNDPRLAEVGSYQTVLDAMGIPNAKLIVDLVVLVAVTSCLNSALYTASRMLFSLGKRGDAPALSKRTSKGGTPYWAVIMSTAAAFLTVFANYIAPAAVFDFLLASSGAIALLVYLVIAVSQLRMRQKRIAAGEAIDFKMWLFPWLTWAVIAFIVAVLTIMLIQEEHRVEIIATGLLSLLVISAGLLVSRRRKAGRVGAAALG

SEQ ID NO: 841 - protein, 978 aa, Burkholderia xenovorans
MKLEHPDRLMNRTPLSLAALEVHDAFAERHIGPDSADQQAMLEALGFASRAALIDAVIPKTIRRTEPLPLGPFAQPKSEAEALATLRELADRNQVFRSYIGQGYYNAHTPTVILRNVLENPAWYTAYTPYQPEISQGRLEALLNFQQMIVDLTGLAISNASLLDEATAAAEAMTLLQRIGKPKSNVFYVADDVLPQTIEVVKTRATPVGIEVKVGPAADAANANAFGVLLQYPGVNGDVRDYRALAEAIHAAGGHVVVAADLLALTVLTPPGEWGADVAVGNTQRFGVPVGFGGPHAAYLAVRDEFKRQMPGRLVGVTVDAQGNPALRLALQTREQHIRREKATSNVCTAQALLAIMASMYAVYHGPHGLKTIALRVNRIAALLAEGAKQLGYTLVNETFFDTLTFETGARTQALHDAALAKRINLRRVSDTQVGLSVDETTTRRDLADLLEVFAQAAGAKIVPQVDALDSTIAASDTASVPPALERTSAYLTHHVFNRHHSETEMLRYLRSLSDKDLALDRSMIPLGSCTMKLNATSEMLPVTWPEFGQIHPFAPAEQTVGYREMIDQLEAMLVAATGYAAVSLQPNAGSQGEYAGLLIIHAYHASRGEAHRNVCLIPASAHGTNPASAHMAGMQVIVVACDAQGNVDIEDLKKKAEQHADKLAAIMITYPSTHGVFEQNVREICEIVHAHGGQVYVDGANMNAMVGLTAPGQFGGDVSHLNLHKTFCIPHGGGGPGVGPVAVGAHLAQFLPNQISSGYERAPNGIGAVSGAPYGSASILPISWMYIAMMGAKNLTAATETAILNANYVAKKLAPHYPVLYSGPGGLVAHECILDLRPIKETSGITVDDVAKRLADYGFHAPTMSFPVPGTLMVEPTESESKEELDRFIEAMIAIREEIRAVEEGRSDREDNPLKHAPHTAAVVIANDWKHAYARETAAYPLPTLIAKKYWPPVGRADNVYGDRNLFCSCVPIADYE

SEQ ID NO: 842 - protein, 359 aa, Nicotiana tabacum
MAAITLLGLLLVASSIDIAGAQSIGVCYGMLGNNLPNHWEVIQLYKSRNIGRLRLYDPNHGALQALKGSNIEVMLGLPNSDVKHIASGMEHARWWVQKNVKDFWPDVKIKYIAVGNEISPVTGTSYLTSFLTPAMVNIYKAIGEAGLGNNIKVSTSVDMTLIGNSYPPSQGSFRNDARWFVDAIVGFLRDTRAPLLVNIYPYFSYSGNPGQISLPYSLFTAPNVVVQDGSRQYRNLFDAMLDSVYAALERSGGASVGIVVSESGWPSAGAFGATYDNAATYLRNLIQHAKEGSPRKPGPIETYIFAMFDENNKNPELEKHFGLFSPNKQPKYNINFGVSGGVWDSSVETNATASLVSEM

SEQ ID NO: 843 - protein, 470 aa, Corynebacterium diphtheriae
MTEHTAPTLTKGLKVRHLTMMGLGSTIGAGLFLGTGVGIKAAGPAVLIAYIIAGFIAVMIMRMLGEMGSVVPASGSFSEYADAGIGHWAGFIQGWVYWLATVAVLGAEITGASGFVASWLGVSPWIPALVFVAFFGLVNLMRVRAFGEFEFWFAFIKVAVLVVFLIIGSLLVLGLLPNHDFVGLSNVRAEGFAPTGLGGIAAALLAVAFGFGGIEVVAIASAESEDPQKSLVNAVRTTITRISIFYLGSVAIIVLLLPYSSLGKAKSAAESPFSQVLAMANIPGVVGVIEVVIVLALLSAFNAQIYASSRMMMSLAERRQAPNIFARVDNRGVPLPAIVLSVVLSVIMVILNYVDTGWLLTFLLNAAGASLLTVWTFIAVSQLKLRRRLEALQGNLAVRMWAFPGLTIATLAILFGLAILMLSDAGARIELLSAIAMVAILFAISLIAVKQPFDKALLPREASYPQNSPS

SEQ ID NO: 844 - protein, 287 aa, Ashbya gossypii
MDYKFEALVTALVLAVSFIFIYGKFSGAKQSQPAVKTTLNKDWQEFSLLTKTVLTHNTAIYRFGLPEADAVLGLPIGQHISISGVIDGKEMLRSYTPTSLDSDATGYFELLVKSYEKGNISKMLAELAIGDRIKVRGPKGFYHYEPNMYKEIGMIAGGTGISPMYQIIRAIFSNPRDKTRVCLVYGNQTKDDILLKPELDAMVAAKPDQFKILYMLDKVAEGEQWEGKLGYITEAIMREHLPAPSSSAQLLLCGPPPMVSSAKRIAVSLGFEKAKPISKKGDQVFAF

SEQ ID NO: 845 - protein, 454 aa, Corynebacterium diphtheriae
MTQATTETELGTGLKTRHLTMMGLGSAIGAGLFLGTGVGIAAAGPAVLIAYVLAGIFVVFVMQMLGELAAARPASGSFSVYAEQAFGHWAGFSLGWLYWFMLTMVLGAEMTGAAAIMGQWFGIAPWIPALICVIFFAVVNLARVSGFGEFEFWFAFIKVAVIILFLVIGVLLIFGLLPNYDFVGTQHFLGDGFMPNGISGVATGLLAVAFAFGGIEIVTIAAAESEDPKTAIATAVRSVIWRISLFYLGSVLVICFLIPFSSIGGAKSAADSPFTIILGMANIPGVVGFMEAVIVLALLSAFNAQIYATSRIVHSFAERGDAPKIFAATNPSGVPMPAVLLSMFFAFVSVGLQYWNPAGLLNFLLNAVGGCLIVIWVIIAFAYLKLHPELVRNGEITTVRMWGFPWLGWVTIAGFLGLTVLMLTDDASRSQITSVTVVFLLLIVVSFFTKKKSK

SEQ ID NO: 846 - protein, 293 aa, Oryza sativa
MATHRSKPLAPARAAEWAAACLDGVRQLLAVVFKCCDLELKQPRGLEDPQVLARETVFSVSEVEALYELFKKISSAVIDDGLINKEEFQLALFKTSKKESLFADRKNSCMIDVSADFAFISVLPHVLNILPALTGFDEFARALSVFHPSAPLDEKIDFSFQLYDLKQQGYIERQEVKQMVVATLAESGMNLSDEIIESIIDKTFEEADTKHDGRIDKEEWRNLVLRHPSLLKNMTLQYLKSMTPEFLDLFELKPSEECSCRFIKNFDIGLLDWAETPELCRMLHVRFEKFSNL

SEQ ID NO: 847 - protein, 487 aa, Escherichia coli
MKPSTEWWRYLAPLAVIAIIALIPVPAGLESHTWLYFAVFTGVIVGLILEPVPGAVVAMVGISIIAILSPWLLFSPEQLAQPGFKFTAKSLSWAVSGFSNSVIWLIFAAFMFGTGYEKTGLGRRIALILVKKMGHRTLFLGYAVMFSELILAPVTPSNSARGAGIIYPIIRNLPPLYQSQPNDSSSRSIGSYIMWMGIVADCVTSAIFLTAMAPNLLLIGLMKSASHATLSWGDWFLGMLPLSILLVLLVPWLAYVLYPPVLKSGDQVPRWAETELQAMGPLCSREKRMLGLMVGALVLWIFGGDYIDAAMVGYSVVALMLLLRIISWDDIVSNKAAWNVFFWLASLITLATGLNNTGFISWFGKLLAGSLSGYSPTMVMVALIVVFYLLRYFFASATAYTSALAPMMIAAALAMPEIPLPVFCLMVGAAIGLGSILTPYATGPSPIYYGSGYLPTADYWRLGAIFGLIFLVLLVITGLLWMPVVLL

SEQ ID NO: 848 - protein, 568 aa, Arabidopsis thaliana
MASLAQQFSGLRCSPLSSSSRLSRRASKNFPQNKSASVSPTIVAAVAMSSGQTKERLELKKMFEDAYERCRTSPMEGVAFTVDDFAAAIEQYDFNSEIGTRVKGTVFKTDANGALVDISAKSSAYLSVEQACIHRIKHVEEAGIVPGMVEEFVIIGENESDDSLLLSLRNIQYELAWERCRQLQAEDVIVKAKVIGANKGGLVALVEGLRGFVPFSQISSKAAAEELLEKEIPLKFVEVDEEQTKLVLSNRKAVADSQAQLGIGSVVLGVVQSLKPYGAFIDIGGINGLLHVSQISHDRVSDIATVLQPGDTLKVMILSHDRDRGRVSLSTKKLEPTPGDMIRNPKLVFEKAEEMAQTFRQRIAQAEAMARADMLRFQPESGLTLSSDGILGPLGSELPDDGVDLTNRCLDKVCLAAVVSKCDWVYPILSVIEAGEVRRNCNILSKEAGIRWDFDTSFKITRERDRTMRVVLGMDIFRLIEYMEDQIGFWLIKNPRNVLEDGVIKYLKQGINVKHQIRFRTVFNNFDILKNEVVLGGGDSELEIQMEVSIPARIPSFSHKVIVSHKFD

SEQ ID NO: 849 - protein, 387 aa, Clostridium perfringens
MAKRDYYEVLGLQKGASDDEIKRAFRKMAMKYHPDRNPGDKEAEENFKEVNEAYDVLKDPDKKAKYDQFGHAAFDGSGGFGGGGFGGFDAGGFDFSEMGGFGDIFESFFGGGFGGGSSRRRNAPQRGADLEYRLNITFEEAVFGCEKEISITRTENCETCHGTGAKAGTSPKTCPKCNGSGQIRVQRQTPLGSFVSTTTCDQCGGTGKVIEDPCPDCKGKGTVRKNRKITVKIPAGVDTGNIIPLRGQGEQGANNGPAGDLYIRVNVAPSKIFRREGSDIYYDYKISMAKAALGAEITVPTVDGNVKYKVPAGTQPGTKFRLKGKGVPHVNGGGRGNQYVHMVVEVPKHLNKEQEEALKAFMKASGESVDDIDEKDEGFFSKFKKKK

SEQ ID NO: 850 - protein, 287 aa, Unknown
  Synechococcus sp. RS9916
MSSAAQPNGGWIDEHHNGVRYGLEGRVLVEETSSFQRITVIESERYGNGLLLDGCWMTAERQERHYHESLVHPALCSAASIERVLVIGGGDGGTARECLRHAGVQHLDMVEIDGRVVELSQQHLPSIGGGCWSDPRFHLHVGDGIAWAAEAADGSYDVVLVDGSDPAGPAEGLFNRAFFNHCKRILKPGGVFATQSESPEAFRQVHLDTVKLIRELFGHADPLYGWVPMYPSGWWSWTFAASDGPRYRQPLPERAAAIASGCEIWSPRWQRGAFDAVPAFMDRELNG

SEQ ID NO: 851 - protein, 721 aa, Unknown
  Synechococcus sp. RS9916
MQGQTQSISFDGREIRLTTGRYAPQAGGSVMIECGDTSVLVTATRSSGREGIDFLPLICDYEERLYAAGRIPGSFMRREGRPPERATLISRLIDRPMRPLFPNWLRDDLQIVATCMSLDERVPADVLAVTGASLATLMAGIPFQGPMAAVRVGLLGDDFVLNPSYREIERGDLDLVVAGTPEGVVMVEAGANQLPEQDVIEAIDFGYEAVCELIKAQQAILKEAGIEQVIPTTPEVDATLPTYLEKNCTKAIGEVLKQFDQTKGERDDKLDAIRTSTAETIQGLKDDDPVRVAVSTNGKALPNSFKALTKKLMRQQIVKDGKRVDGRALDEVRTISAAAGVLPKRVHGSGLFQRGLTQVLSTATLGTPSDAQEMDDLNPSNEKTYLHHYNFPPYSVGETRPMRSPGRREIGHGALAERAIIPVLPAKDTFPYVVRVVSEVLSSNGSTSMGSVCGSTLALMDAGVPLKSPVSGAAMGLIKEGDEVRILTDIQGIEDFLGDMDFKVAGTDKGITALQMDMKITGLPVNTVADAVNQARPARLHILEKMMEAIDTPRQGLSPHAPRLLSFRIDPELIGTVIGPGGRTIKGITERTNTKIDIEDSGIVTIASHDGAAAEEAQRIIEGLTRKVNEGEVFTGSITRIIPIGAFVEILPGKEGMIHISQLSEARVEKVEDVVKVGDEVTVRVREIDNRGRINLTLRGVPQNGEEAAPEPAPTPVAPLT

SEQ ID NO: 852 - protein, 507 aa, Xanthobacter autotrophicus
MAATGPDTPNSGALSPRAPRQAGHARMEALARLPVFFGLEGRRVLVAGGGEPAAWKAELLSAAGARVEVIAPHVCEDLWRLAGAPPRGPISIHVRDWHADDIPGAVLAVAGFDEEADALNFTTAARAAGVPVNAIDKPALSDFTFGAIVNRSPLVVGISTDGAAPVFGQAVRAKIEALLPSGFKAWALAAKTWRQAVTARGLSHHARRAFWERFAATALAEPNRAPQDTDRAALFTAIEAEGTPHRSGHAGSVVLVGAGPGDPELLTLKAVRALQSADVVLYDDLVSGAILDFARREAKKMLVGKTGYGPSCKQDDINALMVDLAKEGRRVVRLKGGEPMIFGRAGEEITHCHAAGVPVEVIPGISAPQGAASRLVTSLTHRDHARRLQFVTAHARDGKLPKDLDFNALADKAATTVVYMPRRTLPDLVRNLMAAGIDPATPAVAMFSVTRPEEKVILATVATLAEEVARAAEVGAQGPCLILYGQALAEVAVDALPQIVQAAANGG

SEQ ID NO: 853 - protein, 170 aa, Oryza sativa
MAMRAITLSHSQSASFGHHHHQTMPSSFRPSTASTRSVKVYAKEDEEKGSKQSLFGSITEALDFSQVRSEKDAELLYEAREATKDGGRMTKEQYGALRRKIGGTYKDFFKSYVDVDGEYVEEGWVDKTCKVCKKDTRGEPRQVDKLGRYAHVACLENPKPTNIFAKLFAR

SEQ ID NO: 854 - protein, 107 aa, Brucella melitensis
MATVKVDNSNFQSDVLQSSEPVVVDFWAEWCGPCKTIAPALDEIAAEMAGQVKIAKVNIDENPELAAQFGVRSIPTLLMFKDGELAANMVGAAPKSRLADWIKASAA

SEQ ID NO: 855 - protein, 898 aa, 'Chlorella' ellipsoidea
MVRVSENGVVENVSLDDKFAVKKSKPSATLSAMELHGAPGACKNGELPEGNLPWEPVTEIDTKDVGTPDQWIPRHPDLIRLTGRHPLNVEPPPTTLMDRGFITPSSLHYVRNHGPVPKMTWADHKVTICGLVDKPLVLSMDEIAAMPQVTMLATLTCAGNRRKEENMVKKTIGFSWGPAGTGCSYWTGVRMSHLLKLAGVDEDREDLHVRFRGPKGELPKGKDGSYATSLPLWKCMWDGSDVIVAWKQNGRILDPDHGFPVRMIIPGHIGGRMVKWLEEIEVADSESDNHYHFMDNRVLPSHVDEALAKEEGWWFKPDFIINELNINSAITTPAHDESVPYAQNTVVKGYAYAGGQKVIRCELSVDDAKSWKLAKINRVQDTPNRGGKFWAWVHWEISVPTVELLQTKEICCRAWSSDMNTQPNSFTWNLMGMMNNCVYRVKVHPSVTNGALALRYEHPTLAGPALGGWMNRAEDKPAVEEEKVVAAAPKEGGRRYCMAEIEQHASKESAWFVRDGKVYDGTAFLKDHPGGAESILLASGMDSSDDFNAIHSAKAKRMLNDYEIGIFDDTAPMSSGSAPPPPMANGHTAAAEKLEQGELIALNPRKKQQFKLIEKAELSHNVRRFRFELQSPKHKLGLPCGKHVYIYGKVGGEPVMRAYTPTSSDDDLGIFDLVIKVYWANEHPSFPQGGKLSQWLAEQPIGAMVEAKGPTGHFHYLGRGRYKMDDKEGFTSHMSMCAGGTGITPCYQVAKAILKDPEDKTQISLIYANQTPDDILLWDELDEMAAKHDNFKVHYVVSAFAKGDTNPKTSEAGWTHSIGRMTQEMAKEHLFQATDNALALFCGPPPMITYACKPFCSAMGYTDETMVILLIDPSIPRPVSLSSLKFDWCNEAATMVQS

SEQ ID NO: 856 - protein, 497 aa, Unknown
  delta proteobacterium MLMS-1
MKCALIIPPWLPEEIFASKTAGSQINYWQPLGTLYVAAALQQAGHQVRFFNGAFMGHGEIMAAVADFAPDFIGLYSTTFGWQKAKDMAAALRAAGGDFLLAVGGPFPIAAQEQCLEESPELDVVVTGEGEETVVEILGRWQQVGAAGGAEAAAAAGPRRRLATGLELDGVLGVVWRRGAEIIKNPPRSLITDLDALPFPARELMGQAVDQYVPPPATYKRRPVAVIITSRGCNRRCLYCFQIDKSRQSGIRYRSVDNVLAEIRACLAEGYREIKFIDDTLADDYERALELARRIKQEGLDFTWFASACVNQVDEQLLRAFKEAGCWAILFGVESGVQKDLNTIRKGITIAQIRKAVAAAKKVGITVYTPFIFGIPGQTYEDGLKSIDFALELDPDIANFHALTPFPGTELWDNLEKYGTVSHDLADYTYQGAAFVPYSMTREEIAELRRIAFKRFYSRPKFLFRRLLALRSVNDLRAAWQGVKSLFWLHVGGKIFQR

SEQ ID NO: 857 - protein, 487 aa, Agrobacterium tumefaciens
MHNEHDFSAAGDRLSTFPAFFRVEGRQVAVFGNGDEAFAKVRLLANTNAHIVAYADHPEADFARYISENSIDHRALAFASPLVDDATLVFAATGDEALDREIVSVARTKKIPANAVDQPEFCDFFTPALVARAPVAIAIGTEGAGPVLAQMIRARIDQMLSPSLGKLARLAVQYRDAAEENVPKGALRRNFWRRFFSGAVADAVALGDTSSARHAADRLLQSPERSEGRVWLVGAGPGAEDLLTLRAQRVLMEADVIVYDALVPQAIVDMGRRDAERLSVGKRKGCHSKSQNDINRLLVRLGLEGKRVVRLKSGDPLVYGRAGEEMAALREAGVAYEIVPGITSAFAAAADFELPLTLRGVASSLIFTTGHDLMGDVLPDWARLAVSGATIAVYMGRSVAASVAKRLIDAGLGVETTVAVIENASRADRRLLHGTLNDLPDLEYRDELIGPVMVIIGDAVAGANFDRSEALALAAKPASLKREYVNG

SEQ ID NO: 858 - protein, 494 aa, Solibacter usitatus
MKGKVYLVGAGPGDPELITVKGRRVLQGADAVLYDHLAAAALLDLAPAHAERVYVGKKKSAHEFTQEEICAMLIERGRRGLTVVRLKGGDPFIFGRGGEEAEALADAGIAFEVVPGVTTPLGIAAYTGVPLTHREHTSAVTFVTGHAVQAIDWDKVGHAETLVIFMGLTTFPEIARELIARGRPAETPAMAVRWATRADQETVVGTLGTLTGMLAGMKPPATIVVGEVVRLREKLDWYGRLPLAGKRIVVTRAREQADALGAALSSLGAGVIELPTIEIGPAADSGPLERAIAELETYDWLIFTSANGVRFFVERLDDLRKLRSKICAIGPATRAAVEALHVKVDLMGKEYVAEGLLEAFAAHDLAGKRVLLPRAAVARDLVPVELAKRGAQVDVVEAYRTAAPAGLGARVREVFARRPDCVTFTSSSTVRNFVEAAGAGALEGVRVASIGPVTSATARELGVAVTVEARPFTVDGLVDAVLELYTEMTPPSTE

SEQ ID NO: 859 - protein, 310 aa, Arabidopsis thaliana
MMVDENVETKASTLVASVDHGFGSGSGHDHHGLSASVPLLGVNWKKRRMPRQRRSSSSFNLLSFPPPMPPISHVPTPLPARKIDPRKLRFLFQKELKNSDVSSLRRMILPKKAAEAHLPALECKEGIPIRMEDLDGFHVWTFKYRYWPNNNSRMYVLENTGDFVNAHGLQLGDFIMVYQDLYSNNYVIQARKASEEEEVDVINLEEDDVYTNLTRIENTVVNDLLLQDFNHHNNNNNNSNSNKCSYYYPVIDDVTTNTESFVYDTTALTSNDTPLDFLGGHTTTTNNYYSKFGTFDGLGSVENISLDDFY

SEQ ID NO: 860 - protein, 225 aa, Arabidopsis thaliana
MEAALSIFKLSFLLTLLSGGSDLIDSLPPNCNRAECPSYEVVHAGNGYEIHRYNTTVWISTEPIQDISLNEASGNGWNQLSDYMNGNNDYHQRIEIALPYITQVSQNLSTFIVSFFVPKAFQPDPPPGNNLHVQRWDSRYVAVKQISGYVADHKIGKQVAELKASLQGTVWAKAIEKSRETGGVRSAWAYTVAQFSWPFQWSQRVNEIWFPFEMEDEETVSIVTQ

SEQ ID NO: 861 - protein, 456 aa, Oryza sativa
MPTITHYVLDPLLETGSATQSQKAASKPPPAPPLPQEKAAEKPIPVPVAPVRRAQTASATLYATPESTSLPDSPSSFPGTWSPYLINHKRRGPCLVKTLSQGDVGSDGSQQPTLSVTLPPLPKRSQSFEAQEPEFEFQQASNGVLEGDSGVVETLDWQNGMLQKGKGTVSGEYGHDQAEFEFQHGNPDATVRPVNVGRPANGGTPRKINNDAFFELQDSLSMASNSEAEDAGGHERWWKPSSPLGTSVGTPGAEFYDAFEEISSDGATRSSQCMDDDLREMRLSLLMEIERRKQAEEALENWQKEWKKLSDHLSLIALTLPPPSLAEDTDDSSMDPGAELCQQITVSQLVAAAIARGFARAEVETDMETKIAAKNFEIARLSDRVQYYEAANREMSQRNQEAIEMSRQQRNIRKKRQKWFWGSVGLAVTLGTAAIAWSYLPAAQPQASQDSNTNSD

SEQ ID NO: 862 - protein, 256 aa, Oryza sativa
MSSSSSSSAVFPLDHLAAPSPTEQLCYVHCNCCDTILAVGVPCSSLFKTVTVRCGHCANLLSVNLRGLLLPAPAPAPANQLHFGPSLLSPTSPHGLLDEVAFQTPSLLMEQAASASLSSITGRSSSSCASNAPAMQMPPAKPVQQEPELPKNAPASANRPPEKRQRVPSAYNRFIKDEIQRIKAGNPDISHREAFSAAAKNWAHFPHIHFGLMPDQGFKKTFKPQDGSEDILLKDSLYAAAAAAAAAAANMGVTPF

SEQ ID NO: 863 - protein, 342 aa, Candida albicans
MFKRFFSYTPRTFKMATFNNSFLMNHTCLRIKDPKVSIPFYTEKFGMKLIATFPFADFTLYMLNYETEANKHLNWSAREGVLELCHNHGVENDSNYKLNNGNGEKDRGFGHICMSVDNIEAFQDQLLKSEVKFQKKLSDGRQKNIAFALDPDGYWIELIENGINKVANKTEVSSYKLNHTMIRVKDPKKSLEFYRDVLGFKLLSTSEHEGAKFTLYFLGYDHDPNFKQDTLVRNEQAKREGVIELTHNWGTESDPEFKGYHNGNSTENGALQGFGHTCVSCEDPAKFCQELEEKFGDKLDWSLKWDQGKIKKIAFIRDPDGYSIEILGHDLFADSFKEQANL

SEQ ID NO: 864 - protein, 284 aa, Francisella tularensis
MLKTKSLTPHEYDIIINKATEKPFTGRYNDLDQKSVYICRNCGTPLFRADSKFISACGWPSYDIHIDNNVKQLPDADGIRTEILCSNCDGHLGHIFHGEGYTKLNTRYCVNSACVDFIPIEDFGTTEEIIVAAGCFWGVEYYMKKLPGVLFAESGYCGGDQPYPDYKKVCQGDTGYLEVVRVIFDTSKVSLQQVLKYFFEIHDFEQVDGQGPDIGEQYKSAIFYYDDKQKQIAEDLKHILAQKGYKVATEIRAMKPYYVAEDYHLDYYMKKGTLPYCHSHKKIF

SEQ ID NO: 865 - protein, 1064 aa, Aspergillus oryzae
MAASWCALRGTRQLALRTRLRSAPSPIALRKATPSSPFRATHRALHTATQQPSRRPVYTSSVADHGDPHPRDLFQPLDTFPRRHIGPSPDAAKEMLATLDPPVASLDEFVKQVLPADILSKKDLKVTDPHAKTNLYRDNVGGGLGETDMLKLLDVYRKQIDVSGKTYIGTGYYGTIVPPVILRNVLENPAWYTSYTPYQPEISQGRLESLLNFQTLTADLTGLPFANASVLDEATAAAEAMTMSFATMPASKQKKPGKAYVVSHLCHPQTIAVMRSRAEGFGINLVIGDILADDFKLVKEQGDNLIGVLAQYPDTEGGIYDFQALSDNIHGAGGTFSVATDLMALTVLKAPGEFGADIAFGNAQRFGVPMGYGGPHAAFFACVDKYKRKVPGRVVGVSKDRLGNRALRLALQTREQHIRREKATSNICTAQALLANMSAMYAVYHGPTGLKSIAQRIMSMTSTLQAKLAALGYNVPIKTNVADGGAIFDTVTVELPTSQEADAIVAAAREQSIFLRRVNSTKVGISLDETSGRDEVKSILQVFATHASKGEVSIDGELGISPLPASLERTSEYLTHPVFNTHHSETEMLRYIRHLESKDLSLAHSMIPLGSCTMKLNATTEMIPISWPEFSQMHPFLPADVAKGYTQMIDDLEQQLADITGMAEVTVQPNSGAQGEFAGLRVIKKYLEAQGESKRNICLIPVSAHGTNPASAAMAGMKVVTIKCDTKTSNLDLEDLKAKCEKHKDELAAVMITYPSTFGVYEPGVKEACEIVHQHGGQVYMDGANMNAQIGLCSPGEIGADVCHLNLHKTFCIPHGGGGPGVGPIGVAEHLRPFLPSHPASEYLQSKRTESSSPPISAAPWGSASILPITFNYINMMGAKGLTHATKITLLNANYILSRLKEHYPILYTNENGRCAHEFILDVRKFKETCGVEAIDIAKRLQDYGFHAPTMSWPVSNTLMIEPTESESKAELDRFCDALISIRQEIAEVESGAQPREGNVLKMAPHTQRDLLSNEWNRPYTRETAAYPLPYLVEKKFWPSVTRVDDAYGDQNLFCTCGPVEETD

SEQ ID NO: 866 - protein, 570 aa, Unknown
  Nostoc sp. PCC 7120
MSQTKPRDVQVLPIGTNTTVLRSRSWTRLRFEIEYALAKGTTANSYLIQGDKLALIDPPGETFTQIYLDALQKRLDVTEINYVILGHINPNRAATLKALLEIAPQITFVCSNPGAINLRGVLENPDLPMLIMRGEETLDLGKGHNLQFIPTPNPRYADELCTYDPQTEILYTDKLFGAHICGDQVFDEGWATINEDRRYYYDCLMAPHARQVETALDKLADFPTRLYATGHGPLVRYGLIELTHAYREWSQQQTSADLTVALIYASAYGNTATLAQAIARGITKAGVAVESINCEFADPEEIRAAVEKSAGFVMGSPTLGGHAPTPVQTALGIVLSTATNNKLAGVFGSFGWSGEAVDLIESKLKDAGYRFGFDSIRVKFKPNEVTLQMCEEAGTDFAQALKKARKVRTQSVPATNVEQAVGRIVGSLCVVTAKQGEISSAMLASWVAQASFNPPGLTIAVAKDRAVETLTHTGNKFVLNVLKEGNHLGLMKHFLKPFGPAQDRFADVATAEAENGSPVLQDALAYLECSVQNRMESGDHWLVYATVENGKVLNQDGVTAVHHRKSGNHY

SEQ ID NO: 867 - protein, 555 aa, Moritella marina
MCSIFGILDIKSDIKPLREQALELSKLLRHRGPDWSGIYTSDNAILVHERLAIVDVNNGAQPLYNEEKTHVLAVNGEIYNHKDLKKTLNVDFEFQTESDCEVILALYKEKGTQFLDDLNGIFAFALYDETEDAYLIGRDHIGIIPLYTGYDEHGNFYVASEMKALVPICTQIEEFPAGHYLWSKDGVVTPYYQRDWKDFDNVAQNGGDKSVVKQGLEDAVKRQLMCDVPYGVLLSGGLDSSVISAITQQYAKRRIEDGGKTEAWWPQLHSFSVGLNGSPDLAAAQKVADHLGTIHHSIEFTVQEGIDALRDVIYHIETYDVTTIRASTPMYLMARKIKAMGIKMVLSGEGADELFGGYLYFHKAPNAKEFHEETVRKVNKLHMFDCLRANKSMAAWGIEARVPFLDKEFVDASMRLNPELKMITGDRIEKNIIREAFEDLLPEEIVWRQKEQFSDGVGYSWIDQLKVHVEEAVTDQMLASAAFKFPINTPDTKEGYYYRAIFEDHFPGDSAAKCVPFGKSVACSTVEALAWDESFQNNADPSGRAAGVHNEAYED

SEQ ID NO: 868 - protein, 122 aa, Oryza sativa
MRQARPYSAMFAGGVSARTGPHALPLARIKKIMKRSAGDSSVVDGGGGARMISGEAPVVFSKACELFIAELTRRAWAATLEGKRRTVHKEDVAAAVQNTDLFDFLVDVVMADGHDDDHTDYK

SEQ ID NO: 869 - protein, 537 aa, Gibberella zeae
MASVDEIFKSSGISGKRKLDPIRDPIQDEIYKSAKMSSSSSNRHAQVDDAQDEDEDMEAGPAPPPEEEDFGPELPPDDDEGRFFGGGITKQESEILDYVDEADAGNAPEKIDAAWLRKTALNFEKRISKNAELRAKFEDEPQKFIGSEADLDADVKGLSLLSEHPELYPEFVKTGCVASLVSLLAHENTDIAIDAIEIMGELTDEDVSAEDEQWNGLVDAMMDADLLGLLVSNFSRLDEDDESDRSGIYHALGVIENLCSRQSVAERVGEDEKLLQWLLQRIQRKEDVVSQNKQYAAEILAILSQMAVANRTQLIRLDAVDLLLQLAAPYRRRDPDKGGEEEEYMENIFASLTCLADEAAGKSKFIDAEGVELCLIMLKEGKKSKPPSLRLLNHAAGGNSGVEVCQKIVEAGGLKTLFTLFMKTQDHRLAEHLVEIFASMLRLLPANSAERIRTLAKFVEKDYAKITKLIKFRRDYVARLSLAEQKNDAEKATTSADDRETAELEWLSRRIDAGLCTLQTIDAVLAWYSLSGTKRYH

SEQ ID NO: 870 - protein, 574 aa, Unknown
  Nostoc sp. PCC 7120
MVALTEKTEKRLTIQTADIAQDTTAIRSLDWERDRFDIEFGLQNGTTYNSFLIRGEQIALVDTSHEKFRQLYFDTLTGLINPTEINYLIISHTEPDHSGLVKDLLQMAPEITVVGSKVAIQFLEDLVHQPFKRKIVKNGDRLDLGNGHEFEFVIAPNLHWPDTIFSFDHKTQTLYTCDAFGMHYCSDIVFDEDLKTIEPDFHYYYDCLMGPNARSVLSALKRMGELPSVKMIATGHGPLLYHNVEELTGRYRTWSQNQTKAETSIGVFYVSEYGYSDRLAQAIINGITKTGVGVDVVDLGAAVDLQELRELVGRCTGLVIGMSPAASAASIQGALSTILGSVNEKQAVGIFETGGGDDEPIDPLLSKFRNLGLTTAFPAIRIKQTPTENTYKLCEEAGTDLGQWVTRDRSIKAMKSLGADLDKALGRLSGGLYIITAKKGDVSSAMLASWVNQASFKPLGFSIAVAKDRAIESLMQVGDRFVLNVLEEGNYQPLMRHFLKRFAPGADRFEGVKTQPAENGAPILGDALAYMECEVVSRMDCGDHWAVYSTVYAGRVSKSEALTAVHHRKVGNHY

SEQ ID NO: 871 - protein, 139 aa, Pennisetum glaucum
  misc_feature (84)..(84): Xaa can be any naturally occurring amino acid
KKHVMSERKRREKLNEMFLVLKSLVPSIHKVDKASILAETIAYLNELQRRVQELESSREPMMLRQSETRKVTRRHDDDEDVGNXSGSKRKASELGSGVEREHPTKDDTSNVTVTISNKEVLLEVQCRWEELMMTSVFDA

SEQ ID NO: 872 - protein, 181 aa, Triticum aestivum
  misc_feature (150)..(150): Xaa can be any naturally occurring amino acid
MSSTGASGPDADAAAGEGLELAQFGAGCFWSVELAYQRLPGVARTEVGYSQGHLDGPTYRDVCGGGTGHAEVVRVHYDPKECPYAVLLDVFWAKHNPTTLNKQGNDVGTQYRSGIYYYTAEQERQARESLAEKQREWKEKIVTEVLPARXFYAAEDYHQQYLEKGGQSAKKRCSDPIRCYG

SEQ ID NO: 873 - protein, 139 aa, Pennisetum glaucum
KKHVMSERKRREKLNEMFLVLKSLVPSIHKVDKASILAETIAYLKELQRRVQELESSREPMISRPSETRKVTRRHDDDEDVGNGSGSKRKASELGSGVEREHPTKDDTTNVTVTISNKEVLLEVQCRWEELMMTRVFDA

SEQ ID NO: 874 - protein, 176 aa, Kluyveromyces lactis
MKFVKNKSYIQSAIFVVNYLIHYIVSYYSCCTHNQHKPNTMARTKQTARKSTGGKAPRKQLASKAARKSAPSTGGVKKPHRYKPGTVALREIRRFQKSTELLIRKLPFQRLVREIAQDFKTDLRFQSSAIGALQESVEAYLVSLFEDTNLAAIHAKRVTIQKKDIKLARRLRGERS

SEQ ID NO: 875 - protein, 139 aa, Pennisetum glaucum
KKHVMSERKRREKLNEMFLALKSLVPSIHKVDKASILAETIAYLKELQRRVQELESSREPMISRPSETRKVTRRHDDDEPVTKGSGSKRKGSELGSGVAREHPTKDDTTNVTVTISNKEVLVEVQCRWKELMMTRVFDA

SEQ ID NO: 876 - protein, 427 aa, Corynebacterium diphtheriae
MFLCLIVGKPARGAEILDRLGFVRSKQNVLAIVLAGGEGKRLFPLTEDRAKPAVPFGGTYRLIDFVLSNLVNAGYLKICVLTQYKSHSLDRHISQAWQFSGPTSQYIASVPAQQRLGKRWYMGSADAILQSLNLVYDERPDYVLVFGADHVYRMDPEQMVADHIASGKAVTVAGIRVPRSEASAFGCIQADENNNITEFLEKPADPPGTPDDPSMTFASMGNYVFSTDALIQALKEDENNPDSEHDMGGDIIPYFVSMGQANVYDFNKNVVPGSTDRDRAYWRDVGTVDAFYEAHMDLISVHPVFNLYNQQWPIRSTERGDLPPAKFVQGGIAQASMVAQGSIVSGSTVRNSVVSTDVVVEEGATVEGSVIMPGARIGKGAVVRHCILDKNVVVSDGQVIGVDRERDEQRFQISPGGVVVVGKNFVV

SEQ ID NO: 877 - protein, 145 aa, Pennisetum glaucum
KKHVMSERKRREKLNEMFLVLKSLAPSIHRMDKVSILAQTIAYLKDLQRRVQELEYSREPIISRPSETTKVARRHDDDEAVTRKVCAAGTKRKDSELSSDVEREHPWEISKDGASNVTVTVADKEVLVDVQCRWEELMMTRVFDA

SEQ ID NO: 878 - protein, 173 aa, Oryza sativa
MSRSVEPLVVGRVIGEVLDTFNPCMKMIVTYNSNKLVFNGHELYPSAVVSKPRVEVQGGDLRSFFTLVMTDPDVPGPSDPYLREHLHWIVTDIPGTTDASFGREVISYESPKPNIGIHRFIFVLFKQKRRQTVIVPSFRDHFNTRRFAEENDLGLPVAAVYFNAQRETAARRR

SEQ ID NO: 879 - protein, 523 aa, Triticum aestivum
  misc_feature (426)..(426): Xaa can be any naturally occurring amino acid
MARGGGNGEVELSVGVGGGGAGAGGADAPAVDISLGRLILAGMVAGGVQYGWALQLSLLTPYVQTLGLSHALTSFMWLCGPIAGLVVQPCVGLYSDKCTSRWGRRRPFILTGCILICIAVVVVGFSADIGAALGDSKEECSLYHGPRWHAAIVYVLGFWLLDFSNNTVQGPARALMADLSAQHGPSAANSIFCSWMALGNILGYSSGSTNNWHKWFPFLRTRACCEACANLKGAFLVAVLFLAFCLVITVIFAKEIPYKAIAPLPTKANGQVEVEPTGPLAVFKGFKNLPPGMPSVLLVTGLTWLSWFPFILYDTDWMGREIYHGDPKGTPDEANAFQAGVRAGAFGLLLNSVVLGFSSFLIEPLCKRLGPRVVWVSSNFLVCLSMAAICIISWWATQDLHGYIQHAITASKEIKIVSLALFAFLXGIPLAILYSVPFAVTAQLAANRGGGQGLCTGVLNIAIVIPQVIIAVGAGPWDELFGKGNIPAFGVASAFALIGGIVGIFLLPKISRRQFRAVSGGGH

SEQ ID NO: 880 - protein, 290 aa, Campylobacter jejuni
MKIALIQQKFHLNKEQTIKKTCEFIEEASKQGAELVCLGELHQSEYFCQSENVDFFDYANDYEKDVKFWANIARKNQIVLIASLFEKRSAGLYHNTAVVFEKDGSIAGKYRKMHIPDDPCFYEKFYFTPGDLGFEPINTSLGKLGVLICWDQWYPEAARIMALKGAEILIYPTAIGWFDKDKDEEKQRQLNAWLGVQKGHAIANGLYVVAINRVGFEKDVSGVEEGIRFWGNSFVFGPQGEELCLLDSQNECVKIIEIDKKRSENVRRWWPFLRDRRIEYFTDLTKRFID

SEQ ID NO: 881 - protein, 1132 aa, Xylella fastidiosa
MKRMLINATQAEELRVAIVDGQSLYDIDIEQPSKEQKKSNIYKGRITRLEPSLEAAFVDYGTDRHGFLPLKEISKDYFQAGLDHHKAGIRELLREGQEIVVQVDKEERGNKGAALTTFISLAGRYMVLMPNSPSAGGVSRRIEGEDRAALKEALEKLNIPNDMGVIIRTAGVGRDTQELQWDLDFLLHAWRAIAEAALSKPAPLLIYQESRLIIRALRDYFRADIGEILVDTEEMYQDAHEFMRHVMPQSLRKLKYYKDDIPLFNRFQIESQIEGAYERNVRLPSGGSIVVDQTEALTAIDVNSSRATKGNDIEETAFQTNLEAADEIARQLRLRDVGGLVVIDFIDMSSSKHQREIETRLQNCLKYDRARVQLSRISRFGLLEMSRQRLRPSLGESSQIVCPYCDGHGRMRSIESLSLSIIRIVEEHAMKENTGQVLVQTPVEIANYLLNEKRRAINEIEKRHDAPIIIIADEQLHTPHYEVTRLRENELSEETGKPSYQRNTPRKLPVHALTKSQLNIPPAPAVKSITPPQLAPTQENIPTIREQSAENRAHPIPELVSSLASWLKRIFGNTDKRQTASNSSHPAPLQQNRNGNVQRNERNRRDGQIATSNTQPQQQSSSHRDNYRHNESNNYPQIQNQCTADTNGKLRNESQTQKSSAYVSKLPQMPRQPQPQLPKTPRTQSQPTQNSTKTILDKQPAPVLYGEDNTLQKAKPIPLTAEAVLTNIPAPSMTATPSGKDQNALPTTSNVTQDTSNALIEAKSTTKTNIDTNTDIEPQQNNHEGTGNNDGSNRRRRGRRGGRRRRRNTSLGNETNAVSESNSIKLSNDTETDNADNIESPQALRPAMQENKRQPEFEFDDLAPAAPITAPLRKTIAAEREGISADLTTTSPQSIMETASRTHIASQMAPQSETSAASTTPNASVQATKTHTHKDVVSDSPSRTPYKAHSNTTRHSSGRRLETLSTAHPSAKAPPSEHITPTSRSNANAKTTKIEIPNKQTNANSYTAARPTATDVLVVTNQPVIATKPSTTIEKAQTKVIPSTTYNNEHIETKRKIVTTESETTQPPVRKQRLPMQNPLPKVVAPLEDKKQAPFVENTTQRNINNATTTSQNDKSLGFTKNNEGNSDNNTL

SEQ ID NO: 882 - protein, 698 aa, Zea mays
  misc_feature (404)..(404): Xaa can be any naturally occurring amino acid
MGYGGPHAAFLATSQEYKRLMPGRIIGVSVDSTGRPALRMAMQTREQHIRRDKATSNICTAQALLANMAAMYAVYHGPAGLKAIADRVHGLAGTFAHGLKKLGTVPVQNLPFFDTVRVTCSDARAIAKEAVKNEMNLRVVDANTITVAFDETSTLEDVDKLFKVFNNGKSASFTAESIAPEVSSSIPSSLARESPYLTHPVFNMYHTEHELLRYLHKLQSKDLSLCHSMIPLGSCTMKLNATVEMIPVTFPNFANLHPFAPTDQAAGYHEMFDDLGNLLCTITGFDSFSLQPNAGAAGEYAGLMVIRAYHNSRGDHHRDVCIIPVSAHGTNPASAAMVGMKIVAVGTDAKGNINIEELRKAAEANKDNLAALMVTYPSTHGVYEEGIDEICKIIHENGGQVYMXGANMNAQVGLTSPGFIGADVCHLNLHKTFCIPHGGGGPGMGPIGVKKHLAPFLPSHPVIPTGGFPLPEKTDPLGTISAAPWGSALILPISYTYIAMMGSQGLTDASKIAILNANYMAKRLEKHYPVLFRGVNGTVAHEFIIDLRAFKTTAGIEPEDVAKRLMDYGFHAPTMSWPVPGTLMIEPTESESKAELDRFCDALISIREEIAEIESGKADVLNNVLKGAPHPPQLLMGDTWSKPYSREYAAFPAAWLRGAKFWPTTGRVDNVYGDRNLICTLQQATQVAEEAAAATATA

SEQ ID NO: 883 - protein, 149 aa, Arabidopsis thaliana
  misc_feature (43)..(43): Xaa can be any naturally occurring amino acid
PKSSSAVVTPHLSPSIVISLSPGLSLGVGRFVFFGPHRERVAXQGFPEQFGQAPFEAGDERAKECVSLLGWFDPPGFFIPPPRAWGSPGHVVAFFLRPRPAMVLFPSPPACLVSMSISRPRLCPCPPMWGGGGNLFSISVSSSDAVGGV

SEQ ID NO: 884 - protein, 456 aa, Pythium irregulare
MGTDQGKTFTWQEVAKHNTAKSAWVIIRGEVYDVTEWADKHPGGSELIVLHSGRECTDTFYSYHPFSNRADKILAKYKIGKLVGGYEFPVFKPDSGFYKECSERVAEYFKTNNLDPKAAFAGLWRMVFVFAVAALAYMGMNELIPGNVYAQYAWGVVFGVFQALPLLHVMHDSSHAACSSSPAMWQIIGRGVMDWFAGASMVSWLNQHVVGHHIYTNVAGADPDLPVDFESDVRRIVHRQVLLPIYKFQHIYLPPLYGVLGLKFRIQDVFETFVSLTNGPVRVNPHPVSDWVQMIFAKAFWTFYRIYIPLVWLKITPSTFWGVFFLAEFTTGWYLAFNFQVSHVSTECEYPCGDAPSAEVGDEWAISQVKSSVDYAHGSPLAAFLCGALNYQVTHHLYPGISQYHYPAIAPIIIDVCKKYNIKYTVLPTFTEALLAHFKHLKNMGELGKPVEIHMG

SEQ ID NO: 885 - protein, 321 aa, Hevea brasiliensis
QVGVCYGMQGNNLPPVSEVIALYKQSNIKRMRIYDPNRAVLEALRGSNIELILGVPNSDLQSLTNPSNANSWVQKNVRGFWSSVLFRYIAVGNEISPVNGGTAWLAQFVLPAMRNIHDAIRSAGLQDQIKVSTAIDLTLVGNSYPPSAGAFRDDVRSYLDPIIGFLSSIRSPLLANIYPYFTYAGNPRDISLPYALFTSPSVVVWDGQRGYKNLFDATLDALYSALERASGGSLEVVVSESGWPSAGAFAATFDNGRTYLSNLIQHVKGGTPKRPNRAIETYLFAMFDENKKQPEVEKHFGLFFPDKRPKYNLNFGAEKNW

SEQ ID NO: 886 - protein, 370 aa, Prochlorococcus marinus
MVYSQAKVIAGGLAHIPIVISVFYLIMTFFNKRAIKFEEANKSKKTEAKVVESKSESKSLDAAKVASQKPLKKKHADVPVNIYRPKTPFEGTVTGNYSLLKEGAIGRVNHITFDLKESDPFLNYIEGQSIGIMPEGEDANGKPHKLRLYSIASTRHGDDFEGNTVSLCVRQLQYEKDGETINGVCSSYLCDIKPGAKVKITGPVGKEMLLPDEEDANIVMLATGTGIAPMRAYLRRMFEATEKEKNKWNFKGKAWLFMGAPKSANLLYEEDLQRYLETYPDNFKYTKAISREQQNTKGGRMYIQDRVLESANEIFNMIEDEKTHIYLCGLKGMEPGIDEAMTKAAEEKGLNWSELRPQLKKAGRWHVETY

SEQ ID NO: 887 - protein, 134 aa, Phyllostachys acuta
KKHVMSERRRREKLNEMFLILKSLVPSIHKVDKASILAETIAYLKELEQRVEELESNREPSRPSETRGRRRHEIAGISGAKRKASSEPGGRDVERERLWALSMDGPSNVNVTVMDKEVLLEVQCGWKEMLMTRV

SEQ ID NO: 888 - protein, 146 aa, Tripsacum australe
KKHVMSERKRREKLNEMFLVLKSLLPSIHRGEQASILAETIAYLKELQRRVQELGSSREPASGPSETTTRLITRPSRGNNESVRKEVCAGSKRKSPELGRDDVERPPVLTMDAGTSNVTVTVSDKDVLLEVQCRWEELLMTRVFDA

SEQ ID NO: 889 - protein, 149 aa, Oryza sativa
MASSMLSSAAVVTSPAQATMVAPFTGLKSSAAFPVTRKTNKDITSIASNGGRVSCMKVWPPIGKKKFETLSYLPDLSDVELAKEVDYLLRNKWIPCVEFELEHGFVYREHGNTPGYYEGRYWTMWKLPLFGCTDSAQVLKEVEECKKEY

SEQ ID NO: 890 - protein, 175 aa, Unknown
  Photobacterium sp. SKA34
MKHTIEVMISEQEVQERVKELGKQITECYKDSKDLVMVGLLRGSFVFMADLARAIDLPHEVDFMTASSYGNTMESNRDVRILKDLDDDIKGKDVLLVEDIIDTGNTLNKVCEILSLREPNSIRICTLLDKPERREVDVKVDWYGFVIPDEFVVGVGIDYAQKYRHLPFIGKVVPE

SEQ ID NO: 891 - protein, 378 aa, Prochlorococcus marinus
MADYYDLLGVSKDADGDTLKRAYRRLARQYHPDINKDPGAEDRFKEIGRAYEVLSDPQTRGRYDQFGEAGLGGAAGMPDVGDMGGFADLFETFFSGFGGAGGSGGARPRRRGPQQGDDLRYDLKIDFEQAVFGQEREIKIPHLETCDTCNGTGAKVGSGPTTCSTCGGVGQVRRATRTPFGSFTQVAECPSCEGTGQVIADPCPACAGQGVRQVRKKLRINIPAGVDTGTRLRVAGEGNAGLRGGPSGDLYVFLTVKSHPQLRRDGITVLSEVNVSYLQAILGDIIEVDTVDGNTSLEIPAGTQPNAVLTLENKGIPKLGNPVARGNQRISINVKLPIRLSDEERGLLEELAGHHSAKGRQHHHHNSGLFARLFGQKG

SEQ ID NO: 892 - protein, 159 aa, Glycine max
SISSSTPPYDLNAFKFSPIKESIVSREMTRRYMTDMITYADTDVVIVGAGSAGLSCAYELSKDPSISIAIIEQSVSPGGGAWLGGQLFSAMVVRKPAHLFLDELNIEYDEQEDYVVIKHAALFTSTVMSRLLARPNVKLFNAVAVEDLIVKEDRVAGVV

SEQ ID NO: 893 - protein, 377 aa, Porphyra purpurea
MAFVSTASPAVVGRSPSPALCGARSTFATGAPVVAPSAPRAVAAGMSAAMMSAAAMNKKAPVADATGLIGNTPLVQLHKIPDAAGCVANIFAKLESMEPCSSVKDRIGRGMIMDAEAAGKITPGKTVLVEPTSGNTGIALAFIAASKGYKLILTMPDSMSIERRMVLRAFGAEVVLTPAAGGMKTAVSKAEAIAAETPDSYILQQFANPSNPKAHYETTGPEIANAIDCDVFVSGVGTGGTITGAGRYLKEKNPETRVVAVEPVESPVLSGGKPGPHKIQGIGAGFVPAILDTTVYDEVVTVTSAESITMARRIALEEGLLSGISTGAALAAALEVGKRPEMQGKNIVFIAPSFGERYLTSALFDEQREEAYAMKAE

SEQ ID NO: 894 - protein, 472 aa, Staphylococcus epidermidis
MPHIIFLTFLYVGGKKLETIKKNEVKTGKVIDLTHEGHGVVKVDRYPIFIPNALIDEEIKFKLIKVKKNFAIGKLIEVISESDDRVTPPCIYYAKCGGCQLQHMTYRAQLDMKREQVVNLFHRKGPFENTVIKETIGMVNPWRYRNKSQIPVGQSNSNQVIMGFYRQRSHDIIDMDSCLIQDRQHQEVMNRVKYWLNELNISIYNEKTKTGLIRHLVVRTGYHTDEMMVIFVTNGATFKQSELLVNKLKKEFPNITSIKQNINNSHSNVIMGRQSMTLYGKDKIEDQLSEVTYHISDLSFYQINSSQTEKLYQQALNYAQLTGKEIVLDTYCGIGTIGLYMAPLAKHVYGVEVVPQAIKDAEDNATKNQLKNTTFECGKAEDVILTWKSQGIKPDVVMVDPPRKGCDETFLTTLLKLNPKRIVYISCNPSTQQRDAQILAEQYELVEITPVDMFPQTTHIETVALFVRKEEE

SEQ ID NO: 895 - protein, 316 aa, Staphylococcus epidermidis
MRKRARIIYNPTSGKELFKRVLPDALIKLEKAGYETSAYATEKIGDATFEAERALESEYDLLIAAGGDGTLNEVVNGIAEQPNRPKLGVIPMGTVNDFGRALHLPSDIMGAIDVIIDGHTTKVDIGKMNNRYFINLAAGGKLTQVSYETPSKLKSIVGPFAYYIKGFEMLPQMKAVDVRIEYDDNIFQGEALLFLLGLTNSMAGFEKLVPDAKLDDGYFTLIIVEKANLAELGHIMTLASRGEHTKHPKVIYAKAKSINISSFTDMQLNVDGEYGGKLPANFLNLEQHIEIFTPKDVFNEELLENDTITDITPDKQ

SEQ ID NO: 896 - protein, 175 aa, Unknown
  uncultured archaeon GZfos9D1
MGKKPARKYTKVTGHAYVRKKYMGGIPGSKIALFDMGNLSMGMDFPVALSLVAKEACQIRHNALEAARIFANRYLVKEVGRNNFYLKIRPYPHHVLRENKIASGAGADRVSSGMRHAFGKAVSSAARVKPGQRILSVGIEAQNFDDAKEALRRASYKLPTPCRFIIDKGEELLGV

SEQ ID NO: 897 - protein, 607 aa, Glycine max
MDTNIGSLSLDACKPANNDVGCPPNGAVSAIKPSVPATTMTSSDATLGRHLARRLVQVGVTDVFSVPGDFNLTLLDHLIAEPQLKNIGCCNELNAGYAADGYARCRGVGACVVTFTVGGLSVINAIAGAYSENLPLICIVGGPNTNDFGTNRILHHTIGLSDFSQELRCFQTVTCYQAVVNNIEDAHELIDTAISTCLKESKPVYISISCNLPGIPHPTFSREPVPFSLSPRLSNKMGLEAAVEAAAEFLNKAVKPVMVGGPKLRVANACDAFVELADACGYPFAVMPSAKGLVPEHKPHFIGTFWGAVSTAFCAEIVESADAYLFAGPIFNDYSSVGYSLLLKKEKAIIVQPERVVISNGPAFGCVLMKDFLRELAKRLKHNNTAYENYSRIFVPEGKPVKAEPREPLRVNVLFKHIQDMLSGETAVIAETGDSWFNCQKLKLPKGCGYEFQMQYGSIGWSVGATLGYAQAVPEKRVISCIGDGSFQVTAQDVSTMLRNEQKTIIFLINNGGYTIEVEIHDGPYNVIKNWNYTGLVDAIHNGEGKCWTTKVTCEEELVEAIQTATGDKKDCLCFIEVIVHKDDTSKELLEWGSRVCAANGRPPNPQ

SEQ ID NO: 898 - protein, 482 aa, Aspergillus niger
MASEQPEAGSLADRITKPEEPAPAEAPEQTEDIPQTDGAAAQQGGSDLHEPDYTVEVKLSDLQADPNNPLFSVKNFEDLGLDPRILQGLSAMNFRKPSKIQERALPLLLGNPAKNLVGQSQSGTGKTAAFVLNILSRLDLSSEQLQKTPQALILAPTRELARQIVGVIQVMGQFLDGLVIGTAVPADTGARPAKMECSVVVGTPGTVMDMIKRRIMIANKLRVLVLDEADNMLDQQGLGDQCIRVKALLPRDIQVVLFSATFPAHVHEYASKFAPQANEITLQHEELTVEGIKQLYLDCSNDEDKYQTLVNLYGLLTVGSSIIFVKTRASAQEIEKRMVAEGHTVASLTGGIEGSQRDAVIDQFRAGHAKVLITTNVLARGIDVSTVSMVINYDIPEIHQPGARQRQADFQTYLHRIGRTGRFGRVGVSISFVSNREEWEMLNQIQRYFNTNIQRIDTKDWDEVEEIIKKTIKSSRAQLGFR

SEQ ID NO: 899 - protein, 483 aa, Medicago truncatula
MDSKSVYWAIIVAWLTLFQGSMILVQGQFNYKEALTKSLIFLEAQRSGKLPPNNRVPWRGDSAVDDGKLANVDLSGGYYDAGDNVKYGLPMAFTVTTLSWAAIFYKTEFEATKEMGNIQDAIKWGTDYFLKASSRRNKLYVEVGDPEEDHHCWAPPEKMKTKRSVKVIDSNTPGSEIASETAAAMASSSIVFRHTDRKYARRLLNKAKLLFDLAKSHKGTYDGECPFYCSYSGYNDELVWAATWLYMATKKSLYMKYIQEESISANVAEFSWDLKYAGVQVLLTQLHFEGQKGLETFKSHGESYICSVLPDSPYHQIHLSPGGFIHMRDGANTQYATSTSFLFTVYSDLLAKYKQKVKCGNKEFDSSHVLDFAKKQMDYILGKNPEGRSYMVGFGKNPPTQAHHRGASVPKLSPNEDINCPMSFSKWLKRDGPNPHELTGAIVGGPDINDKFDDNRTDSPKTEPCTYVNSLAAGALAKLASLG

SEQ ID NO: 900 - protein, 202 aa, Brucella melitensis
MTAESTRKASIERSTKETSIAVSVDLDGVGKFDITTGVGFFDHMLEQLSRHSLIDMRVMAKGDLHIDDHHTVEDTGIALGQAVAKALGERRGIVRYASLDLAMDDTLTGAAVDVSGRAFLVWNVNFTTAKIGTFDTELVREFFQAFAMNAGITLHINNHYGANNHHIAESTFKAVARVLRAALETDPRQKDAIPSTKGSLKG

SEQ ID NO: 901 - protein, 378 aa, Unknown
  Mycobacterium sp. MCS
MTSDIDEVRQIEADAAPTRFARGWHCLGLTRDFGDGKPHTVNAFGQKLVVFRSGDGRINVLDGYCRHMGGDLSQGEVKGNEIACPFHDWRWGGDGRCKQVPYSKRAPRLARTATWTTLEQDGMLFVWNDPERKPPPDDVTIPRIEGATSDEWTDWHWYTTVVDTNCREVIDNVVDMAHFFYIHGSLPTHFKNIFEGHVATQYMNSAGRADLQPPEGPRMLGTTSVASYHGPSFMIDDLTYHYEEADHHTVLINCHYPIDANSFVLQYGIIVKKSEALPDDLAVQTAVSLGDFVKMGFEQDVEIWKNKARIDNPLLCEEDGPVYQLRRWYEQFYVDIADVTPDMVDRFEYEVDTTRPREEWMKIVEANISARASATSAG

SEQ ID NO: 902 - protein, 461 aa, Arabidopsis thaliana
MEVFRLGELRHLLVTVFLSGLAEYLIRPVMTDVTVAAVCSGLDDSCSLAVYLTGVQQVTVGMGTMVMMPVIGNLSDRYGIKAMLTLPMCLSVLPPAILGYRRDTNFFYAFYVIKTLFDMVCQGTIDCLANAYVAKNVHGTKRISMFGILAGVSSISGVCASLSARFLSIASTFQVAAISLFIGLVYMRVFLKERLQDADDDDEADSGGCRSHQEVHNGGDLKMLTEPILRDAPTKTHVFNSKYSSWKDMVSLINNSTILIQALVVTFFATFSESGRGSALMYFLKARFGFNKNDFAELFLLVTIIGSISQLFILPTLSSTIGERKVLSTGLLMEFFNATCLSVAWSPWVPYAMTMLVPGAMFVMPSVCGIASRQVGSSEQGKVQGCISGVRAFAQVVAPFVYSPLTALFLSENAPFYFPGFSILCIAISLMIGFLQSLLIKDHPSLPLVNITINNPSKAEA

SEQ ID NO: 903 - protein, 242 aa, Triticum aestivum
MENHQLPYTTQPPATGAAGGAPVPGVPGPPPVPHHHLLQQQQAQLQAFWAYQRQEAERASASDFKNHQLPLARIKKIMKADEDVRMISAEAPVLFAKACELFILELTIRSWLHAEENKRRTLQRNDVAAAIARTDVFDFLVDIVPREEAKEEPGSAALGFAAGGVGAAGGGPAAGLPYYYPPMGQPAAPMMPAWHVPAWEPAWQQGGADVDQGAGSFGEEGQGYTGGHGGSAGFPPGPPSSE

SEQ ID NO: 904 - protein, 424 aa, Burkholderia xenovorans
MSNPNPFFEESLATRDTAVRGAILKELERQQSQVELIASENIVSRAVLEAQGSVLTNKYAEGYPGKRYYGGCEYADVIETLALDRIKQLFNAKFANVQPHSGAQANGAVMLALVKPGDTVLGMSLDAGGHLTHGAKPAMSGKWFNAVQYGVNRDTMLIDYEQIEELAQQHKPALLIAGFSAYPRALDFARLRAIADSVGAKLMVDMAHIAGVIAAGRHQNPVEHAHVVTSTTHKTLRGPRGGFVLTNDEDIAKKINSAVFPGLQGGPLMHVIAGKAVAFGEALQPGFKTYIDSVLANAQALGEVLKAGGVDLVTGGTDNHLLLVDLRPKSLKGNQVEQALERAGITCNKNGIPFDTEKPTITSGIRLGTPAGTTRGFGMSEFREVGRLIVEVLDALRDHPEGHAATEQRVRREIFALCERFPIY

SEQ ID NO: 905 - protein, 247 aa, Anaplasma phagocytophilum
MRSSNLTTTVHFLSPVFAAFFPSHGTEQEDAPIVRVKTAKGRKISSTNWIRRQVNDQYVSLAKKEGYRSRSAYKLIEINDKFKILQRGRFVLDLGSSPGGWAQVASKNTAIIDSTEPTVVAVDIQSMKDIHNVSFVQCDIDSDHDLLNEKLSGRKFDVVLSDMAPKSCGHRQVDHANIINLCELARDIALEYLNPNGSFVTKLLHGEYEQEFRRSIMTHFGVVSYFKPKSSRKDSSEIYLVALKFKG

SEQ ID NO: 906 - protein, 242 aa, Unknown
  Acinetobacter sp. NCIMB9871
MSQKMDFDAIVIGGGFGGLYAVKKLRDELELKVQAFDKATDVAGTWYWNRYPGALTDTETHLYCYSWDKELLQSLEIKKKYVQGPDVRKYLQQVAEKHDLKKSYQFNTAVQSAHYNEADALWEVTTEYGDKYTARFLITALGLLSAPNLPNIKGINQFKGELHHTSRWPDDVSFEGKRVGVIGTGSTGVQVITAVAPLAKHLTVFQRSAQYSVPIGNDPLSEEDVKKIKDNYDKSLGWCMNS

SEQ ID NO: 907 - protein, 295 aa, Nicotiana tabacum
KGGIRYHPEVDLDEVNALAQLMTWKTAVADIPYGGAKGGIGCKPKDLSRSELEPLTRVFTPKIHELIGINTDVPAPDMGTNAQTMAWILDEYSKFHGHSPAIVTGKPIDLGGSLGREAATGRGVVYATEALLAEYGKNIKDLTFAIQGFGNVGAWAAKLIHERGGKVIAVSDITGAVKNPNGLDIPALLNHKEATGKLIDFCGGDVMNSDEVLTHECDVLIPCALGGVLNRENADNVKAKFIIEAANHPTDPEADEILSKKGIVILPDIYANAGGVTVSYFEWVQNIQGFMWDEE

SEQ ID NO: 908 - protein, 417 aa, Moritella marina
MKMNKLRREIIKAGGYVALAAAPLTAFSKEFMKYGKMYSDGEGVSYADGPKPVLSNFPQKDNVVIVHTRPPHLETPFNVFNEGLITPNNRFFVRYHLADVPVAIDTDKYTITISGAVNEEVTLSLAELKSIEGQQEIVAVQQCTGNSRGYSSPRVFGAQLSNGAMGNAKFKGVPLKNVLAKAGISSAATSVIIDGLDKPVRDTTPDFQKSLPIDHIMTGEPMLVWEMNGEPLPFLNGFPVKLIVPGWYATYWVKHVSHLKVIEGEFDNFDAFFMTTAYRLPDNDSKSELPTARAKKTLPVNRFPIRSFVTSLENGDEVNAATSIEIKGIAFDSGSGIKKVEVSVDGGNKWMQAALGENLGRFSFRGWKLSHNFNEKGRTLVMVRATGKSGETQPLNASWNHGGYNRNAIERTSIKVV

SEQ ID NO: 909 - protein, 714 aa, Burkholderia xenovorans
MTDKQLAFPIDDINRHAVALFSAGRFAEALSMVTPLLEDDALPAGARADALNIAGACCFALQRHTDAEHHWRRCLRIKPGYAEVYGSLGMLLRSLGRLSAAKAMYRQLVALQPAHADARNHLGAVLYGLGYKEEAEASYREALVLRPGYAEAHYNRGIVLHELGRLHEAEAAFRHAVPGLPGHAEVHNNLGNVLTEQGRFAEADAAYREALAIRPHYPEALNNLGGVLKATFRLAEAELAFRLALAIRADYAEAHLNLGTVLADLERLPEAEAAYREAISHRPDYAEAHYNLGVTMGRREQLFEAEMAYREAIRLRPDLVHAYNNLGCVLRRLDRLTAAVEAFRHALRMCPDLAEAHYNLGAALAQLMQLSEAENAYRRALALRADYGDARFGLAVLLLGMGRFEEGWRLYECRYEQRAFVHYRTASMLGCPQWQGGPLDGKSLLVWQEDGLGDMIQFSRYFALLKAQGASHITFACAPSLHRLMGRVDGVDAVLDHDTARAHPAAYDCWTSLLSAPLHLRTSVDTIPRPVRLTAEPSLIDRWRSLLDALPPGRKIGLVWKGNANHHNDANRSIPSLAILAPLWSVPGVSFVSLQKGQGEEEARHPPAGQPLLDVGSRVTDFADSAAIIAQLDLVIAVDTSTAHLAASLGTPCWVMLPEKDIDWRWMHERSDSPWYPHTLRLFRRAPGEDWSMPVERVRQACLERFADADRAPT

SEQ ID NO: 910 - protein, 296 aa, Anaplasma phagocytophilum
MGSIPEFSIRDLMEAGVHLGHKAGRWNPAMAPYIYGVHRYKDIHIIDLRKTAVLLRNALSVLYDVVHRRGRVLFVGTKVQASNVIAEEAARCGQYYVNHRWLGGMLTNWETVSSSIRRLLDFEKLLNDTDAKFTKKELLMFDKKREKLERSLGGIREMGGLPHILFVIDTNKEHIAIQEANKLKIPVVAVLDTNSDPRGVDYPIPGNDDSIRSIDFFCRAVSNTILEAIRSDLMSSGISVAGSVGQAKDGSVVDSGKGKSIAAHKGGGKASKGAAEVVAGGSVVSASGGEDAVVQE

SEQ ID NO: 911 - protein, 295 aa, Nicotiana tabacum
KGGIRYHPEVDPDEVNALAQLMTWKTAVANIPYGGAKGGTGCSPSDLSISELERLTRVFTQKIHDLIGIHTDVPAPDMGTNPQTMAWILDEYSKFHGYSPAVVTGKPIDLGGSLGRGAATGRGVLFAAEALLRDHGKSIAGQRFVVQGFGNVGSWAAQLITEQGGKIVAVSDITGAIKNKNGIDIASLLKHVKENRGVKGFHGADSIDPNSILVEDCDVLIPAALGGVINRDNARDIKAKFIVEAANHPTDPEADEILAKKGVVILPDIYANSGGVTVSYFEWVQNIQGFMWDEE

SEQ ID NO: 912 - protein, 478 aa, Clostridium perfringens
MKFNELNLSEDIIKALNNLGYKNPSEVQEASIPKLLKGEDIIVKSQTGSGKTASFGIPVCEKINIEEKKVQCLVLTPTRELAIQVKDELSNIGRIKKVRCAAIFGKQPFNEQIRELKQRVHIVVGTPGRVFDHMERGTLDLSEVNYVVIDEADKMLSMGFIDQIKDILGELRLNKTTALFSATFSKEIEEICEEYMRNPMLLEVKSKVFNRDRIEESAIEIEEKNKEKALWKCLYAYHPESAIVFCNTRNKVKSVYKMLKDEGITCNELHGDMEQKKRIEVMENFRDKHFKVLVCTDIAARGIHVDSIELVINYEVPMETESYVHRIGRTGRAGREGKAITFVNHYEKKYLENVEEYIGYEIKKVSLPSDEEVKAGRKIFKESQKVQLKESKKPKKEVHGDIVKIHVNGGKKKKIRAFDIVGCFSNLPGLTGEDIGIIDVQDGFSYVDILNGKGDKVLKSFKEVTIKGKKVKIQKARK

SEQ ID NO: 913 - protein, 236 aa, Phaseolus vulgaris
MTKRYWNIILEEMMEAGVHFGHGTRKWNPKMSPYISANRKGIHITNLIRTARFLSESCDLVFHAASGGKQFLIVGTKKKAADSVARAAIRARCHYVNKKWLGGMLTNWYTTKTRLQKFRDLRMQQKTGRFDCFPKKDAAILKRHLAQLETYLGGIKYMKGLPDIVIIIDQQEEYTALRECITLEIPTICLIDTNSDPDLADISIPANDDAIASIRFILNKLVFAICEGRSRSIRNS

SEQ ID NO: 914 - protein, 72 aa, Thiobacillus denitrificans
MSKEDVIQMQGEVIENLPNATFRVKLENGHVLLGHISGKMRMHYIRILPGDKVTVELTPYDLTKGRIVFRAK

SEQ ID NO: 915 - protein, 195 aa, Bordetella parapertussis
MRTAEITRNTNETRIRVAVNLDGTGKQTIDTGVPFLDHMLDQIARHGLIDLDIKADGDLHIDAHHTVEDVGITLGMAIAKAVGSKAGLRRYGHAYVPLDEALSRVVIDFSGRPGLEYHIDFTRARIGDFDVDLTREFFQGLVNHALMTLHIDNLRGFNAHHQCETVFKAFGRALRMALEVDPRMGDAVPSTKGVL

SEQ ID NO: 916 - protein, 112 aa, Unknown
  Photobacterium sp. SKA34
MKIINAIIKPFKLDDVREALADVGVEGMTVSEVKGFGRQKGHTELYRGAEYQVDFLPKVKIEIATQAQNLDAIVEAIGKAAQTGKIGDGKIFVYDLEHAVRIRTGEVDTEAL

SEQ ID NO: 917 - protein, 488 aa, Candida albicans
MRIPSARFVRTGLCSFKPRSFASGRLPYTYLATRAFHSSKIRAINFDPYKTLGVDKSADDRQIKKAYYDLVKKYHPDVNKEKDAEKRFHKIQESYELLRDKEKRAQYDQFGASAFDANGNANPFAGQGGNPFGGFGGGSAGGNPFSGMGFDFEDLFREAFAGGRGGAGGGRGGRSFVTEHVGDNIEVLKTIPFKDSIFGTSVTINYKAVDSCTTCSGSGLKAGAKKNTCPTCHGAGQTTHVMGGFHMSSTCPSCQGAGVTISKSDECGTCHGHGVQEIPKSKTVEIPAGVSDGTRIRIPGAGDAPMVTKDPYNQLVNGDLIIRINVQKDPVFSRNKNDLVINEEILMTTAALGGEIVVPTLDGQKIKLKVRPGVQNGRKLTIPEKGVPINRNLNNRGNLEVILNVKTVVPETPTQKALLEALADTFNDKNAKRTDADWSLDIEDDKNGKVNETYDESDLHPSKLKRIGKVLGKFFNFEQNDKGTKKNN

SEQ ID NO: 918 - protein, 358 aa, Idiomarina baltica
MNQQRWLFIDRDGTLVLEPPVDKQLDSVSKLEFEPNVIPALLKLQQAGYRLVMVSNQDGLGTDSFPQADFDAPHDLMMAVFASQGVRFDDVLICPHFEEDNCSCRKPKLGLVQDYLQKGLIDFTDSYVIGDRETDIKLAESMGIRGIRYDRANLDWNAIVRDLTQRSRSAKVIRTTHETDIRIAVDLDNATPRSFSTGIGFFDHMLEQIATHAGISLTVNVTGDLHIDDHHTIEDTALALGQALRQALGDKRGIGRFGFALPMDECRAECLIDLSGRPHLKWQADFTRDKVGELSTEMVEHFFRSLTDAMAISLHLSTTEGNTHHQVESLFKVFGRALRQAVAKTGDQQLPSSKGMLA

SEQ ID NO: 919 - protein, 341 aa, Pseudomonas putida
MLVTKQPVLRRFWYALLPMTALEDGPKPFTLLGEALVLWKRPDGTPVAMRDRCCHRTAKLSKGFVSAEGNIACGYHGWEYDCTGTCVKIPQSPTGAIPPGAAVKAYHCQEKYGYAWVSLDDPLQPIPEFPEDGAPGYRRIFQFYEEWKTSPLRVMENSFDNSHFSFVHKANFGLFDQPQPASYEFRETDYGFEAETRVPIRNPEASFRITGTTEPITQRHLLNRYYLPFSRRFGCMYPDSGIHHIIYNCATPIDDNRLMLVQWLYRNDSEEQCSTQELIDWDAAITAEDRDILEATDPDACVDTRRRVELHMPSDKPGLVIRRQLLGLLEAHGESEVFLSH

SEQ ID NO: 920 - protein, 556 aa, Vibrio vulnificus
MTESFAQLFEEFLNETEFQQGTIVKGTVVAIENGYVLVDAGLKSESAIPAEQFKNAAGELEVEVGSEVDVALDAVEDGFGETQLSREKAKRHEAWIVLEKAYEEAATVVGIINGKVKGGFTVELNGIRAFLPGSLVDVRPIRDTAHLENKELEFKVIKLDQKRNNVVVSRRAVIESESTVERDELLETLQEGSEVKGIVKNLTDYGAFVDLGGVDGLLHITDMAWKRVKHPSEIVNVGDEILVKVLKFDRDRTRVSLGLKQLGEDPWVAIAKRYPEGHKLSGRVTNLTDYGCFVEIEEGVEGLVHVSEMDWTNKNIHPSKVVNVGDEVEVMVLEIDEERRRISLGLKQCKANPWQSFAEAQAKGDKVTGKIKSITDFGIFIGLDGGIDGLVHLSDISWNVAGEETVREFKKGDEISAVVLAVDAERERISLGIKQMENDPFNAYVADNKKGALVNGTVTAVDAKGATIELEDGVEGYIRASEVSRDRVEDATLILSVGDKVEAKFTGVDRKNRVINLSIKAKDEAEEQEAMASINKADEAAFGNAMADAFKAAKGE

SEQ ID NO: 921 - protein, 937 aa, Mesorhizobium loti
MMTTALTPFSARHIGPGVNDVRAMLAVIGVPSVETLISQAVPQSIRLDLPLTLPAPASEAEALAELSAIMAKNTVLKSFIGAGYHGVHVPPVIQRNLFENPAWYTAYTPYQAEISQGRLEMLFNFQTLVTELTGLPVASASLLDEATAVAEAVGIALRHHRDKRTKVAFAGTPHPQTLDVVRTRAEPLGIEIDGETIDDNTAALLVSWPDTLGVYGDHKAAIDKARAAGALVVFIADPLGLTLTDAPAKLGADIAVGPMQRFGVPMGFGGPHAAYCAVSDRLTRLMPGRLVGQSTDSKGRPGYRLALQTREQHIRRDKATSNICTAQALLANMATAYAIWHGPAGLQAIAGRIHALANRLASGLKAAGVSVLGASRFDTVTVEAKGKAAEIAEAAEKTGRLLRVLDADHVGIAFDETSTDADLDAIASLFGAKAAPSADSTVPGKPRGKEFLTQPVFNENKSETDMMRLLRRLADKDLALDRSMIPLGSCTMKLNAAAEMMPVSWPSIADLHPFAPASHSAGYRAMIGELEGWLSEITGFDAVSLQPNAGSQGEYAGLLAIRAYHRSRGEGHRTVCLIPSSAHGTNPASAAMAGMSVVVVRCLEDGNIDMDDMRAKANEHSKNLAALMFTYPSTHGVYEEGARHLCALIHEHGGQVYFDGANLNALVALARPADIGADVCHMNLHKTFCIPHGGGGPGVGPIGVKAHLKPYLPGHVTEGSAHAVSAAPFGSASILPITWMYIRMMGAAGLKQATETAIISANYVATRLAPHFPLLYKGRHDRIAHECILDTRVLKESAGISVDDIAKRLIDYGFHAPTMSFPVAGTLMVEPTESEPKRELDRFCEAMIAIAGEAAKVARGDWPLADNPLVNAPHTAAETLAGQWTHPYSRLEAAYPAGDADTAAKYWPPVSRIDNVAGDRNLVCSCPPLSDYLGAAE

SEQ ID NO: 922 - protein, 221 aa, Zea mays
  misc_feature (90)..(90): Xaa can be any naturally occurring amino acid
MGRRPARCYRQIKNKPYPKSRYCRGVPDPKIRIYDVGMKRKGVDEFPYCVHLVSWEKENVSSEALEAARIACNKYMTKSAGKDAFHLRVXRVHPFHVLRINKMLSCAGADRLQTGMRGAFGKPQGTCARVDIGQVLLSVRCKDNNAAHASEALRRAKFKFPGRQKIIESRKWGFTKFSRADYLKYKSEGRIVPDGVNAKLLGNHGRLEKRAPGKAFLDAVA

SEQ ID NO: 923 - protein, 804 aa, Magnaporthe grisea
MFLQYLAATAALVTVCTAVPYPREDDMPSSVAVRMSPEHRSSIELVFGNSTGGTQNDGLVGASFYEGVFEHYVQTREAQGPWTHVGIELDMTIKNKAQRCIAYNEDDEPISVQVKDKNETMIPDGIWKMSKPSLIMRFACDNKYGSTPDSKFNLTSTATVTFSDEKGTKKMERKFEDYPANDPFTMPLRGAKTVGPWAQVEMKVADAHKDKWICVALDKDGKTIEVSRGAETTTEQVFWDDGKGPWKFKKESEVHRLNCSPDDFVPQPKQPEDLQAFLQKQLSLRGSCPESRYVGSAKFLAAPMNKRGRTRFPYLPVDGLLDLLHVSVKAFHATSRSLAAHKDPYKVLGVDKTASASDIKKAYYGLAKKFHPDTNKDPTAKEKFGEIQSAYEILSDATKRQQYDQFGAAGFDPNQGGGDPFGGGNPFGGGHPFSGFGGQGGFGSHINMEDLFSAFTGQKGPFGGGGRGGRGGRNPFGPQTVVGDNIEVQASISFAEAAKGTSKTVTINPLVSCKTCKGSGLKAGAQRTTCKTCQGTGARVHTINGGFQISSTCTKCSGTGSVTPRGSDCGTCHGDGVTRERTTIKVDIPGGVEDGMRLRVDGEGDAAATGGADPESVRSVRGDLFLLVRVQADPKYKRTGSDIVYTATIPLTTAILGGEVKIPTLDGDVNVKVATGTNTGDIITLSGMGMKKLGSRYAGKGDLRVEFKVAMPKYLSANQRTIVEMLAEDMGDKTAKRIMNFKMPSSTNDADSHQNEGFLKSIWHNLTNHPGHRKPEGSSEAPSGESNKSSEKDEPKKQSGSGSG

SEQ ID NO: 924 - protein, 1080 aa, Unknown
  Frankia sp. EAN1pec
MTIETTAQTPISDTAASAAAADGVREIDPGTASENGGDTQARQAPPRPESAGPARPESTGSARPDTAGPGLPAGFVPRFTDRHVGPDQADRRAMLDLLGLGSLKGLTDAAVPAAIRDTELDLPPAVDETEVLAELRGLAGYNRRVTSMIGLGFHPAVMPGVIQRNVLENPAWYTAYTPYQPEISQGRLEALLNFQTVITDLTGLAVAGASLLDEPTAAAEAMQIAHRAARGRRSTFVIDADTLPQTIAVVRTRAEALGITVLVADLRDGLTGRPSPAPGERPAAGPAAPAQPAAPSAPSEVPSVVPSDVLGDAFGVLLSYPGAGGEVRDLRGVIAQARERDIVVTVAADLLALTLVRSPGALGADIAVGSTQRFGLPLSFGGPHAGYLAVRSGLERTLPGRLVGVSVDAAGNPAYRLTLQTREQHIRREKATSNICTAQVLPAVLASMYAVYHGPEGLAGIAARVHGHAVSLAAGLRAGGVEIVHDGFFDTVLARVPGRAAQVVADALAHGVNLRLVDGDHVGVSCNETTVAADLRAVWSAFGVGGADGPAAAVGPAAGPALPAALIRTGEEPYLAHPVFHAHRSETAMLRYLRRLADVDFALDRGMIPLGSCTMKLNATTEMAAVTWPDFADIHPFAPLDQAAGYVSMIRDLEEWLARITGYAGVSVQPNAGSQGELAGLLAIRAYHRDHAAAGNPVRDVCLIPSSAHGTNAASAAMAGMRVVVVACDAEGNVDLDDLTAKAAAHAPALAALMVTYPSTHGVYEEGIARACAVVHDAGGLVYVDGANLNALVGLSKPGRFGADVSHLNLHKTFCIPHGGGGPGVGPVAVGAKLLPYLPNHPLRPEAGPETGVGPISGAPWGSAGILMIPWAYIRLMGAEGLREATSVAVLNANYVARRLAPHYPVLYTGRNGLVAHECILDLRPLTKETGVTVDDVAKRLIDYGFHAPTMSFPVAGTLMVEPTESEDLGEIDRFCDAMIAIRAEAAKVGAGEWPREDNPLRNAPHTAEMVTGDEWAHPYPRSVAAYPVASLRAAKYWPPVRRIDGAYGDRNLVCTCPPVEAFDATAEPVRVPLPAATPA

SEQ ID NO: 925 - protein, 112 aa, Rhodospirillum rubrum
MKFVIAITKPFKLDEVREALGALGIQGMTVTEVKGFGRQKGQTEVYRGAEYVVNFLPKVKIELAVPDNLLDQVVETIQSTAQTGKIGDGKIFVFDLGEAVRIRTGERGEEAL

SEQ ID NO: 926 - protein, 396 aa, Candida glabrata
MSTDQMTQLDESQIETNYDKVVYEFDDMNLNEKLLRGVFGYGFNKPSAIQQRAIMPIIEGNDVLAQAQSGTGKTGTFSIAALQRIDPAIKAPQALMLAPTRELALQIQKVVMALGFHMDIKVHACIGGTSFVEDAEGLRDAQIVVGTPGRVFDNIQRRKFKVDNIKMFILDEADEMLSTGFKEQIYQIFTMLPPTTQVVLLSATMPRDVLEVTAKFMQNPVRILVKKDELTLEGIKQFYVNVEEEQFKYDCLTDLYDSISVTQAVIFCNTRRKVEELTQRLTADNFTVSSIYSDLPQQERDTIMKEFRSGSSRILISTDLLARGIDVQQVSLVINYDLPTNKENYIHRIGRGGRFGRKGVAINFIVNEDVQALRELEQFYSTQIEELPSDIGTLFT

SEQ ID NO: 927 - protein, 1061 aa, Oryza sativa
MASCRRPAPLRLVVFLAIVLLRWSTNGNATAGGDDALRGDALALVRLRASLRCHAHALRDWSAGNVAAVCAWTGVRCAGGRVVSVDVANMNVSTGAPVSAAVAGLDALANLSLAGNGIVGAVTASALPALRFVNVSGNQLGGGLDGWDFASLPSLEVFDAYDNNFSSPLPAGVVALRRLRYLDLGGNFFSGEIPAAYGGMAALEYLSLNGNNLQGAIPPELGNLTSLRELYLGYYNVFDGGIPPELGRLRNLTMLDISNCGLSGRIPPELGALAALDTLFLHTNQLSGAIPPELGNLTALTALDLSNNALTGEVPATLASLTSLRLLNLFLNRLHGPVPDFVAALPRLETVQLFMNNLTGRVPAGLGANAALRLVDISSNRLTGMVPEMLCASGELHTAILMNNFLFGPIPASLGSCSSLTRVRLGQNYLNGTIPAGLLYLPRLNLLELQNNLLSGDVPANPSPAMAAASQSSQLAQLNLSSNQLSGPLPSSIANLTALQTLLVSNNRLAGAVPPEVGELRRLVKLDLSGNALSGTIPAAIGRCGELTYLDLSKNNLSGAIPEAIAGVRVLNYLNLSRNQLEEAIPAAIGAMSSLTAADFSYNDLSGELPDAGQLGYLNATAFAGNPRLCGPLLGRPCGYGGGGAAAVGAGGSSSAPVVTTRQRAAGGDFKLVLALGLLVCSVVFAAAAVLRARSCRGGGGPDGGGAWRFTAFHKVDFGIAEVIESMKDGNVVGRGGAGVVYVGRTRSGGSIAVKRLNTSSSAAAAGGGEAARHDHGFRAEIRTLGSIRHRNIVRLLAFCSRRGGSGGGEAASSSNVLVYEYMANGSLGEVLHGKGGGFLSWDRRYRIAVEAARGLCYLHHDCSPMIVHRDVKSNNILLGDNFEAHVADFGLAKFLRSGGGATASSECMSAVAGSYGYIAPEYAYTLRVDEKSDVYSYGVVLLELITGRRPVGDFGEGVDIVQWTKRVTDGRRESVHRIIDRRISTVPMDEVAHIFFVSMLCVQENSVERPTMREVVQMLSEFPRHGSDQPSPSSSAPETGEESSPEKEPNCYKLFPDLLT

SEQ ID NO: 928 - protein, 217 aa, Solanum tuberosum
MAEVKLLGLRYSPFSHRVEWALKIKGVKYEFIEEDLQNKSPLLLQSNPIHKKIPVLIHNGKCICESMVILEYIDEAFEGPSILPKDPYDRALARFWAKYVEDKGAAVWKSFFSKGEEQEKAKEEAYEMLKILDNEFKDKKCFVGDKFGFADIVANGAALYLGILEEVSGIVLATSEKFPNFCAWRDEYCTQNEEYFPSRDELLIRYRAYIQPVDASK

SEQ ID NO: 929 - protein, 113 aa, Glycine max
MGFRISSSSSSSCFCLQRALLPPLTAIATSTRALRRSNCIPSCSVSYQKFVEFALDETKRHTHLIPSPLQEKFSFMNSKDVKGSFSMLSFEAAKIRLLRSLIIQTETMQVVFF

SEQ ID NO: 930 - protein, 661 aa, Bacillus halodurans
MLLLSLIALTSNFCWWGFFVVTGIKVLFYPFDLIISTTCFAAVWFRRYFTIQRKTDKLVDQLKRANKTKDDFLANTSHELRNPLHSILNLSEGILEREKRSLNEKSVADLKIVLSVGRRMSFMLNDLLDAMSLKENTPRLMLQHLSIHTIANGVLEMFRFMVEGKPIRLNNQIPENIPNVLADESRVIQILFNLVHNAVKFTREGEISLEAYVKDDRVYIAIRDTGIGMDKDALKRVFDPYEQVRSEETMVEGGFGLGLSISQKLVELHGGILTVRSTPGQGSVFTFSLQISKQTGLADDNHLLVQSDRENELAAATLSKPTISPVAYRPRILVVDDEPVNLKVIASILANEAYEVKTVISGEEAIAVLDTKEWDLVVADVMMPKMSGYELTKNIRQRFTLTELPILLITARSRPEDIENGFRAGANDYLTKPVNLLELRARIKALTEAKQSIRDQLRMEGAWLQAQIQPHFLFNTLNAILALSEIDIKRMQKLLEVFADFLKNKFTFTNLDELAPIEIELSTVQSYLYIEKERFAQRLNVRWEVEDCKALMIPLFTIQPLVENAVKHGLNRSSGGEITIKIKNEDTYVKVTVTDNGVGMDENIVQHLLTERPSARSGIGLRNTDMRLKRHYGKGLHIESKLGVGTSVSFLVQKQMVQADV

SEQ ID NO: 931 - protein, 281 aa, Triticum aestivum
MAEHLASIFGTEKDRVNCPFYFKIGACRHGDRCSRIHNRPTISPTIVLMNMYQRPDMITPGVDAQGQPIDPRKMQEHFEDFYEDIFEELSKFGEIETLNVCDNLSDHMIGNVYVQFREEDQAAAAHTALQGRFYSGRLIIVDFSPVTDFREATCRQYEENTCTRGGHCNFMHVKQIGKDLRKKLFGRYRRSQRGRSRSPSPHHRRERHDRDDYRGRDDFRRGGGGGGGGRRGGSSRHERHDDGGRRRYGGSPPRRARSPVRENSEERRAKIEQWNREREAK

SEQ ID NO: 932 - protein, 284 aa, Triticum aestivum
MEPGPDAPRGEGASAPEESGPSSSSVAVEKAEEPQAQAQPPEGGGQQVALQEHLQPQPLSQQPPVPAGLSRYESQKRRDWNTFLQYLRNHKPPLTLARCSGAHVIEFLKYLDQFGKTKVHADGCAYFGQPNPPAPCACPLRQAWGSLDALIGRLRAAYEESGGRPESNPFAARAVRIYLREVREAQAKARGIPYEKKKRKRGSTSAPAAPPPVVTAAEAAATSGGGEDDEDEPSQSAEQQHTTPASPPTRISSAGATSTTAAAAATTTTTTTRGKEKEAAEGSA

SEQ ID NO: 933 - protein, 603 aa, Solanum tuberosum
MNSKEEGAYRLFSEPSPRYYDEKKVFQKSNLFHMLPKGIPVPPSGPSRRHNGDATVAPIQWMKPCNMSSLKGVQLTFQQLPKELKRPFQLDKYQLPSIRRRFDKANFFVLQNMGLGGDGEKGESWDVEKSKGKKKKEVTEEETGCWTKLWFIGSCISSRSKVDSSISGISTHCDKSTYVLTSCIALAESKSTNTSRDQPVAPIISSTTTSNAESNSSTSKLEEELKVSSRLRKFAFNDLKLATRNFRPESLLGEGGFGCVFKGWIEENGTAPVKPGTGLTVAVKTLNHDGLQVLSIWQAEVNFLGDLVHPNLVKLIGYCIEDDQRLLVYEFMPRGSLENHLFRRSMPLPWSIRMKIALGAAKGLAFLHEEAERPVIYRDFKTSNILLDADYNAKLSDFGLAKDGPEGDKTHVSTRVMGTYGYAAPEYVMTGHLTSKSDVYSFGVVLLEMITGRRSMDKNRPNGEHNLVEWARPHLGERRRFYRLVDPRLEGHFSIKGAQKAAQLAARCLSRDPKARPMMSDVVEALKPLPNLKDMASSSYYFQTMQADRVGSSPSTKNGVRTQGSFSRNGQQHPRSLSIPNGSHASPYHQQFPQNSPKPNGKT

SEQ ID NO: 934 - protein, 604 aa, Triticum turgidum
MAALVTSQLATSGTVLSVTDRFRRPGFQGLRPRNPADAALGMRTVGASAAPKQSRKPHRFDRRCLSMVVRATGSGGMNLVFVGAEMAPWSKTGGLGDVLGGLPAAMAANGHRVMVISPRYDQYKDAWDTSVISEIKVVDRYERVRYFHCYKRGVDRVFVDHPCFLEKVRGKTKEKIYGPDAGTDYEDNQQRFSLLCQAALEVPRILDLNNNPHFSGPYGEDVVFVCNDWHTGLLACYLKSNYQSNGIYRTAKVAFCIHNISYQGRFSFDDFAQLNLPDRFKSSFDFIDGYDKPVEGRKINWMKAGILQADKVLTVSPYYAEELISGEARGCGLDNIMRLTGITGIVNGMDVSEWDPIKDKFLTVNYDVTTALEGKALNKEALQAEVGLPVDRKVPLVAFIGRLEEQKGPDVMIAAIPEIVKEEDVQIVLLGTGKKKFERLLKSVEEKFPTKVRAVVRFNAPLAHQMMAGADVLAVTSRFEPCGLIQLQGMRYGTPCACASTGGLVDTIVEGKTGFHMGRLSVDCNVVEPADVKKVVTTLKRAVKVVGTPAYHEMVKNCMIQDLSWKGPAKNWEDVLLELGVEGSEPGIVGEEIAPLALENVAAP

SEQ ID NO: 935 - protein, 98 aa, Arabidopsis thaliana
  misc_feature (18)..(18): Xaa can be any naturally occurring amino acid
MASSMLSSATMVASPAQXATMVAPFNGLKSSAAFPATRKANNDITSITSNGGRVNCMQVWPPIGKKKFETLSYLPDLTDSELAKEVDYLIRNKWIPCV

SEQ ID NO: 936 - protein, 605 aa, Triticum turgidum
MAALVTSQLATSGTVLGITDRFRRAGFQGVRPRSPADAPLGMRTTGASAAPKQQSRKAHRGTRRCLSMVVRATGSAGMNLVFVGAEMAPWSKTGGLGDVLGGLPPAMAANGHRVMVISPRYDQYKDAWDTSVVSEIKVADEYERVRYFHCYKRGVDRVFVDHPCFLEKVRGKTKEKIYGPDAGTDYEDNQLRFSLLCQAALEAPRILDLNNNPYFSGPYGEDVVFVCNDRHTGLLACYLKSNYQSSGIYRTAKVAFCIHNISYQGRFSFDDFAQLNLPDRFKSSFDFIDGYDKPVEGRKINWMKAGILQADKVLTVSPYYAEELISGEARGCELDNIMRLTGITGIVNGMDVSEWDPAKDKFLAANYDVTTALEGKALNKEALQAEVGLPVDRKVPLVAFIGRLEEQKGPDVMIAAIPEILKEEDVQIVLLGTGKKKFERLLKSVEEKFPSKVRAVVRFNAPLAHQMMAGADVLAVTSRFEPCGLIQLQGMRYGTPCACASTGGLVDTIVEGKTGFHMGRLSVDCNVVEPADVKKVVTTLKRAVKVVGTPAYHEMVKNCMIQDLSWKGPAKNWEDVLLELGVEGSEPGVIGEEIAPLAMENVAAP

SEQ ID NO: 937 - protein, 365 aa, Unknown
  Candidatus Desulfococcus oleovorans Hxd3
MAVKRDYYEILGVARDVSATELKKQYRKIALKCHPDKNPGNKEAEDQFKEASEAYAVLCDPEKRQIYDQYGHAGLEGLGNGRGAGFDDIFSSFGDIFEDFFGFGSGRRSRRGPRKGEDLRYDLTIDFLEAAFGKQTEIELEKLEPCSACEGTGCAEGTQPETCRHCGGTGQATRSQGFFVVKTTCPACRGTGRMIASPCARCRGNGREMVRKTVSLKIPAGVDTGSRLRLSGEGEAGDPGGRPGDLYVFINVRPHEFFQRNNNDVVCIMEISFVQASLGATISVPTLTGERELEIPKGTQYGDIFRFKGEGIASLRSGNRGDQIIQVEIKTPTRLNKKQEELLTEFSRLESDKIGNKLKNLFKRR

SEQ ID NO: 938 - protein, 378 aa, Arabidopsis thaliana
MSSPEKFSPAPESNSNPSLPDALIISCIARVSRLYYPILSFVSKSFRSLLASPELYKERSLLNRTEGCLYVCLYLNPFESPSWFTLCLKPDQALSSETSNKKKSSGYVLATVSIPHPRLVQRSSLVAVGSNIYNIGRSISPYSSVSIFDCRSHTWREAPSLPVELVEVSAGVLDGKIYVAGSCKDGDSLNLKNTFEVFDTKTQVWDHVPIPYNETKHNIYSKSLCIDEKWYVGAKRKVVSYNPKKGIWDLVESEMCSYKSSYDYCEIENVLYSVEKTWRGTVFRWYDTELGRWRKLEGLVEQLPIILACPRLANFGGKMAVLWKENMTYSGSNKMLWCAVITLERRKKREIWGKVEWFDHVLTVPLTYVFENVLVATI

SEQ ID NO: 939 - protein, 604 aa, Triticum turgidum
MAALVTSQLATSGTVLSVTDRFRRPGFQGLRPRNPADAALGMRTVGASAAPKQSRKPHRGNRRCLSMVVRATGSGGMNLVFVGAEMAPWSKTGGLGDVLGGLPAAMAANGHRVMVISPRYDQYKDAWDTSVISEIKVVDRYERVRYFHCYKRGVDRVFVDHPCFLEKVRGKTKEKIYGPDAGTDYEDNQQRFSLLCQAALEVPRILDLNNNPHFSGPYGEDVVFVCNDWHTGLLACYLKSNYQSNGIYRTAKVAFCIHNISYQGRFSFDDFAQLNLPDRFKSSFDFIDGYDKPVEGRKINWMKAGILQADKVLTVSPYYAEELISGEARGCELDNIMRLTGITGIVNGMDVSEWDPIKDKFLTVNYDVTTALEGKALNKEALQAEVGLPVDRKVPLVAFIGRLEEQKGPDVMIAAIPEIVKEEDVQIVLLGTGKKKFERLLKSVEEKFPTKVRAVVRFNAPLAHQMMAGADVLAVTSRFEPCGLIQLQGMRYGTPCACASTGGLVDTIVEGKTGFHMGRLSVDCNVVEPADVKKVVTTLKRAVKVVGTPAYHEMVKNCMIQDLSWKGPAKNWEDVLLELGVEGSEPGIVGEEIAPLALENVAAP

SEQ ID NO: 940 - protein, 604 aa, Triticum turgidum
MAALVTSQLATSGTVLGITDRFRRAGFQGVRPRNPADAALVMRTIGASAAPKQSRKAHRGSRRCLSMVVRATGSGGMNLVFVGAEMAPWSKTGGLGDVLGGLPPAMAANGHRVMVISPRYDQYKDAWDTSVVSEIKVADEYERVRYFHCYKRGVDRVFVDHPCFLEKVRGKTKEKIYGPDAGTDYEDNQLRFSLLCQAALEAPRILDLNNNPYFSGPYGEDVVFVCNDWHTGLLACYLKSNYQSNGIYMTAKVAFCIHNISYQGRFSFDDFAQLNLPDRFKSSFDFIDGYDKPVEGRKINWMKAGILQADKVLTVSPYYAEELISGEARGCELDNIMRLTGITGIVNGMDVSEWDPTKDKFLAVNYDVTTALEGKALNKEALQAEVGLPVDRKVPLVAFIGRLEEQKGPDVMIAAIPEILKEEDVQIVLLGTGKKKFERLLKSVEEKFPNKVRAVVRFNAPLAHQMMAGADVLAVTSRFEPCGLIQLQGMRYGTPCACASTGGLVDTIVEGKTGFHMGRLSVDCNVVEPADVKKVVTTLKRAVKVVGTPAYHGMVKNCMIQDLSWKGPAKNWEDVLLELGVEGSEPGVIGEEIAPLAMENVAAP

SEQ ID NO: 941 - protein, 334 aa, Synechococcus elongatus
MIIRTPSSPANRSVMRIAQNITELIGRTPLVQLNRIPVADGCLARIVVKLESFNPSASVKDRIGISMILEAERKGLIAPDRTTLVEPTSGNTGIALAMAAAARGYRLILTMPDTMSSERRAMLRAYGATLELTPGIEGMAGCIQRAQEIVASHPEAYMLQQFKNPANPKIHRETTAEEIWADTDGTVDILISGVGTGGTITGVAEVLKERKPSFQAFAVEPANSPVLSGGRPGPHKIQGIGAGFVPEVLATQLIDEVVTVSDDEAIAYGRRLAREEGLLSGISSGAAVAAAVQVARRPENTDKLIVVILPSFGERYLSTPLFQEPELVSVSSNG

SEQ ID NO: 942 - protein, 375 aa, Brevibacillus choshinensis
MKRDYYEVLGVGKGADADEIKKAYRKLARQYHPDVNKAADAEEKFKEVKEAYDVLSEPQKRAQYDRFGHQDPNQGFGGGGFDASGMGGFGDIFDMFFGGGGRRANPNAPRKGSDLQFGLSIEFTETVFGKETDVEIPKEAECDTCHGSGAKPGTGVETCKTCSGTGQQEVAANTPFGRIVNRRVCTTCEGKGKVFKEKCSSCRGSGRVKVRRKIHLNIPAGVDDGAQLRVTGEGEPGVNGGPPGDLYVVLRVKSHEFFEREGNDIYCEVPLTYAQAALGDEIEVPTVDGRVKLKIPSGTQTETFFRLRGKGVPHLRGNGRGDQHVKVRVITPTKLSDKQKELLRELAELSGEKPGQHGGEDEGFFEKMKRAFRGE

SEQ ID NO: 943 - protein, 353 aa, Burkholderia xenovorans
MAPAASPAKWARSRAAARLQRRALSPDRLNGERFDVVVVGAGPAGLAAAVYAASEGLRVAVLDTKAPGGQAGTSSKIENYFGFPTGISGQALAGRGLSQCRKFGAEVGVPIEVLGIECESAPPFHLRLNYDEHVYASSVVIATGARYRKPLLPRLEQFEGRGIYYSATFMEAAFCNNEEVVIVGGGNSAGQAAVFLSGLARHVHIAIRGDGLNASMSNYLIRRIEATANITVHSRTQIVQLNGETQLESIKWDTQGYIEEKPIRHVFLFLGAQPNTGWLGDCIALDRNGFVLTGPDAVHQWPSERAPYYLETSRPGIFAVGDVRSGSVKRVAAAVGEGAAAIQSLHQYLALNR

SEQ ID NO: 944 - protein, 261 aa, Picea glauca
MEDMNMNIGGAATFYGVNMNEYGDTGVGSMMALMTEQEPGNESIMSTMTMTIPSSAFSSYSHAGQVEGLLSAAAATMFNQGGHHHHQKHLVGGHFPPEQLVMNEQAAVISDSSLSSVKTEVCSNQLEFHRKTSGGGRSCCPQPSLVVRAPQQQQHQHHHHQEASRMVTSLEVDIDSACSSNPNDSIDTLKTKIACHPHYPQLLAAYMDCQKIGAPPEVVTVLDEISQENQLGRHLATMDIGVDPELDQFMEAYCQMLIKYH

SEQ ID NO: 945 - protein, 422 aa, Saccharophagus degradans
MTVQDYMLTLGKQARAASRQMASADTGKKNAALLAIADAINSARDTIAAENARDMEAGRANGLDAALLDRLELTPERIDGMIEGLNQVAALPDPCGEITDLKYRPSGIQLGKKRTPLGVVGIIYESRPNVTVDAASLCLKSGNAAILRGGSEAIHSNKAVAVCIAAGLKAAGLPETAVQVVETTDRAAVGELITMTKYVDVVVPRGGKSLIERISADARVSVIKHLDGICHVYVDKTANLDKAFNIVINSKTHRYGVCNAMETMLVDEAIAADFLPRAAKEFAARGVELRGCEKTVALLTASDIPVVAALEEDWDTEYLAPILSIKLVANMDEAIEHINNHGSHHTDALVSENYTLARKFLTEVDSSSVMINASTRFADGFEYGLGAEIGISTDKIHARGPVGLEGLTSQKWIVFGDGHIRN

SEQ ID NO: 946 - protein, 327 aa, Gibberella zeae
MVTLPSPFSDIDRVQLLFNRPTDIEPLSRLTESVNNNVKLWIAREDRNSGLAFAGNKVRKLEYVLADALAQGADTVVTTGGIQSNHMCQTSAAAARLGLKVALYPADRVASNDAEYKYLGNIQANAILGAETFPVDTAEETVITTLKDRGQKPYSIPPGASSHPLGGLGYARWAFELLEQEKKIGVTFDTIALVAGSCSTLGGLLAGLKLAQKEQIPGSKKRLIGFSVLHKSKKDVEALVLKTSRTTASKIGISPNEITADDFEINTSYIGDGYGQLNDSTAEAMKKLARKEGILTDPVYTGKAFTGLLDLAKTGYLNVSTTIVLNI

SEQ ID NO: 947 - protein, 697 aa, Unknown
  Acinetobacter sp. ADP1
MSMFNIIRKEFQFGQHQVVLETGRVARQANTVLVTMGGVTVLVAVVAQPKAKAGQDFFPLTVNYQEKQYAAGRIPGGYGKREGRASEAETLISRLIDRPIRPLFPEGYFNEIQITATVVSSDKTMDADIAAMLGASAALSIAGTPFRGPIGGARVGLINGEYVLNPNFEQLAQSDLDLVVAGTESAVLMVESEAKELSEDQMLGAVLFGHDEMQIAVQAIKEFAAAAGAVESTWVAPTKNETLLEQLKAAFEAKISEAYTIAVKQDRYTALDALYAEAVAQFVPENDETGIADEVNELFEDLKYRTVRDNILSGKPRIDGRDTKTVRAIDVQVGVLDRAHGSALFTRGETQALVTTTLGNTRDALMVDTLAGTKTDNFMLHYNFPAYSVGETGRESGPKRREIGHGRLARRGVQAVLPAADRFPYVIRIVSDITESNGSSSMASVCGASLSLMDAGVPLKAPVAGIAMGLVKEGERFAVLSDILGDEDHLGDMDFKVAGSANGITALQMDIKIEGITEEIMEVALNQAYAGRMHILNEMNKVISRARAEISAHAPTFEVITINPDKIRDVIGKGGATIRQITEETKAAIDIEDNGTVRVFGETKAAARAAIAKIQALTAEVEPGKIYDGKVIRIVEFGAFVNIMPGTDGLLHISQISNERVANVSDVLKEGQDVKVQVADVDNRGRIKLSMKDIEQA

SEQ ID NO: 948 - protein, 396 aa, Unknown
  Frankia sp. CcI3
MSVRDMVEKDYYAALGVPKDASATDIKKAYRGLARELHPDKNPGDAKAEARFKEVSEAYDVLSDEGRRREYDEARALFAAGGRPGGGFGGPGRAGGYGGFGAPGTGYGSGPNLNLDDLLGGANGGLGGIFDNLFQRSSPGRGPRRGADIEAEVTIPFEKSLTGLEASVRLPGAATCTTCTGSGARPGTTPRTCPTCRGLGVVSRSQGGFALSEPCRDCLGKGTLIDHPCPDCRGTGRREREQRIRIPAGVSDGQRLRVRGRGIPGERGGPAGDLEVTVHVLRHPVFEREGSNLAITLPVTITEAALGASIRVPTLDGAPLTMKVPAGTSSGRRLRARGRGVPTAGGGNGDLIVTLEVTVPKPSDLSPRARTALLEFAQAHPEDPRAPLMERMEAGG

SEQ ID NO: 949 - protein, 398 aa, Bacillus licheniformis
MKKMARLYMLMLNVFIVMLGIGLIIPLMPTFIEEFGASGSTLGLLIAASGITQLLFSPVAGEMTDKYGRRKMIILGIGAFAVSQLLFALASQMWLLFVSRLLGGAGAAFLVPAMFAYIADITSEKDRSKGMGLISAAMSLGFVIGPGAGGYLAAFGLTFPFYVSAGLAGLATVLSLLVLPETLSQEKMLEKRRSVQKREPLAKQMARALRSPYAFLFILVFILNFGIMNFEAVFSLYVDHKHGFTPGDIAFVITAASLIGVFVQAVALGMLTNRFGEKKLMNMTLIGSAGALAVCSIAGSYWLVFGATIVFFMLTSILRPAINTLISKMAGDEQGFAAGMNNAFMSLANIVGPTVAGLLFDVNVEIPYIFGVVVLVLSFLAAVSWGRKQQARTIPEKV

SEQ ID NO: 950 - protein, 140 aa, Thermus thermophilus
MVVTCPKCGAKNRLGTPPPGQVPVCGACKTPLPWVVEADEKGFAQEVAGAPLTLVDFFAPWCGPCRLVSPILEELARDHAGRLKVVKVNVDEHPGLAARYGVRSVPTLVLFRRGAPVATWVGASPRRVLEERLRPYLEGR

SEQ ID NO: 951 - protein, 300 aa, Bacillus cereus
MTAAVYTSRANLSTLMLERGIPGGQMANTEDVENYPGYESILGPDLSNKMFEHAKKFGAEYAYGDVKEVIDGKEYKTIIAGKKEYKARAIIVASGAEYKKIGVPGETELGGRGVSYCAVCDGAFFKGKELVVIGGGDSAVEEGVFLTRFASKVTIVHRRDTLRAQKILQDRAFQNEKVDFIWNHTIKEINEANGKVGSVTLVDVNSGEEKEVKTDGVFVYIGMLPLSKPFVELGITNENGYLETNERMETKVPGIFAAGDVREKMLRQIVTATGDGSIAAQSAQHYVEELLEELKTVSEK

SEQ ID NO: 952 - protein, 176 aa, Unknown
  Symbiodinium sp. C3
MQIFVKTLTGKTITLEVEPSDSIENVKTKIQDKEGIPPDQQRLIFAGKQLEDGRTLSDYNIQKESTLHLVLRLRGGMQIFVKTLTGKTITLEVEPSDSIENVKTKIQDKEGIPPDQQRLIFAGKQLEDGRTLSDYNIQKESTLHLVLRLRGGMQIFVKTLTGKTITLEVEPSDSIE

SEQ ID NO: 953 - protein, 149 aa, Bacillus anthracis
MGYIEELRKVVGTRPLILVGSAIIILNDNQEVLLQYRSDTYDWGVPGGAMELGETTEETARRELFEETGLNAKIMQFIGVLSGKEVYFQYPNGDEIFNVIHLYQGHHVSGELRLDHEGLQLQYFPVDKLPNLNKTTEKILQKFLHALTE

SEQ ID NO: 954 - protein, 129 aa, Glycine max
  misc_feature (108)..(108): Xaa can be any naturally occurring amino acid
VQPLLFSDPDGMVQRGLALTHQDEILTPAAHTIDSSFRNDHVDSYALPDSNLYANAYKNIIMTRGTTKLLLDMAPISKFAEMLYLNARSANYTMGRKIFTGAHSYRHXHYHDEAAILDSYRCMHSALSN

SEQ ID NO: 955 - protein, 434 aa, Rhodospirillum rubrum
MEASVAPPALRNAPCAGVNAACLSAADDAVAIAIAQETTRQRESIELIASENFVSKAVLEAQGSVLTNKYAEGYPQRRYYGGCANVDRVEDLAIARLNQLFGSTYANVQPHSGSQANQAVFLALLAPGDTILGLDLKAGGHLTHGAPVNISGRWFTAVSYGVDPRTHLIDMEQMADLARRHRPKLLIAGGSAYPRLLDFARFRQIADEVGAILMVDMAHFAGLVAGGVYPSPVPFADVITSTTHKTLRGPRGGFVLTNDAAIAKKINSAVFPGLQGGPLMHIIAAKAVAFGEALDPSFKIYARRVVENCRVLAQTLLDGGLAITSGGTDCHLAVVDLRPLGVTGTIAEQALESIGITLNKNAIPNDPEKPMVTSGIRVGSAAGTSRGFGPEEYRRIAALILETLHAVRAGTLEADREGIRTRVRSLVAGFPLPY

SEQ ID NO: 956 - protein, 482 aa, Oryza sativa
MGMEVAAARLGALYTTSDYASVVSINLFVALLCACIVLGHLLEENRWVNESITALIIGLCTGVVILLMTKGKSSHLFVFSEDLFFIYLLPPIIFNAGFCLLEFYSWSIYSAAIAIFSRMNIGTLDVGDFLAIGAIFSATDSVCTLQVLNQDETPFLYSLVFGEGVVNDATSIVLFNALQNFDLVHIDAAVVLKFLGNFFYLFLSSTFLGVFAGLLSAYIIKKLYIGRHSTDREVALMMLMAYLSYMLAELLDLSGILTVFFCGIVMSHYTWHNVTESSRVTTKPGKSIGISSILLGLVLIGRAAFVFPLSFLSNLTKKAPNEKITWRQQVVIWWAGLMRGAVSIALAYNKFTRSGHTQLHGNAIMITSTITVVLFSTMVFGMMTKPLIRLLLPASGHPVTSEPSSPKSLHSPLLTSMQGSDLESTTNIVRPSSLRMLLTKPTHTVHYYWRKFDDALMRPMFGGRGFVPFSPGSPTEQSHGGR

SEQ ID NO: 957 - protein, 991 aa, Roseovarius nubinhibens
MDRRAFLRGSGLAIGGLTAIAATGGTVTQASAAGAVTGKVDLKKSVCTHCSVGCTVVAEVAGGVWVGQEPGWDSPFNLGSHCAKGASVREHAHGERRLKYPMKKEGGEWKRISWEQAINEIGDQMEGIREESGPDSVYWLGSAKHSNEQAYLFRKFAAYWGTNNVDHQARICHSTTVAGVANTWGYGAMTNSYNDIHNSKAIFIIGGNPAEAHPVSLLHVLKAKEQNNAPLIVCDPRFTRTAAHADEYVRFRPGSDVALIWGILYHIFENGWEDKEFIRTRVWGMDQIREEVAKWTPEEVERVTGTPGSQLKRVAMTLANNRPGTVIWCMGGTQHTNGNNNTRAYCILQLALGNMGVEGGGTNIFRGHDNVQGATDVGVLSHTLPGYYGLSAGAWAHWARVWEEDSEWLSNRFAKVTGADGKEKSLQNLTGIPVSRWIDGVLEDPANTDNPDKVRAMVLWGHAPNSQTRMTEMKTAMEKLDMLVVIDPYPTVSAVLHDRTDGVYLLPAATQFETRGSVTASNRSLQWREQVVDPLFESKPDHEIIALFAKKFGFHDRLFRNIELEEDGLTPNVEDTLREINRGMWTIGYTGQSPERLKLHMENQHTFDRTTLRANGGPADGDFYGLPWPAWGTPEMKHPGTPNLYDMSKPVAEGGLCFRARFGVERDGDNLLAEGVSNPGAEIQDGYPEFTYQMLVDLGWDGDLTDAEKRSIAKVAGVDVAGDVGQSDDGEDKTTEGAQLTQPSGEQGAAEEVGEQSMSPFPSDFNERASTINWKTDLSGGIQRVAIKHGCAPFGNAKARAVVWTFPDPVPKHREPLYTNRRDLVEDYPTYEDRKFYRLPTLYASIQKQDFSKDYPIILTSGRLVEYEGGGDETRSNPWLAELQQDMFVEINPRDANNLGVRDGAQVWVEGPEGGKVKVMAMVTERVGEGVAFMPFHFGGHFQGEDLRSKYPDGADPYVLGESTNTAQTYGYDSVTQMQETKATLCKIMPA

SEQ ID NO: 958 - protein, 421 aa, Unknown
  Silicibacter sp. TM1040
MKDLENIPALMEDIGKRAKAAAQQLATASAAQKEQALNAAADAVWAQRGEIIAANAKDLEFGRDKGLSSAMMDRLMLDEARIQGIVDGLRAVAAQADPVGAVLDEWTQPSGLRIQRVRTPLGVIGVIYESRPNVTADAGALCLKSGNAVILRGGSESLHSAQAIHGCLAAGLRAADLPEDAVQLVPTRDRAAVQELLTMTAYVDVIVPRGGKGLVGLVQREARVPVFAHLEGIVHIYLDKDADRKKAIDVVLNAKTRRTGICGAAECLLIHEDIADSIGKDVLDLLAMGGVEIHAEEGLPGPDSMQVATSEDWGKEYLDAIIAAKKVASIDEAIAHIRRYHSAHTDCIITENDAAVAQFFSELDSAILMHNASTQFADGGEFGMGAEIGIATGKMHARGPVGATQLTSFKYLVRGDGTVRA

SEQ ID NO: 959 - protein, 310 aa, Staphylococcus epidermidis
MAQKPVDYVTQIIGNTPVVKLRNVVDDDAADIYVKLEYQNPGGSVKDRIALAMIEKAEREGKIKPGDTIVEPTSGNTGIGLAFVCAAKGYKAVFTMPETMSQERRNLLKAYGAELVLTPGSEAMKGAIKKAKELKEEHGYFEPQQFENPANPEIHELTTGPELVEQFEGRQIDAFLAGVGTGGTLSGVGKVLKKEYPNVEIVAIEPEASPVLSGGEPGPHKLQGLGAGFVPDTLNTEVYDSIIKVGNDTAMDMARRVAREEGILAGISSGAAIYAAIQKAKELGKGKTVVTVLPSNGERYLSTPLYSFDN

SEQ ID NO: 960 - protein, 374 aa, Clostridium acetobutylicum
MANKDYYEVLGLEKGASDDEIKKAFRKLAIKYHPDKNRGNKEAEEKFKEINEAYQVLSDPDKKANYDRFGTADFNGGGGFGDFSGGFGDFGDLGDIFNSFFGGGFSGGSSRARKDAPQRGNDMEYSISLTFEEAVFGVEKSINITRSENCETCGGTGAKKGTSPKTCDKCGGTGTIRVQRNTPLGSFVTQSSCDKCGGRGTIISDPCHECHGAGHVRKKRKISVKIPAGVDTGNVIPLRGQGEHGKNGGPAGDLYISIKVTPHKKFKREGFDIYIDTHISFPKAALGTDMTVPTIDGDVKYTIPAGTQSGTVFRLKGKGVQRVNGGGRGNQYVKVIVDTPKALNDKQREALKMFMEASGEAKSEKKSGFKRFFE

SEQ ID NO: 961 - protein, 716 aa, Mycobacterium avium
MTSAKAAAPTPTGEVWPGKAYPLGASYDGAGTNFAVFSEVAERVELCLFDGDGTESRVALPEVDGFVWHAYIPGIEPGQRYGYRVHGPYDPAAGQRCNPNKLLLDPYSKAVDGTFEWNQSLFGYNFGDPDSRNDDDSAPSMPKSVVINPYFDWGNDRPPDHHYADTVVYEAHVKGLTQTHPDIPEQMRGSYGAVAHPVIIEHLQSIGVTAIELMPVHHFANDSTLIEKGLSNYWGYNTIGFFAPDTKYSSAATPGGQVQEFKAMVRSLHEAGIEVILDVVYNHTAEGNHLGPTLSMRGIDNAAYYRLVDDDKRYYMDYTGTGNSLNVGHPHALQLIMDSLRYWVTEMHVDGFRFDLAATLAREFYDVDRLATFFELVQQDPTVSQVKLIAEPWDVGPGGYQVGNFPPQWTEWNGKYRDTVRDFWRGEPATLDEFAYRLSGSADLYEHTGRRPVASINFVTAHDGFTLRDLVSYNEKHNEANGEDNNDGESHNRSWNCGAEGPTDDEQVNALRARQQRNFLTTLLLSQGVPMICHGDELGRTQNGNNNGYCQDNELTWIDWANADVDLLAFTRVVSALRAEHAVFRRRRFFSGKPVGRRGQDGLRDIAWFTPDGTEMTDEDWGANFAKSVTVFLNGHGIPDRDARGQRLLDDSFLLCFNAHHESIEFTLPPKEFGASWQVVVYTGPEETTPADEVPGAGVLNVDAHTAVVLRAPDGG

SEQ ID NO: 962 - protein, 304 aa, Vibrio vulnificus
MIWNFILNPQAGGGKALRFWQQLKPLLSQHNIKHHFHQTQYQGHAKVLSKELAEQGERAFVAIGGDGSVNELLQGIFESDCDLQEFVLTVAPQGTGNDWARYHHIPKSPNAWLEFLQAANVVEHDVGVVEYGDDFLQQHVFINMAGCGLDCHILQQMGCAGGKSLRYYSTLLSSLYGYQGRTLHFKRLDDSSSQDVARTVLLSMFCIGRYGGAGMDFSPKAHHQSGVLHSVCVEDMPFLKRLFSLPYLLNGKIEQHSRVQAETMRALLVAGEDTALFQCDGELIGELPARLTLRPCAIRVLTRR

SEQ ID NO: 963 - protein, 440 aa, Ostreococcus tauri
MRLANVAPVARGARVGSSDPTRAVAANGTRAPPRRTASFDPPGRGERGRTVVRRNTPAGVGRKADDPLGVFRLEYDVSQDEKHRPKTWKPTITVAVSGAAGQISNHLLFKIASGSVFGADQPVILRLLGSERSRTALEGVSMELEDCLFPLLREVDIGIDARTVFAGADWALLIGAKPRGPGMERGDLLEMNGKIFVEQGKALNDVAKPTCKVIVVGNPCNTNALIALSHAPNLDPKNFHALTKLDENRAKCQLAIKAGVFYETVTNVAIWGNHSTTQVPDFVNAKIDGKKATDVITDREWLESDFTPAIQTRGGLLIKKWGRSSAASTAVSIADHIRNLVNPTAPGDFFSSAVLSNGNPYGIPDGLCYSFPCRSKGDGSYEIVQGLEINDWLRERMDKSAEELVNEKGCVGSLFGDAHLDEFDIQCPVDLDDTLLPGEM

SEQ ID NO: 964 - protein, 222 aa, Nostoc punctiforme
MALFGFGKKQVMPTPEEALSGRAQSMSVPAAHYVNKNPLKAPYPDGLEKAIFGLGCFWGAERKFWQLKGVYTTAVGYAAGFTPNPTYEEVCSGRTGHNEVVLVVFDPKVISYSELLKVFWESHNPTQGMRQGNDAGTQYRSGIYVYSESQKQLAEASREAYQQALNDAGYGKITTEILDAPEFYYAEAYHQQYLAKNPNGYCGLGGTNVSCPVGVVESQVSS

SEQ ID NO: 965 - protein, 257 aa, Triticum aestivum
MEPSSQPQPATGDVVAGGSQVYPASAYPPAATIAVAPGIIPAASQPASPFPANPAQLTAQNQLIYEQAQQFHQQLQQQQQRQLQQFWAERLSEIDQATDFKNHTLPLARIKKIMKADEDVRMISAEAPVVFAKACEIFILELTLRSWMHTEENKRRTLQKNDIAAAITRTDVYDFLVDIIPRDEMREEGVGLPRAGQPPLLGAPADASYPYYYPQQVPGAVMGYGGQQGHLPYVWQDPQEQQQHQGHPGEQQQSESG

SEQ ID NO: 966 - protein, 306 aa, Unknown
  Synechococcus sp. CC9311
MGWTLKDIPDQTGRLALVTGANSGLGLETSRALLQKGATVLMACRNQKKSEAARRDLLELGTTGVDLLDLDLSDLNSVERCAKAVQERYGRLDLLMNNAGLMAPPRRLSVQGFEMQFAVNHLGHMALTQRLLPLMEGRQDPRVVTVTSGAQYFGKMQWSDLQGERRYDRWKAYSQSKLANVMFALELNHRLHKQNSTVISLAAHPGLARTNLQKVSVASRGAWQESLAYRLMDPLFQSAAMGALPQLHAATASSAKGGEHFGPGGFASMRGMPTRQPVARPARDAEQRERLWTTSDDMIQCNKSEV

SEQ ID NO: 967 - protein, 277 aa, Phyllostachys pubescens
KWNYDGSSTGQAPGEDSEVILYPQAIFKDPFRRGNNILVMCDCYTPAGEPIPTNKRYNAAKIFSSPEVAAEEPWYGIEQEYTLLQKDTNWPLGWPIGGFPGPQGPYYCGIGAEKSFGRDIVDAHYKACLYAGINISGINGEVMPGQWEFQVGPSVGISSGDQVWVARYILERITEIAGVVVTFDPKPIPGDWNGAGAHTNYSTESMRKEGGYEVIKAAIEKLKLRHREHIAAYGEGNERRLTGRHETADINTFSWGVANRGASVRVGRETEQNGKGY

SEQ ID NO: 968 - protein, 503 aa, Ralstonia metallidurans
MRDRTLVLSVLIVASCGLGYELIAGALSSYLLGDSILQFSSIIGCYLFAMGVGSWLSRYVKDEDVLTRFIDIEILVGLLGGISAALLFVVFAWLSAPFRTALYALVFVIGMLVGMEIPLVMRILNARRAQFSDLVSRVLTFDYLGALAVSLVFPLVLAPRLGLSRTGFLFGMLNVAVALFTLRIFRDEVSRTTLRTLRAGMVLAVLTVGFAGSNYLTHWAERGLFGDEIIHSETTPYQRLVITRWKDDLRLYINGNLQFSSRDEHRYHEALVHPVLQALPWARRVLVIGGGDGLALREILKYRNIEHVTLVDLDPAMTTLFSRSEPLRALNHGSLTDQRVTVVNADAAQWLEQNQDSFDAIIVDLPDPSNFGLGKLYSVPMYRLMSRHLAEKGYAVVQSTSPYYAPRSFWDIDATLREAGLHTWPYHTYVPSFGEWGYILVGKRNDYTPPTRYDVPMKFLDGDTTALMFRFPADMAPRQGEPNRLNEQTLVHDFERDWRNVIR

SEQ ID NO: 969 - protein, 553 aa, Oryza sativa
VCAWVLGLITADKNATRIHPPGNPETPPPPPPPAARRSPTMAMATALRKLSSDALRRQPLSRITPLYYMASLPATEERSGVTWPKQLNAPLEEVDPEIADIIEHEKARQWKGLELIPSENFTSVSVMQAVGSVMTNKYSEGYPGARYYGGNEYIDMAESLCQKRALEAFRLDPAKWGVNVQPLSGSPANFHVYTALLKPHERIMALDLPHGGHLSHGYQTDTKKISAVSIFFETMPYRLDESTGLIDYDQMEKSAVLFRPKLIVAGASAYARLYDYDRMRKVCDKQKAILLADMAHISGLVAAGVVPSPFDYADVVTTTTHKSLRGPRGAMIFYRKGVKGVNKQGKEVMYDFEDKINAAVFPGLQGGPHNHTITGLAVALKQATTPEYRAYQEQVMSNCAKFAQSLTAKGYELVSGGTDNHLVLVNLKSKGIDGSRVEKVLENVHIAANKNTVPGDVSAMVPGGIRMGTPALTSRGFVEEDFAKVADFFDAAVNLALKVKAAAGGTKLKDFVATLQSDSNIQSEIAKLRHDVEEYAKQFPTIGFEKETMKYKN

SEQ ID NO: 970 - protein, 319 aa, Geobacillus stearothermophilus
MKRIGVLTSGGDSPGMNAAIRSVVRKAIYHGVEVYGVYHGYAGLIAGNIKKLEVGDVGDIIHRGGTILYTARCPEFKTEEGQKKGIEQLKKHGIEGLVVIGGDGSYQGAKKLTEHGFPCVGVPGTIDNDIPGTDFTIGFDTALNTVIDAIDKIRDTATSHERTYVIEVMGRHAGDIALWSGLAGGAETILIPEADYDMNDVIARLKRGHERGKKHSIIIVAEGVGSGVDFGRQIQEATGFETRVTVLGHVQRGGSPTAFDRVLASRLGARAVELLLEGKGGRCVGIQNNQLVDHDIAEALANKHTIDQRMYALSKELSI

SEQ ID NO: 971 - protein, 317 aa, Bordetella parapertussis
MNPPKHAKVLILGSGPAGYTAAIYAARANLAPLVVTGLAQGGQLMTTTDVDNWPADPDGVQGPDLMQRFLRHAQRFDAGVVSDAIHTVRLDRRPFALTGDQGAYTCDALVIATGASAKYLGLSSERAFMGKGVSGCATCDGFFYRNRDVLVVGGGNTAVEEALYLSNICRTVTVVHRRDRFRAEPILVDRLQARAALGKVKFEYFHELDEVLGDASGVTGARLRDNRDGTARDVAAKGVFIAIGHAPDTGLFEGQLALRNGYIVTRGGLSGLATMTSIPGVFAAGDVQDQIYRQAVTSAGTGCMAALDAQRWLEGAA

SEQ ID NO: 972 - protein, 266 aa, Ustilago maydis
MPTFQHTDYIAAFDTALDTGTAMAQDDSAFTSLPPPTQHPFKKVFKMGRRPARCYRYCKNKPFPKSRYNRGVPDPKIRIYDLGRKKASVDDFPFCAHLVCDEHQQITSEALEAARICANKYITKTSGKDSFHLRVRVHPFHVIRINKMLSCAGADRLQTGMRGAYGKPYDTVARVNIGQILLSVRTRDSNKAVVLEALRRSRYKFAGRQKIIISKKWGFTNMNREQYAEAKQSNRILKDGCYLQYINNHGPLEQNLRLQARVAAQK

SEQ ID NO: 973 - protein, 488 aa, Bacillus subtilis
MSNQDQALIFELSREGRIGYSLPELDVPEIELGDLLSDTYIRDEDAALPEVSELDIMRHYTALSKRNHGVDSGFYPLGSCTMKYNPKINEKIARIPGFAAIHPLQDEDTVQGALELLYDLSKHLEEITGMDEVTLQPAAGAHGEWTGLMMIRAYHEARGDFKRTKVIVPDSAHGTNPASATVAGFETVTVKSNEKGLVDLEDLKRAVNEETAALMLTNPNTLGLFEEQITEMAEIVHQAGGKLYYDGANLNAVLSKARPGDMGFDVVHLNLHKTFTGPHGGGGPGSGPVGVKQDLIPYLPKPVLVKKEGRFTFDYDRPHAIGRVKPYYGNFGINVRAYTYIRSMGPDGLKAVTENAVLNANYMMRKLAPYYDLPFDRHCKHEFVLSGKRQKKLGVRTLDIAKRLLDFGYHPPTIYFPLNVEECIMIEPTETESKETLDAFIDAMIQIAKEAEENPELVQEAPHTTIVKRMDETKAARHPVLRYEAEER

SEQ ID NO: 974 - protein, 448 aa, Bacillus subtilis
MKHRYLPATEKDKQEMLATIGVSSIDDLFADIPENVKYKKEHQIKKAKSETELTRELTKLASKNRDTVQYASFLGAGVYDHYQPVIVDHVISRSEFYTAYTPYQPEISQGELQAIFEFQTMICELTGMDIANSSMYDGGTALAEAAMLASGHTKKKKIVVSKTVHPESREVLKTYAKGQYIDVVEVPAADGVTDLDALRQTVCENTAAVIVQYPNFFGRIEPLKDIEPIAHQGKSMFIVSANPLALGLLTPPGKFQSDIVVGDAHRFGIPSAYGGPHCGFFAVTKKLMRKVPGRLVGQTEDENGKRGFVLTLQAREQHIRRDKATSNICSNQALNALAASVAMTALGKNGVKDIARQNLLKANYAKQEAKKAGLTVMFDGPMFNEFVIKLDEPVRAVNKRLLAKGMIGGYDLGLTYPELDCHMLIAVTELRTKEEIDALIQELGDRHE

SEQ ID NO: 975 - protein, 648 aa, Zea mays
MAPHLLAVAVAVAAIIATVSLLAPGAAAYPWPVCGTSNDFEPNSTYQANLNLLAAMLPNNVSASPVLYATAVVGAVPEQVWGMGLCRGDANASSCLACLTQAFQDLPNDCSYNKDAAIYYDPCTLHYSDVHTLADDDTGPTTMSYNINNNANVTSDPARFERLLAALVNATAEHAASNSTRRFATGEADADFDRQFPKVYALAQCTPDQTPAQCRKCLAGLISQSLDGFQNNIGGRVLWVNCTWRYETSPFFNGPAMVRLASSSSPPAAAAAGGGERKYSVFIVVLAVVLPTLAALNLVFCFCFWRRPAPQAKQSQPMYSTEAEDVETVDSMMIDVSALRAATGNFDESNKLGEGGFGAVYKGVLPDGDEIAVKRLSKSSTQGVEELKNELALVARLRHRNLVRLVGVCLEQQERLLVYEFVPNRSLDLVLFGTDTREPLSWEQRYRIINGIARGLQYLHEDSQLKVVHRDLKASNILLDVEMNPKISDFGLARIFGRDQTQAVTSRVVGTYGYLAPEYLMRGNYSVKSDAFSFGVMVLEIVTGRKNNGSSHKSGDLLTTVWEHWEAGTVAELVDPSLGGSFPEGDVLRCIHIGLLCVQGDPAARPVMSSVVTMLGTDTVTLQAPSKPGFFARKSGTSTTVSADDGSI

SEQ ID NO: 976 - protein, 179 aa, Staphylococcus epidermidis
MHKDLKNVLLSEEDIQNICKEMGAIITEDYKDRPLVCVGILKGSVMFMADLIKRIDTHLSIDFMDVSSYHGGTESTGEVQILKDLGASIENKDVLIIEDILETGTTLKSITELLQSRKVNSLEIATLLDKPNRRKADIEAKYVGKKIPDEFVVGYGLDYRELYRNLPYIGTLKAEVYSK

SEQ ID NO: 977 - protein, 782 aa, Oryza sativa
MDSIGINRAPLGSSSSAAAVTARRGIALRPARRSVASTNRVGVATIGFGDASGLRACSEKVRRFDSVRSTTARAQNGNAGRSMTEERGCTMSDTEMPFKYSSGKAFPLGVSQVEGGLNFALFSQHASSVILCLKLPGRGTEDEKGADVVEFVLDQQKNKTGDIWHVIVEGLPASGVLYGYRVGGPQGWDQGHRFDSSTVLLDPYAKLVSGRKYFGVAEEKSSQHFGTYDFDSSPFDWGDDYRLPNLPEADLVIYEMNVRAFTADESSGLDSTSRGSYLGLIDKIPHLLELGVNAVELLPVFEYDELEFKRYPNPRDHMVNTWGYSTINFFAPMSRYASAGGGPVAASKELKQMVKELHKAGIEVILDVVYNHTNEADDAHPYMTSFRGIDNKVYYMLDLNKNAELLNFSGCGNTLNCNRPVVKELILDSLRHWVEEYHIDGFRFDLASVLCRGPDGCPLDAPPLIKEIAKDAVLSRCKIIAEPWDCGGLYLVGRFPNWDRWAEWNGKYRDDLRRFIKGDPGMKGVFATRVSGSADLYQVNERKPYHGVNFVIAHDGFTLCDLVSYNLKHNDANGEGGCDGCNDNFSWNCGVEGETNDLNVLSLRSRQMKNFHVALMISQGTPMMLMGDEYGHTRYGNNNSYGHDTCINNFQWEQLEQRRDGHFRFFSEMIKFRHSNPILRRDRFLNKNDVTWHEDCWENQESKFLAFTVHDHNSGGDIYLAFNAHDYFVDAVIPPPPHHKCWNRVVDTNLESPNDIVPEGVPFTGPKYRIAPYSSILLKAKP

SEQ ID NO: 978 - protein, 133 aa, Staphylococcus epidermidis
MSIEVGNKLKGKITGIKKFGAFVELPEGKSGLVHISEVADNYVENVEDHLSVGDEVEVKVLSIADDGKISLSIKKAKDRPRKPRHSKANHGKPVQKTEDFEKKLSNFLKDSEDKLTSIKRQTESRRGGKGSRR

SEQ ID NO: 979 - protein, 72 aa, Streptococcus pyogenes
MAKEDVIEIEGKVVETMPNAMFTVELENGHQILATVSGKIRKNYIRILVGDRVTVEMSPYDLTRGRITYRFK

SEQ ID NO: 980 - protein, 102 aa, Taraxacum officinale
RRVKFTPTYLQSAGLNLKHVYIRSLLASICFHAYQQVAYMILQRVSPVTHSVGNCVKRVVVIVSSIFFFRTPISLINSIGTGIALAGVFLYSQVKRIKPKTT

SEQ ID NO: 981 - protein, 236 aa, Nandina domestica
MTRRYWNINLEEMMEAGVHFGHGTRKWNPRMAPYISAKRKGIHITNLTRTARFLSEACDLVFDAASRGKQFLIVGTKNKAADSVASAAIRARCHYVNKKWLGGMSTNWSTTETRLHKFRDLRAEQKTGRFNRLPKRDAAMLKRQLSHLQTYLGGIKYMTGLPDIVIIVDQQEEYTALRECVTLGIPTICLIDTNCDPDLADISIPANDDAIASIRFILNKLVSAICEGRSSYIRNR

SEQ ID NO: 982 - protein, 516 aa, Aspergillus oryzae
MPSEDQNQQFKRIGIVGAGNMGSMMAFAFSELGLDVSIWDVKKENVDQLLQSAKDIKGQGKIEGFEDIGEFTQSLEGQGERKLFIFSITHGDPADSVLSKIKHALKKGDIILDGGNENYRRTERRQKECEEIGVSWIGTGVSGGYQSARRGPSLSPGGDEKALELVLPLLERYAAKDRKTGQPCVARVGPAGSGHFVKMVHNGIEGGMLSAVAEAWSILHYGLGLKYDEIGDIFDEWNQKGELRNNFLLDIGADVCHRRKSPEGDGKGEGIGEKNEYVLDDVLDKVVQDDDDTEGTPYWCVMETANRHVSAPTIATGHYMRIASGNRAERLRVAEKLRMPKPKPIEGIKDRRLFIEDLRRAVYCCFLSSFCQGLELIARASDDEGWNIDLSKCLQIWRGGCIIQSEAIADLLQPLLKKDVHYTNLKDIDEVAHALKHNFDSLKRIVIDSTVFDQYIPAISATLEYLKYAGGTMLPTKFMEAQMDLFGAHAYYKPGVPGEDPGPVKKGPHHYEWRPA

SEQ ID NO: 983 - protein, 382 aa, Phaseolus vulgaris
MAIDCMTNIQTMSQPQKHHHQDNKEDEAPLVFDASLLRHQLNLPKQFIWPDDEKPCMNVPELVVPLIDLRGFLSGDPVATMEAARMVGEACQKHGFFLVVNHGIDANLISHAHSYMDDFFEVPLTQKQRAQRKTGEHCGYASSFTGRFSSKLPWKETLSFQFSAEEKSSTIVKDYLCNTLGQEFEQFGRVYQDYCDAMSNLSLGIMELLGMSLGVGKACFREFFEENDSIMRLNYYPPCQKPDLTLGTGPHCDPTSLTILHQDQVGGLQVFVDNEWHSINPNFNAFVVNIGDTFMALSNGRYKSCLHRAVVNSKTTRKSLAFFLCPKGDKVVSPPSELVDDLTPRLYPDFTWPMLLEFTQKHYRADMKTLEAFTNWLQQKRS

SEQ ID NO: 984 - protein, 243 aa, Volvox carteri
MALMMKRSAVAARPAVSRKAVVTCVARQSWLPGSEIPKHLDSPAALAMAGNFGFDPLGLGKDAEALRWYQQAELVHARTAMTAVAGILIPGLLTKAGALNVPEWYDAGKVAIESSFAPFGALLAVQLFLTGFVEAKRWQDFKKPGSQAEKGSFLGFETAFAGTGDNGYPGGIFDPLGLSKDADKLADWKLKEIKNGRLAMVAFLGFTAQKFATGKGPIDNLAAHLADPWHVNYASNGVSVPFL

SEQ ID NO: 985 - protein, 261 aa, Picea glauca
MEDMNMNIGGAATFYGVNMNEYGDTGVGSMMALMTEQEPGNESIMSTMTMTIPSSAFSSYSHAGQVEGLLSAAAATMFNQGGHHHHQKHLVGGHFPPEQLVMNEQAAVISDSSLSSVKTEVCSNQLEFHRKTSGGGRSCCPQPSLVVRAPQQQQHHHHHHQEASRMVTSLEVDIDSACSSNPNDSIDTLKTKIACHPHYPQLLAAYMDCQKIGAPPEVVTVLDEISQENQLGRHLATMDIGVDPELDQFMEAYCQMLIKYH

SEQ ID NO: 986 - protein, 214 aa, Volvox carteri
MIAAKSQVALGRRAPVRGQRAVCAATARPTWLPGLSPPAHLKGSLAGDSGFDPLGLGQDEGRLKWYAEAEKTNGRWAMMAVTGILGQELLGVTPSWYEAGAKEYDIPSTPLTAIEFIVMGFLEIKRYQGFKTTGTSGFINSFPFDPAGLNSASMATKEVKNGRLAMVAFVGFAVQALVTRTQPIEGLTKHLSDPFGKNITYYVTHLPEVLAGTA

SEQ ID NO: 987 - protein, 138 aa, Oryza rufipogon
SDDKALKRHLLRKYSGYLGGLRKELSKKRKKGKLPKEARQKLLTWWELHYRWPYPSEMEKIALAESTGLEQKQINNWFINQRKRHWKPTEETQFAVMEAYHHQSTDAAAAFYVDVDARLVGATAVAPASAVYTARPDH

SEQ ID NO: 988 - protein, 254 aa, Ralstonia metallidurans
MDRQHGKATGKVYLIGAGPGAADLITVRGARLLGEAQVVLHDALVSPEMLAWCPQAELVEVGKRCGQRSTAQLFINRQIVDLATKHERVVRLKGGDPMLFGRADEELQALEAAGIEYEVVPGITAALAAASAIGRPLTKRGVSRSVAFATQAKAADAVDVEADVKADTIIYYMGRDQAANIATQLIARGKPASTPAWVVEAATTPRQRSHQFTLGQMAAGEAARWMDPVQPSLLMIGEALGSRATEYVEAERAA

SEQ ID NO: 989 - protein, 2578 aa, Corynebacterium diphtheriae
MRDSALPRYFRALVAVISAISLVGVGLHATQPTARADEELAPAVVAGTFQKNLGCSKEWEESCDKTRMKRKGNLYATTLKIPEGDWKFKVVLNGDWGTSYGAPGFDENNIPLKLTKDTELEFSFDPLSHRIGLKPVGLDDEKLKTYDDSKDKDIVGAPFKHSAAGKNFYFVLTDRFQNGNPENDRGGAKDGDKNDHGFDPTDKAYYHGGDIEGLIKQLDYIKNLGTTALWLTPSFKNRAVQCGHDPKDCSSGYHGYWITDFTQIDPHLGSNDDLKRLIEEAHNKGIKVYFDIVANHTADLIQLAGGNQYISEDQQKYKDVDGKEFLLKDYAGKKEFPELNDFSFPYKPIRKPEDNIIVPKELNDVHLYHNRGNNTWEGESVIHGDFEGLDDLMTEHPKVVSHMIEAYNKWAGFGLDGFRIDSVKHVNMEFWKEWTEAVKKHAKESRAGEKEDFFMFGEVFNGTAESLSPFVRDTQMDAALDFAFHYKALDFAKGQSTQGLHDLFYSDDWYTTTRSDATNLPTFLGNHDVGRIGYLLRDNDDKVQRDVLAHQLMFLTRGQPVVYYGDEQGFAGTGDGKDKQARQDMFGTQVDEFKNEQDIYGKQLGSDNHFKESGELYGKIKQLAELRTANKALATGAQIERWETPGPGIYAFSRVDRDEKQEYLVALNNSHLEQTATPAPLTPNASFTKIYGEGPDKISPNLDGTVNLKLPRLSAVVYKVESNQKVSGAVDGTGLSVKGQALKDNAPIMTNIGGKAWSETSFAWRELGTEEWKKLGTDTGQNARVFHDVRDLKPGTIVEYRTVTVDADNNKTASTGWGVVGVDLGVDTAALLAPSAVVAGDFTKDLGCTGGDQGNWDPACAKTELKSVGGTDWHTVKLNLKAGEHQYKIAVAGSWNENYGQEKDGDRPNDRGYHNGKNVKFNLDREQEVQFFYNPVTNEFFNSVEHGVITLPGTMGGALNCPKNDQKSDEHGNWGPACLATLMTKTGDHIYEFSSPKVPTPGNYDVKVAYGLEWGNDWGPDGHKTQRNYDVKITDSGILHYRWDENKHELTWNITERSSLDLQDTFAHWLDDRTIAVPRSQLRDASPSDVEGLLVSVSDGKPSIKSGKGASSQADAKIEEQKLHYVGQIGGDLLARNPHLDGMVTFRFKDEVQKDKARELLQGGLGFAVVKKKEQEPVSFTGVQIPGVLDAHYAADARDAQLGVHWKGDKPTVSLWAPTAKNVKLKLFGEEGSLGNGEDHKMDYDKTTGVWSVEGKPDWKNHAYQFEVEVYAPSTHKVEHNLTTDPYSVGLSMDSKYSVMLNLNDPELKPADWGKAMDPIDPVDRMIYELHVRDFSASDKSMDQQYRGKYKAFTQSGSKSVMHLKELADAGLNSVHLLPTNDIATIPEDPAKAKTPAITSTGAADTQQQEAVAAVQKEDAFNWGYDPYHYMAPEGSYATKPDAKTRVKEYREMVKALNGMGLHVVSDQVYNHAFQGQQDEKSVLDKVVPGYYHRLMLDGKIANSTCCANLATEHVMMEKLMTDSVKSWAKNYHIDGFRFDLMGHHSAANMINVQTELSELTVEKDDIDGSSIYLYGEGWNFGEVENNQRFIQATQENLAGTGIGTFNDGLRNGVHGHEGRTQGFGTGLAMEGNGTDQKDQGHLRHLTDIVRVGMAGNLQDFKFNSKDGYKRGGDIWLDGKRIGYGLMPQDTVNYVDAHDNQTLYDLSVLQLPQSLSMDDRVRMNTVQLATVALGQSPAFWHAGTEIMRSKSLDRDSYNSGDHFNKLDLSMQEHNFGVGLPIAEKNDKQWELYKGFLNDEHLKAKPEDLKKANDMAKELMTLRKDNPLMRLGDVDQIQEKVTFPANGPDAQPGLIVMNIDDTKGEDRDAKRDGILIVINSSPKQIEQTINELEGLDFTLEKTLAEGVDKETQKGSTWNKAEKKLTIPARTVAVFERTQNEAAHHDPQYPETKVFKDATEDVKVEGPKDMPETAKYSIDPAVDGVSVDEKTGALTVKPTAIKEDGLVVTVTVKYSDGSEDRAVAKFVTDTSIASMYDPTYEETKAESADKKVTIKKPMSGEKSLPEDAHFTLEGESAKKATIDGFTGEITVEPLKDERRLELDVKVTYADESVDMVKAVVVAGDTLADQHDPKYADTQMEKGTKTVIAAPEGMPENIKYELAEPQDGVTVRDDGSIEVTTDAESLDIKVKVTYSDKSTDTAVAHVTTVAQTEQSVEVTPGTQTLVDVPGNGDVTVTVPQNSGLKAEVAGNLVTLTSDGSVEGHVTVTYQVKDADGKTTTGKINVQVAKLAEASWPKSASVAAGDSTVITPEGVDTLPYGTTLSVGSLPEWATFDQTTGQLTLTADEDATDESTTATITVAYPDGLTKQYSVALSVGAATETTADQHDPQWESVVVNGDSVTSHGVDVPADAEVSVDKLPEGWTATVTGSDVEITPAAGSPAGHVIALPVTVRYADGTTDTAVINVLTQPDWSTSNKAPKADSGMFYQAGPGAPAWVRVNNDGSMTWADNAPEGTHEIPVIVTKDGVHYLVTASVNAPKKVVLDTEGSSSILGVVVAILAAGGIMALFALLFNCTWFKNCR

SEQ ID NO: 990 - protein, 698 aa, Staphylococcus aureus
MSQEKKVFKTEWAGRSLTIETGQLAKQANGAVLVRYGDTVVLSTATASKEPRDGDFFPLTVNYEEKMYAAGKIPGGFKKREGRPGDDATLTARLIDRPIRPLFPKGYKHDVQIMNMVLSADPDCSPQMAAMIGSSMALSVSDIPFQGPIAGVNVGYIDGKYIINPTVEEKEVSRLDLEVAGHKDAVNMVEAGASEITEQEMLEAIFFGHEEIQRLVDFQQQIVDHIQPVKQEFIPVERDEALVERVKSLTEEKGLKETVLTFDKQQRDENLDNLKEEIVNEFIDEEDPENELLIKEVYAILNELVKEEVRRLIADEKIRPDGRKPDEIRPLDSEVGILPRTHGSGLFTRGQTQALSVLTLGALGDYQLIDGLGPEEEKRFMHHYNFPNFSVGETGPVRAPGRREIGHGALGERALKYIIPDTADFPYTIRIVSEVLESNGSSSQASICGSTLALMDAGVPIKAPVAGIAMGLVTREDSYTILTDIQGMEDALGDMDFKVAGTKEGITAIQMDIKIDGLTREIIEEALEQARRGRLEIMNHMLQTIDQPRTELSAYAPKVVTMTIKPDKIRDVIGPGGKKINEIIDETGVKLDIEQDGTIFIGAVDQAMINRAREIIEEITREAEVGQTYQATVKRIEKYGAFVGLFPGKDALLHISQISKNRIEKVEDVLKIGDTIEVKITEIDKQGRVNASHRALEE

SEQ ID NO: 991 - protein, 391 aa, Candida tropicalis
MCTSANNRLDQLTQILHPENLLNPTNASHPESSLRPDHPFKIAVVGSGNWGTTIAKIVSENAVARPHLFSHFVNMWVFEEKIDGTNLTEIINTRHENIKYLPGVKLPKNLIAVPDIVKAVKGADLIVFNLPHQFLPRILKQLKGHVPKTTRAISCLKGLEVNANGCKLLSTVIEEELGIACGALSGANLAPEIARGNWSETTVAYRVPADYRGPGKDIDKLVLKALFHRPYFHVNVIDDVAGVSIAGALKNVVALAVGFVEGLGWGDNAKAAVMRVGLLETIKFAKLFFNDAEIDTFTGESAGVADLITTCSGGRNVKVGRYMAETGCAAEEAEKKLLNGQSSQGIVTTKEVHEFLTNVNKLEEFPLFEATYQITFGSESIENLPNLLNNY

SEQ ID NO: 992 - protein, 750 aa, Solanum tuberosum
VKRPMKFTMDQLVNEFPSRELPVTLVCAGNRRKEQNMVKQTIGFNWGAAAVSTTVWRGVPLRALLKRCGVQSKKKGALNVCFEGSDVLPGGGGSKYGTSIKKEFAMDPSRDIIVAYMQNGEMLSPDHGFPVRMIIPGFIGGRMVKWLKRIVVTTQESESYYHYKDNRVLPPHVDAELANAEAWWYKPEYIINELNINSVITTPCHEEILPINAWTTQRPYTLRGYAYSGGGKKVTRVEVTLDGGETWSVCTLDHPEKPTKYGKYWCWCFWSLEVEVLDLLSAKEIAVRAIDETHNTQPEKLIWNVMGMMNNCWFRVKMNVCKPHKGEIGIVFEHPTQPGNQSGGWMAKERHLEISAVAPPTLKKSISTPFMNTASKMYSMSEVRKHNSSDSAWIIVHGHIYDASRFLKDHPGGVDSILINAGTDCTEEFDAIHSDKAKKLLEDFRIGELITTGYTSDSSPNTSVHGSSSISSFLAPIKELVQTPTRSVALIPREKIPCKLVDKQSISHDVRKFKFALPSEDQVLGLPVGKHIFLWAPVDDKLCMRAYTPTSTVDEVGFFELVVKVYFKGVHPKFPNGGQMSQHLDSLPIGAFLDVKGPLGHIEYQGKGNFLVHGKQKFAKKLAMIAGGTGITPVYQVMQSILKDPEDDTEMYVVYANRTEDDILLKEELDAWAEQIPDRVKVWYVVQESITEGWKYSTGFVTEAILREHIPQPSHTTLALACGPPPMIQFAINPNLEKMGYDIKEELLVF

SEQ ID NO: 993 - protein, 911 aa, Solanum tuberosum
MAASVENRQFPHLEPGLSGVGRNFKPRPDSPVRGCNFPPSSNHELPFQKQQNLPIYLDYSSSEDEDDDDEKNEYVQMIKKGKTELEPSIHDTRDEGTADNWIQRNFSLIRLTGKHPFNSEPPLARLMHHGFITPVPLHYVRNHGPVPKASWADWSVEVTGLVKRPMKFTMDQLVNEFPSRELPVTLVCAGNRRKEQNMVKQTIGFNWGAAAVSTTVWRGVPLRALLKRCGVHSKKKGALNICFEGSDVLPGGGGSKYGTSIKKEFAMDPSRDIIVAYMQNGEMLSPDHGFPVRMIIPGFIGGRMVKWLKRIVVTTQESESYYHYKDNRVLPPHVDAELANAEAWWYKPEYIINELNINSVITTPCHEEILPINAWTTQRPYTLRGYAYSGGGKKVTRVEVTLDGGETWSVCTLDHPEKPTKYGKYWCWCFWSLEVEVLDLLSAKEIAVRAIDETHNTQPEKLIWNVMGMMNNCWFRVKMNVCKPHKGEIGIVFEHPTQPGNQSGGWMAKERHLEISAVAPPTLKKSISTPFMNTASKMYSMSEVRKHNSSDSAWIIVHGHIYDASRFLKDHPGGVDSILINAGTDCTEEFDAIHSDKAKKLLEDFRIGELITTGYTSDSSPNTSVHGSSSISSFLAPIKELVQTPTRSVALIPREKIPCKLVDKQSISHDVRKFKFALPSEDQVLGLPVGKHIFLCATVDDKLCMRAYTPTSTVDEVGFFELVVKIYFKGVHPKFPNGGQMSQHLDSLPIGAFLDVKGPLGHIEYQGKGNFLVHGKQKFAKKLAMIAGGTGITPVYQVMQSILKDPEDDTEMYVVYANRTEDDILLKEELDAWAEQIPDRVKVWYVVQESITEGWKYSTGFVTEAILREHIPQPSHTTLALACGPPPMIQFAINPNLEKMGYDIKEELLVF

SEQ ID NO: 994 - protein, 1033 aa, Vibrio vulnificus
MLINATQKEELRVALVDGQRLYDLDIESPGHESKKANIYKGRITRVEPSLEAAFVDYGAERHGFLPLKEIAKEYFPDGYSYQGRPSIKEVLTEGQEVIVQIEKEERGSKGAALTTFISLAGSYLVLMPNNPRAGGISRRIEGDERTELKSALSTLELPQGMGLIVRTAGVGKSAEELEWDLNVLLKHWAAIKDASESNPAPFLIHQESNVIVRAIRDYLRRDIGEILIDSNTIYERAKEHIQLVRPDFVNRVKKYDGEVPLFSHYQIESQIESAFQREVRLPSGGSIVIDPTEALTSIDINSARATKGGDIEETALNTNLEAADEIARQLRLRDLGGLVVIDFIDMTPVRHQREVENRLREAVRLDRARVQIGRISRFGLLEMSRQRLSPSLAEASHHICPRCSGTGVVRDNESLALSVLRLIEEEALKDNTAQVLAVVPVPIASYLLNEKRRSVNHIERIQEVKITVVPNSDMETPHFEVIRVREGEEVDLLSYLLPKKLEAMKEAEGKESPETEYKPKKIEEPVLKGFASPAQSVPAPAPKAAVAKVANEKPQAEEKPGLFGRLIKALGSFLFGSAEEKVEAEKTERKDEREKGNRRQKRDRNDRRRNNRDNNRENNRDRDGKRRQRNRDENVVETQDEAIKPRSQQKRKQRPAQNKADNAVESKANAKVAEKGLQLAAEAQGASKQEGQKTPSKAEKVKERRQRRKLNKPVRVKDQLEQAEETLMDAAPVVEAETFNKQNTPASEKAEKVVADTVDAMDNSENEEKPRRNRRSPRHLRASGQRRRRGRDRRPNPFRLRKGGVASPEMAMGKVMPRYIPKPVAKKEEMVKEEVVTAVTAVPAMQGGVACPEMAMGKVIIRRDITAAQTPTETKPKRSKSRNNKPAKAAVVEVVTEEPTVENAVVATIQETDVQKIEPQVESVSQPVEQVSVETTEVVAEIVETTEVVAEVESATETVANETEATVAVVESSIKVIKAQASAPMTKAPGPQELIEIQVVAAPFKAERYAQRGAGSQVATSQASAAMTKPEMV

SEQ ID NO: 995 - protein, 356 aa, Solanum lycopersicum
MDGKENNGVNGSNKVGIPKCCLKARVFDPELEANCHSTVVSGWFSQPPTSFDGKEKVLYFNNPMWPGEAHSLKVEKVLFKGKSEFQEVLVFESASYGKVLVLDGIVQLTEKDECAYQEMIAHLPLCSIKSPKKVLVVGGGDGGVLREISRHSSVELIDICEIDKMVIDVSKKYFPDLAIGFEDPRVNLHVGDAVEFLKNTPEGKYDAIIVDSSDPVGPAIELVEGPFFAKIARALRPGGVLCNMAESMWLHTHLIQDMISICRETFSSVHYAWASVPTYPSGVIGFLLCSTEGPFVDFKHPVNPIEKLEGALQHQRELKFYNSEMHEAAFALPCFLRREVSGLRDSPRSAGSGVKI

SEQ ID NO: 996 - protein, 512 aa, Apium graveolens
MENGTKELNKQPPPSAAMQVQTSPPKLPIATWKLILVAAIAAGVQFGWALQLSLLTPYVQLLGIPHKWAAYIWLCGPISGMLVQPIVGYYSDRCQSSFGRRRPFIASGAGCVAISVILIGFAADIGYKAGDDMNKTLKPRAVTVFVIGFWILDVANNMLQGPCRALLADLCNGDTRRMRSANALYRFFMAVGNILGNAAGSYNNLYKLFPFSKTHACDLYCANLKSCFIISIVLLIFITVLALTVVREKQWSPDEADEEPPSSGKIPVFGELLRALKDLPRPMLMLLAVTCLNWIAWFPFILFDTDWMGREIYGGTAGQGKLYDQGVRVGSLGLLLNSVVLGLTSIAVEYLVRGVGGVKILWGLVNFLLAIGLVMTVVVSKVAQHQRQHGANGQLLPPSAGVKAGALSLFSILGIPLSITFSIPFALASIYSSGSGAGQGLSLGVLNLAIVVPQMIVSVLAGPFDSLFGGGNLPAFVVGAISAAISGVLAIVLLPKPCKDAAAKLTLSGPYH

SEQ ID NO: 997 - protein, 576 aa, Bordetella pertussis
MDSNLMSSVSTSAILGGENFADLFAESLKSQDMKSGEVISAEVVRVDHNFVVVNAGLKSEALIPLEEFLNDQGELEVQPGDFVSVAIDSLENGYGDTILSRDRAKRLSAWLQLEQALENGELVTGTITGKVKGGLTVMTNGIRAFLPGSLVDLRPVKDTTPYEGKTLEFKVIKLDRKRNNVVLSRRQVLEASMGEERQKLLETLHEGAVVKGVVKNITDYGAFVDLGGIDGLLHITDMAWRRVRHPSEVLQVGQEVEAKVLKFDQEKSRVSLGVKQLGEDPWVGLARRYPQGTRLFGKVTNLTDYGAFVEVEAGIEGLVHVSEMDWTNKNVDPRKVVTLGEEVEVMVLEIDEDRRRISLGMKQCRQNPWEEFATNFKRGDKVRGAIKSITDFGVFVGLPGGIDGLVHLSDLSWTESGEEAVRNFKKGDELEAVVLGIDTEKERISLGIKQLEGDPFNNFVATHDKGAVVPGTIKSVEPKGAVITLSVDVEGYLRASEISSGRVEDATTVLKAGENIEAMIVNIDRKARSIQLSIKARDNAETAETIQRMSEASASSGTTNLGALLKAKLDQQRNDG

SEQ ID NO: 998 - protein, 362 aa, Haemophilus influenzae
MQPTLFIDRDGTLIDEPKTDFQIDSLEKLKLEPKVIPALLRLKAKYRFVIVSNQDGLGTDAFPQTNFDKPHNVMMALFESQGITFDEVLICPHKPEENCLCRKPKIKLLDHYIRKNLFDIDRSFVIGDRETDMQLAENLGIRAIQYDPQKMNWDLIAEKLLGETVTNCGKRPPRFAEVIRQTKETDIKVQVWLDEAGVNEIKTGVGFFDHMLDQIATHGGFRMNVQCKGDLWIDEHHTVEDTALALGQALKQAIGDKRGIARFGFVLPMDECKAECALDLSGRPWIKFNACFKRDKVGDFSTELTEHFFQSLAFSMLATLHLNVTGNNDHHKIESLFKAFGRTLRQAIRIEGNEMPSSKGVL

SEQ ID NO: 999 - protein, 492 aa, Clostridium perfringens
MSKKAYIIGAGPGDEELLTLKAINALQKCTAVLYDRLVGNNILNYLNDDCEIYYCGKEPGCHYKTQEEINESIVELAKKGHVVGRVKGGDPYVFGRGGEEVLALVEENIPFEVIPGVTSPISVLNYAGIPITHRGLAQSFHIVTGMSARTLNVNWEALSKENGTLVFMMGLSNLETIVEKLLENGKDIETPCGVVMRGTTSKQRKVIGTLENICKKVREAKLESPCIIVVGDVVSLNEKLSWYEKLPLFGANICLTRSKEQSKEIKWKLKELGAEVTEINSIKIKKTAENLDEYINTLEKYDHIVFTSVNAVNVFFDYLVKNRVDIRKIKADFAVLGKATKKALISRGIVPSIMAHSFTAEGLFEVLKDNIKEGEEVLIPCSSLSREYLFDNLASLGAKCHRVNIYDTVCGDVKNPRAFKEVDMVLYTSPSTVKNMIDMIGLEALKEKVSIAIGPITLKALNESGIEGKMCKTHCGDGFLSEIEGIWQEVKK

SEQ ID NO: 1000 - protein, 185 aa, Brassica napus
MASEAKESAANNPGLSTVRDEATKGYIMQQTMFRVKDPKASLDFYSRVLGMSLLKRLDFSEMKFSLYFLGYEDTSTAPTDPTERTVWTFGRPATIELTHNWGTESDPEFKGYHNGNSEPRGFGHIGVTVDDVHKACERFEQLGVEFVKKPNDGKMKNIAFIKDPDGYWIEIFDLKTIGTTAGNAA

SEQ ID NO: 1001 - protein, 212 aa, Brassica rapa
MKWFEVPGFNIIHAINAWDEDDGDTIVLIAPNIMSIEHTLERMELVHALVEKVKIDLVTGIVTRHPISARNLDFAVINPAFVGRRSRYVYAAIGDPMPKISGVVKLDVTRGDRDDCTVARRMYGPGCYGGEPFFVARDPGDPEAEEDDGYVVTYVHDEVAGESKFLVMDAKSPELEVVAAVRLPRRVPYGFHGLFVKESDLNKLLTIESIGN

SEQ ID NO: 1002 - protein, 493 aa, Magnaporthe grisea
MALKSTPDHFWLSVEKVQHKSLSRWVTPSAMGCQPAGGCACLVFHTDRFPPAKVDLKSSSASHSFGSSLFTTAAIPGLDAPVFTTDSQQSPWLPSSSPSLPASSAQQHYQHLPPQQDFVLFDTPRRSHQPSRSISQSSAIGSASRNHPSASPSTQNQRVAQIIQATGHSTTSTAFTNRLSTQFPKQFYASSAPNSTVALTADRARPARPPVPLFSQSTGNVTQIQTKMNNTSGKSSPSSSASPSPPASSSSQNLHSSCSDLGLDDFTAFGGGASAFPSPAMPGVFDIASTTASTMGTVSPQDLFLSDNFMSAPNSTALTTLTSPSLYNGSPDFGDSYDVSPNFVGNDLESAGESAWFPLFPQENTNVAAPQLPQELAAPTQQQQSPAAGSEDLEAAPSPAPRRKSGNSPTSSTGRHSSVSGVNARRRDKPLPPIVVEDPSDTVAMKRARNTLAARKSRERKAMRFEELEDKLEKLTAERDHFKNLAKQYGAPV

SEQ ID NO: 1003 - protein, 353 aa, Glycine max
MEKVDQAFIQYPQHRPNLTIIQPEHIPIIDLSPITNHTVSHPSPIEGLVKEIGNACKEWGFFQVINHGVSLTLRQNIEKASKLFFAQSLEEKRKVSRDESSPMGYYDTEHTKNIRDWKEVFDFLAKDPTFVPLTSDEHDNRLTQWTNPSPQYPPHFRDIIKEYVEEMEKLSFKLMELIALNLGLEAKRFEEFFIKDQTSFLRLNYYPPCPYPHLALGVGRHKDSGPLTILAQDEVGGLEVRPKADQDWIRVKPIPNAYIINLGDMIQVWSNDAYESVEHRVVVNSEKARFSIPFFLFPAHDTVVKPLEELINEQNPSKFRPYKWGKFLVHRLDSNFKKQNAENVQTYHYKIRE

SEQ ID NO: 1004 - protein, 713 aa, Bacillus cereus
MLKVKRPFDAYLDEMNKITILLPHAYGTSRTFRLQEGSNVKDLPIAHTIALPDATKYECFIEEPLDVGKYYTVRDERNEETDLQIGAVIRTAIFDEKYYYEGTDLGAVHQKEATTFKVWAPTARLAKVRIYKSDKEYTDYEMYREENGVWAHTLHGDLAGEKYTFLVCINLIWNEAVDPYAKSVTVNGKYGVVIDLEKTNVTKRGQLPPLQAMTDAILYELHIRDATIHPGSGVSKKGTYKGLMEEGTTGRNGTLTGLSHIKDLGVTHVELLPLYCFGGVDEANPSSAYNWGYNPLYYNAPTGYYATNPSDPYNRIVECKQLIETFHEHGIRVIIDVVYNHVYERELSSFEKLVPGYYFRHGENGMPSNGTGVGNDIASERKMMRKFIVESILYWLTEYNVDGFRFDLMGILDVDTINIIEKEVRNIKRDALLLGEGWDLQTPLPLEEKATLNNAKKMPHIAQFNDQFRDGIKGSTFHINKRGFAFGGYVDCNHLQYIASGSLLSMKETGLFLEPVQSINYVECHDNMTMWDKLMRSNEESEEILKKRHLLATAMVILSQGIPFLHAGQEFYRTKQGNENSYNANDEINQLDWDRKEKEIETVNYIKGLIAIRKEHGAFRLQNADLIKKHMTFLQTSPEVLAYHLEHVESFGPWKEIVVLFNSSLEAKTVQLPKEETWHVLVNEKQAKIEPISSFRGKELRLAPISTYILTIM

SEQ ID NO: 1005 - protein, 112 aa, Unknown
  Synechococcus sp. RS9917
MKKVEAIIRPFKLEDVKLALVNAGIVGMTVSEVRGFGRQKGQVERYRGSEFTVEFLQKLKVEVVIDDARVDTVVTAIAEAAKTGEIGDGKIFISPIDTVVRIRTGDRDGSAL

SEQ ID NO: 1006 - protein, 99 aa, Synechococcus elongatus
MATYKVTLVNAAEGLNTTIDVADDTYILDAAEEQGIDLPYSCRAGACSTCAGKVVSGTVDQSDQSFLDDDQIAAGFVLTCVAYPTSDVTIETHKEEDLY

SEQ ID NO: 1007 - protein, 359 aa, Solanum lycopersicum
FISPDIAKIRKLVRQSKCLQDKMTAKESATWLAIINQEEVLARELYPDRCPPLSSGGSSGTFTMNDSSEYDVEGAIDDPIFDVQEQKPNHLSLLNVNVEMFKEKLPLLQQSQPMKGDIFANLDFTRKRKPADDLTFLMDPKTYTCECLHCPHSELRNGFPDRSSRDNHQLTCLFRNTSQFVVPNFHMEEVKPVVFPQQYVEPKRASLPVNPAPPSFDTSGLGVPADGQRVINELMSFYESNVQGNKSSMAGNSVMSKEQPLQQPSIQQNNYLQSQGNVLEGSIFGDTNISASNSMFVQGDRFDQSKVLTSPFNASSTDDFNFMFGSPFNMQSTDLSECLSGISHDDVKQQDVPVITSEF

SEQ ID NO: 1008 - protein, 293 aa, Mycobacterium avium
MPDWTAAQLPSFAGRTVIVTGANAGLGEVTARELARVGGHVILAVRNTDKGRAAADRMAGVATGRVEVRELDLQDLASVRRFADGIDTVDVLVNNAGIMATKHAVTVDGFEGQIGTNHLGHFALTNLLLPKLTDRVVTVSSLMHHFGYISLKDLNFRSRPYSAWLAYSQSKLANLLFTSELQRRLDAVPSSLRALAAHPGWSHTNLQGNSGRKLGDAAVLAVDRIVSTDADFGARQTLYAVSQDLPGDTFVGPRFGLYGRTQPTWRNWPAKRAGTAAALWELSEELTGTKFPL

SEQ ID NO: 1009 - protein, 727 aa, Oryza sativa
MDASAGSSAPHSHGNPGKQGGGGGGGGRGKAPAAEIRGEAARDDVFFADDTFPLLPDFPCLSSPSSSTFSSSSSSNSSSAFTTAAGGGCGGEPSEPASAADGFGELADIDQLLDLASLSVPWEAEQPLFPDDVGMMIEDAMSGQPHQADDCTGDGDTKAVMEAAGGGDDAGDACMEGSDAPDDLPAFFMEWLTSNREYISADDLRSIRLRRSTIEAAAARLGGGRQGTMQLLKLILTWVQNHHLQKKRPRTAIDDGAASSDPQLPSPGANPGYEFPSGGQEMGSAAATSWMPYQAFTPPAAYGGDAMYPGAAGPFPFQQSCSKSSVVVSSQPFSPPTAAAAGDMHASGGGNMAWPQQFAPFPVSSTSSYTMPSVVPPPFTAGFPGQYSGGHAMCSPRLAGVEPSSTKEARKKRMARQRRLSCLQQQRSQQLNLSQIHISGHPQEPSPRAAHSAPVTPSSAGCRSWGIWPPAAQIIQNPLSNKPNPPPATSKQPKPSPEKPKPKPQAAATAGAESLQRSTASEKRQAKTDKNLRFLLQKVLKQSDVGSLGRIVLPKKEAEVHLPELKTRDGVSIPMEDIGTSQVWNMRYRFWPNNKSRMYLLENTGDFVRSNELQEGDFIVIYSDIKSGKYLIRGVKVRRAAQEQGNSSGAVGKHKHGSPEKPGVSSNTKAAGAEDGTGGDDSAEAAAAAAAGKADGGGCKGKSPHGVRRPRQEAAAAASMSQMAVSI

SEQ ID NO: 1010 - protein, 74 aa, Arabidopsis thaliana
  misc_feature (32)..(32): Xaa can be any naturally occurring amino acid
  misc_feature (35)..(35): Xaa can be any naturally occurring amino acid
  misc_feature (45)..(46): Xaa can be any naturally occurring amino acid
  misc_feature (54)..(54): Xaa can be any naturally occurring amino acid
  misc_feature (56)..(56): Xaa can be any naturally occurring amino acid
  misc_feature (61)..(64): Xaa can be any naturally occurring amino acid
  misc_feature (66)..(66): Xaa can be any naturally occurring amino acid
MASSMLSSTAVVTSPAQATMVAPFTGLKSSAXFPXTRKANNDITXXTSNGGRDXCXKVWSXXXXEXGRCEIKLF

SEQ ID NO: 1011 - protein, 257 aa, Arabidopsis thaliana
  misc_feature (17)..(17): Xaa can be any naturally occurring amino acid
  misc_feature (80)..(80): Xaa can be any naturally occurring amino acid
MASSMLSSAAVVTSPAXATMVAPFTGSKLFAAFSVTRTTNKDITLIVSNGGRVSCMNVWPPIGKKKFATLSYFPDLSDVXLAHEVDYLLPIKCISCVALPLQHGLVVRALRAHFPLTFDGLALWPIRALLHFPRAPDSLSSLSLLSPFLHQCVLLSFPFTTNWFPSITLYSYSIPLIVFSLPLLTFLYSFLYTLFLHLLPIYSSSLLSPLLSPISHCPFTILLSYSTPSSLPLIYLVWLVLIFPYFLPFSPPSLPPF

SEQ ID NO: 1012 - protein, 230 aa, Zea mays
  misc_feature (138)..(138): Xaa can be any naturally occurring amino acid
MAGRDDLKLLGTWPSPFVTRVKLALALKGLSYEDVEEDLYKKSELLLKSNPVHKKIPVLIHNGAPVCESMIILQYIDEVFAGTGPSLLPADPYERAIARFWMAYVDDKLVAPWRQWLRGKTEEEKSEGKKQAFAAVRXLEGALRECSKGGGFFGGDGLGLVDVALGGVLSWMKVTEVLSGDKIFDAAKTPLLAAWVERFSELDAAKVSLPDVGRLLEFAKAREAAAAPSN

SEQ ID NO: 1013 - protein, 319 aa, Yarrowia lipolytica
MTHSPVVIIGSGPAAHTAAIYLSRAEIKPTLYEGMMANGIAAGGQLTTTTEIENFPGFPDGIMGSQLMEDMRKQSIRFGTEIITETVSKVDLSQRPFKYWTEFNEDEEPHTADAIILATGASAKRLSLPGEDQYWQQGISACAVCDGAVPIFRNKPLAVVGGGDSAAEEALFLTKYGSKVYVIVRKDKLRASAVMAKRLASHPKVEILFNHVSIEAKGDGKLLNALEIENTLTGEKRDLEVNGLFYAIGHIPATSIVKGQVETDEEGYVVTVPGTANTSVKGVFAAGDVQDKRYRQAITSAGTGCMAALDCEKLLAEEE

SEQ ID NO: 1014 - protein, 303 aa, Anabaena sp.
MTQAKAHADVPVNLYRPNAPFIGKVISNEPLVKEGGIGIVQHIKFDLTGGNLKYIEGQSIGIIPPGVDKNGKPEKLRLYSIASTRHGDDVDDKTISLCVRQLEYKHPESGETVYGVCSTYLTHIEPGSEVKITGPVGKEMLLPDDPEANVIMLATGTGIAPMRTYLWRMFKDAERAANPEYQFKGFSWLVFGVPTTPNILYKEELEEIQQKYPDNFRLTYAISREQKNPQGGRMYIQDRVAEHADQLWQLIKNEKTHTYICGLRGMEEGIDAALSAAAAKEGVTWSDYQKDLKKAGRWHVETY

SEQ ID NO: 1015 - protein, 714 aa, Rhodospirillum rubrum
MSAPSTPLVWPGQPFPLGATWDGSGTNFALFSAHAEKVELCLFDRAGRKETARIVLPEYTDEIWHGYLPDIRPGQMYGYRVYGPYDPNAGHRFNANKLLIDPYAKSLKGEILWHDALFAYKLGHPDGDLTFDRRDSARHMPKCEVVDPAFTWGRSMEPHPWHETVIYEMHPRGFTMLHPGVPEELRGTFDGLAHRRVTDYLTDLGVTAIELLPVHAYVQDRHLIDRGLTNYWGYNSIGFLAPHATYLGHGRTASAFKAFVQKMHDAGLEVILDVVYNHTAEGNHLGPTLSFKGIDNRSYYYLMGEDLRHYNNFTGTGNALELRHPRVLGMVMDSLRYWATAMGVDGFRFDLATTLARVEGPFTEHAGFLDAVAQDPVLSHVKLIAEPWDTGLGGYQVGAFPPGWAEWNDQYRNTIRKFWKGDDGLLPTMAGRFSASSDVFNRRGRRPWASVNFITAHDGFTLADLVSYNGKHNEANGEDNRDGSDDNNSWNCGAEGPTDDEEINTLRRRQMRNMLATLLLSQGTPMLLAGDEFANSQNGNNNAYCQDNALSWLDWDGIDEKARSQIAFVTSLLRLRREHVVFHRTRFFTGSVIPGTEVKDVVWLRPDGEEMTEADWGNSVSQALAIRLSGEAGLTHLDRRGRQQTDDTFLLVLNASHTEVVFTLPEGGRWETVIDTMDEDGQSSLPKADGGTIRALPGRSLQVLRCRAAHGRSA

SEQ ID NO: 1016 - protein, 100 aa, Glycine max
  misc_feature (23)..(23): Xaa can be any naturally occurring amino acid
  misc_feature (58)..(58): Xaa can be any naturally occurring amino acid
  misc_feature (63)..(63): Xaa can be any naturally occurring amino acid
  misc_feature (80)..(80): Xaa can be any naturally occurring amino acid
YYTTYVPTVILTNTMNNPASYTXLLEMKHVITHGRIESVLNYHTLMTDLTGLPKHNAXRLIKXTASAESLAMCNNILMGXRNLLLFSNNCHLQTIDISCY

SEQ ID NO: 1017 - protein, 611 aa, Nicotiana benthamiana
MPAWWGKKSTKNKETQSKEKERDKYVKPRSFDEVLCRNSPRNSKDLNLGGSGSGFSGSGFSGFDSGSSLDKAHPLPRPSVGNDQGVVLGCGSVSVSSTSSSGSSDGPVNTTDQAQFDILFRGNGDNRLSPLSRSPVRSRGTTTTSSPLHPRFSSMNLDSPTGKLDNDVSSESHQLPLPPGSPPSPSALPNPRTCGVAEGSNVNMSKWKKGKLLGRGTFGHVYLGFNRENGQMCAIKEVRVVSDDQTSKECLKQLNQEIILLSNLSHPNIVRYYGSELDDETLSVYLEYVSGGSIHKLLQEYGAFREPVIQNYTRQILSGLSFLHARNTVHRDIKGANILVDPNGEIKLADFGMAKHITSSSLVLSFKGSPYWMAPEVVMNTSGYGLPVDIWSLGCAILEMASSKPPWSQYEGVAAIFKIGNSKDFPEIPDHLSNDAKNFIKLCLQREPSARPTASQLLEHPFVKNQSTTKVTHVGVTKEAYPRSFDGNRTPPVLDSGGRNISPTKGNYASHPVITISRPLSCPREIVKTITSLPVSPTSSPLRQYEPARRSCYLSPPHPAYGIGGHSGYDENDYLMFQARPTTRNTLEPWLEIPQFKVQTPSRSPKLRPIL

SEQ ID NO: 1018 - protein, 257 aa, Oryza sativa
MAGGGDDLKMLGVYVSPFPLRVKLALSFKGLSFEYVEEDLHNKSDLLVSSNPVHKRTPVVIHNGKPISESMVIVQYLDEASPGAGAALLPSDPLDRAVARFWASYVDDKVIRMITVHQFSHASFSDDFGADRMMQLFSAWKMVFKGKTEEEKVEGRKQTFAVAETLEGALRECSKGKPFFGGDAVGYVDVALGGFVPWVHAMEELFGLKQFDAAKTPLLAAWLERVGELEAYKAVMPDAGMMIEFKKKQAQEAAAEA

SEQ ID NO: 1019 - protein, 614 aa, Solanum lycopersicum
MPAWWGKKSTKNKDLQAKEKEREKYVKPRSFDELLSRNSPRTSKDFSGSGSGFSGFDSGSSLEKAHPLPMPSVSSLGNDHGVVLGCGSVSVSSTSSSGSSDGGGPVNTDQAQLDTFRGLGDNRLSPLSRSPVRSRGTTTTSSPLHPRFSSLNLDSSTGKLDDVRSECHQLPLPPGSPPSPSALPNPRPCVVAEGANVNMSKWKKGRLLGRGTFGHVYLGFNRENGQMCAIKEVKVVSDDQTSKECLKQLNQEIILLSNLTHPNIVRYHGSELDEETLSVYLEYVSGGSIHKLLQEYGPFREPVIQNYTRQILSGLSFLHARNTVHRDIKGANILVDPNGEIKLADFGMAKHITSCASVLSFKGSPYWMAPEVVMNTSGYGLAVDIWSLGCTILEMATSKPPWSQYEGVAAIFKIGNSKDFPEIPEHLSNDAKSFIRSCLQREPSLRPTASKLLEHPFVKNQSTAKVAHVGVTKESYLRSFDGSRTPPVLELHPGGRTISPGRNISPAEGNYASHPVITVSRPLICARENVKAITSLPVSPTSSPLRQYEPARKSCYLSPPHSSYGIGGQSGYEANDYSMFQTRPSTRITLEPWLEIPHFRTQTPSRSPKTRPIL

SEQ ID NO: 1020 - protein, 133 aa, Saccharophagus degradans
MSGIIEIKVRDYECDIQGIVNNSVYQNYIEHARHEFLLERGVDFAALAYQGINLVVVRAELDYKASLKSGDMFSVETKLLKASRIKFEFQQTIRRLSDNALCLNAKVIGAALNDKGRPIPCAELEPLFESTSD

SEQ ID NO: 1021 - protein, 606 aa, Methylococcus capsulatus
MCGIAGLFNCNLPADELRLDQAVAKLTHRGPDDRGIFLDGRFGMGHTRLSIIDLAGGHQPLFSEDRRLALIANGEIYNFIELRSELTAAGFRFQTQSDSEVILHAYLAFGEGFLERIQGMFAFALYDALEGRLILARDRLGIKPLFLARRPDGIAFASEIKALLPLLDQPREIDPQGLAQYFQNQFSTGATTVLRGVERVLPGEAVVVEAGKTTRRFRYWSPLAVRTEELDFDEAAARFDALMERVMVEHMRSDVPFGLFLSGGVDSSLLLALLTRYSGEPIRTFSVGFPGTSLTDELPLAEGLARRFRSRHREIRPGPQDILHSLPLTVWAADDLMRDNASLPTSLLARAAGEELKVVFSGEGGDEVFAGYGRYRTSPLERLFKSLLAPGSGGFRTRGSFRGRWPKTLFGPALLAAAQSARRPVQESWRETPREWSDLQRMQYVDLCHALPDNLLVKADRMLMAWGVEGRVPFLDHRVVEFGLSLPDRLKIEGRQGKLFLKRWGERLVPAEQLYARKRGFHVPLGEWLDEPFLERLNRILPEHPALTPWFKPAGIRALIARCRDERQGSAMLWAIIQFAIWHRLFISGNGERPEALTDPLEILQR

SEQ ID NO: 1022 - protein, 700 aa, Unknown
  Synechococcus sp. RS9916
MATIHRGSPWPMGSTITARGVNFSLAAPAANRVELLLFPHGDAAQPDRIIDLDSAHRSGDYWHVEVEGLGAGCCYGYRVFGPLQPGGHGFRPAKVLLDPCARAISGWNVYRRGSATGASPNTDACLKGVVCERDRFDFNTHPRPQHRWNRSVIYELHVGSFTRREDSGLEPNLRGTLRGLIRKLPYLQSLGITAIELLPIQAFDPQDAPPGRDNVWGYSPLSWFAPHHEFIEGHDPLAARQQVRELVAACHDAGIEVLLDVVYNHTTEGNQQGPTLSWRGIADCLYYHQTAKGEYQDVSGCGNSIAANRPLVRQLILESMRCWAIELGIDGFRFDLGIALSRGEKLKPLDHPPLFEAIDSDPELSDLKLVSEPWDCGGLYRLSDFPSKRIGAWNGRFRDDLRRFWKGDENSTWTLGQRLRGSPDLNDGKPLKLDRSVNFITAHDGFTLADLVSFNVKHNLANGEDNRDGENHNSSWNHGVEGPTTDRAVQTLRRRQQRNLLTSLLLSRGVPMLLMGDEVGRSQGGNNNTWCQDSPLSWMIWRQDDCDGDLLLFVQRLLKLRQRLPDLFSPETPISETRPRRGSEPDQLWRQWHGVELNKPDWASWSHCIATSLQRGDRGAVLWVGFNSYFKAMHFDLPPAASPWHRLIDTALPAGDDLPETPEPWTPQGVPLESRSLVVMAARELLPSETNTGSTTANNT

SEQ ID NO: 1023 - protein, 217 aa, Oryza sativa
MDDSHDLASPTSPDTASSSSSSTSTSSSSATVAPKKRPRNDGRHPTYRGVRMRSWGKWVSEIREPRKKSRIWLGTFATAEMAARAHDVAALAIKGRTAHLNFPDLAHLLPRPATAAPKDVQAAALLAAAAADFPSVSVDANAKSPDTCSVASAASPQPPPPDAEADPDSTLFDLPDLLLDLRYETSSSLSCGASWAVDDDVAGGVVFRLEEPMLWDY

SEQ ID NO: 1024 - protein, 264 aa, Staphylococcus epidermidis
MNILKIQILQFNVERGNVDKNMQNIKTKFNQYLDKDTSVVVLPEMWNNGYALEELEQKADKNLKDSSLFIKDLAHTFNVDIIAGSVSNIRENHIYNTAFAINKNKELINEYDKVHLVPMLREPDFLCGGNVVPEPFYLSDQTLVTQIICYDLRFPEILRYPARKGAKIAFYVAQWPSSRLDHWLSLLKARAIENDIFIVACNSCGDDGHTNYAGNSIVINPNGEILDHLDDKEGVLTTHIDVDLVDQQREYIPVFRNLKPHLYK

SEQ ID NO: 1025 - protein, 467 aa, Musa acuminata
MEAKSTGRFTLGKQSSLAPDRDDGELQALRSGDLDGLQVLEEVDANIRLMYLANEGDLAGIEETLASGVDVNFRDIDDRTALHVAACQGFADVVQLLLDRGALVDPEDRWGSTSNFITIAPAKQPLADAVHYKNHEVIKLFEKHGAKLQVTPMRVENAREVPEYEIDPSELDFTNSVNITKGTFIIAKWRGIQVAVKKFSDDVMADEDKLWDFFIFCRSAFRDELALLQQIRHPNVVQFLGAVTQSSPMMIVTEYLRKGDLRAYLNRKRTLRPSSAVLFALDIARGMNYLHEHKPEAIIHRDLEPSNILRDDSGHLKVADFGVSKLLKVAKTVKEERPLTCLDTSCRYVAPEVFLNEEYDTKVDVFSFALILQEMIEGCPPFSYKQDNEVPKAYVSKQRPPFRAPPKQYGHGLKELIEHCWSENPADRPTFREIIDRLSKIQNHIAQKRRWKVSLFNFYLGLQLFSL

SEQ ID NO: 1026 - protein, 575 aa, Aspergillus oryzae
MRRPEDASNENPVTSAGLVAQGQTPPNWVSVKEDVAFTPRKIKIICAGAGFGGLTLAHKIKHGLKLEGVVDFVIYEKNADVGGTWFENRYPGVACDVPAHAYTFLFEPNPNYSHFYAPGPEIEEYIQRTARKWNLYDNIELNSKVVEATWDEAAGKWKVKVEQNGVIKEDEAEVFVSASGPLSKWKLPNIPGMSEFGGKLVHTAAWDESYEWKNKRVAVIGNGSSGVQCVAAMHSQVSKMVNYVRNPTWIASNFSGHLTRDGRNFAYTEEEKKKFREDPAAFFEMRKELENSVNQFAYGMMKDHTLNKLATEIATQQMQDRLKNSHDPSIALKMKPDFSPGCRRLTPCDGYLESFANPNTHMCWEAIDCITEKGIKTVDGKEEEFDLIVCATGFDTSFVPRWTMSGRDNATLDERWKHNPEAFFSVQVDGMPNYFIIGGPNFTVSNGSLLAGISFVCDYIMRWAQHMATHDIKSMEVKKEAIDDYNVWAQEYFKRTAWADNCRSWYKNGKSSGQVTAPYAGTTSHFKKCLDSIGAEHFNIQYNSANRFRCLGNGQVAGEENGMGDLAYYFVEGLW

SEQ ID NO: 1027 - protein, 959 aa, Sinorhizobium meliloti
MSLIHEIDYGTPASKSEKLVTLTIDGREITVPEGTSIMRAAMEAGIEVPKLCASDMMDAFGSCRLCLVEIDGRAGMPASCTTPVAAGISVSTQTQRLKDVRRGVMELYISDHPLDCLTCAANGDCELQDMAGAVGLRDVRYGYDGENHVTARNNGEINAKWAPKDESNPYFTYDPAKCIVCSRCVRACEEVQGTFALTISGRGFDSRVSAGMNEDFVSSECVSCGACVQACPTATLTEKSVIEIGQPEHSVVTTCAYCGVGCSFKAEMRGEELVRMVPWKDGQANRGHSCVKGRFAYGYSNHRDRILNPMVREKVTDPWREVTWEEAFAHVASEFRRIQYQYGRDSVGGITSSRCTNEETFLVQKLVRAGFGNNNVDTCARVCHSPTGYGLNQTFGTSAGTQDFDSVEHTDVAVIIGANPTDGHPVFASRLKKRLRQGAKLIVIDPRRIDLVRSAHVEASYHLPLKPGTNVAILTAIAHVIVTEGLANEAFIRERCDWSEFEDWAAFVAEPHHSPEATEAYTGVPPELVRGAARLYATGGNGAIYYGLGVTEHSQGSTTVMAIANLAMLTGNIGRPGVGVNPLRGQNNVQGSCDMGSFPHELPGYRHISDDATREIFEKLWGVTLNHEPGLRIPNMLDAAVEGTFKGLYVQGEDILQSDPDTKHVAAGLAAMECVVVHDLFLNETANYAHVFLPGSTFLEKDGTFTNAERRINRVRRVMRPKNGYADWEVTQKMAQAMGLAWNYRHPSEIMDEIAATTPSFAMVSYDYLDKMGSVQWPCNEKAPLGSPIMHVDGFVRGKGKFIRTEYVATDERTGPRFPLLLTTGRILSQYNVGAQTRRTENVVWHAEDRLEIHPHDAEQRGIRDGDWVRLASRSGDTTLRALITDRVAPGVVYTTFHHPSTQANVITTDFTDWATNCPEYKVTAVQVSPSNGPSDWQRDYDEQARQSRRIAGKLEAAE

SEQ ID NO: 1028 - protein, 431 aa, Synechococcus elongatus
MATLSVDLEVQAQATRAAARQLAQWSGADRQRLLSAIATTLEQEAPRILAANQADCEAATTEGIAPALYARLKLDADKLAAAIAGVRDLAQLPDPLGQIQIDRELDEGLILQRLTCPVGVLGVIFEARPDAVIQIASLAIKSGNGAILKGGREAICSCQAIVAAIAQALAEQQAPVEAIRLLTSREETLALLKLDRYVDLIIPRGSNSFVRFVQDNTHIPVLGHADGICHLYVDQAAAIEKTVTITVDAKTQYPAACNAIETLLIHEAIAPQFLPVVAAALHEKGVSLRGDAAAQTIVPMEAATEEDWRTEYSDLVLAVRLVPSLDAAIAHINEYGSGHTDAIATEDAAAAAQFFSQVDSAGVYHNCSTRFADGFRYGFGAEVGISTQKLPPRGPVGLEGLVTYKYVLSGDGQIAATYSGAQAKPFLHRDR

SEQ ID NO: 1029 - protein, 272 aa, Triticum aestivum
MAAAEPSGSSQPGAPGRWSLHGKTALVTGGTRGIGRAVVEELAALGAAVHTCSRKEAELGERLKEWEARGFRVTTSVCDLSVREQRERLIGDVAERFGGKLNILVNNVGTNIRKPTTEFSAEDYSFLMATNLESAYHLCQLAHPLLKASGLGSIVFISSVCGLVAVFSGTLYAMTKGAINQLTKNLACEWAKDGIRTNSVAPWYITTSLTEGLLANKEFEASVVSRTPLGRVGEPGEVSSLVAFLCMPGSTYITGQTISVDGGMTVNGLYPA

SEQ ID NO: 1030 - protein, 347 aa, Comamonas testosteroni
MFIRNCWYVAAWDTEIPAEGLFHRTLLNEPVLLYRDTQGRVVALENRCCHRSAPLHIGRQEGDCVRCLYHGLKFNPSGACVEIPGQEQIPPKTCIKSYPVVERNRLVWIWMGDPARANPDDIVDYFWHDSPEWRMKPGYIHYQANYKLIVDNLLDFTHLAWVHPTTLGTDSAASLKPVIERDTTGTGKLTITRWYLNDDMSNLHKGVAKFEGKADRWQIYQWSPPALLRMDTGSAPTGTGAPEGRRVPEAVQFRHTSIQTPETETTSHYWFCQARNFDLDDEALTEKIYQGVVVAFEEDRTMIEAHEKILSQVPDRPMVPIAADAGLNQGRWLLDRLLKAENGGTAP

SEQ ID NO: 1031 - protein, 469 aa, Burkholderia xenovorans
MSKQAIGVVGLAVMGRNLALNIESRGHAVSVFNRSREKTDELIAEYPDRKLVPAFTLEEFVESLEKPRRILLMVKAGEGTDATINQLKPLLDKGDILIDGGNTHFTDTIRRNQDLAKSGLHFIGTGVSGGEEGALKGPSIMPGGQRDAYDLVAPILTEIAAKAPDGEPCVAYMGPDGAGHFVKMVHNGIEYGDMQLIAESYAVLKQVVGLSNEELGKVYTEWNQGELDSYLIEITSKIFSKKDEETGKDLVDVILDRAAQKGTGKWTSQNALDLGAPLPLITEAVFARVLSSLKTQRVAASKVLEGPAARPLGAEREAFIESVRRALYFSKVISYAQGFAQLRAASEEYKWDLDYGTIAKIFRAGCIIRARFLQKITDAYTKDKAIANLLLDPYFRDIAKNYQSALREVVIAAINAGVPVPAFASAIAYFDAYRSERLPANLVQAQRDFFGAHTFERIDKPGSFHANWS

SEQ ID NO: 1032 - protein, 427 aa, Aspergillus oryzae
MGKSSKDKRDAYYRLAKEQNWRARSAFKLIQIDEQFDLFEHENPEKVTRVVDLCAAPGSWSQVLSRVLIKGESFGRRAWVEKKGKEAAALANANGDATDNNVDGDAAMEELKPRKNVKIVSIDLQPMAPLEGITTLKADITHPSTIPLLLRALDPEAYDSTTSSPSSLRQPHPVDLVISDGAPDVTGLHDLDIYIQSQLLYAALNLALGVLRPGGKFVAKIFRGRDVDLIYAQLRTVFEKVSVAKPRSSRASSLEAFVVCEGFIPPSIHGGSMGIDALKNPLFGGAAVAHTVSADGNVGVEVMDVDSEAKPGADLTTTKTVTSTEPHKENQVRMLHADSDNSSAPEPLSQKPVTERFAVENRWIPPFIACGDLSSWDSDASYTLPPDHVSLDPVQPPTAPPYRRALELRKEKGGAYGKTKLGALGRA

SEQ ID NO: 1033 - protein, 675 aa, Myxococcus xanthus
MRICLIALPWSLYRHPSAALGALCAYLKQEEPTLEVVCRSDFLDAAAALGFGCYDRISQASYDVGEMLYAALCFPERKEQVRTFFISRMEESGAPLTGAGSFLDPEIHGERPTWSSAFDVIQARLEAHLDRVAEEVAGRYQLVGLTTCFGQLFANLALSMRIKRRSTGTRIVLGGSTVSERVGPSLLKELDCFDYVIQGEGEQPLLALARGLAAAEDVSGLKGLITRETASVLPRGAPFWEVSDVNNLPIPDYSEYATRAEALNFLWLMTVEGSRGCWWDRAKRTGNPKATCHFCNLNVQWSGYREKGAERLVSEVVALNERYHNNVLFFLDNIIRLKGVDEFAQRLIDTGKDWVIFYEMRANIRPHELLMLWQAGVRFVQFGIESLSESYLKRIGKGTSVITNLQVMKICHELGISNGANLLTDFPGGRPEEVAETCETIQRYALGYEPLSANRFWLGRGATVQVLSQEYGVRNLRNADFYRAGLPEALYERLDLLDLSYDQDGPVADWSHVRALCKQWGAAYSAARASEYRHLLTYLDSGQSMRIFDARTGVLRTSVFKGLARDVYMYCAEIRRWDDLNQEFIEPGRATAQQIAELIEGWNQQGLLYREGERLEGGRFLSLAPAFTPELASRRIRAAHAAELQRRGARADAPKPHPMPPRAGDKAPPPVQVKA

SEQ ID NO: 1034 - protein, 1138 aa, Unknown
  Acinetobacter sp. ADP1
MKRMLINATHAEEVRVALITGNRLYDFDLENRTREQKKSNIYKGHVTRVEPSLEAVFVEYGAQRQGFLSMREIASSYLHADPRQTSNIRELITEGTELLVQVEKEERGNKGAALSTFISLAGRYLVLMPNNPKGGGISRQISGSVREELKEMLASLNVPRGMSVIVRTAGIGRSQEELQLDLQHLLDLWSQIQSTSNSGPSPMLVHQEAGVVTRAIRDYLRDDVAEILIDSEQAYNEAYNFVKAVMPRQLDKLKTYTLNEPLFAHFAIESQIQTAYEREVKLPSGGSIVIDQTEALVSIDINSAKSTRGHDVEETALNTNLEAAEEIARQLRLRDIGGLVVIDFIDMTKDRNQRMVEAKLREATQSDRARIQFGQLSRFGLMEMSRQRLRPSLEEATGYVCPRCHGTGMVRDLRSLSLSIMRKVEEIALRERHGEVQVEVPVEIAAFLLNEKRHSLVYLEQTSGVRVTVLPHPHLETPHYEIQYNPEGFAPSSYERTEATRSSEKELGYESSGWHLEDTEHQHASPVSQEASKAKNQQKPASPASAPAATPVKAASPCAWLENLFVQKQAQTVDQSRSAQNAAAAIEQMVNNGAVSRGQFGQVAHVPAIAETAPVAVPSNNAYMSQNTTKHDAREQVEKDEKPQQQSRQNNKKRKHKEHREQHNHVQEQPQQVQIHEETVQLSRQEQREQKRHQKRHQSSPSEQHNEQQQTEEAVVPRRDRNQQRPNRPNRYRDQSVLSEETAQTKAPANATAPVVDERQVRVDQIDVPRDEVLATALVINVDESQSEIVALTEQKETVKTAPVMKSEPVEAKTLPENKVKAATQVEPAVAETKSKQTESTDSASTQVRRASNDPRMRRRQQREAQKAKAQTPKVLPSQVPQLAQYSIGSLIRHVYGEDCTVLIEQFGLVPTFNRALLKFTEQYAATLVVSEVANATEDKKPVTRDVELPNSKPAEEVEPAPVLPLTPPQASVSRVANDPRERRRLAKQAAEQAHEQAKLAAEQAQIGSKEQPAADAVATSQVEEAPKSIETPVEAIALVEAVVDQPTATIVQEASTEEVAATSQIAVEAEQPQHDAVQASLPEIEQAETATTPQAKGKTSKATAKSAPKETSTEQEKIARPRRPRGRPPKKTSTGTE

SEQ ID NO: 1035 - protein, 757 aa, Glycine max
  misc_feature (12)..(12): Xaa can be any naturally occurring amino acid
SHWLFFSSLLTXCCALSRDGVLLLSFKYAVLNDPLYVLANWNYSDETPCSWNGVSCSNENRVTSLLLPNSQLLGSVPSDLGSIEHLQILDLSNNSLNGSLPSSLSQASELRFLNLSNNLITGDVPESLSQLRNLEFLNLSDNALAGKLPESFSNMQNLTVASFKNNYLFGFLPSGLRTLQVLDLSSNLLNGSLPKDFGGDNMRYLNISYNRFSGEIPTEFAAEIPGNATVDLSFNNLTGEVPDSTVFTNQNSKSFNGNFNLCGEITKNPCPIPSSPSSEPKASAPISPPAIAAIPKSFDDSPLAPTGQKQRGLKQGTIIGIVVGDIIGVGILAMLCVYVYRLKKKKDAESTKKKNEAAITRSRSESSSSTTSESRGFTRWSCLRKRTEEEDSSETTSSSESEVEGATAATHDNSKGPQQENNKTGTLVTVDGERQLELETLLKASAYILGATGSSIMYKAVLEDGTSLAVRRIGESGVERFKDFENQVRVIAKLVHPNLVRVRGFYWGHDEKLIIYDFIPNGCLANVRYRKLGLSPSHLPWEIRLKIAKGVARGLAYLHEKKHVHGNLKPSNILLGNDMEPKIGDFGLERIVTGDTSYKAGGSARIFGSKRSTASRDSFQDMTFGPSPSPSPSSISGVSPYHAPESLRNLKPHPKWDVYSFGVMFLELLTGKIVVLDDMGQGPGLLVEDKNRALRMVDMVIRADMEGREEALLAYFKLGYSCVSSIPQKRPPMKEALQVLEKISSSFSSSSSYHYSV

SEQ ID NO: 1036 - protein, 148 aa, Brassica napus
MAPKAGKKPAEKKPAAAEKPAEEVAEKAPAEKKPKAGKKLPKEAGAIDKKKKRNKKSIETYKIYIFKVLKQVHPDIGISSKAMGIMNSFINDIFEKLAQEASKLARYNKKPTITSREIQTAVRLVLPGELAKHAVSEGTKAVTKFTSS

SEQ ID NO: 1037 - protein, 158 aa, Clostridium perfringens
MEIYDISVKDINGENVSLERYRGKVLLIVNTASKCGFTKQFDGLEELYEKYKDEGFEVLGFPCNQFKEQDPGSNSEIMNFCKLNFGVTFPMFEKIDVNGENESLLYSYLKEQKSGMFGSKIKWNFTKFLVDREGNVIKRFSPQTTPKSIEKDIEELLA

SEQ ID NO: 1038 - protein, 409 aa, Debaryomyces hansenii
MSFQDVLKRGDDFLNEYPRTSRLWNYASHATCLFMILQSKLFLNVLYNPHLHNIEKLDRALEKARSENRSLLTMMNHMSVVDDPTFYAALPFRFHTDIETIRWGFGAHNVCFSNKALSWFFNLGKILGTRRFGDGPFQGSLDAAIRILSPDDTLDLEFTPGVKEVAKPTLLQEINGIGPVGGNTTMLAEKIRPTAESTNLLMSKSPFIRTKTSWFHVFPEGFVLQLQEPHQNSMRYFKWGISRLILESTRTPVVVPIFTYGFEKVAPEDSADKGINRWLPSNIGAEIHINIGDPIPDETLESYRKKWRDLCNKYIDPKNPTDLSEELKTGKMAKRLRSDLAAELREAVLAIRNSLGVFKPEDPRFKNPVFWEEYTRTEGKSDPDVRFIGKNWAIKRLQKHLPEYSEDEP

SEQ ID NO: 1039 - protein, 284 aa, Saccharomyces cerevisiae
MAIDAQKLVVVIVIVVVPLLFKFIIGPKTKPVLDPKRNDFQSFPLVEKTILTHNTSMYKFGLPHADDVLGLPIGQHIVIKANINGKDITRSYTPTSLDGDTKGNFELLVKSYPTGNVSKMIGELKIGDSIQIKGPRGNYHYERNCRSHLGMIAGGTGIAPMYQIMKAIAMDPHDTTKVSLVFGNVHEEDILLKKELEALVAMKPSQFKIVYYLDSPDREDWTGGVGYITKDVIKEHLPAATMDNVQILICGPPAMVASVRRSTVDLGFRRSKPLSKMEDQVFVF

SEQ ID NO: 1040 - protein, 250 aa, Vitis pseudoreticulata
MGKSYPTVSEEYKKAVEKARKKLRGLIAEKNCAPIMLRIAWHSAGTFDVKTRTGGPFGTMKMPEELAHGANNGLDIAVRLLEPIKEQFPIISYADFYQLAGVVAVEVTGGPEIPFHPGREDKPEPPPEGRLPDATKGCDHLRQVFVTQMGLNDKDIVALSGAHTLGRCHKERSGFEGPWTSNPLIFDNSYFKELLSGEKEGLLQLPSDKALLSDPAFRPLVEKYAADEDAFFEDYKEAHLKLSELGFADA

SEQ ID NO: 1041 - protein, 447 aa, Arabidopsis thaliana
MALIQFGSSCVAQWGILRPRFAVKAFYPSRLESHQDNCISQINCLGASRSSMFAQGSLPFLSLTGVSPNTHSRRGARFTVRADTDFYSVLGVSKNATKAEIKSAYRKLARSYHPDVNKDAGAEDKFKEISNAYEILSDDEKRSLYDRYGEAGVKGAGMGGMGDYSNPFDLFESLFEGMGGMGGMGGGMGSRGSRSRAIDGEDEYYSLILNFKEAVFGIEKEIEISRLESCGTCNGSGAKAGTKPTKCKTCGGQGQVVASTRTPLGVFQQVMTCSPCNGTGEISKPCGACSGDGRVRRTKRISLKVPAGVDSGSRLRVRGEGNAGKRGGSPGDLFAVIEVIPDPVLKRDDTNILYTCKISYVDAILGTTLKVPTVDGEVDLKVPAGTQPSTTLVMAKKGVPVLNKSKMRGDQLVRVQVEIPKRLSKEEKMLVEELADMSKNKVANSRR

SEQ ID NO: 1042 - protein, 494 aa, Oryza sativa
MEIGAVENGGVVGGEVVAGKRGKTPQATETFEKVATIGVVANLTVYLVKRFNIGQIEAANITNIFFGDAGNDFVCSLPALKPPICHEKTRLGGGCNSPSTLQLSVLYLSLGFLIIGGGAIRPCSLPFGVDQFDKTDEEGRKGLNSYYNWYYGTSTAALVLSITVIIYIQNNVSWPIGFGIPTLLMFLAIIMLFLGTNLYVHVQPEGSIFAGIAQVLVASFKKRNLKLPCPHDINQQGLMLYNPPSKGNRVFRLPLTSQFRFLNKGAIVMGDDINVDGSVVSISLIALTLFIPIYDRILVPIARRFTGVESGITLLQRQGIGLAISPISMVVAGLVERKRRNSALSNGGISPMSVLWLAPQLVLMGIAEAFNAVGQIEFYNKQFPENMQTLAGSLFFCTIAGANYLSTALANIMRKVTTRDGHSSWLTDNINLGKLDYYFYFIALMGVLNLIYFLICSHFYQYKVMSLHSEESIKIPTKEEEATEIDIDTDAPSK

SEQ ID NO: 1043 - protein, 418 aa, Unknown
  Frankia sp. CcI3
MILGSGSAWDTACVQLANAARHLGLDDGMHDLLRTPRRAITVSVPLQRDDGQLTVLTGYRVQHNLARGPGKGGIRFHPTTDLDEVKALAMWMTWKCALMGIPYGGAKGGIAVEPAMLSLPERERLTRRYAAELVPLIGPEKDIPAPDVGTDEQTMAWIMDTYSAHTGYTTTGVVTGKPLSIGGSAGRAGATSLGVQLSVFAALRETGRDPHAMTIAVQGFGKVGALAAQYLHDAGCTVVAVSDVKGGIYNPQGLNPAALIRHLAGGAETVVGYPGTDTITNDELLELDVDVLVPAALEGVITVENVDRVRAPIIVEGANGPVTAEADQVLDDRGVLVVPDILANGGGVAVSYFEWVQDIQAYFWSEDEVSDRLRALMDRAYREVSLLATTQKISMRNAAHVIGVGRVADAHRTRGLYP

SEQ ID NO: 1044 - protein, 198 aa, Magnaporthe grisea
MDHTRDPCPWVILNDFGGAFCMGAIGGTIWHGVKGFRNSPYGERRIGALTAIKMRAPVLGGNFGVWGGLFSTFDCAVKGIRKKEDPYNAIIAGFFTGGSLAIRGGYKAARNNAIGCAILLGVIEGVGIGFQKMMAGSTKLEKPSRSRHKSPPESSTTIQQTNDRRSPLYSPFQATTSAAAVVYFLGHLWMVGVVSSVL

SEQ ID NO: 1045 - protein, 493 aa, Listeria monocytogenes
MGKVMLIGAGPGDAQLLTVKGLAALQKADVIVYDRLVEPAMLQERKASCKLIYVGKEPLHHPIPQEEIEQILVKEAATNELVVRLKAGDPYVFGRGGEEGETLYKAGIPFEVIPGITSAIGGLAYAGIPVTHRNFASSFHVITGHLKKGRDPLDWEALARLEGTLVFLMGMTNLPNICANLLENGRKAETGVAIVQWASRGKQLTVTGNLQNIEQKVAESGISSPALIVVGDVVSLRPQLNFFEEMPLFHTKVLLPRARAGKSMLAEQIRDLGGEVTMYPNIQVVDVVPTKTKEELREVSGLLFTSKEAVERFFDYLAQLDLDIRSLKNTHLTAIGKQTKEAFSEKGIIPDSFIKRRSTELILEHLPRLQKNVSNLIIGSIVDTAEVNAILAEVEAMEMMPLYDMRPVTERPFDLASFEQVCFSSSRSVQNLLDVLTTEEKAILQTKTILSIGRFTSATLASFGINNFIEAESATPESLIELIQKTKLEGVPQ

SEQ ID NO: 1046 - protein, 371 aa, Robiginitalea biformata
MKEDYYELLGVSKGATAAEIKKAYRKKAIEFHPDRNPGDATAEENFKKAAEAYEVLSDPNKRARYDQFGHQAFEGGGFGGGGMNMEDIFSQFGDIFGSAFGGSGFGGFGGFGGGQRRVKGSNLRIRVTLDLEEVALGVEKKIKVKRKVQAPGVTYKTCGTCGGNGQVTKITNTILGRMQTAATCTACGGSGQVIDSRPDGADAHGLVMQEETVSIKIPGGVESGMQLKVSGKGNDAPGNGVPGDLLVAIETREHPTLKREGDNLHYDLYISMPDAVLGTSKEIDTIGGKVRIKLEPGIQSGKILRLRNKGIQSINGYGAGDLLVHVNVWTPKELSKEQREFFERMQEDDKFAPKPEKSDKSFFEKVKDMFS

SEQ ID NO: 1047 - protein, 184 aa, Acidobacteria bacterium
MSREEGLPANLKAIVTAEQIQHRVVELGRQITADYAGKRIVIIGVLENAFVFMADLIRHIELPTVCQFVLSDIHDVEEGLAPAREIFFFPEVEVSGEHVLLIEGLVQSGLTTDFLVTNLMGRGAASIKTASLLNRQSSRKVSVQLDYFGFDIDDPYVVGYGLGAPHLGRNLPYVAATKPPEPGV

SEQ ID NO: 1048 - protein, 407 aa, Thermus thermophilus
MVSTLKRDEALFELIALEEKRQREGLELIASENFVSKQVREAVGSVLTNKYAEGYPGARYYGGCEVIDRVESLAIERAKALFGAAWANVQPHSGSQANMAVYMALMEPGDTLMGMDLAAGGHLTHGSRVNFSGKLYKVVSYGVRPDTELIDLEEVRRLALEHRPKVIVAGASAYPRFWDFKAFREIADEVGAYLVVDMAHFAGLVAAGLHPNPLPYAHVVTSTTHKTLRGPRGGLILSNDPELGKRIDKLIFPGIQGGPLEHVIAGKAVAFFEALQPEFKEYSRLVVENAKRLAEELARRGYRIVTGGTDNHLFLVDLRPKGLTGKEAEERLDAVGITVNKNAIPFDPKPPRVTSGIRIGTPAITTRGFTPEEMPLVAELIDRALLEGPSEALREEVRRLALAHPMP

SEQ ID NO: 1049 - protein, 104 aa, Triticum aestivum
HQLHVCLPSSTNKTRLLYRMSLDFAPWMKHMPFMHLLWSHFAEKVLNEDLRLVLGQQDRMNNGANVWNWPVSYDKLGIRYRLWRDAVERGVDRLPFSNEIESGS

SEQ ID NO: 1050 - protein, 247 aa, Arabidopsis thaliana
MRTLYNKAQCQFRLTTMDQQDHGQSGAMNYGTNPYQTNPMSTTAATVAGGAAQPGQLAFHQIHQQQQQQQLAQQLQAFWENQFKEIEKTTDFKNHSLPLARIKKIMKADEDVRMISAEAPVVFARACEMFILELTLRSWNHTEENKRRTLQKNDIAAAVTRTDIFDFLVDIVPREDLRDEVLGSIPRGTVPEAAAAGYPYGYLPAGTAPIGNPGMVMGNPGGAYPPNPYMGQPMWQQQAPDQPDQEN

SEQ ID NO: 1051 - protein, 158 aa, Staphylococcus epidermidis
MESIYDFVVQKNNGESYKLEQYKGDVMLIVNTASECGFTPQFEGLQKLYDEYKDQRFIILGFPCNQFGGQEPGSGEEAAQNCKINYGVTFPIHEKVDVKGDNQHPLFHFLTNAAKGMINEKIKWNFTKFLIDREGNVIKRFSPQKKPEQIKTEIEKLL

SEQ ID NO: 1052 - protein, 616 aa, Ralstonia eutropha
MRDLDTTTQPAVSGGSATETQVPAGPQTMTPSEAFVETMVANGVTEMFGIMGSAFMDAMDIFAPAGIRLIPVVHEQGAGHMADGYARVSGRHGVVIGQNGPGISNCVTSIAAAYWAHSPVVIVTPEAGTTGIGLGGFQEAKQLPMFQEFTKYQGHVTHPQRMAEFTGRCFDRALAEMGPTQLNIPRDYFYGKVNVEIPKPQRLDRGPGGEQSLNEAAELLAQAKFPVIISGGGVVMADAIEECKALAERLGAPVVNSYLHNDSFPASHPLWCGPLGYQGSKAAMKLISRADVVIALGSRLGPFGTLPQHGMDYWPKNAKIIQIDADHKMLGLVKKISVGICGDAKAAAIALTQRLANRTLACDSSRDGRATEIANEKAAWEKELDGWTHERDPYSLDMIEEQKNERTFNGGTYLHPRQVLRELEKAMPADVMVSTDIGNINSVANSYLRFEKPRSFFAAMSWGNCGYAFPTIIGAKVAAPHRPAVSYAGDGAWGMSLMETMTCVRHNIPVTAVVFHNRQWGAEKKNQVDFYNRRFVAGELDNQSFAAIAKAMGAEGIVVDRLEDVGPALKRAIDLQMNHGKTTIIEVLCTRELGDPFRRDALSKPVRYLDKYKDYV

SEQ ID NO: 1053 - protein, 268 aa, Aspergillus nidulans
MAGVLFSPEKDIPNLSGKVILITGGTAGLGAAAAIHLAKHSPSHIYISGRNAKSADAVIQQTQKSGTKVSFLACDLASLDSIKKAADTILAQESRLDLLMCNAGIMAVPPGKTSDGYEVQFGTNHLGHALLIQKCLPLLQQTAALPGADVRVVILTSLGFRMHPSAGIVFSDLKSEQNFPAFGSWIRYGQSKLANILYARELARRYPSITSVSVHPGVVGTGLVENLGWAKRTFVYVTNLWKLMKPEEGKLEERAALRAGWDPVVQVG

SEQ ID NO: 1054 - protein, 438 aa, Oryza sativa
MASLAQHVAGLASPPLSGAPRRRPAAPTRPSALVCGTYALTKEERERERMCQLFDEASERCRTAPMEGVSFSPEDLDSAVESTDIDTDIGSLIKGTVFMTTSNGAYVDIQSKSTAFLPLDEACLLDVNHIEEAGIRAGLVEEFMIIDENPGDETLILSLQAIQQDLAWERCRQLQAEDVVVTGKVIGGNKGGVVALVEGLKGFVPFSQVSSVYVHVHGMSCLSSAVLNHIVNTSCPLFYKPLLDLDQKSTAEELLDKELPLKFVEVDEEQGRLVLSNRKAMADSQAQLGIGSVVLGTVESLKPYGAFIDIGGINGLLHVSQISHDRVADISTVLQPGDTLKVMILSHDRERGRVSLSTKKLEPTPGDMIRNPKLVFEKADEMAQIFRQRIAQAEAMARADMLRFQPESGLTLSSEGILGPLSSDTPSEGSGEGQTTDE

SEQ ID NO: 1055 - protein, 626 aa, Lactobacillus plantarum
MQANLQWLDDPEVFRVNQLPAHSDHHYYHDTAEFKTGSRFIKSLNGAWRFNFAKTPAERPVDFYQPDFDATDFDTIQVPGHIELAGYGQIQYINTLYPWEGKIYRRPPYTLNQDQLTPGLFSDAADNTVGSYLKTFDLDDAFKGQRIIIQFQGVEEALYVWLNGHFIGYAEDSFTPSEFDLTPYIQDQGNVLAVRVYKRSTAAFIEDQDMFRFSGIFRDVNILAEPASHITDLDIRPVPNANLKSGELNITTKVTGEPATLALTVKDHDGRVLTSQTQTGSGSVTFDTMLFDQLHLWSPQTPYLYQLTIEVYDADRQLLEVIPYQFGFRTVELRDDKVIYVNNKRLVINGVNRHEWNAHTGRVISMDDMRADIQTMLANNINADRTCHYPDQLPWYQLCDEAGIYLMAENNLESHGSWQKMGAIEPSYNVPGDNPHWLAAVIDRARSNYEWFKNHPSIIFWSLGNESYAGEDIAAMQAFYKEHDDSRLVHYEGVVHTPELKDRISDVESRMYEKPQNIVAYLEDNPTKPFLDCEYMHDMGNSLGGMQSYNDLIDKYPMYQGGFIWDFIDQALFVHDPITDQDVLRYGGDFDERHSDYEFSGDGLMFADRTPKPAMQEVKYYYGLHK

SEQ ID NO: 1056 - protein, 181 aa, Solanum tuberosum
MASSIVSSAAVATRSNVAQASMVAPFTGLKSAASFPVTKKNNNVDITSLASNGGRVRCMQVWPPINMKKYETLSYLPDLSDEQLLKEVEYLLKNGWVPCLEFETEHGFVYRENHKSPGYYDGRYWTMWKLPMFGCTDATQVLAEVQEAKKAYPQAWIRIIGFDNVRQVQCISFIAYKPEGY

SEQ ID NO: 1057 - protein, 384 aa, Musa acuminata
MDSVSPVTLDLNKEEGHCSNGAVVFDTSFLRRQAKIPESFVWPRNERPHPLEELEVPVVDLRGLFEGDEASISRAAEASRAACVRHGFFQVINHKVDAKVSGDALDAAGDFFKLPLSTKLRARRQPGSAWGYVGAHADRFASKLPWKETLTFGYDYGERGDGVVDYFTSKLGEGFEPMGRVYRRYCEAMKELSLSIMELLGISLGVGREYYRQFFEDGSSIMRCNSYPPCQEPELALGTGPHCDPTALTILLQDHVGGLQVFTEGKWQAVRPVRSALVINIGDTFMALSNGRYKSCLHRAVVNSERERLSLAFFVCPRGDRVVRPPRELLLLLEEEEEEEEEAVPRAFPDFTWTELLEFTQTHYRADTTTLQNFARRRFLASSP

SEQ ID NO: 1058 - protein, 472 aa, Pseudomonas putida
MSGQNMHSGELKRGLKNRHIQLIALGGAIGTGLFLGSAGVMKSAGPSMILGYAICGFIAFMIMRQLGEMIVEEPVAGSFSHFAHTYWGGFAGFLSGWNCWVLYILVGMSELSAVGKYVHYWWPEIPTWVTAAAFFVLINAINLMNVKFFGEAEFWFAIIKVVAIVSMIGLGAYLLTSGSGGPEATVANLWTHGGFFPNGVSGLVMALAFIMFSFGGLEMLGFTAAEADKPKTVIPKAINQVIYRILIFYVGALVVLLSLTPWDNLVASIDASGGSYGSSPFVQVFSLLGSDVAANLLNFVVLTAALSVYNSGTYCNARMLLGMAEQGDAPASLAKVDKRGVPVRSILVSAAVTFVAVLLNYLMPQNALELLMSLVVATLVINWAMISYSHLKFRQHLDRTGQKPLFKALWYPYGNYVVLAFVVLILGIMLMIPGIQVSVYAIPVWLLAMLVVYMVKSRRQVNAGGAVETVAK

SEQ ID NO: 1059 - protein, 716 aa, Idiomarina loihiensis
MNPITKQFQYGQHTVTLETGVIARQATASVLASIDDTTVLVTVVAKKEAREGQNFFPLTVNYQEKTYAAGKIPGGFFKREGRPSENETLTCRLIDRPIRPLFPDGFMNEVQVVATVVSVNPQINPDIVALIGTSAALSISGVPFAGPIGAARVGVVNDEYVLNPTADELENSKLDLVVAGTDKAVLMVESEAQLLSEDQMLGAVMYGHEAMQDVIKAITEFTAEAGKEKWDWQAPAKDESLQTKIRELAEQGIGEAYRTTDKAERKGKLDQVKEQMVEKLTAEDENVDLEESGKIFHDLESDIVRSRIIAGEKRIDGRDPDMVRAISVATGVLPRTHGSALFTRGETQALVTATLGTDRDAQMIDELTGMNTNRFMLHYNFPPYCVGETGMVGSPKRREIGHGRLAKRGIQAVMPSHDEFPYTIRVVSEITESNGSSSMASVCGSSLALMDAGVPIKSSVAGIAMGLVKEGDKHVVLSDILGDEDHLGDMDFKVAGNTDGITALQMDIKIDGITRDIMESALAQAKSARLHILKVMDEAIGGHREELSTYAPRFTTIKIDQDKIKDVIGKGGAVIRELTESTNTNIEIGDDGTIKVAASDQADADAAIEKIKQLTANVEVGKIYQGKVARIVDFGAFVTVLPGKDGLVHISQIAEERVNDVNEYLKVGDVVPVKVLEIDRQGRVRLSMKEAAEKKEEPAPEAPAEPAAEEENKSEE

SEQ ID NO: 1060 - protein, 133 aa, Agrobacterium tumefaciens
MRYRGIEISTRPHHIDSGKDLLKGEPDMATVKVDAANFQSEVLESAEPVVVDFWAEWCGPCKMIAPSLEEISSELAGKVKVAKLNIDENPELAAQFGVRSIPTLAIFKGGEVADIKVGAAPKTALSAWISSAA

SEQ ID NO: 1061 - protein, 206 aa, Francisella tularensis
MSKGSSTKKWLHEHTSDYYVIQANKLGYRSRASFKILEIQDKYQLFKPNMFVVDLGASPGGWSEQVIKYIGKNGKLIALDLLEMAPIAGVEFIQGDFSSDETYQKLNTLVNNQKIDCVISDMAPNLSGNKTSDQAKSIYLLELALDFANTNLNKNGSFVAKVFQGQGSDEYLKLVRESFNKVIQFKPKSSRAKSREFYVIATEFKG

SEQ ID NO: 1062 - protein, 345 aa, Myxococcus xanthus
MKVAVLTGGGDCPGLNAVIRAVVRRANAHGFEMMGLRDGWKGLLEDNHFRLTRETTSGILHRGGTILGTSRVNPFKVENGLERVKRAIERNGIHAVIAIGGEGTLSAATRMSQEGLRIVGVPKTIDNDINATDFTFGFDTAVAIATEAIDRLHSTAESHKRVIVCEVMGRHVGWIATYAGIAGGADVILVPEIPADLAKVAEHIQRRHAGGRTFSIVVVAEGTRIKLSADQQEQLVTSGALDEAGRPRLGGVGTILAHEIERRTGFETRVSVLGHIQRGGAPTAHDRVLATRYGVHACDMVARGEFGKMAALRGNDIISVDLADATRELKRVPQEFFEVAQVFFG

SEQ ID NO: 1063 - protein, 508 aa, Glycine max
  misc_feature (177)..(177): Xaa can be any naturally occurring amino acid
  misc_feature (312)..(312): Xaa can be any naturally occurring amino acid
  misc_feature (314)..(315): Xaa can be any naturally occurring amino acid
  misc_feature (373)..(373): Xaa can be any naturally occurring amino acid
MLSRFTRLFSAPSNVARLVNGVQPRFSTTTVQDAPKIEEEPRFLEMVHQYFDIAGTFTDIPKDKLEVYKQCSAVFKVRLPLVRDNGKMEFIPAYRAQHKHHRLPVKGGTRYSEHIDLQEVEALSCLMTLKCAVVELPYGGGKGGIKIDPSKYSARELEDLTRRYTLELARKNFIGAXIDVPGPDMGTGAREMSWMKDTYTVFYGHNDINATACVTGKPLSQGGIKGRVESTGLGVFFGVREFLKDVELMKKYGIDSTNGYEGKTIIVQGFGNVGYFASKFMCEQGAKLIGVVDVEGSIYNPDGIDPDKLLEXRXXKGTLLDFPGSESYKDDSAFYKPCDFAIPAAVEKSINKLNAGRLQCKVLAEAANGPTTXAAEDILTKRGILVLPDILLNAGGVTVSYFEWLKNLDHMRPGRLVKRWEEKSKQNLLKIIADKTGTDLKLTAEDAKLLRGASELDIVYSGLEEVMCAAVEETVATSKKLNVPFRLASYVNAILKVHKVYEESGFAL

SEQ ID NO: 1064 - protein, 432 aa, Lactobacillus johnsonii
MTELISIKDSSKHVDQEVKMHVWLTDKRSSGKIIFLQLRDGTAFFQGVIRKNDVSEEVFEAAKSLRQEASFYITGTVHEDKRSHFGYEIQISDLEIVSNNEGYPIGNKEHGVDFLLDNRHLWLRSKRPFAIMQIRNTMFKATVDFFEKEGFIKFDAPIFMHSAPEGTTQLFHVEYFNNDAYLSQSGQLYGEAGAMAYGKIFTFGPTFRAEESKGRRHMTEFWMMEPEMAWMHQDESLDIQERYLAYMVKQVLENNEYELKILGRDPEKLRPTTEGNFTRLSYDDAIKMLQEAGRDIKWGDDFGAPDEGYISEQFDRPVFIVNYPTTIKPFYMKKNPDNPKEYLCADVIAPEGYGEIFGGSEREGNYEILKQQIEEAGLNLEDYQWYLDLRKFGGVPHSGFGMGFERTIAWICKLDHIREAIPFPRLINRMQP

SEQ ID NO: 1065 - protein, 726 aa, Arabidopsis thaliana
MTEIDRSRAFAKDVKRIVVKVGTAVVTGKGGRLALGRLGAICEQLAELNSDGFEVILVSSGAVGLGRQRLRYRQLVNSSFADLQKPQMELDGKACAGVGQSSLMAYYETMFDQLDVTVAQMLVTDSSFRDKDFRKQLSETVKAMLRMRVIPVFNENDAISTRRAPYKDSTGIFWDNDSLAALLSLELKADLLILLSDVEGLYTGPPSDSTSKLIHTFIKEKHQDEITFGEKSKLGRGGMTAKVKAAVNAAYGGVPVIITSGYAAENISKVLRGLRVGTLFHQDAHLWAPVVDTTSRDMAVAARESSRKLQALSSEDRKQILHDIANALEVNEKTIKAENDLDVAAAQEAGYEESLVARLVMKPGKISSLAASVRQLAEMEDPIGRVLKKTQVADDLILEKTSSPIGVLLIVFESRPDALVQIASLAIRSGNGLLLKGGKEARRSNAILHKVITDAIPETVGGKLIGLVTSREEIPDLLKLDDVIDLVIPRGSNKLVSQIKNSTKIPVLGHADGICHVYVDKSGKLDMAKRIVSDAKLDYPAACNAMETLLVHKDLEQNGFLDDLIYVLQTKGVTLYGGPRASAKLNIPETKSFHHEYSSKACTVEIVEDVYGAIDHIHQHGSAHTDCIVTEDSEVAEIFLRQVDSAAVFHNASTRFSDGFRFGLGAEVGISTSRIHARGPVGVEGLLTTRWIMRGKGQVVDGDNGIVYTHKDLPVLQRTEAVENGI

SEQ ID NO: 1066 - protein, 1206 aa, Oryza sativa
MDSSCRPPSYGPWPNMNHLHPPEFHSCCNHTYPPGYYSFRLPSPQEIPPPHLYYHGPFPQHPNAYPSYFARPPPYPVDQTAYGYDKFKSHCCGCPNHSCHGGERSNIKIEEERPEVNPDTEQRDASGSDIVRHPNYQNQAIWLPSGNMNDKENKKSMELPPQFYNGWIPVSGKWVGDVKQQDQDDQKAKQFQWPIFWMPAGYNEKRQEAKELKEVDESPKVSEEAPPSPKIKIIPLSWFENGHNDQKPSVKDESHHNERSTVKKQSAGTEHQDGREMKNIPLMPKKESEEKMPARENYKTIPVMPRKDNEENKPAGGNYRIIPVMPVKESDDKKPEASVQRDEKKASSTEMEEENGKRSNEESSKAKNSKLPPVCLRVDPLPRKKSGSGSSRSPSPPTRKDADIAKKDVKEIHMQKQDAKQSDPKKERTVSEAKEKAHDEMNKGRAYGNETVQAASVKQMQEEQFPMSLADQKVQATGVNFDAQENVGEKNLQGSDKNTEGEAKIQGEPAKDYDTTPSINFSEVDAAVCIQSAYRGYNVRRWQPLEKLRMIKNVNEQMKDLKEQLQGIEASSKQLTVKEQVAINETIMNLLLKLDTIQGLHPTVREARKSVARELISLQEKLDCLCKQSSGESIHTNGEKEKPEAMENNFQNTDPVSAIEASEKQEKAAGVDEEQGLSTINSKLLMPDAVSSVVSMYTTQDADPTDHIEESNTTKEEAPNNGGKVATQCDCQGEPSMDVMGDAALLGHSTEQKQQIEESNAISMDKSCEREKDVPPVGGQEIPSGDHMEPLHDEALSENSNELQQCTTSERSSTMISPAAADNSMITMAATSVESSVSADKVSPVEGQVTEAAVEHAPVEKDQCEEPNTTIVDSGDSSVSLKNEELQDHDQAPSGSSIMSNSAEQPEEASDVNMQQQVENVDTTQDATEESDATPEIGMVDVTYADTENYVQSPLLQTTSKLQSTTGQNVLKEPEAAKQSDVSGEYESVLVGKQNESANNLTGDSAKEEPPLVGLGMEADTHESAPRELKDEPILPETERSELSCEHGDITGHEDSEMYAPPECETDVQKESCCVDRRRADMQVPKEVECDELGDDNPKEDASVQTENMASEEASLASATPDGMKDENKVAEETTSDYATPYSSKSDNENKLAEENQKLKEMLQNLLASGSDQMGVITELSEKVKTLERKLARKKRPKDMWQGSGS

SEQ ID NO: 1067 - protein, 788 aa, Magnetospirillum magnetotacticum
MDGKIVWVHAAGKLVRDEANGAIRFMYGAYQDITAVKAAEDAIRAAKEIAEEATKAKSDFLANMSHEIRTPMNAIIGMSHLALQTKLDKKQRNYIEKVHRSGENLLGIINDILDFSKIEAGKMTMESIDFRLEDVMDNLANLVGLKAEDRGLELLFNVAPDIPSALIGDPLRLGQILINLGNNAVKFTEKGEIIVGAELVERSEDQAELHFWVRDSGIGMTPEQCGKMFKSFSQADTSTTRKYGGTGLGLAISKTLVELMDGRIWVESEAGKGSTFHFHVRVGVQSHPPLRRVFSPDELLGLRVLVVDDNAAAREILSAMAKGFGLEVDSAWDGTQALEMVAAAERKDLPYDLILMDWKMPIMDGVETVQKLQHGDHARIPAVIMVTAYGREEAATNAEERGVVMKTVLTKPVTAASLLEAIGETLGKGVVAEHQGQDKAESYKETMKALEGCRVLLVEDNEMNQELATELLSQAGMEVVVAVHGQDALDILARDNRFDGILMDCQMPVMDGYTATRAIRANPALSAIPVIAMTANAMAGDREKVMEAGMLDHIAKPLNLETMFSTMAKWIKVAKAPAKTAPAPREKPKTAEVSGGLPDLPGIDIKAGMATMANKESLYLRMLAKFRDSQGHFADLFAAARQDPDPQAATRAAHTLKGTAGNIGAKGVQSAAAALEQACKEGRPEGEIRQALVSALAELDPVIAALGRMDAPETTKAPAIPEAEVTAALARLAALLEDSDAEAGDLLDELLPKLEGTALAGALKPVADAIEDCDLDLALAKLRGLDVK

SEQ ID NO: 1068 - protein, 430 aa, Ralstonia eutropha
MSTQTPILIIGAGQAGAMAAAELRKLGHAERIVMVGGERHAPYERPPLSKAVLADASQQGQVGVHPAGFYAERDIELRLCTTVSAIDAARSVATCTDGSEIRFDACLLATGGRARTLPHLPAGTPNVHYLRTLDDAARLREAMQGADEVLVIGGGFLGLETASTAVDLGLKVTILESADRLLARAAPAELSDWLAQRVRARGVDLRLGCRITAIEPQAQGVQVRLADGTTWHIPVLVVAIGLTPNTELAAIAGLALHPGNGGIQIDEQGRTSVPNIYAAGDCASQFQPLFGAEMRMESWQSANEQARIAATSMLGLQAALAATPWFWTDQFGCNVQMLGAALPGMRYVWRDMPASGAASPKSMLLGTLDGCLRHAIAVNAGGDLRQLRSLFDLPVNEHLARLCDAALPLRQIVREVQAEISSRTASLTTN

SEQ ID NO: 1069 - protein, 358 aa, Pseudomonas putida
MSQFHSLTIKQVRNETRDAVSIAFDVPEHLQGQFRFTQGQYLVMRTQLDNEEVRRSYSICSAVQDGELRVAVKRVPGGRFSAFANEVLKAGQQLEVMPPSGSFFVPLDPARQGNYLGVAAGSGITPILSIIATTLASEPHSRFTLLYGNRSSSGALFRDKLEDLKNRYLDRLNLIFVFSREQQDVDLYNGRIDADKCGQLFSRWLDVAGLDAAFICGPQAMTETVRDSLQANGMAKERIHFELFAAAGSEARREAREAARQVDSALSHITVISDGRALSFDLPRNTQNVLDAGNAIGAELPYSCKAGVCSTCKCRVIEGEVEMDSNHALEDYEVAAGYVLSCQTYPVSDKVVLDFDQL

SEQ ID NO: 1070 - protein, 913 aa, Gibberella zeae
MSCLPSCFIASKIREFLEEYESQSNREGSSQGTFNLGFTFSFTCEQTSISRGTLVHWDKGWDIPSAIDQDPCSLLQEAVDETGLPVRVCVLANDAVGTLLTKAYTAEKSSSALAAIILGTGTNAAYVEDITNIQRLNTDEKWTEKDHEGVMVINTEWGSWDDDLKVLPQTRFDKLIDESSSDPGCGLLEKMVSGMYLGELLRLIILELVLNGSLSITFEEDSPIHQFTGIETSFLTKITAFGLEDTAGSLDYLTKTLAVKDVTIEEMLKIQALSKAIIKRSARLVGTGLAAIIIQSGRLQPSTTQKTTTTAQTQEIAQKPVKQQKGGAISSLAKFIRSIFGCMRPEDDTSIPVVKSPYGSEEIIESTILVEEDINIAVDGSLFEYHAEFEELMRSALRDVAEIGSVNERRIKIELTKDGSVTSEGQDSYLPQGLFQVSLTLTLTNTSYHYSVSVDDVVTMVKAKSWAITKGLLFLSTLLSTSSVVNADNPIVQTVYTADPAPIVHNGRVYLFTSHDEDGSTNFNMKDWRLFSSNDMVNWQHHPSPMGLTTFSWANDRAWAGQVASRNGKFYYYVPVAMKNGRMAIGVGVSDNILGPYRDALGKPLVENNEIDPTVFIDDDGQAYLYWGNPGLWYVKLNQDMISYSGGVNKVQLTTAGFGSRPNSAERPTNYEEGPWLYKRNGMYYMIYAANCCSEDIRYSTGPTATGPWTYRGVLMAHEGKSFTNHPAVIDFENKSYFFYHNGALPGGSGYTRSVAVESFQYNSNGLIPQLRMSTTGPAQVRSLDPYTRQEAETIAWTNGVETEACSEGGLAVSFINNGDYIKVKGVAFGNGAQSFSARVASANSKGGKIELRLGSETGKLVGTCTVPSTGGWQTWKTVDCPVSGATGTSDLFLRFTGEGSDYLFNVNWWQFK

SEQ ID NO: 1071 - protein, 761 aa, Unknown
  Silicibacter sp. TM1040
MSLAEKLAQERRARLAAERLLELKQAELTDANRKLGRHALALTKRIGATQAEIATFKNENEKVKSDLNTANEKVEQAERRLWHSIQAFQDGFAFFDSDSKLIGANTAYLNIFEGVEEVSPGVSYVRILQILTDEGLIDTEELSADSWRAMMTERWMSPAPEPTVVRLWNDRYLKLIDQRGHDGDIVSLALDITATVHYEEELRSARERAEAANRAKSAFLANMSHEIRTPMNGVVGMAELLSDTTLTEEQRLYANTIKNSGEALLVIINDVLDYSKIEADKLALHPEAFDLEACMHEVVMLLQANARDKGLTLLVDYDLFMPTNFIGDPGRIRQILTNLIGNAIKFTNEGHVTARVTGVPHPEDNTVMLHISIEDSGIGIPDDKIQHIFGEFNQVEDETNRQFEGTGLGLAITERLIKLMDGEIWVESQLGKGSCFGFRLPLVVADGSQVNAPELPENLNCVMIVDDMDINREILNRQLQRLDLKVVAVTSGAEALDVLNAEIDLVITDRNLPGMDGLKLARSLHHASPQTPVLLLSSDPADGSDPALSDLFAGILQKPIPRGALFRALSKLDAPSVHPARPQDVPPAAPAIEPPSDAPVQVPAPEAGVDFGSGATIASDLRRMRVLAAEDNRTNQLVFRKMVKDMNIDLRFAGNGLEAVELYQSFKPDMIFMDISMPKMDGKEATQAIRELEKENGRRVQIVALTAHAMDGDSEGILAAGLDDYLTKPLRKSVIHDRIMKNMPTAVAPLQGEGDDLQATG

SEQ ID NO: 1072 - protein, 495 aa, Pisum sativum
MSKSSQQLNVEVEEVVDDSSPSFLNNYHEIDEKVVQQIVYDALVFTTLNGLLVGDKSVQRSGRVPGVGLVHLPFSLLPPPFPQTHWNQACELAPLFNELVDRVSLDANFLQQSLSRTKKVDEFTSRLLDIHSKMLEINKKEEIRLGLFRSDYMFDEKTQSLLQIEMNTISTSFSGVGCIITQLHRNILSRYGKSLGLDSERVPTNTADSKYAEALAKAWSEYNNPSAVIIVVVQAEERNMYDQHFVSAILRERHHITTIRKTLAEINQEGEILSDGTLSVDGQVVAIVYFRAGYTPADYPSESEWKARLLIEQSSAIKCPNISYHLVGTKKIQQELAQPNVLERFFENKEDIAKLRKCFAGLWSLEDSDIVKRAIETPELFVMKPQREGGGNNIYGDDLRETLLKLQKSDSQEDAAYILMQRIFPVNTEAILVRNGFLHKDRVISEFGIFSTYLRNKDKVIVNNESGYMVRTKPSLSDEGGVLPGFGVIDSVYLT

SEQ ID NO: 1073 - protein, 543 aa, Phaseolus vulgaris
MGGRSGCLFCSPSFTGIKTKPLSSYTFPSFSFTFSPHQPHSLSFPKLMSQPLTLNSAPLAEPDTDSSAAPPLFDYHSIDQKLLENIVYDALVWSTLNCLLVGDKSVQRSGTVPGVGLVHLPLCLLPGPFPESHWKQACELAPIFNELVDRVSLDGKFLQESLSRTKNADEFTSRLLDIHSKMLQINKKEDIRLAIVRSDYMVDEKTNSLLQIEMNTISTSFALIGCLMTGLHKSLISQYGNILGLDSNRVPANNAVDQSAEALAKGWSEYNDPRAAILVVVQVEERNMYEQHYISALLRDKYHIKSIRKTLAEVDQEGEILPDGTLSVDGQPISVVYFRAGYTPKDYPSESEWRAGLLMEQSSAIKCPSISYHLVGTKKIQQELAKPGVLERFVENKDHVAKLRACFAGLWSLEDSDIAQKAIENPELFVMKSQREGGGNNIYGDDMRENLLKLQKAGSEEDAAYILMQRIFPATFPAILVRDGNWSTGHVIAEAGIFGTYLRNKDKIIINNESGYMVRTKVSSSYEGGVLPGFGVVDTVYLT

SEQ ID NO: 1074 - protein, 379 aa, Oryza sativa
MSTSAPISSPEPPEFIRGSLIPALPDDLAIHCVALLPRAAHPSLALVSRAFHTLLCRDPGPLLAARRRLRLSDPHVILSLRPPASASPLFFLLLPHPGWPPLPLPSPPVPVSSSSSVAVDGNRVFLFGGSVSGVPSPSVQILDPRTRFWSVGPRLSSPREFAAAVAHSGVLFVAGGCVPSSPFWAESLNLSSPDAKWSPVPSPPHFREKWMHGSASLAGKVLAVADRGGLAYDPAAPPTEAWAPVSPILDMGWKGRAAVVGGILYSYDYLGQVKGYDPDTDCWSKVEGLEQELPKFLCGATLANVGELLYLVWEGKWKGKGKAKGKGEARSMVVIDWAAIVVTKAEEGRLTGKVLSRDTIVFKDMPKGSAITHCIALEL

SEQ ID NO: 1075 - protein, 459 aa, Candida glabrata
MGQILSNPVIDKEHHSGADLLTAFGLCAMQGWRMSMEDAHIVEPNVLPETDDEHIAFYSIFDGHGGSAVAQFCGSKMVSILTSQESFKEKKLKQALIDTYLKTDEELLKDPEMRNDHSGCTATSILVSKLQQTLVCGNSGDSRTVLSINGVAKALSFDHKPTLTSERSRIVAADGFVEMDRVNGNLALSRAIGDFEFKSNDKLGPHEQIVTCVPDIVEHRLNYDNDEFVILACDGIWDCLSSQECVDLVHHGIMKGDMSLNDISSRIIDVCCSPTTEGTGIGCDNVSIVVVALLKENETINAWFERMRNKGYKPPHSFEEQRRSIFSYYQFPEDDEKVFDVTTKKPQDRFNQDSEISTGDEDERNKMEIDEDDNDRSGAQKKTGASIPVDLLSLEALLNGAGNIQLNQGPDNVSYISGSSLTDMINSLSRAAAMANNTRDSDSEEEDTKIIEDVSDKQE

SEQ ID NO: 1076 - protein, 77 aa, Zygnema circumcarinatum
MKKQNLIEMEGVVTESLPNAMFRVYLDNGCEVLAHISGKIRRNYIRILLADRVKVELSPYDLTKGRITYRLRTKSNG

SEQ ID NO: 1077 - protein, 336 aa, Carboxydothermus hydrogenoformans
MGSIKVTVLGAGSWGTALSNLLAQKGVNTVLWGRDSAVIEEINRERENKRYLPGVKISQELIATADLEFALKDANFLVAAVPSQAFRDLLQKIKPYFKPEQILVNTAKGIEEGSLLRMSAVFTEVLPEYRDNYTILSGPSHAEEVGRGIPTAIVVSGYSPEKLYKVQELFSTEYFRVYTNDDLTGVELGGSLKNIIAIASGICTGLGLGDNTRAALVTRGLIEITRLGIKLGAKKETFMGLSGLGDLFVTAGSRHSRNYKAGILIGEGKSLEETQKEINMVVEGIRTTRAAYQLAQRLEVEMPITEALYKVLFAGLPPREGLFGLMTRAKKEELNF

SEQ ID NO: 1078 - protein, 107 aa, Haemophilus influenzae
MSEVLHINDADFESVVVNSNIPVLLDFWAPWCGPCKMIAPVLDELAPEFSGKVKIVKMNVDDNQATPAQFGVRSIPTLLLIKNGQVVATQVGALPKTQLANFINQHI

SEQ ID NO: 1079 - protein, 428 aa, Bacillus anthracis
MFCYQCEQTPTGGCKVMGVCGKNETIASLQDTIVFGLKGIAAYRTHAAQLGYTDAFVDATTQEALYMTLTNSNFNEQEHIDMAMKVGKSALRVMELLDKAHTNHFGVPEPVQITQNRVEGKAIVVTGHNLFALEELLKQTEGKEINIYTHSEMLPAHGYPQLKKYKHLKGNIGKAWYDQRRLFEKFTGAILATTNCVMPIKGSYSDRFFSYDIAGLEGVQKIENDNFAPLIQKALELPEVHMESDEQLVTGFHHNTVLSLAPEIIEAVKEGKIKRFFVIAGCDAPGKGGEYYRELATSLPPETVILTTSCGKFRFNDVDYGVVPGTEIPRYIDLGQCNNSISTVKIAAALADAFQCEVNELPVSIVLSWFEQKAVAILLGLFSLGIQDIRIGSKAPEFISAGVLDVLQETFGLKLITTAAEDMEMMLS

SEQ ID NO: 1080 - protein, 175 aa, Arabidopsis thaliana
MANHETIFDQLKKQIPVDEEEPLILNRDSSVGLVIVDVVNGFCTIGSGNMAPTKHNEQISKMVEESAKLAREFCDRKWPVLAFIDSHHPDIPERPYPPHCIIGTEESELVPALKWLESEDCATLRRKDCINGFVGSMESDGSNVFVDWVKEKQIKVVSFSFDKMLSFDVEQVYCF

SEQ ID NO: 1081 - protein, 208 aa, Idiomarina loihiensis
MGKKRSVSSQRWLKEHFDDQFVQKAQKKGLRSRAVFKLEEIQKRDKLIKKGQTVVDLGAAPGGWSQYVADYFNGDGQIIACDILAMDPIAGVDFLQGDFREESVLEALLERIGGKNVDVVLSDMAPNMSGNGTVDQARSMYLVELALDMCHQVLKPGGSFAVKVFQGQGFESFLKDVRAAFNDVKTRKPESSRARSREVYLVATDYKL

SEQ ID NO: 1082 - protein, 982 aa, Neurospora crassa
MEAPALEQRQSLHDSSERQQRFTSLILPNGVGCSSREEPQGSGGLLVPHNDNDIDNDLASTRTASPTTTDFSSSSSDDNSTTLETSVNYSHSSNTNTNTSCPPSPITSSSLKPAYPLPPPSTRLTTILPTDLKTPDHLIRDPRLIRLTGSHPFNVEPPLTALFEHGFLTPQNLHYVRNHGPIPSSVATPPATINKEEDDSLLNWEFTVEGLVEHPLKISVRELMDASKWDNVTYPVTLVCAGNRRKEQNVLRKSKGFSWGAGGLSTALWTGVGLSEILARAKPLTKKGGGARYVCFEGADQLPNGTYGTSVKLAWAMDPNKGIMVAHKMNGENLHPDHGRPVRVVVPGQIGGRSVKWLKRIVVTKGPSENWYHVFDNRVLPTTVGPEESGEKTEEMERVWRDERYAIYDLNVNSVICEPGHGEVVSLRGDQGPGTYRLRGYAYAGGGRRVTRLEVTLDQGKSWRLAGIEYPEDRYREAQDGEELFGGRLDVSWRESCFCWCFWDLEIPLSELRKAKDVCIRAMDESLALQPKEMYWSVLGMMNNPWFRVVIHHEGDTLRFEHPTQPMLTSDGWMDRVKKEGGNLANGFWGEKVPGAEENVVKEEPVKEISMVDEKVTRLITLEELRQHDGEEEPWFVVNGQVYNGTPFLEGHPGGAASITGAAGQDVTDEFLAIHSENAKAMMPTYHIGTLTPSAPAALKSSSTSDPALSDPSRPIFLQSKTWNSAILTFKESVSPDTKIFHFALSHPAQSIGLPVGQHLMMRLPDPAKPTESIIRAYTPISDGTLERGTLRVLVKIYYASPTEDIKGGQMTQALDALALGKAVEFKGPVGKFVYQGRGVCSVNGRERKVKRFVMVCGGSGVTPIYQVAEAVAVDDQDGTECLVLDGNRVEGDILMKSELDELVERAKPMGRCRVKYTLSRPGAEWEGLRGRLDKTMLEREVGEGDLRGETMVLLCGPEGMQNMVREVLKGMGWKDEDVLVF

SEQ ID NO: 1083 - protein, 414 aa, Synechococcus elongatus
MAAPARAFVYQAYQAANQLARTKPLVRSQALQAIAQAIDSARDGILEANTLDLEACQDSEMPDLLRRWLKLTPERLDRTVEILERLSVRSDPIQQVMRASFQHEHSQAYSQLMPLGVIAFVYEALPELAAIATGLCLRVGNSILLKGGTEAVHTNQAIVSVMQEALESTELPTTSLISLPEDDPATSLAALVTQDQWIDLVIPYGRPELVQQVARLATSPVLRTSMGNCYLYWASGGELETVRWMILDSHASEPDAVNAIEKVLIDRDCNLSKLTVLMDSLRSKGFRLKGDEELVQEMPELELARHEDWSRPYLSRTVAFKLVPGIEAATDWINTHSSGHADSIVTDSYEDSRAFSRELNSAMVHVNASPRFSRSPRHSNEIALGMSNQKGYRRGRITLETLTTIKQVVLGLGQ

SEQ ID NO: 1084 - protein, 382 aa, Geobacter sulfurreducens
MRKRINLLREFSVPLIAGVVVALLWANLDPAGYHSFIEQPFFGGMSFHFVVNELFMVLFFGIAAVEITQSCLPGGDLNPLRKAVNPLLATLGGVVGPVLVYLGLNAIIGGPELTRGWGIPTATDIALAWLVARLVFGAGHPAVSFLLLLAVADDAIGLAIIAVFYPDPNHPTEPIWLFLTVAGMVVAYILRSLKSRSYWPYVVVGGGLAWTGLFKAHLHPALALVFIIPFLPHPSRETAHLFEADPRDTSTLARFEHDWKIVVDFGLFMFGLANAGVGFSSVGAATWLVLASLVIGKTLGIFAMGYVGRALGFPLPQQVGAKELAMTGLVAGIGLTVALFVAGVAFVEPDIQGSAKMGALLSGGVSIVAIMLGRALNVRRIP

SEQ ID NO: 1085 - protein, 700 aa, Oryza sativa
MSVSSSSMGGGGGGDAGGRTVVWFRRDLRVEDNPALAAAARAGGEVVPAYVWAPEEDGPYYPGRVSRWWLSQSLKHLDASLRRLGAGKLVTRRSADAVVALLQLVRDTGATRLFFNHLYDPISLVRDHRLKEMMAAEGIIVQSFNADLLYEPWEVVDDEGQSFTMFAPFWNRCLSMPYDPAAPLLPPKRINSGDLSMCPSDDLIFEDDSERGSNALLARAWSPGWQNADKALTAFLNGPLIHYSVNRKKADSASTSLLSPYLHFGELSVRKVFHLVRMKQLVWSNEGNRAAEESCTLFLRSIGLREYSRYLSFNHPCSHEKPLLAHLRFFPWVINECYFKIWRQGRTGYPLVDAGMRELWATGWLHDRIRVVVSSFFVKVLQLPWRWGMKYFWDTLLDADLESDALGWQYISGSLPDGRELDRIDNPQLEGYKFDPHGEYVRRWLPELARLPTEWIHHPWDAPASVLQAAGVELGSNYPLPIVGLDAANARLQEALSEMWQLEAASRAAMDNGMEEGLGDSSEVPPIEFPRELQMEVDREPARVTANVLTTARRREDQMVPTMTSSLNRAETEISADFMNSVDSRAEVPTRVNFEPRTEREENFRTTAGNVARTNGIHEHNNFQQPQHRMRNVLAPSVSEASSGWTGREGGVVPVWSPPAASDHSETFASDEADISSRSYLDRHPQSHRLMNWSQLSQSL

SEQ ID NO: 1086 - protein, 721 aa, Unknown
  Candidatus Desulfococcus oleovorans Hxd3
MTEHVFEATVNGKPFTIKTGRLAKQAAGAALVQYGETIVLVTVAAATEPKEDADFLPLSVEYQEKIYSAGRIPGNYFRREIGRPSEKETLTCRLTDRPIRPLFPAGYTFETQVITTVLSMDRENDPDVLSIVGASAALTISDLPFDGPLAAVRVGRLNGTLVANPTNTELDDCDINIVVAGSRSGVVMVEGGSNVVSEAEMLEAIFFGHNALLPLIDIQDQMRNACGKPKRVIVPPEKDTELETRIAELVGDAVAQAVTEPEKDARKSALSKVRENLFQGLGEAFADRKREIKGLFSDLVKKVCRDIVLNQGRRIDGRAFDEVRPISCEVGVLPRTHGSALFTRGETQVLGVMTLGSGHDEQRVETLFGDETRPFMLHYNFPPFCVGEVKRVMGPSRRDIGHGNLAHRGISYVLPDKETFDYTIRLVSEVLESNGSSSMGTVCSCILALMDGGVPIKAPVSGIAMGLVADGDKVAVLSDILGDEDHFGDMDFKVTGTEKGITALQMDIKIKSLSREILEKALHQAKDGRIHILGKMLEALSHYRDDISPYAPKIYIVKIHPDKIREIIGPGGKVIRELQAMSNTRIEVDDSGTVKIAASTEEEARIAIKAVEDIGRVPEPGEIYEGEVVRITDFGAFIQIKNGTDGLCHISELEHHHVKSVTDVVKMGDKVRVKVLEVSPEGKIRLSRKALLPAPEKGEEDEKSAPRSRRPGGNSDRRNNR

SEQ ID NO: 1087 - protein, 877 aa, Oryza sativa
MLSVRCGGGGGGAAAVEEHGAVRHHRPLTPRQQQQLRTVVESLRLDPLEVDEGARLEIARQSYRAGDYKAALEHCNAVYRANPRLLENLLLLGAVYYQLREFDMCIAKNEEAVAIQPNCPECFNSIANAWREKGDVDNAIQFYVHAVQLRPTFADAWTNLANAYTRKGNLSQAAECCHQALALNPHLADAYCNLGDVLKAQGLYREAYSHYLDALNIKPTFANAWNNIAGLLMQWGDFNKAAVYYKEAIKCNPAFYDAHLNLGNLYKVTGMRQDAIVCFQNAARAKPENAVAYVFSGNLGNAYHEQGQLDLAILSYRQAIHCNSSYVEAYNNLGNALKDAGRNEEAISCYQTCLALQPSHPQALTNLGNVYMERNMMDIAASLYMATLTVTTGLSAPYNNLAMIYKQQGNCNHAITCFNEVLRIDPMAADCLVNRGNTFKEAGRITEAIQDYFHAVTIRPTMAEAHANLAAAYKDTGLLEASIISYKQALQLRQDFPEATCNLLHTLQMSSLPSVQPFHAIAYPIDSTLALEISRTYAAHYSLVASRFGLPTFTHSYPVPISNDGRTSRLRIGYVSSDFGNHPLSHLMGSIFGMHNQDTIEVFCYALSHDDGPEWRQRIRSEAEHFIDVSSMSSDMIAKVINEDKIQILINLNGYTKGARNEIFALQPAPIQVSYMGFPGTTGADYIDYLVTDEFVSPLKFSHIYSEKLVHLPHCYFVNDYKQKNRDVLGPVCPHKRADYGLPEDKFIFACFNQLYKMDPDIFNTCPLCNGHTTGTDILWAGLPMITLPLEKMATRVAGSLCLATGIGEEMVVNRVSFFTSVNKNGRLLVWSVIVISGPEDWWQFRSWMVVVLFSEIVGLDSFKLQYPPCPVFIIHG

SEQ ID NO: 1088 - protein, 146 aa, Unknown
  Photobacterium sp. SKA34
MEYLHTMVRVSNLDASLDFYCNKLGLVEIRRKESERGRFTLVFLAASNQAETAKETQSPLLELTYNWDPESYTGGRNFGHLAFAVDNIYDLCAHLQNNGVVINRPPRDGHMAFVRSPDGISIELLQKGDALEAAEPWVSMQNQGEW

SEQ ID NO: 1089 - protein, 138 aa, Oryza glaberrima
SDDKALKRHLLRKYSGYLGGLRKELSKKRKKGKLPKEARQKLLTWWELHYRWPYPSEMEKIALAESTGLEQKQINNWFINQRKRHWKPTEEMQFAVMEAYHHQSTDAAAAFYVDVDARLVGATAAAPAAAVYTARPDH

SEQ ID NO: 1090 - protein, 255 aa, Glycine max
MCKGRTLMRIQTLVLVHLSLIRGMSLMKSNGFLQNAWGIYRGEFWQGMGLHLNALAALKEYNGTQVEKLSSGRQLSLPSSTSLQITTSQEHQHLSWVPVSSEREWDPSDIGVHPAEDCSQPSAYMAGEDFNQNSPRMKRRKSETPGDTEGCKRCNCKKSKCLKLYGGCLAAGVYCIEPCSCQDGFNKPIHEDTVLQTRKQIESRNPLAFAPKVIRNSDSVPEIGDDPNKTPASARHKRGCNCKKSSCLKKYCECY

SEQ ID NO: 1091 - protein, 119 aa, Zea mays
  misc_feature (55)..(55): Xaa can be any naturally occurring amino acid
RGGRNTFFFLLNNGGSPIGGGVPGGPFNVFKNGNSPGLGEGFPNGGGGCSPPKVXPGGGVAGARGAPFGLKKGCFFFFGVFGLKGAPPKALFGGGFGVFGGNTPPPNPPGIPPVSRIAL

SEQ ID NO: 1092 - protein, 156 aa, Glycine max
LNLSNLCVLLRLFDYIQGKNNYKQKIEMTAPVISEVLPSDGPFCESSFVVSFYVPKENQANPPPAKGLQVQRWKTVFVAVRQFGGFVKDSSVGEEAAALKASIAGTKWADAVEKSQKRAGHASVYTVAQYNAPFEYDNRVNEIWFLFDIENELQTV

SEQ ID NO: 1093 - protein, 472 aa, Bacillus thuringiensis
MNHLRGGSEVANKELKRGLEARHIQMIALGGTIGVGLFMGSASTIKWTGPSVMLAYAIAGIFIFFIMRAMGEMLYMEPSTGSFATFGHKYIHPLAGYMTAWSNWFQWVIVGMSEIIAVGAYMQYWFPDLPAWIPGVIAMVILGAANLISVKSFGEFEFWFAMIKIVTILLMIIAGFGLIFFGIGNGGEAIGISNLWSNGGFFTGGFSGFFFALSLVVGAYQGVELIGITAGEAKDPKKTLTRAIQSTIWRILIFYIGAIFVIVTVYPWDQLSTIGSPFVATFAKVGITAAAGLINFVVITAAMSGCNSGIYSAGRMLYTLGVNGQAPKYFTKLSGNGVPLFGTVGVIIGLAVGVVLSYIAPKNLFVYVYSASVLPGMVPWFVILISQINFRKEKGTEMKDHPFKMPFAPVTNYLTIAFLIMVLIGMWFNDDTRISLVVGIVFLAIVTISFYAFGIGKRPPLDVPNDQEISSK

SEQ ID NO: 1094 - protein, 413 aa, Rhodopirellula baltica
MKAFEATRIFFDQAADRLEIDPDLREALLMPQREVQVQVTIRLDDGRLANYIGFRVQHDHSRGPMKGGLRFHPEVDLDETRALASLMTWKTAVVDLPYGGAKGGIGIDPSKMSSAEIERLTRAFVDQIHDIVGPDTDIPAPDMGTDHQVMAWFRNQWEKYHGFHPAVITGKPVEEYGAKGREEATGRGVGTLTVKLTKRLGMDASKTRVAIQGFGNVGSHAAKFLHDAQFPIVAVSDITGTYYNADGLNIPELLRHKFAHPKGLLEGFERAEHLPLDALLKLDHVEVLIPAALGGVITQKNAQDINAKVIVEAANGPVDPDADAALHDRGVTILPDILANAGGVTVSYFEWVQNRQHYRWPLDRVRQELDHTMNEAFEKVWQMAAQHEVSLRTAAYMIGISRVRRATELAGLA

SEQ ID NO: 1095 - protein, 76 aa, Phyllostachys pubescens
GGNDMRTFYTLVMVDPDAPSPSDPNLREYLHWLVTDIPGTTGAAFGQEVVCYESPRPTMGIHRFVFVLFQQLGRQT

SEQ ID NO: 1096 - protein, 153 aa, Oryza sativa
MAPKAEKKPAAKKPAEEEPAAEKAEKAPAGKKPKAEKRLPAGKGEKGSGEGKKAGRKKAKKSVETYKIYIFKVLKQVHPDIGISSKAMSIMNSFINDIFEKLAGESAKLARYNKKPTITSREIQTAVRLVLPGELAKHAVSEGTKAVTKFTSS

SEQ ID NO: 1097 - protein, 158 aa, Glycine max
MAAASTMITLKFSFLWSLLLSVSLLGVKSSHSHQNGGRRTIPPTCKRIECPTHDVIEVGDGYEIRRYNNNSTVWMSTSPIQDISLVEATRTGFRSLFDYIQGKNNYKQKIEMTAPVITEVSPSDGPFCKSSFVVSFFVPKLNQANPSSAKGLHVQRWN

SEQ ID NO: 1098 - protein, 319 aa, Rhodopirellula baltica
MGGYSLMSRGKTFDNIARAIGDTPMVQINRLVPSGDATVFAKCEFFQPLNSVKDRIGVAMIEAGERDGSINPDTHIIEPTSGNTGIALAFVCAAKGYKLTLTMPESMSVERRALLRAMGANLVLTPAGDGMKGAITTAQELVDQTDNSFMPQQFENPSNPAIHEATTGPEIWADTDGKIDAIVAGVGTGGTITGVARYLKKQNPDFKAFAVEPKHSPVISGGSPGKHRIQGIGAGFIPGNLDTSIIDDVVQVDDEDAFEWGRQLAKQEGIVAGISSGANMWAAAQIAARPEMKGKRIVTVMCSLGERYLSTPLFGDLGL

SEQ ID NO: 1099 - protein, 87 aa, Pharus virescens
KPSQVVHQPRVDVGGNDLRTFYTLVMVDPDAPSPSDPNLREYLHWLVTDIPGTTGAAFGQEVMCYESPRPTMGIHRFVFVLFQQLGR

SEQ ID NO: 1100 - protein, 180 aa, Nicotiana tabacum
MASSVLSSAAVATRSNVAQANMVAPFTGLKSAASFPVSRKQNLDITSIASNGGRVQCMQVWPPINKKKYETLSYLPDLSQEQLLSEVEYLLKNGWVPCLEFETEHGFVYRENNKSPGYYDGRYWTMWKLPMFGCTDATQVLAEVEEAKKAYPQAWIRIIGFDNVRQVQCISFIAYKPEGY

SEQ ID NO: 1101 - protein, 87 aa, Puelia ciliata
KPSMVVHQPRVDVGGTDMRTFYTLVMVDPDAPSPSDPNLREYLHWLVTDIPGTTGAAFGQEVVCYESPRPTMGIHRFVFVLLQQLGR

SEQ ID NO: 1102 - protein, 332 aa, Phaseolus coccineus
MVVLSQPALNQFFLLKPFKSTPLFTGIPVVDLTHPDAKNLIVNACRDFGFFKLVNHGVPLELMANLENEALRFFKKSQSEKDRAGPPDPFGYGSKRIGPNGDVGWVEYLLLNTNPDVISPKSLCIFRENPHHFRAVVENYITAVKNMCYAVLELMAEGLGIRQRNTLSRLLKDEKSDSCFRLNHYPPCPEVQALNRNLVGFGEHTDPQIISVLRSNSTSGLQICLTDGTWVSVPPDQTSFFINVGDALQVMTNGRFKSVKHRVLADTTKSRLSMIYFGGPALSENIAPLPSVMLKGEECLYKEFTWCEYKKAAYTSRLADNRLAPFQKSAAD

SEQ ID NO: 1103 - protein, 556 aa, Francisella tularensis
MSENFKELFEQSLKQTEMRIGKIIEATVVSIDKEFAMIDAGLKSESFIPVSSLKNSNGELEVAAGDRINVVLEALDNSCGETRLSRDKAKKIELWDRIEKAFENNETVLGKITNHVRGGYTMDVEGLRAFLPGSLVDTRPIKDVAHLEDKDIELKVVKIDTKRNNIVVSRKAVIEENNSGDRDAMLEKISEGSVLKGIVKNITDFGAFIDLGGVDGLLHITDISWSRISHPTDVLSIGQEIDVKVIKFDKEKQRISLGIKQLGEDPWLNIANELPVGAKLMGTVTNITDYGCFVKLKEGIEGLVHTSEMDWTNKNVNPHKAVSIGQEIEVIVLELDADNHRISLGIKQCRPNPWSEFEKNYKPGDKVTGKIRSITEFGVFIGLEGGIDGLVHISDVAWDNPAKAIKELKKGDEVEAVLVSVNTDLERIALSMKQLSEDPFKNFINIHPKGSLVTGKVTKVQDNGAVVMLDEDNNIDGFIRISEISAEHTKDVRDELSEGQEVEARIINIDAKKRSITLSIKAVDEDNTAAGKSNYKVEQMTPTTLGDLIKEQLNKK

SEQ ID NO: 1104 - protein, 365 aa, Triticum aestivum
MVRPVFDAAVLSGRSDIPSQFIWPEGESPTPDAAEELHVPLINIGGMLSGDAAAAAEVTRLVGEACERHGFFQVVNHGIDAELLADAHRCVDNFFTMPLPEKQRALRRPGESCGYASSFTGRFASKLPWKETLSFRSCPSDPALVVDYIVATLGEDHRRLGEVYARYCSEMSRLSLEIMEVLGESLGVGRAHYRRFFEGNDSIMRLNYYPPCQRPLETLGTGPHCDPTSLTILHQDNVGGLQVHTEGRWRSIRPRADAFVVNIGDTFMALSNGRYKSCLHRAVVNSRVPRKSLAFFLCPEMDKVVAPPGTLVDASNPRAYPDFTWRSLLDFTQKHYRADMKTLEVFSSWIVQQQQGQLALQPAMT

SEQ ID NO: 1105 - protein, 371 aa, Bacillus subtilis
MTPDTSMKRVVVKIGSSSLTSLHGEISIRKLEALVDQVVKLKDAGYEVILVSSGAVAAGYRKLGFIQRPEKLPEKQASASIGQGLLMEAYSKLFLAHGYVASQILITRSDFSDEYRYNNVRNTMNVLLERGIIPIINENDTVTVNRLKFGDNDTLAAKVAGLIDADMLVILSDIDGLYDGNPRTNPEAKKIQRVSEITPDIEACAGDTGSIVGTGGMRSKLDAFKIVMASGIKGFLGQADAGDILYHAVHEQAEGTYFEAEGTLPLNQKEQWIAFNSGPEGEMILSDDCSRKITNGQSSLYLDGVQKIKGKFKSGSVVRLMDSKGTEIGLGIVNYSSVQLQEPEKKKELTNRALIDQEAFVCHVDFSLPVN

SEQ ID NO: 1106 - protein, 464 aa, Unknown
  Sulfitobacter sp. EE-36
MDHFPIYLSTKGQRIVLSGGGEAALAKLRLLLKTEAKISVFASTPAPEIAAWADAGRLTLHTRALRHGDVLCAKLFYAADEDETEDARTAAIARAEGALVNIVDNLHDSAFITPAIVDRDPVTIAIGTEGAAPVLARAIKADLEERLPTTLGTLARIGKGFRKMADALPFGRPRRDFWRDYYFAAGPRAVADGKAAVENALNTLLFDHQSRAARAGHIAFVGGGPGDPELLTLKARRALDEADVVIYDRLISPEILELARREALMIDVGKEGFGPSTAQETINDLLVEHAQAGAQVVRLKSGDATIFGRLDEEIDAVDAHGIGWHIVPGITSASAAVATIGQSLTKRGRNASVRFLTGHDMKGFADHDWAALARPGEVAAIYMGKKSARFIQGRLLMHGADRSTPVTLVENASRADQRIVETTLDRLPTDLNAANLTGPALTFYGLAPRAAARATTELFQEEMA

SEQ ID NO: 1107 - protein, 480 aa, Thermus thermophilus
MGQKKGPVAEGLPPGFPGGRRGRGKGLSPRESRTRRTSKGASKRAWARPQSSPPRGVWQGCKLHSMLRLDTRFLSGFPEALSRHGPLLEEARRRLLAKRGEPGSMLGWMDLPEDTETLREVRRYREANPWVEDFVLIGIGGSALGPKALEAAFNESGVRFHYLDHVEPEPTLRLLRTLDPRKTLVNAVSKSGSTAETLAGLAVFLKWLKAHLGEDWRRHLVVTTDPKEGPLRAFAEREGLKAFAIPKEVGGRFSALSPVGLLPLAFAGADLDALLMGARKANETALAPLEESLPLKTALLLHLHRHLPVHVFMVYSERLSHLPSWFVQLHDESLGKVDRQGQRVGTTAVPALGPKDQHAQVQLFREGPLDKLLALVIPEAPLEDVEIPEVGGLEAASYLFGKTLFQLLKAEAEATYEALAEAGQRVYALFLPEVSPYAVGWLMQHLMWQTAFLGELWEVNAFDQPGVELGKVLTRKRLAG

SEQ ID NO: 1108 - protein, 384 aa, Unknown
  Synechococcus sp. RS9917
MRVSTAGSGDSQERMFTVVVLGLQSGRQRRAERRFTVGFSQLQATVRRITASGGTIQAVIPGAADGASPAPSSTPAAAAVTASAPKPAHKAVPVNLYKPKSPFIGTVTENYSLLAEGAIGRVQHITFDLSGGDPQLHYVEGQSIGIVPEGEDANGKPHKLRLYSIASTRHGDNYADHTVSLCVRQLQYEKDGETVNGVCSTYLCDIEPGSKVKITGPVGKEMLLPDDEDANVIMLATGTGIAPMRTYLRRMFEPKERELNNWHFRGKAWLFMGAPKTPNLLYDADFEHYQEQFPDNFRYTKAISREQQNSKGGRMYIQDRVLEHADEIFAMIEDPKTHVYMCGLRGMEPGIDEAMTAAAAAKGLDWSELRPQLKKAERWHVETY

SEQ ID NO: 1109 - protein, 407 aa, Clostridium perfringens
MRYIVVGASAAGISGAKTLRELDKDAEIILVSKDENVYSRCILHHYISGHRDIEALDFTDRDFFEKYNIEWKKGLEVKSIDDREHVIGLSNGESLKYDKILLATGASAFIPPVENLREAKNVVGLRNLEDAIKIKEEAEKVKNVVVLGAGLVGIDAIAGLVGKNLNVTLVEMGDRVLPIQLDKYASSKYEKRFEDAGIKLKLGVRAEKVLIDENKNPKALLINTGEEIPCELIIVATGVRSNVAFLKDSSIETDRFGLIINEKGETNARDVYGAGDITGRNPIWPTAVKEGIIAANNMVGNEIFMEDFFGSKNTMNFLGLTTMSLGVVNVPDDSYTEEIDISGENYKKIIHKDGKIYGAIIQGDLSYAGVLTQLIKEKIHVSKVKKPLFEIDYADFFNIKENLEYTY

SEQ ID NO: 1110 - protein, 175 aa, Brassica napus
  misc_feature (93)..(93): Xaa can be any naturally occurring amino acid
  misc_feature (168)..(168): Xaa can be any naturally occurring amino acid
GMGVSGGEEGARNGPSLMPGGSFQAYNNVKDILEKVAAQVEDGPCVTYIGEGGSGNFVKMVHNGIEYGDMQLISEAYDVLKNVGGLSNDELAXEIFTEWNRGELESFLVEITSDIFRVKDEFGDGELVDKILDKTGMKGTGKWTVQQAAELSVAAPTIAASLDCRYLXGLKDERE

SEQ ID NO: 1111 - protein, 433 aa, Arabidopsis thaliana
MSLKIKFLLLLVLYHHVDSASIVKFLPGFEGPLPFELETGYIGIGEDENVQFFYYFIKSENNPKEDPLLIWLNGGPGCSCLGGIIFENGPVGLKFEVFNGSAPSLFSTTYSWTKMANIIFLDQPVGSGFSYSKTPIDKTGDISEVKRTHEFLQKWLSRHPQYFSNPLYVVGDSYSGMIVPALVQEISQGNYICCEPPINLQGYMLGNPVTYMDFEQNFRIPYAYGMGLISDEIYEPMKRICNGNYYNVDPSNTQCLKLTEEYHKCTAKINIHHILTPDCDVTNVTSPDCYYYPYHLIECWANDESVREALHIEKGSKGKWARCNRTIPYNHDIVSSIPYHMNNSISGYRSLIYSGDHDIAVPFLATQAWIRSLNYSPIHNWRPWMINNQIAGYTRAYSNKMTFATIKASGHTAEYRPNETFIMFQRWISGQPL

SEQ ID NO: 1112 - protein, 421 aa, Bacillus halodurans
MEDKDKRSGKTTDVLASTQTVIKKALDKLGYPDEMYELMKEPIRMLTVRIPVRMDDGSTKIFTGYRAQHNDAVGPTKGGVRFHPNVTEKEVKALSIWMSLKAGIVDLPYGGGKGGIVCDPRDMSFRELERLSRGYVRAISQIVGPTKDIPAPDVFTNSQIMAWMLDEYSRIREFDSPGFITGKPIVLGGSHGRESATAKGVTICIREAAKKKGIDLQDARVVIQGFGNAGSFLAKFMHDAGAKVIGISDAYGALHDPDGLDIDYLLDRRDSFGTVTKLFKNTISNEELLELDCDILVPAAIENQITEKNAHNIKAQIVVEAANGPTTIEATEILTNRDILLVPDVLASAGGVTVSYFEWVQNNQGYYWTEEEVEGKLEAVMVHAFDNIYKLAKGRKVDMRLAAYMVGVRKMAEASRFRGWV

SEQ ID NO: 1113 - protein, 347 aa, Bacillus anthracis
MKDLIIIGAGQAGLTMGYYLKQEGYNFLLLEAGNRVGDSWRNRYDSLQLFTPRSYSSLPGMALIGEKNEFPYKDEIATYLEEYARHFQLPVQLQTEVLKIRKEKGIFELHTSTEILQTKKVIIATGGFQQPFIPSVSANLSSHVFQIHSSQYKSPSQIPQGKVLVVGGGNSGMQIAVEFAKTHEVTMSISHPLTFLPLHLFRKSIFNWLDKLGLLYAEVNTKRGKWFQKRKDPIFGFEGKELIRNGAIQLQEKVVSASENNIMFQNGETYSAESIIWSTGFIQNYNWIEIEKVVNENGLPNHIKGISPVRGLYYIGLPWQSQRGSALICGVGKDAAYLLSEIKKIDQ

SEQ ID NO: 1114 - protein, 384 aa, Idiomarina loihiensis
MATQDFYQVLGVSKDANERDIKKAYKRMAMKYHPDRTEGDKDMEIKFKEIKQAYEVLSDPQKRQMYDQYGHEAFEQARQGGAGHGAGGFGGGGADFADIFGDVFGDIFGGGRRQQARAQRGADLRYNLDMSLEEAVRGKTVELEIPTLVECRDCNGSGAKKGSKPQTCGHCHGSGQIQMRQGFFAVQQTCPQCRGTGTIIKDPCRTCHGHGRKEETKTLSVKIPAGVDTGDRIRLANEGEAGEHGAPAGDLYVQVHVREHPIFARDGNNLFCEVPVSFTKAALGGDIEVPTLEGKVKLKVPKETQTGKHFRLRGKGVKSVRTGEVGDLICKVMIETPVNLSSKQRDMLEELEDSMGTGDEAAKFRPKEKGFFDGVKQFFDDLRS

SEQ ID NO: 1115 - protein, 437 aa, Arabidopsis thaliana
MSLILKFMLLILLVSSHHVRSGSIVKFLPGFKGPLPFELETGYIGIGEEENVQFFYYFIKSDKNPQEDPLIIWLNGGPGCSCLSGLFFENGPLALKNKVYNGSVPSLVSTTYSWTKTANIIFLDQPVGSGFSYSKTPIERTSDTSEVKKIHEFLQKWLIKHPQFLSNPFYVVGDSYSGMIVPALVHEISKGNYICCNPPINLQGYVLGNPITHIEFEQNFRIPYAHGMSLISDELYESLKRICKGNYFSVDPSNKKCLKLVEEYHKCTDNINSHHTLIANCDDSNTQHISPDCYYYPYHLVECWANNESVREALHVDKGSIGEWIRDHRGIPYKSDIRSSIPYHMNNSINGYRSLIFSGDHDITMPFQATQAWIKSLNYSIIDDWRPWMIKGQIAGYTRTYSNKMTFATVKASGHTAEYLPEESSIMFQRWISGQPL

SEQ ID NO: 1116 - protein, 308 aa, Aspergillus nidulans
MSLTNCRFYEEKYPEVDSYVMVNVKQIAEMGAYVKLLEYDNIDGMILLSELSRRRIRSIQKLIRIGRNEVVIVLRVDKEKGYIDLSKRRVSPEDVIKCEERYNKSKAVHSILRHVAEATQTPLETLYQQIAWPLNRKYGHSHDAFKISITNPDVWADVEFPNEAVKKELTQYIGKRLTPHPTKVRADIEVTCFGYDGIDAVKNALRTAEAENTPENQIKVKLVAPPLYVLTSQCLDKTHGIKMLEEAIERIETTIKASGGGCTVKMAPKAVTEHDDAALQELMEKRERENMEVSGDESQSESDEGVPE

SEQ ID NO: 1117 - protein, 414 aa, Unknown
  Acidovorax sp. JS42
MYQRNILVEQTDPEVWAAIQAEDRRQEEHIELIASENYASPAVMAAQGSQLTNKYAEGYPGKRYYGGCENVDVIEQLAIDRIKQLFGAEAANVQPNSGSQANQAVLMAFLKPGDTILGMSLAEGGHLTHGMPLNMSGKWFNVVSYGLNDKEEIDYDALEAKAREHKPKLIIAGASAYALRIDFERFAKIAKEVGAIFWVDIAHYAGLVVAGEYPNPVPFADVVTSTTHKSLRGPRGGIILMKAEHEKAINSAIFPGLQGGPLEHVIAAKAVAFKEALSPEFKQYQQQVTKNAKVFAETLIQRGLRIVSGRTESHVMLVDLRAKGITGKEAEAALGKAHITINKNAIPNDPEKPMVTSGIRVGTPAITTRGFKEEETRLTANLVADVLDNPHDEANLEAVRAKVHALTSRFPVYR

SEQ ID NO: 1118 - protein, 463 aa, Bacillus subtilis
MQKQKQELHRGLEERHISLMSLGAAIGVGLFLGSASAIQLAGPGILVAYAASGLVMFFIMRALGEMAIQKPVAGSFSRYARDYLGPLAGYLTGWNYWFLWVVTCMAEITAVGIYMGFWFPDVPNWIWALSALVIMTGVNFLAVKAYGELEFWFALIKIVAILSMIAVGLLMIIAGVGNGGIATGISNLWNNGGFFPHGLKGVLLSLQMVMFAYLGIEMIGVTAGEVKNPQKSLAKAIDTVFWRILIFYVGALFVIMSIYPWQEIGSQGSPFVLTFQKVGIPSAAGIINFVVLTAALSSCNSGIFSTGRMLFNLAEQKEAPQAYGQLTKGGIPGKAVLASAGALLVGVLLNYVVPAKVFTWVTSIATFGAIWTWAIILLSQIKYRKSLKPEEKKQLKYKMPLFPFTSYVSLAFLAFVVILMAYSPDTRVAVIIGPIWFLILLAVYYGKGFHKKNAAAASERNIS

SEQ ID NO: 1119 - protein, 632 aa, Bacillus subtilis
MCGFVGVFNKHPLAQTADQEELIKQMNQMIVHRGPDSDGYFHDEHVGFGFRRLSIIDVENGGQPLSYEDETYWIIFNGEIYNYIELREELEAKGYTFNTDSDTEVLLATYRHYKEEAASKLRGMFAFLIWNKNDHVLYGARDPFGIKPLYYTTINDQVYFASERKSLMVAQNDIEIDKEALQQYMSFQFVPEPSTLDAHVKKVEPGSQFTIRPDGDITFKTYFKANFKPVQTEEDKLVKEVRDAIYDSVNVHMRSDVPVGSFLSGGIDSSFIVSVAKEFHPSLKTFSVGFEQQGFSEVDVAKETAAALGIENISKVISPEEYMNELPKIVWHFDDPLADPAAIPLYFVAKEAKKHVTVALSGEGADELFGGYNIYREPLSLKPFERIPSGLKKMLLHVAAVMPEGMRGKSLLERGCTPLQDRYIGNAKIFEESVKKQLLKHYNPNLSYRDVTKTYFTESSSYSDINKMQYVDIHTWMRGDILLKADKMTMANSLELRVPFLDKVVFDVASKIPDELKTKNGTTKYLLRKAAEGIVPEHVLNRKKLGFPVPIRHWLKNEMNEWVRNIIQESQTDAYIHKDYVLQLLEDHCADKADNSRKIWTVLIFMIWHSINIEKRYMPEELSHQPKEVIFV

SEQ ID NO: 1120 - protein, 121 aa, Clostridium acetobutylicum
MDYKMSKVDIVTRPEKFDELKSELNKIGVTGMTVTNVLGCGLQKGTLEYYRGNPVEITLNPKIKVEIVVCSVPVEKVVETAKNVLNTGKIGDGKIFVYDVSKVVKIRTGEEDYDALQDDKE

SEQ ID NO: 1121 - protein, 463 aa, Bacillus anthracis
MANKELKRGLEARHIQMIALGGTIGVGLFMGSASTIKWTGPSVMLAYAIAGIFIFFIMRAMGEMLYMEPSTGSFATFGHKYIHPLAGYMTAWSNWFQWVIVGMSEIIAVGAYMQYWFPDLPAWIPGVIAMVILGAANLISVKSFGEFEFWFAMIKIVTILLMIIAGFGLIFFGIGNGGEAIGISNLWSNGGFFTGGFSGFFFALSLVVGAYQGVELIGITAGEAKDPKKTLTRAIQSTIWRILIFYIGAIFVIVTVYPWDQLSTIGSPFVATFAKVGITAAAGLINFVVITAAMSGCNSGIYSAGRMLYTLGVNGQAPKYFTKLSGNGVPLFGTVGVIIGLAVGVVLSYIAPKNLFVYVYSASVLPGMVPWFVILISQINFRKEKGAEMKDHPFKMPFAPVTNYLTIAFLIMVLVGMWFNDDTRISLVVGIVFLAIVTISFYAFGIGKRPPLDVPNDQEISSK

SEQ ID NO: 1122 - protein, 154 aa, Lactobacillus johnsonii
MEQDYIKNLRKKVGHEPLILNFAGGVLVNDQDEILLQKRSDFKSWGLPGGAMEFGESAQETCVREFLEETGLKVKVKSLLGISTDFIQHYLNGDVAQAVVIEFLVELVGKTNKKPDSETLELKYFPKDNLPDIFNKQHLKFIEHYYQGDYPFFE

SEQ ID NO: 1123 - protein, 314 aa, Spinacia oleracea
QIASDVEAPPPAPAKVEKHSKKMEEGITVNKFKPKTPYVGRCLLNTKITGDDAPGETWHMVFSHEGEIPYREGQSVGVIPDGEDKNGKPHKLRLYSIASSALGDFGDAKSVSLCVKRLIYTNDAGETIKGVCSNFLCDLKPGAEVKLTGPVGKEMLMPKDPNATIIMLGTGTGIAPFRSFLWKMFFEKHDDYKFNGLAWLFLGVPTSSSLLYKEEFEKMKEKAPDNFRLDFAVSREQTNEKGEKMYIQTRMAQYAVELWEMLKKDNTYVYMCGLKGMEKGIDDIMVSLAAAEGIDWIEYKRQLKKAEQWNVEVY

SEQ ID NO: 1124 - protein, 369 aa, Thermotoga maritima
MKKEKKDYYEILGVPRDATQEEIKRAYKRLVKEWHPDRHPENRKEAEQRFKEIQEAYEVLSDPQKRAMYDRFGYVGEQPTYQETESGGFFDDIFRDFENIFNRDIFDVFFGERPHQEERREYARRGEDIRYEIEVTLSDLINGAEIPVEYERYETCPRCGGTGVEPNAGYMDCPSCGGTGRIREERRSFFGYFVSERTCERCGGTGKIPREYCHECGGSGRVLRKVRRTVKIPPNVEDGTHLRITGGGNAGYYGGPYGDLIIIVRVKPDPRFKKSGSDLVYDVTIDYLQAILGTTVEVPLPEGGTTMLKIPPGTQPETVFRLKGKGLPNRYGRRGDLIVNVHVEIPKSLSREERKVLEELAKKRGVTIG

SEQ ID NO: 1125 - protein, 169 aa, Streptococcus agalactiae
MERAIFAGGCFWCMVQPFEELDGIESVLSGYTGGHVENPTYKEVCSKTTGHTEAVEIIFNPEKISYADLVELYWAQTDPTDAFGQFEDRGDNYRPVIFYENEEQRQIAQKSKDKLQASGRFDRPIVTSIEPADTFYPAEDYHQAFYRTNPARYALSSARRHAFLEENWH

SEQ ID NO: 1126 - protein, 236 aa, Agrostis stolonifera
MTRRYWNINLKEMIEAGVHFGHGIKKWNPKMAPYISAKRKGTHIINLARTARFLSEACDLVFDAASQGKSFLIVGTKKRATDLVASAAIRARCHYVNKKWFSGMLTNWSITKTRLSQFRDLRAEEKMGKFQHLPKRDVAILKRKLSTLQRYLGGIKYMTRLPDIVIVLDQQKEYIALRECAILGIPTISLVDTNCDPDLANISIPANDDTMTSIRLILNKLVFAICEGRSLYIRNH

SEQ ID NO: 1127 - protein, 138 aa, Oryza glaberrima
SDDKALKRHLLRKYTGYLGGLRKELSKKRKKGKLPKEARQKLLTWWELHYRWPYPSEMEKIALAESTGLEQKQINNWFINQRKRHWKPTEEMQFAVMEAYHHQSTDAAAAFYVDVDARLVGATAAAPAAAVYTARPDH

SEQ ID NO: 1128 - protein, 168 aa, Unknown
  Synechococcus sp. CC9311
MDDRLECTMSLDLDAKKTLLRKIPHGLFICGVAEGDQVNGFTASWVTQGSFDPPLVVMAVRADSTSNGMIQRTRRFSLNVLAADQKDLAAVFFKPQQAVGGRFEAAPFTTGELGLPILKDALGAVECELVGELAHGDHTVFLGQVKSAVLHRDAAALELSSTGWQYGG

SEQ ID NO: 1129 - protein, 208 aa, Magnaporthe grisea
MVFSAPAFITRLTRPFTSSTMLSVSEATSGGAAATIPEGAQRATFAAGCFWGVEHIFRKHFENKGLYDARVGYIGGEAQNPSYRAVCSGATGHAEATQVVFDPSRISYRQLVEFFYKTHDPTTPNQQGNDRGTQYRSAVFYHNAEQEKIAREVTQKANEQWWKGKIVTELLPAGQWWDAEDYHQLYLHKNPSGYQCASHHLRDFPELK

SEQ ID NO: 1130 - protein, 339 aa, Stenotrophomonas maltophilia
MTFVRNAWYVAALPEELSEKPLGRTILDTPLALYRQPDGVVAALLDICPHRFAPLSDGILVNGHLQCPYHGLEFDGGGQCVHNPHGNGARPASLNVRSFPVVERDALIWIWPGDPALADPGAIPDFGCRVDPAYRTVGGYGHVDCNYKLLVDNLMDLGHAQYVHRANAQTDAFDRLEREVIVGDGEIQALMKIPGGTPSVLMAKFLRGANTPVDAWNDIRWNKVSAMLNFIAVAPEGTPKEQSIHSRGTHILTPETEASCHYFFGSSRNFGIDDPEMDGVLRSWQAQALVKEDKVVVEAIERRRAYVEANGIRPAMLSCDEAAVRVSREIEKLEQLEAA

SEQ ID NO: 1131 - protein, 165 aa, Staphylococcus aureus
MNNRNVYDIEVSDYKGLTYKLEAFRGKVILVVNTATECIYSEQLKKLETLFQKYKDRGFVVLSFPNNNFDNRQPGSNEEILKISREKFGVTFPVLAKISVNGNDEHPLFTHLKNEQPGIFGSPIKWNFTKFIIDRQGNVVNRFLPMEDPLDISANIEILLQESSS

SEQ ID NO: 1132 - protein, 141 aa, Silicibacter pomeroyi
MGDKTLTCLACGQLNRVPEARLTAGAKCGKCGDGLLTGQARDVDPAILEKAKKNDDLPLVVDFWAPWCGPCRMMGPEYAKAAGVLAGQARLVKLDTQKHQSTGGRYGIRGIPTMVAFERGKEKKRQSGAMQSGQIVGWVRG

SEQ ID NO: 1133 - protein, 294 aa, Saccharomyces cerevisiae
MKTLVHVASVEKGRSYEDFQKVYNAIALKLREDDEYDNYIGYGPVLVRLAWHISGTWDKHDNTGGSYGGTYRFKKEFNDPSNAGLQNGFKFLEPIHKEFPWISSGDLFSLGGVTAVQEMQGPKIPWRCGRVDTPEDTTPDNGRLPDADKDAGYVRTFFQRLNMNDREVVALMGAHALGKTHLKNSGYEGPGGAANNVFTNEFYLNLLNEDWKLEKNDANNEQWDSKSGYMMLPTDYSLIQDPKYLSIVKEYANDQDKFFKDFSKAFEKLLEDGITFPKDAPSPFIFKTLEEQGL

SEQ ID NO: 1134 - protein, 113 aa, Unknown
  Synechococcus sp. CC9311
MSDHASVAVTYNVSIEVDAVEHSFSCRSDQTVLAAAEEAGVMLPSSCCSGVCTTCAARLKSGAVEQPDAMGVKEDLRAEGFTLLCVAFPCSDLRLLAGQEDALYEAQFGQYQK

SEQ ID NO: 1135 - protein, 276 aa, Listeria monocytogenes
MRESLKNSKRLVIKVGTSTLMYGNGHINLRTIEKLAMVLSDLRNEGKEVILVSSGAIGVGCHKLQLPVRPTSIPEQQAVASVGQSELMHIYSKFFGEYGQVVGQVLLTRDVTDFPISRENVMNTLESLLERGIIPIVNENDTVAVEELEHVTKYGDNDLLSAIVAKLVQADLLIMLSDIDGFYGSNPSTDPDAVMFSEINQITPEIEALAGGKGSKFGTGGMLTKLSAASYCMNANQKMILTNGKNPTIIFDIMQGEQIGTLFASKKEEFSHDGTH

SEQ ID NO: 1136 - protein, 482 aa, Staphylococcus epidermidis
MEDNNMKRGLNSRHISMIAIGGAIGTGLFVATGSVISQAGPGGAILAYILIGIMLYFLMSSIGELATFYPVSGSFSSYSTRFVDSSLGFTMGWLYWGMWSLVTSVDIIVASNVLQYWDVFKVLNPLTWSLIFLTLLFLINIFSVKAFGETEFWLSLIKVITIIVFIIFGIMMIFGILGGHTYGFENYTKGQAPFVGGISGILSVLLVAGFSVGGTEVVAVTAGESNNPEKSMPKAIKQVFWRILLFYVLSIAVIAAIIPYTDPLLLNENESVSQSPFTIVFDKIGIAFAASVINAVILTSLLSAANSGIYTTSRMLFSLSADKQAPKFFGKLNDKTKLPMRALITTYIIIVLVIVYANFNANAVFNLLNIIGSMVIVVWGSSIWSQIRLRQAIKKQGKNPDKLLPYKAPFYPVGPIIVLFTLLFLLLGSSFGSIASGDILGVIRNFTPLFILAIIYIAHKLIKRTHFVKLEEIDLTPHNYKN

SEQ ID NO: 1137 - protein, 148 aa, Triticum aestivum
VDQGLYLGSVGAALNNEALKSLNITHILVVARSLNPAFPAEFTYKKIEVLDSPDTDLGKHFGECFTFIDEGICTGGNVLVHCFAGRSRSVTVILAYLMKKHQMSLQSAMSLVRSKRPQIAPNAGFISQLVNFEKSLQVEQGQRTLQSN

SEQ ID NO: 1138 - protein, 227 aa, Rickettsia akari
MTNNLSGYRNKFVRVKTSKKRTVSSGNWLRRQLNDPYVAKARIEGFRSRAAYKLLEIHEKFKLFTPNMKIVDLGAAPGGWSQVASKLIKASDNSLNNKIISIDLLEIEPIIGVEFLQKDFFEENTEELIIQVLDGKADIVMSDMASNTTGHKATDHIRTLLLCEQAFEFALKVLKPSGHFIAKIFRGGAENELLNKVKCEFKTVKHFKPSSSRSESTEIYLVAINKK

SEQ ID NO: 1139 - protein, 303 aa, Oenococcus oeni
MLINNLYQLIGKTPLLRLNIDVPNRSRIYAKLEMFNPGGSIKDRLGIALIAYGRKIGAVKEGTTIIEPTAGNTGIGLALAAQQYHLPVKLIVPEKFSFEKQTLMRALGAEVINTPADDGIKGAIAKAQSLAKTIKNSYVPLQFQNPANPDIYYRTLGPEILQDLSGQKIDAFVAGSGSGGTFVGTTKFLQEHYPKMQAVTVEPEGSILNGGPEHPHRIEGIGVEFVPPFFDQIRVDQVKTISDDRAFEYVKWLAAHVGLFAGSSSGAALAASLQLAKELPSDSTVVTVFPDSSERYLSKGIYD

SEQ ID NO: 1140 - protein, 477 aa, Mannheimia succiniciproducens
MMNYFPVFADLNNRPVLVVGGGTIAARKVNLLLKANAEVRITAQKLNAELTALVEQDRIIWIAKEFHGEQIRNVFLVVAATDDEQLNEQVFQVAESRQKLVNVVDDQARCSFIFPSIIDRSPIQVAVSSGGAAPVLARLLREKLEALLPQHLGVMADISGKWRHKVKQQLKTITERRRFWESLFNGRFSRLLKNRQIEAAKKELELQLTKDYQGGSVSLVGAGPGDAGLLTLKGLQEIQQADVVLYDALVSAEILDLVRRDAELIFVGKRAQGRQVAQQETNQLLADLALQGKRVVRLKGGDPFVFGRGGEELEVLAQQGIPFSVVPGITAAIGATAYAGIPLTHRDYAQSAVFVTGHRKADASDIEWQTLARSNQTLVIYMGTLKAATIAQSLQQYGRAASTPVAVISQGTQETQHTQIGTLKNLAELAEKAPTPALIVVGEVVSLHEKLAWFGEDKFAQKRPHFTLDSLRIERVA

SEQ ID NO: 1141 - protein, 436 aa, Selaginella martensii
  misc_feature (167)..(167): Xaa can be any naturally occurring amino acid
MAVASQAAPFLPSSSQQPCCDRHKVANLRTGFLGWRSSRPQLAPKQQHRISCSVAPSPTQAPPLPKGAECYGVFCVTYDLKEEEKPKTWKKLVRVAVSGAAGTISNHLLFKIASGEVFGPDQPVALNLLGSDRSKEALEGVAMELEDSLYPLLREVIIGTDAYEVFXDAEWALLIGAKPRGPGMERADLLDINGKIFAAKGKALNEVASPNVKVIVVGNPCNTNALICLNNAPKIPKKNFHALTRLDENRAKCQLALKAGVFYDNVSNVTIWGNHSTTQVPDFVNAKINGRPVKEVINDHKWLEEEFTPTVQTRGGVLIKKWGRSSAASTAVSIVDAMKSLVQPTAPGDWFSSGVYAAGNTYGIDNDLVFSLPCRSKGDGDYEIVSGLTIDKYLYERIKKSEDELVAERRCVAHLIGQENGYCDLPGGDTMLPGEQ

SEQ ID NO: 1142 - protein, 88 aa, Unknown
  Acidovorax sp. JS42
MAKEELIEMQGSVTEVLPDSRFRVTLDNGHQLIAYTGGKMRKHHIRILAGDKVSLEMSPYDLTKGRITFRHLAGRGPGPGTGSSSGNR

SEQ ID NO: 1143 - protein, 326 aa, Glycine max
  misc_feature (135)..(135): Xaa can be any naturally occurring amino acid
  misc_feature (162)..(162): Xaa can be any naturally occurring amino acid
  misc_feature (185)..(185): Xaa can be any naturally occurring amino acid
  misc_feature (263)..(263): Xaa can be any naturally occurring amino acid
MNMVSLVKYTALPLTSPDSSSHVPRPQLCALPSVHNVQQSTQPSLSSLKPLYISSTQNFAFRRRRVPECQAYEADRSRPLELNIELPDEEAGIEATQRIKIGLYFATWWALNVVFNIYNKKVLNAFPYPWLTSTXSLAAGSLMMLISWATKVAELTMALISXLPHVDFQFWKALFPVSVLHTMGXCAATVSMSKVAVSFTHIIKSAEPAFSVLVSRFLLGEAFPGQVYLSLVPIIGGCALAAVTELNFNMIGFMGAMISNLAXVLRNIFSKKGMKGMSVSGMNYYACLSILSLLILTPFAIAVEGPKMWAAGWQTALSEIGPNFVW

SEQ ID NO: 1144 - protein, 383 aa, Bacillus halodurans
MVEEMNNEVTEMKSFSVGDVVSGKVTKVEDKQAFVDVGFKVDGIIPISELSSLHVEKVSDVLSEGDELELKVLKVEDDELILSKRAVQAEKAWETLQAALDSGEVIEAEVADVVKGGLVVDLGVRGFIPASLVERHYVEDFSDYKGRTLRLKVVELDKEANKLILSQRAVLDEEVEAKKKEVLASLQPGDVVEGTVQRLTDFGAFVDVGGVDGLVHISQLAHHRVETPAEVVKEGDAVKVKVLSVDPDSERVSLSIKETLPGPWEQVEGTIQPGDVIEGTVKRLVSFGAFVEVAPGVEGLVHISQIANRHIGTPGEVLSEGERVQAKVLDVNISEKRISLSIRELLDDAGSNQSDREVYESTNEESSGFSLGDMIGDELKKYK

SEQ ID NO: 1145 - protein, 436 aa, Selaginella martensii
MAVASQASPFKSPFLQEPCSDRHKVANLRTSFLGWRSSRPQLAPKQQHRISCSVAPSPTQAPPLPKGAECYGVFCVTYDLKEEEKPKTWKKLVRVAVSGAAGTISNHLLFKIASGEVFGPDQPVALNLLGSDRSKEALEGVAMELEDSLYPLLREVIIGTDAYEVFRDAEWALLIGAKPRGPGMERADLLDINGQIFAAKGKALNEVASPNVKVIVVGNPCNTNALICLNNAPKIPKKNFHALTRLDENRAKCQLALKAGVFYDNVSNVTIWGNHSTTQVPDFVNAKINGRPVKEVINDHKWLEEEFTLTVQTRGGVLIKKWGRSSAASTAVSIVDAMKSLVQPTAPGDWFSSGVYAAGNTYGIDNDLVFSLPCRSKGDGDYEIVSGLTIDKYLYERIKKSEDELVAERRCVAHLIGEENGYCDLPGGDTMLPGEQ

SEQ ID NO: 1146 - protein, 957 aa, Pseudomonas fluorescens
MSQLPSLSQLRDPHAFLRRHLGPDAAEQQAMLDSLGLGSRVELIEQTVPPGIRLNRELDLPPALDEQAALARLRGYAEQNQVWTSLIGMGYHGTLTPTVILRNVLENPGWYTAYTPYQPEIAQGRLEALLNFQQLTIDLTGLELANASLLDEATAAAEAMALAKRVAKSKSNLFFVDENCHPQTISVVQTRAEGFGFELIVDAVDNLKQHQVFGALLQYPDTHGEIRDLRPLIDHLHAQQALACVAADLLSLLLLTPPGELGADVVFGSSQRFGVPMGYGGPHAAVFASREEYKRAIPGRIIGVSKDARGNVALRMALQTREQHIRREKANSNICTAQVLLANIASFYAVYHGPEGLKRIAQRVHRLTCILAAGLERHGIQRLNQHFFDTLTLDVGGAQTAIIESAQAAQINLRILGRGQLGLSLDEACDENTVARLFDVLLGADHGLSIDDLDAETLASGIPEMLQRSTSYLRHPVFNAHHSETEMLRYLKQLENKDLALNQSMIPLGSCTMKLNATSEMIPITWPQFANLHPFVPREQAVGYTLMIEELERWLCAITGFDAICMQPNSGAQGEYAGLLAIRKYHESRQQGGRDICLIPSSAHGTNPASAQMAGMRVVIVECDDAGNVDLEDLKAKASEAGAKLSCLMATYPSTHGVYEEGISEICEVIHKHGGQVYMDGANLNAQVGLARPADIGADVSHMNLHKTFCIPHGGGGPGMGPIGVRAHLAPFVANHPVVPIDGPQPQNGAVSAAPWGSASILPISWMYIAMMGPQLADASEVAILAANYLAQHLSGAFPVLYTGRNERVAHECILDLRPLKAATGISEEDVAKRLMDYGFHAPTMSFPVPGTLMVEPTESESKAELDRFIGAMLSIRAEITEVQNGNWPAEDNPLKRAPHTMADITGVWERPYSIEQGITPDAHTKAHKYWPAVNRVDNVYGDRNLFCACVPVDDYR

SEQ ID NO: 1147 - protein, 351 aa, Triticum aestivum
MAAMATTASSLLKTSFSGVRLPAAARTPSCVATPRAGAICNSISSSTPPYDLNAFKFSPIKESIVSREMTRRYMTDMITYADTDVVIVGAGSAGLSCAYELSKDPSISIAIIEQSVSPGGGAWLGGQLFSAMVVRKPAHLFLDELNIEYDEQEDYVVIKHAALFTSTVMSRLLARPNVKLFNAVAVEDLIVKEDRVAGVVTNWALVSMNHDTQSCMDPNVMEAKVVVSSCGHDGPFGATGVKRLQDIGMIQAVPGMKALDMNTAEDAIVRLTREVVPGMIVTGMEVAEIDGAPRMGPTFGAMMISGQKAAHLALKALGRPNGIDGTLKNVTPALHPEMILAATNNGDIVDA

SEQ ID NO: 1148 - protein, 359 aa, Helicobacter pylori
MKVLSYLKIFYLFLLIGAIMQANENMGSQHQKTDERVIYLAGGCFWGLEAYMERIYGVIDASSGYANGKTSSTNYEKLHESDHAESVKVIYDPKKISLDKLLRYYFKVVDPVSVNKQGNDVGRQYRTGIYYVNSTDKEVIDNALKALQKEVKGKIAIEVEPLKNYVRAEKYHQDYLKKHPGGYCHIDLKKADEVIVDSDKYTKPSDEVLKKKLTKLQYEVTQNKHTEKPFENEYYNKEEEGIYVDITTGEPLFSSADKYDSGCGWPSFSKPINKDVVKYEDDESLNRKRIEVLSRIGKAHLGHVFNDGPKELGGLRYCINSAALRFIPLKDMEKEGYGEFIPYIKRGELKKYIQDKKTH

SEQ ID NO: 1149 - protein, 208 aa, Medicago sativa
  misc_feature (185)..(185): Xaa can be any naturally occurring amino acid
SGRTAVAIVSSELAIHQLDYPSESEWRARLLIEQSSAIKCPNISYHLVGTKKIQQELARPNVLERFFENKEDIAKLRKCFAGLWSLEDSDIVNEAIEKPELFVMKPQREGGGNNIYGDDLRETLKRLQKPGSQEDAAYILMQRIFPANTASILMRNGFLHKDHVISEFGIFSTYLRNKDKVIVNXESGYMVRTKPSLSDEGGVLPGFG

SEQ ID NO: 1150 - protein, 543 aa, Clostridium difficile
MKVLIIGGVAAGTKTAAKIKREMGDNCSVTILNKGDDISYAGCGLPYYVGKIIEDKSSLIVNTPESFSKLTGAEVRCGVEVTSIDRNAKQVTLKTLSTGEKENLSYDKLVIATGADPIKPPIPGIDLPGVFFMRTPNDAIKLRDSIENGIKRAVVIGGGFIGLEIAENLSAMGIRVSVVDMAEHVMPGFDTDFAEYVENHMADKGIMIFTGDQVVGIEGENKVEKLRTKNRAIKTDLVVMSVGIRPNTGFLKDTGLEFAPNNTIIADEYMLTNDKDIYVVGDCAFVKNSLTNKPTWSPMGSSANHEGRICAQNISGKSKTYNGVLGTTVVKLPELNAGKTGLSKEIAEKEGYNVCSVTIATDDKAHYYPGASNFIIRMVAEKNTRKLLGVQVMGPGAVDKIVDIAATAITLGADLYSLESMDLAYAPPFSTAIHPFVVAVNVLQNKLNGELDSVLLDEIEDFDSWTKLDVSKAPSIPSLRYIPVGEINGEIEGLAKDEKILLICAKGKNSYMAQNRLRRFGYTNTKVLEGGILFYPNLKVMEE

SEQ ID NO: 1151 - protein, 373 aa, Oryza sativa
MASPIASTSRTTLGSLLRGTATSSVSSRSAVLARKLSTEVQSSAPTDGASATAAAAVAADVVAASNPAAESQSSDDAVERRRLRRAVMNNLSDLGSTQTRATSFRPHKLRLNPVDAHQLTLQHLVASTAQVGHSLSSLKAANQPYIYGQRHGVAIFDLERATLPALRRAAAVVKAIAERDGVILFVGTRPGQQAAVLAATKRLGANGFHVTAERWMPGVITNAPKLLASAILKSMADLDPSGNANTNRLASQTLQPDLVVVLNPVENSFAIREATQANIPTIAITDSDVDPRCVTYPIPANDDSIRSVELIIGVLSKAGQEGLRVRAKKLDEADKIERKVTKALNHNIDGANFDPRTRGAPTLRRHDDDEEDA

SEQ ID NO: 1152 - protein, 114 aa, Methanosarcina mazei
MKYVIAMIRPERLDAVKRELQKIEVSRLTVSSVSGYGAQKGYMEIYRAMEYDANLLEKIKIEIAVNDEFLEPTIEAIKTGAKGSDGYVGSGKIFVLPLENVIRIRTNETGPEAI

SEQ ID NO: 1153 - protein, 363 aa, Zea mays
MENNAVTENNPGDKSKGAAIGHADSCPSEFMVTNLGKEHHLNGYKNQEFREKDIFNHSNSSAFSRYGNKRIEPSGEIQFFPSPCVIGQGHVNGKNPVFQPDGVLLPPNEHNTGESTRQARISLDSRTEGAAILCSTSAREDAGANSSSHRKDSMSHPSYGFIPVPIPVGATMPYHYGAILQPVYYPQSPLMHCDSAGINKAAIQHASGQPNYHEAPGKPSHVLIEHKQSEENHQLHHSRQILRESGEPIDMARAHVDRANQTASCSQGICKGSGCTCSGEADINANTMVALESGNESGIQNGDRSRREAALMKFRMKRKDRCFEKKVRYHSRKKLAEQRPRVKGQFVSQKLNSATTTDAEADS

SEQ ID NO: 1154 - protein, 441 aa, Thermotoga maritima
MRVLLINPYSGGYYYRLGAVYPPLGLMYISSSLKRKGHSVALIDMNVEKFDLERFNFRDYDVVGISADTVRFPVVERIAKKAKAQNVTVVMGGPHATAYYHEILQKGLCDYVVLGEGERAFSDLVESIASNEKYPLIPGVAYMKDGEVIALPSRFLENLDDLPFPDREKVHLYRTKFAGERATSLITSRGCPFNCEFCSASQFMGRRIRWRSIENVIDELKILKKLGYGSVIFFDDNFTINPKRVVNLCEEMMRKDLRFKWWAFSRADELLGREDMVEAMSKAGCRMLFIGFESANDEVLEEYGKNLKSDIAFDVMKLLKKYKVDVFASFVIGALKDTRKTIEKTVKFAKKLKASIVQFSILTPYPGTALFEKLKHLIFEKDWRKFDGTHLVFKHPNFSPKELRRLFIKAYYAVYTSPRLIFRRGIPFLVRLLFYREAYFL

SEQ ID NO: 1155 - protein, 345 aa, Francisella tularensis
MKVITAEYIWVDGSDPVPHLRSKARVLPFKEFETPDEFPEWSFDGSSTNQATGDNSDCILKPVNFVIDPLRDYGYLVLCEVYNPDGQTPHATNNRAKLRALLASADCQDMWAGFEQEYTMFKDGRPLGWPTTGFPGPQGPYYCSAGNSKAFGRDLVEAHMQACLEAGILFYGINAEVMPGQWEFQIGYRGVDGEDAGILNVADHTHLARWLLERLGEEYGIDISFDNKPIKGDWNGAGLHTNFSTSKTRNPQTGREAIKKICAALEKNHKKDILNYGHNLHERLTGKLETSDMNTFSVGDADRGCSIRIPRPVALKGYGYLEDRRPGANADPYVIAMALANAAIN

SEQ ID NO: 1156 - protein, 264 aa, Geobacter sulfurreducens
MSSVADNPIVHFVGAGPGDAELITVKGARLLREAKVVVYAGSLVDRELVRTYAPGAEVHDSAALTLEETTALLARAVADGRRAVRLHTGDPSIYGAIQEQMVELDRLGIGYEVVPGVTSAFAAAASLKQELTLPEVSQTVIITRLAGRTPVPERERLAEIARIGATLVIYLSVGMIEQVVAELLQGAYTPATPAAVVSRASWPDEQAVEGTLADIADKVRSSGIGKQAIILVGDVLKARREGLKARSLLYDGGFSHEFRTGIIT

SEQ ID NO: 1157 - protein, 308 aa, Streptococcus suis
MAIYQNITQLVGKTPVIKLNNIVPEGAAEVYVKLEAFNPGSSVKDRIALAMIEDAEKAGTIKPGDTIVEPTSGNTGIGLAWVGAAKGYNVIIVMPETMSVERRKIIQAYGAELVLTPGSEGMKGAIAKAKEIAEEKNGWVPFQFANPSNPKVHEDTTGQEILEDFGTTGLDAFVSGVGTGGTVSGVSHVLKTANPDIAIYAVEADESAVLSGEAPGPHKIQGISAGFIPDTLDTSAYDGIIRVKSDDALATGRAIGGKEGFLVGISSGAAIHAAIEVAKELGTGKKVLAILPDNGERYLSTALYEFND

SEQ ID NO: 1158 - protein, 317 aa, Oryza sativa
MGKASKDKRDIYYRKAKEEGWRARSAFKLLQIDQEFNIFHGVKRVVDLCAAPGSWSQVLSRNLYVPAKQSPDCKEGDLPLIVAIDLQPMAPIEGVIQVQGDITNARTAEVVIRHFDGCKADLVVCDGAPDVTGLHDMDEFVQSQLILAALTIVTHVLKVGGKFVAKIFRGKDTSLLYCQLKLFFSQVTFAKPKSSRNSSIEAFAVCENYSPPEGFKEKDLYHLLEKVGTPSGADDLDCRSGWLEGPNKVYIPFLACGDLSGYDSDRSYPLTSTEGGSYQSLDPVQPPIAPPYKTALEMKKVASHGIGADISKLSLDS

SEQ ID NO: 1159 - protein, 112 aa, Rhodospirillum rubrum
MKLIMAIIKPFKLDEVCEALTSLDVHGLTVSEVKGFGRQKGQTEIYRGAEYQVNFLPKVKIEVAVSDGLADLAVEAICNAARTDRIGDGKVFVYDLDKIVRIRTGEIDADAL

SEQ ID NO: 1160 - protein, 146 aa, Mesorhizobium loti
MRYLHTMVRVADVDASLDFYCNKLGLKEVRRYENEQGRFTLIFLAASEDEQSGINDKAPLIELTYNWDPEDYKGGRNFGHLAYEVDDIYATCQHLMDNGVTINRPPRDGNMAFIRSPDGISIELLQKGPAKAKAEPWASMANTGSW

SEQ ID NO: 1161 - protein, 403 aa, Listeria monocytogenes
MSSTKSIINKKTLLFGLISVFLCGMGFSIIMPVVPFLVTPYVTNASDQALMVTLLTSVYALCVFFAAPGLGALSDRFGRRPVLLICFIGSAIGYFIFGLGGALWVLFLGRIFEGITGGSISTLFAFFADITPQEERTKYFGWVSAAAGAGAALGPAFGGLLAHFGYAMPFFFGAAITFINFLFGYFYMPESLEEANRLKRIPLMRLNPFSQLLKILTIKNLGRLLIAAFFIWVPNGSLQAVMSQFAIDSFSWKPVLIGMMFSIMGIQDILSQAFVMPKLLLKLTDKQIAILGMIAEIIGYLLIAASSIFTLAPLLVIGMFVFGFGDSIFGPSFNGMVSKSASASEQGRIQGGSQAIQSVARIIGPVIGGQLYITLGHAAPAIMGVLLITVAIFILYKKTSLAK

SEQ ID NO: 1162 - protein, 371 aa, Zea mays
MVLAAHDPPPLVFDAARLSGLSDIPQQFIWPADESPTPDSAEELAVPLIDLSGDAAEVVRQVRRACDLHGFFQVVGHGIDAALTAEAHRCMDAFFTLPLPDKQRAQRRQGDSCGYASSFTGRFASKLPWKETLSFRYTDDDDGDKSKDVVASYFVDKLGEGYRHHGEVYGRYCSEMSRLSLELMEVLGESLGVGRRHFRRFFQGNDSIMRLNYYPPCQRPYDTLGTGPHCDPTSLTILHQDDVGGLQVFDAATLAWRSVRPRPGAFVVNIGDTFMALSNGRYRSCLHRAVVNSRVARRSLAFFLCPEMDKVVRPPKELVDDANPRAYPDFTWRTLLDFTMRHYRSDMRTLEAFSNWLSTRSNGGQHLLEKK

SEQ ID NO: 1163 - protein, 464 aa, Bordetella bronchiseptica
MHRNTTRCTIALPGGSILKLQSLDDFLRRVAARDPQQAEFMQAVQEVMLSLWPFIEKHPHYAEHALLERLVEPERVIQFRVCWTDDQGQAQVNRAFRIQHSSAIGPFKGGMRFHPTVNLSVLKFLAFEQTLKNALTTLPMGGGKGGSDFDPKGKSDAEVMRFCQALMLELHRHLGPDTDVPAGDIGVGAREVGFMAGMMKKLSNSAASVFTGKGLCFGGSLIRPEATGYGTVYFAQEMLQRAGLSFDGMRVSVSGSGNVAQYAIEKAMALGAKVVTISDSCGTVIDEAGFTHEKLLALMHIKNDLRGRLDTYASQFGLRYEAGVRPWHVPVDVALPCATQNELDENDARTLIRNGVKCVAEGANMPATLDAAKAFIAAEVLYAPGKASNAGGVAVSGLEMSQNSARLPWTREQVDARLHAIMRDIHENCVRHGHGAGNYVNYVDGANIAGFVKVADAMRQQGLY

SEQ ID NO: 1164 - protein, 111 aa, Triticum aestivum
  misc_feature (92)..(92): Xaa can be any naturally occurring amino acid
KIMKADEDVRMIAAEAPVVFARACEMFILELTHRGWAHAEENKRRTLQKSDIAAAIARTEVFDFLVDIVPRDDGKDADAAAAAAAAAAGIPXPAAGVPSTDPLAYYYVPQQ

SEQ ID NO: 1165 - protein, 171 aa, Unknown
  Silicibacter sp. TM1040
MTTTERAVLAGGCFWGMQELIRHRKGVLSTRVGYTGGDVPNATYKNHGTHAEGIEITFDPEQTSYREMLEFFFQIHDPTTVNRQGNDIGMSYRSAIYYVDARQKQIAEDTIADVEASGIWPGKVVTEVEPVGDFWEAEAEHQDYLQRLPNGYTCHFPRPDWVLPKRDQAAE

SEQ ID NO: 1166 - protein, 87 aa, Bordetella pertussis
MAKEELIELNGIVDEVLPDSRYRVKLDNGIEVGAYASGRMRKHRIRILAGDRVTLEMSPYDLTKGRINFRHKDERSGPPSRPPQHRR

SEQ ID NO: 1167 - protein, 177 aa, Francisella tularensis
MTYSAENTEVYITSQQLEQAVTRLAEQINQDYSGQQVTLVCVLKGSFMFFADLVRKLRIDLRTQFITASSYGSSTKSSGTVTLTETSLKEEYVKDKNIIIIEDIVDTGHTYHKLIEGIGKYNPKTLKFATLLFKPARLERDVKLDYVCFEIEDKFIVGYGLDFDEKYRELPYIGLIK

SEQ ID NO: 1168 - protein, 187 aa, Brassica napus
MSLDKHMEKVLYSAEVIAERVAQLGSEITSEFSGDSDPPVFVGVATGACLFLADLVRRIDLPISIDFIRADSYGSGTVSNGSPRISFDLKLDITDKHVILVEDIVDTGNTVSCLIEHMTLKKASSVSVCTFLDKPSRRKVYFKLVGDGKFYSGFECPDEFVVGYGMDFAEQYRNLPYIGVLKPEYYM

SEQ ID NO: 1169 - protein, 466 aa, Unknown
  Synechococcus sp. WH 5701
MSVSSGPSSDEAAVENLVIVGSGPAGYTAAIYAARANLSPLLITGFQDGGIPGGQLMTTTHVENFPGFPDGILGPDLMDRMKAQAVRWGTRLVEADAEAIDLSERPYRVSAEGRTIRTQAVILATGASANRLGLPHEQQFWSQGISACAICDGATPQFRNEQLAVVGGGDSACEEAVYLTKYGSHVHLIVRRESLRASGAMADRVLANSAITVHWQREVADVSGNGWLEALTLRNPDDGSTEELPVRGLFYAIGHTPNTHLVRDQLAVDAKGYLVTTPGQPDTSLEGVFAAGDVADAQWRQGVTAAGSGCQAALAAERWLTHHGLATTVKRTDVEPEPSGEPAHTAVSDADNYDPAALWQKGGFALRKLYHDSDKPLLVVYTSPSCGPCHVLKPQLKRVLLELDGAAQGVEIDIEAEQEIATQAGVNGTPTVQLFQGKQLRQQWRGVKQRSEFKAAIEALLPVPVA

SEQ ID NO: 1170 - protein, 331 aa, Xanthobacter autotrophicus
MAAAYRRIGVMGAGAWGTALANAAARAGRQGGREVVLWGRDAAAMAEMAQLRENRPDLPGIALDPAVTPTADLAAVAATDALLLVVPAQACRTALARLAPLARDGLPVISCAKGIERGTRAFMSEVIGEAMPGARPAVLSGPSFATDVAAGLPTAVTLAAHDEQLAMELAAALGSSTLRLYHSADVRGAEIGGATKNVLAIAAGIVSGRRLGASAAAALVARGFAELMRFGRAYGAKAETITGLSGLGDLILTTSGPQSRNFAFGQALGAGAATGDKLAEGAFTASVLVEMARAKDVDVPVSAAVDGVLQGRLSIDGAIEALMARPQRAEG

SEQ ID NO: 1171 - protein, 93 aa, Unknown
  Synechococcus sp. RS9917
MASFTISIDGGSSFSCADDQYILDAAEEQGIDLPYSCRAGACSTCAGKILSGSVDQSDQSFLDDDQIAKGYALLCVSYPLSDCSVKTDVEDEL

SEQ ID NO: 1172 - protein, 574 aa, Medicago truncatula
MSNWLGFSLTPHLRIDEEFGTENQNQNQNHVAEGSEIGRNYVTPSSHPHPHHLSIMPLRSDGSLCVSDSFTPQEWRYENAITDGNSNEEGPKLEDFLGCYSNQNQNSTTTSTMSKINVNVSPSFCTNNNPEIDTRENLTNQSLIHSFHAYNDHSNNNHHALIHDNSMYKSWMTQTQFSSEGKTTSSDGNGFQSLNLTMSPCVQNGVGGGVGSAISNVQVNEDPRKRSLSKSNAREPVPRKSIDTFGQRTSQYRGVTRHRWTGRYEAHLWDNSCRKEGQTRKGRQGGYDKEEKAAKAYDLAALKYWGPTTHINFPLSTYDKELEEMKHMTRQEFVANLRRKSSGFSRGASVYRGVTRHHQHGRWQARIGRVAGNKDLYLGTFSTQEEAAEAYDIAAIKFRGTSAVTNFDISRYDVKRICSSSTLITGDLAKRSPKDSTPPATTAEDFNSCGSSSTLSQPPPLTITDGEQHSDELSNMVWNSNNDEQKPQNGTNITESSQHGSPSNKNEMNPQSPKCSLGLPNEFGVSGADYGHGYFTLHGPKFDDGSNENDHMNNNRLGNLGLVNQVPMFALWNE

SEQ ID NO: 1173 - protein, 225 aa, Medicago sativa
LPDGTLSVNGQAVAVIYFRAGYTPVDYPSESEWRARLLMEQSSAVKCPSISYHLVGTKKIQQELAKPGVLERFLENKDDIAKMRECFAGLWSLDDSDIVRKAIERPELFVMKPQREGGGNNIYGEAVRDTLIKLQKTGSQEDAAYILMQRIFPNTSAAVLMRNGCWHKDHAVSELGIFGTYLRNKDRVVVNNQSGYLMRTKISSSDEGGVAAGFAVIDSVYLTLM

SEQ ID NO: 1174 - protein, 588 aa, Unknown
  Petunia x hybrida
MAGVANGGTKCIQDSSSASAIANAEATLGRHLARRLVEIGIEDVFSVPGDFNLTLLDHLIAEPKLKNIGCCNELNAGYAADGYARERGIGACVVTFTVGGLSVLNAIAGAYSENLPVICIVGGPNTNDYGTNRILHHTIGLPDFSQELRCFQTVTCYQAVVNHLDDAHEQIDKAISTALKESKPVYISISCNLPAIPHPTFSRDPIPFSISPRLSNKRGLEAAVDATVAFLRQAVKPVMIGGPKLRVAKALNAFVEFADSSGYAMAVMPSAKGLVPEQHPHFIGTYWGAVGTSYCGEIVESADAYLFAGPIFNDYSSVGYSLLIKKEKSIIVQPDRVVIGNGPAFGCVLMKDFLTELAKRIQKNTTAYENYRRIFVPEGTPPKSEPNEPLRVNVMFQHIQKMLSDETAVIAETGDSWFNCQKLKLPKGCGYEFQMQYGSIGWSVGATLGYAQSVPKKRVISCIGDGSFQVTAQDVSTMIRCDQKNIIFLINNGGYTIEVEIHDGPYNVIKNWNYTGLVEAIHNGEGNCWTQKVRTEEELTDAIATATGEKKDCLCFIEVIVHKDDTSKELLEWGSRVCSANGRPPNPQ

SEQ ID NO: 1175 - protein, 507 aa, Unknown
  Petunia x hybrida
MDAKIGSIDTCKPTTNNVATLPTNNTVTISTHTPSTTIIPCNSTTDSTLGRHLARRLVQVGITDVFGVPGDFNLTLLDHLISEPNLEFIGCCNELNAGYAADGYARPRGVGACVVTFTVGGLSVLNAIAGAYSENLPLICIVGGPNSNDYGTSGVLHHTIGLPDFSQELRCFQTVTCYQAVVNNLEDAHEMIDTAISTALKESKPVYISISCNLPAIPHPTFSREPVPFSLSPRLSNQMGLEAAVEAAAEFLNKAVKPVVVGGPKLRVAKASDAFVELMDASGYAVAVMPSAKGMVPEHHPHFIGTYWGAVSTAFCAEIVESADAYLFAGPIFNDYSSVGYSLLLKKDKAIIVQPDRVTIGNGPAFGCVLMKDFLAALAKRLKHNPTAHENYRRIYVPEGHPLKCEPNEALRVNVLFEHIQRMVSADTAVIAETGDSWFNCQKLKLPEGCGYEFQMQYGSIGWSVGATLGYAQAARDKRVLAFIGDGSFQVTAQDISTMLRCGQRTI

SEQ ID NO: 1176 - protein, 507 aa, Unknown
  Candidatus Desulfococcus oleovorans Hxd3
MIITLINPPALVARYNYSTLSHPPLGLACIASFLEQQDHNVHINDAIGQAIDRFVAYEPAPGFFVQGLSFESIISRIPSRSRIIGFSCLFTHAWPLVRELIAAVRRAFPHAYLVAGGEHATAMADICLAQSPLDLCIMGEGEETMAGVVQAVEEGLPLDSVPGVAFLDRTTGRIIETRRRPRIRNLSRLPRPAWHRVSPHVYRIYEGAATGPTMPMIGSRGCPFKCRFCAAPNMWGHCWKKREPADIVDEMEDYAKRFGTREFQFFDISPFLSKPWTRALCQEIIDRGLKVAWQAPAGVRAEVIDQQMAALLVASGHTRIQFALESGSPAVRKAMNKKIDIHRFEAGLTAGLSSGMKVCVLFIIGYPGEALSDVRMTFRSIRRLAIKGVHEIAVSTFLPLPGTAIFDELRKKGQLAINDDYCLKMADATALTHATSWNPLFSNRQLLLLKWLGILQFYGLSFLLHPSRGFRTLRNLVRGVQESKTDRAIAEIRQKLALHRAGKDRRP

SEQ ID NO: 1177 - protein, 526 aa, Arabidopsis thaliana
MGLQNMLVVREGNDTPGCGRLISDATELLVFRSPNDSEAFRCLVDKISSSERRFCAGVKSTKRPDINKDIPANGSSNENQPLAVLPTNESVFNLHRGGMRRRCLDFEMPGKRKKDIVDDQQSVCDNNVAGESSSSCVVPGIGLHLNAVAMSAKDSNISVIHGYSISGEIQKSFSGSTTPIQSQDTVQETSDQAENEPVEEVPKALMFPELNLGSLKKKMRKSEQAGEGESCKRCNCKKSKCLKLYCECFAAGVYCIEPCSCIDCFNKPIHEETVLATRKQIESRNPLAFAPKVIRNADSIMEASDDASKTPASARHKRGCNCKKSNCMKKYCECYQGGVGCSMNCRCEGCTNVFGRKDGSLLVIMESKLEENQETYEKRIAKIQHNVEVSKEVEQNPSSDQPSTPLPPYRHLVVHQPFLSKNRLPPTQFFLGTGSSSFRKPNSDLAQSQNEKKPLETVTEDKTEIMPEILLNSPIANIKAISPNSKRVSPPQPGSSESGSILRRRGNGRKLILRSIPAFPSLNPNQ

SEQ ID NO: 1178 - protein, 132 aa, Glycine max
  misc_feature (11)..(11): Xaa can be any naturally occurring amino acid
  misc_feature (47)..(47): Xaa can be any naturally occurring amino acid
MGYGRPYASFXATDMSARGSMPGRIIGSRDDSFVKTDCAGWQMHTRXSHDWRHTAISTICTAEALLANMDAMYAVNHGPERLSNIAHRIHSLARALAIEINRLGTVEIHDLPLFHTVNDKTSYALAVADAAV

SEQ ID NO: 1179 - protein, 468 aa, Unknown
  Candidatus Desulfococcus oleovorans Hxd3
MDGPTRVLLIKPYTNVRPAIVDVPIGPLYLLSYLRHHLAGAVDTKFIDLRLSRHRRAELVSMLTGFSPQVVGISLLTFNRAFLDTYLPVIRAHAPGALIVVGGPYATYHYADILDRHREVDVAVIGEGERVFLNLVRTVIEEGDVQSVKGIACRGADAVACNEREPYIEDLDAVPFPDYEAIDIRRYWGNHPEMNGVLAKKAYTHIISSRACPYHCVYCHNIFGKKVRKRSPENFVVEIELLYHQYGVREFQIIDDIFNIDRPRMHDILRRIMSSGMKIKIAFPNGLRGDLLTHEDIDLLQAAGAYMITLAIETASVRMQKIIRKHLDIPRVMDNIAYAASRGLIVKGYFMIGFPGETVEEMKQTIDLAVKSKLDLAHFFTVIPFEGTELAEMARALYPDVGREVATHYLPARPFYQEATGYNLNRLQKTAYLRFYGSLRTVRTFLKIPRKLHRLQRWAAFALDVFRA

SEQ ID NO: 1180 - protein, 317 aa, Thermotoga maritima
MVFFDTGSLKKKEIKDKYDIVVVGGGPAGLTSAIYARRAGLSVLVVEKAIEGGYVNLTHLVENYPGFPAISGEELASKFKEHAEKFGADIYNAEVVKLEVQGDKKVVELDDGKRIEAPVVIVATGANPKKLNVPGEKEFFGKGVSYCATCDGYLFAGKDVIVVGGGDSACDESIFLSNIVNKITMIQLLETLTAAKVLQERVLNNPKIEVIYNSTVREIRGKDKVEEVVIENVKTGETKVLKADGVFIFIGLDPNSKLLEGLVELDPYGYVITDENMETSVKGIYAVGDVRKKNLRQIVTAVADGAIAVEHAAKHYF

SEQ ID NO: 1181 - protein, 455 aa, Francisella tularensis
MSFIPHKLEQIKKMLDTIGASSVDQLFDEIPRHLRADTLNIKDGINEIQLANLMRKRANKNHHNINYIGAGAYSHHIPAAIWDIVARGEFYTAYTPYQAEASQGGLQVIYEFQTMMAGLTGMDASNASMYDGATALAESVLMAIRSNKKAKSQKVLIAEALHPTYLRVLETITKHQGIEFDIVNLDSKNGKTDVTKLEDFANTNYAAVVIQSPNFLGQLADVDGITNWAHKHGALVIAVTNPMSLAILKSPAEWGDNGADIVCGEGQPIGVPLASGGPYFGFMTCKMAHVRQMPGRIVGRTVDLDGNEGFCLTLQAREQHIRRAKATSNICTNQGLMVTAATIYMSLLGAEGLERVASISHENTQTLATELAKINGVSIRFNSAFFNEVVIDLPVNAETFVTEMEKEAIDAGYFLGEYHSDLANSIMVCATEIHTSEDIKEYIEATKKVLARIGG

SEQ ID NO: 1182 - protein, 165 aa, Zea mays
  misc_feature (37)..(37): Xaa can be any naturally occurring amino acid
  misc_feature (115)..(115): Xaa can be any naturally occurring amino acid
NSAREKDEQQQSRGIALMQGICAVVYRKADNTPCPIXAAFNKDALKSLNITHILIVAKSLDPVFPAEFNYKKIEVLDIPDTDLLKHSDECFGFIDEAISSGGNVLVHCFAGRSRXKHQMSLESALSLVRSKRPQVAPNGGFISQLEKFQKSLQVEQEWRMQPVQH

SEQ ID NO: 1183 - protein, 526 aa, Vibrio angustum
MLEQSMKQQLKAYLENLKTDIQLVLSLDDSDTAQKLHELAHEIAELNDKVSVIEDNNASVRKPVMQVVNPTKETSMSFAGLPMGHEFTSLVLALLHSGGHPMKLEQAVIDQIAALDQDIIVETFISLSCQNCPDVVQAFNMMAAINPRIKATMIDGAAFQDEVTERNIMAVPTVYVNGEVFGQGRMSLTEILNKLDTGAAKKVAASLNEKAPFDVLVVGGGPAGASAAIYAARKGIRTGVVAERFGGQVMDTMSIENFISVKETQGPRLAASLEEHVKQYNVDIMSEQRVNNIVEAADTEDGYTHVYLESGAMLKARSVIISTGARWREMNVPGEQEYRNKGVAYCPHCDGPLFKGKRTAVIGGGNSGIEAAIDLAGIVEHVTVLEFADTLRADQVLIDKAESMPNIDIIKMAQTTEVVGDGTRVTGISYKDRNTDEIKHIELAGIFVQIGLVPNTEWLKESAVALTPRGEIEIGAHGNTNVNGIFAAGDVTTVPYKQIIIAMGEGAKASLGAFDYLIRTPAPIAK

SEQ ID NO: 1184 - protein, 144 aa, Zea mays
PSVRRVGGRVGAHDETVLEKPVICYRQIKNNPYPKSRYCRGVPDPKIRFYDVGMKRMFFDEFPYCVHLVSWEKENVSSEALYASPIACNRYMTKAAGKDAFHLRVRVHPFYVLRVNKILSCFRADRLQTGMRGCLFFFPRHLFF

SEQ ID NO: 1185 - protein, 92 aa, Brassica napus
  misc_feature (32)..(33): Xaa can be any naturally occurring amino acid
  misc_feature (62)..(62): Xaa can be any naturally occurring amino acid
  misc_feature (77)..(77): Xaa can be any naturally occurring amino acid
  misc_feature (79)..(79): Xaa can be any naturally occurring amino acid
MAIRLSRVINSKQSQKQQPRVPKGHVAVYVGXXMENKKRFVVPISYLNHPSFQGLLSRAEEXFGFNHPIGGLTIPCXEXIFVGLLNSYGCIL

SEQ ID NO: 1186 - protein, 554 aa, Unknown
  Shewanella sp. ANA-3
MCSIFSILDIQSDAKELRQVALEMSKLMRHRGPDWSGIYASDKAILAHERLAIVDIEHGAQPLLTEDGSLILAVNGEIYNHKELKAQLGDKYSYQTNSDCEVILALYQEYGTEFLDKLNGIFAFVLYDKAKDAYLIGRDHMGIIPLYTGRDAAGNFYVASEMKALMPVCKTVAEFQPGQYLYSSIGEPVQYYTRDWQSFDAVKDNGASQEELRDALEAAVKRQLMSDVPYGVLLSGGLDSSVISAITQTFAKRRIEDDDQSGAWWPQLHSFAVGLKGAPDLAAAKKVADAIGTIHHEINFTFQEGLDAIKEVIYHLETYDVTTIRAATPMYLMARKIKAMGIKMVLSGEGADELFGGYLYFHKAPNAQAFHEELVRKLDKLHLFDCLRANKAMAAWGLEARVPFLDKEFMDVAMRINPEAKMSKDGRIEKHILRQAFEHKLPKEVAWRQKEQFSDGVGYSWIDGLKAHAAEQVDDLQLANAKFRFPYNTPETKEAYFYRCFFEEHYPLPSAAETVPGGKSVACSTPEALAWDESLRGIIDPSGRAVRSVHAASY

SEQ ID NO: 1187 - protein, 161 aa, Bacillus anthracis
MIREGEERRVYILGYIEELRKVVGTRPLILVGSAIIILNDNQEVLLQYRSDTYDWGVPGGAMELGETTEETARRELFEETGLNAKIMQFIGVLSGKEVYFQYPNGDEIFNVIHLYQGHHVSGELRLDHEGLQLQYFPVDKLPNLNKTTEKILQKFLHALTE

SEQ ID NO: 1188 - protein, 136 aa, Oryza meridionalis
SDDKALKRHLLRKYSGYLGGLRKELSKKRKKGKLPKEARQKLLTWWELHYRWPYPSEMEKIALAESTGLEQKQINNWFINQRKRHWKPTEEMQFAVMEAYHHQSADAAAAFYVDARLVGATAAAPAAAVYTTRPDH

SEQ ID NO: 1189 - protein, 250 aa, Corynebacterium glutamicum
MTISQENQPIIQPVSLIGGGPGAWDLITVRGMNRLQEADVILADHLGPTDELEKLCDISSKTVVDVSKLPYGRQVTQERTNEMLVEYAQQGLKVVRLKGGDPYVFGRGFEELEFLGEHGIECEVIPGVTSAVSVPAAAGIPITNRGVVHSFTVVSGHLPPGHPKSLVDWAALAKSGGTLSIIMGVKNAGAIAEALMDGGLDADTPAAVIQEGTTDAQRSVRCTLGTLGAVMVEEEIKPPAVYVIGQVAGL

SEQ ID NO: 1190 - protein, 345 aa, Rhodopseudomonas palustris
MTKYKLEYIWLDGYKPTPNLRGKTTIKEFEIYPTLEQLPLWGFDGSSTMQAEGHSSDCVLKPVAMYPDAARKNGILVLCEVMMPDGVTPHPTNTRATILDDEGAWFGFEQEYFFYKNGRPLGFPEAGYPAPQGPYYTGVGYKHVGDIARQIVEEHLDLCLAAGINHEGINAEVAKGQWEFQVFGKGSRTAADQMWMARYLMLRLTEKYGIDIEFHCKPLGDTDWNGSGMHCNFSTAYMREVGGKEYFEAMMKAFEANLDDHIAVYGPDNHMRLTGKHETAPWNKFSYGIADRGASIRVPHSFVNNGYKGYLEDRRPNSQGDPYQIASQVLKTISSVPTSKSAAAA

SEQ ID NO: 1191 - protein, 266 aa, Rickettsia rickettsii
MNIKKLILPAAAALGGVVIPVLIYMFFNYGKPELIKGWAIPIATDTAFVLGILSFFSRHISLELRAFIIGFSLIDDAFALIILALFYAKTINTLALLISSIIIFILFILNYRQVKQLFYYIIVGLLLCISMVKSGIHDTLCRAIIALFIPVNIKGEFNTSFKKLENLIRPFVNYFILPLFVFMNSGILLEYFAFKGICSNSILALIYGIIFGLSVGKQLGIMLFSYPFVKFKLCNLPSDTSWLKFYSIAILRGIGFTLSLFIGSNV

SEQ ID NO: 1192 - protein, 317 aa, Saccharophagus degradans
MLYDNILATIGNTPIVRLNKLAPEGQNIYVKVESFNPMASVKDRLAFAIIDDAEKRGVLKPGQTVVEATSGNTGIALAMVCAAKGYPFVATMVETFSVERRKLMKALGAKVILTPAAEKGTGMVKKAAELAEKHGWFLASQFENEANPAYHRNTTGPEILRDFAGKDLDYFVSGWGTGGTMTGAGQMLKLARPDLKVIVAEPQNAAMLSGNPWSPHKVQGWTPDFVPAVLDKTVADEIVTVSDDDAIATAKALATQEGIFCGISSGATLAATIAYAKQAPTGSTFVVMLPDTGERYLSTPLFADITEESDDEWLSQQ

SEQ ID NO: 1193 - protein, 495 aa, Coccidioides immitis
MLPQSDQPVIAEAKRIAAEFEYSSADVNRGVKKFLSEMEIGLTGEGSTLSQIPSYITCVPDGSEKGVYLAVDLGGTNIRVCSIHLNGDSTFDMTQEKAVIPRELMVSDSAAELFGFIAEQIECFLQKHHEERYASHTEKRRLGNIAFHDEDIFDLGFTFSFPVIQTAINKGNLYRWTKGFDIPEAVGQDVCKLLQDAVDQRNLPVRVSALINDTVGTLMARSYCSSGHSKALIGAIFGTGTNGAYVERLDRVKKLNNRGGDLVDASASEMVVNTEWGSFDNPLEVLPNTRHDQELDGISVNPGVQMFEKRVSGMFLGEILRCTILHMNKSPALNLCGGSSAIPKDSILYQHWGIDTKFLSTVEGDSTDDLREVKEELRSDLGIENASTTDCKAIKVLTHAIGKRAARLSAVPLAAIIISSGRLGTEDVIDIGVDGSLIEFYPGYEKYIREAWREIPEIGEKGEKKIQIGIAKDGSGVGAALSALVARQAEKRKQG

SEQ ID NO: 1194 - protein, 369 aa, Arabidopsis thaliana
MALVQRIPISSSSIRNWQQARTNLTPICCLHYNTASSSSSPFTEKHSVERYQRDQWLYKAVEPTPPSTPSPSPFEDEVFVRENDIASQLPELKKLLAVLKEKRVKGCKGGDCGPGDVYLVGTGPGDPELLTLKAVRVIQSADLLLYDRLVSNDVLELVAPDAKLLYVGKTAGYHTKTQEEIHELLLNFAEAGATVVRLKGGDPLVFGRGGEEMDFLQQQGIRVQVIPGITAASGIAAELGIPLTHRGVATSVRFLTGHSRKGGTDPLFVAENAADPDTTLVVYMGLGTLPSLAQKLMDHGLPSDTPAVAVERGTTPLQRTVFAELKDFATEIQSAGLVSPTLIIIGKVVELSPLWPHCTKESSCLVETR

SEQ ID NO: 1195 - protein, 428 aa, Zea mays
  misc_feature (171)..(171): Xaa can be any naturally occurring amino acid
MLLSVPIQMALNPSFRFRAKSTDNDAQDWDLQRAIGLMEVGDARNGSAAAALTKGGADDAARKPLPPCCVKAKARVPETEANCHDTVVSGWFTEPRSRFGKTSKVQYFNNPMWPGEAHSLKVEKILFQGKSPYQEILVFESSTYGNVLVLDGIVQLTDKDECAYQEMVTHXFPLCSIPAPKNVLVVGGGDGGVLREIARHDSVETIDICEIDQLVIDVCKEFFPNLSIGFKDPRVRLHVGDAVDFLRNSPEGKYDAIIVDSSDPIGPAQGTRWRKLFIQTIARALKPGGVLCNLAESMWLHTHLIQDMLAICRQTFKGAVHYAWTSVPTYPSGVIGFLLCAKEGRAVNFLTPVNPIEKIEGTTKAGRELRFYNSEIHRAAFVLPTFVRRELEAYTTPSTSAENEKPKESVSEPQKIKILSNNAILTAS

SEQ ID NO: 1196 - protein, 760 aa, Unknown
  Nocardioides sp. JS614
MTDSQDNRTPESPQGVDRKAEGGCPVLHDGVTAQGSESENPAIDSPTPRTGGRPNSLKDWWPNHLDLSVLHAHSSKSSPLDPGFRYSEEFEKLDIEALRRDIVEVLHTSQDWWPADFGHYGGLFVRMAWHAAGTYRIHDGRGGAGQGAQRFAPLNSWPDNANLDKARRLLWPVKQKHGQKISWADLIVFAGNVALEDMGFTTFGFGFGREDIWEPEEIYWGPEDTWLGDERYSGDRELSNPLGAVQMGLIYVNPEGPNGNPDPLASARDIRETFARMAMNDEETVALIAGGHTFGKTHGAGDADLVGPEPEAAPLEAQGLGWHSSFGSGKGEDTITSGIEVTWTYHPTRWDNEFFHILYAYEWELMKSAAGANQWRPKNGAGADMVPDAHDPSKRREPRMLTSDLALRFDPEYAKISSRFKDHPEEFALAFAKAWYKLLHRDLGPIARYLGPLVGETQIWQDPVPAVDHELVSDDDVAALKAKVLDSGLSVAELVSTAWASAASFRSTDKRGGANGARIRLEPQRSWAVNQPEQLAGVLDRLEGIQREFNEAGGAKISLADLIVLAGSAAVEKAAKDGGVDVTVPFRAGRTDASQEQTDVDSFAVLEPRADGFRNYLLENEKAQPEVLLVERAYLLGLTAPEMTVLVGGLRALGNNVGGSGHGVLTDRPGVLTNDFFANLLAPGAQWKASESEANVYEIRDLASGELRWTATAVDLIFGSNSQLRSLAEVYASADAREKFVRDFVAAWVKVMDADRFDLA

SEQ ID NO: 1197 - protein, 975 aa, Bacillus anthracis
MVHITIDGKKYTAEPSSTILGVINENGIEHPQICYVPEVDPIQTCDTCIVEVDGKLMRSCSTVVTEGMNIERNSTRAKEAQTEAMDRLLENHLLYCTVCDNNNGNCKLHNTAELMEIEHQKYPYEPKVDVSEVDMTHPFYRYDPNQCIACGQCVEVCQNLQVNETLSIDWEAERPRVIWDEGVSINDSSCVSCGQCVTICPCNALMEKTMLGEAGFMTGLKPDILEPMVDLIKEVEPGYSGIFAVSEVEAAMRDTRTKKTKTVCTFCGVGCSFEVWTKGRKILKVQPSSDAPVNAISTCVKGKFGWDFVNSKERITKPLIRKNGTFVESTWEEALNVVANKLGSIKEEYGKDAIGFISSSKITNEDNYVIQKLARQVFETNNIDNCSRYCQSPATDGLFRTIGMGGDAGTIKDIAQSGLVIIVGCNPTEGHPVLATRIKRAHKLHGQKLIVADLRKTEMAERSDVFISPKQGTDQVWLMAVTKYMIDQGWHDQQFIDENVNFFEDFKESLTEYTLEYAEEVTGISKETLIQMAEMIRDADGTCILWGMGVTQNTGGSDTSAAISNLLLATGNYRRPGAGAYPLRGHNNVQGACDMGTLPGWLPGYQHVTNDMERAKFEMAYGVKINSEPGLNNIEMLHAIDEGEMKAMYLVGEDMALVDSNANHVHEVLSSLDFFVVQDVFLSKTAQYADVVLPAAPSLEKEGTFTNTERRVQRLYQVLPTLGDAKPDWWIVQAIANKLGANWNYSHPSEIFAEMASLSPLFSQANYEVLEGWNSFHWGSFDGTNTPLLFQDGFNFPDKKARFAIADWVRPAEFPAEFDLHINNGRMLEHFHEGNMTNKSTGIQTKVPGVFVEVSPALAKERGVKTGSLVRLVSPFGALKLRVLVTDRVKANELYLPMNSTDNETAINFLTGPAVDTRTNTPAYKQTKVRMEVLEVDGENPMPKANPRNKKRHPQSGIEVHRKWARPGYVHLTDK

SEQ ID NO: 1198 - protein, 691 aa, Methylococcus capsulatus
MNPIRKQFQYGAHTVSFETGEIARQADAAVMVDMAGTVVLVTVVGRKDASPHGDFFPLTVNYQEKAYAAGRIPGGFFKREGRPSEKETLTARLIDRPIRPLFPDGFTHEVQVVATVMSLNPEVDPDIPSMLGASAALTLSGLPFKGPIGAARVGFVNGAYVLNPDGSVVEGSELDLVVAGTANAVLMVESEAKILPEEVMLGAVVFGHEQMQTAIRAINELAEEVGVTPWPWEPSAVDAALVAAVDELARAGLGEGYNIADKQLRQQKLKEVRKAVIDALTAEGAHDENAVKRQIEKLEEEIVRSNILHHGKRIDGRDLSTVRPITIRTGVLPRTHGSALFTRGETQALVVATLGTGRDAQLIDALEGEYKENFMLHYNFPPYCVGETGAIGSPKRREIGHGRLAKRGVQAIMPTMDEFPYVIRIVSEITESNGSSSMASVCGSSLALMDAGVPTKGAVAGIAMGLILEGEEFAVLSDIMGDEDHLGDMDFKVAGTRDGVTALQMDIKIDGITPEIMRQALHQAREGRMHILDKMAQALPAPRSEMSDYAPRITSFTIDPSKIREVIGKGGATIRAITEETGTSIDISDDGVVKIASVDKQAGLEARRRIEDITAEVEVGKVYEGKVARLMDFGAFVTILPGKDGLVHISQISDEHVEKVSDKLAEGDMVKVKVLEIDRQGRVRLSMKAVE

SEQ ID NO: 1199 - protein, 721 aa, Thermococcus kodakarensis
MMYSAMMEVLRMDEKLVPVVCPYCGVGCRLYIRSSDGHPLGIEYANDIPGISNENGKLCPKGNAVLEYVLARDRLKKPLKAKEQGKFVEISWSQAIKEVAERLKEYSKDDPNSMMFFGSAKTFNEPNYLIQKLARMLGTNNVDHCARLCHASTVSGLKAVFGAGAMTNTYRDIEEANVIFIIGHNFAETHPVGFRYVLKAKERGAKVIVADPRFTRTAWFADIYLQHYPGTDIALINGLIHVIIEERLYDEKFVRERCTGFDELAKTVEKFTPGYVEKITGVPADLIVQAARTFATGGKGVITWAMGITQHTHGHDNVRLLATLSAICGYQGREGCGVSPMRGQNNVQGACDLGVLPNVFPGYKAVSDPEGRKFFEEFWGTELSGEVGLTVIEAAHAIEKGKVRAYYVMGENPVISDANTNHVIKALHKLEFMVVQDIVPTPTMEFADIVLPAAAMLENEGSLTNTERRVQWSFQAINPPGEARPDWWIVSEIGKAAGFTGDGPKGFNYSGPEDILREVNACTPQYRGITPERLKANLAGIHWPCPSEDHPGTRVLYKERFLTSDGKAHLAAVEYRGPAETPDEDYPFLLTTVRYVGHYHTLTMTGRSRALVKRWPEPLAEIHPEDAERLGIKTGDWVKIVTRRGEYPIRAKVTRTVKKGVIAVPWHWGANVVTNDALDPVAKIPETKACACKVVKITEEEARELMKKVPPVIPEIEIVRG

SEQ ID NO: 1200 - protein, 489 aa, Escherichia coli
MVSETKTTEAPGLRRELKARHLTMIAIGGSIGTGLFVASGATISQAGPGGALLSYMLIGLMVYFLMTSLGELAAYMPVSGSFATYGQNYVEEGFGFALGWNYWYNWAVTIAVDLVAAQLVMSWWFPDTPGWIWSALFLGVIFLLNYISVRGFGEAEYWFSLIKVTTVIVFIIVGVLMIIGIFKGAQPAGWSNWTIGEAPFAGGFAAMIGVAMIVGFSFQGTELIGIAAGESEDPAKNIPRAVRQVFWRILLFYVFAILIISLIIPYTDPSLLRNDVKDISVSPFTLVFQHAGLLSAAAVMNAVILTAVLSAGNSGMYASTRMLYTLACDGKAPRIFAKLSRGGVPRNALYATTVIAGLCFLTSMFGNQTVYLWLLNTSGMTGFIAWLGIAISHYRFRRGYVLQGHDINDLPYRSGFFPLGPIFAFILCLIITLGQNYEAFLKDTIDWGGVAATYIGIPLFLIIWFGYKLIKGTHFVRYSEMKFPQNDKK

SEQ ID NO: 1201 - protein, 59 aa, Sorghum bicolor
VLADTQMPEEPDGWFQGTADSVRKFIWVLEDYYNHKSIEHIVILSGDQLYQMNYMELVQ

SEQ ID NO: 1202 - protein, 169 aa, Asarina barclaiana
GDFGFDPLGLGEVPENLERYKESELIHCRWAMLAVPGILVPEALGFGNWVKAQEWAAVPGGQATYLGNPVPWGTLPTILVIEFLAIAFVEHQRSMEKDPEKRKYPGGAFDPLGYSKDPKKFEELKVKEIKNGRLALLAFVGFCVQQSAYPGTGPLENLATHLADPWHNK

SEQ ID NO: 1203 - protein, 442 aa, Oryza sativa
MDPWSEIEGKRAHDPIFQNYFSQNCRQSVDGFCKKRSADAAVARAERCIRVLGPIIVGAGPSGLAVAACLKEKGVDSLVLERSNCIASLWQLKTYDRLSLHLPRQFCELPLMPFPAYYPIYPSKQQFVAYLESYAARFGICPTYNRTVVCAEYDEQLQLWRVRTRATGIMGEEVEYVSRWLVVATGENAEVVLPEIDGLDDFKGTVMHTSSYKSGGAFAGKRVLVVGSGNSGMEVCLDLCNHNANPHIVVRDAVHILPREMLGQSTFGLSMWLLKWLPVHVVDRILLLIAQTMLGDTAQLGLKRPTIGPLELKSLSGKTPVLDVGTFAKIKSGDIKVRPAIKQISGRQVEFMDTRLEEFDVIVLATGYKSNVPFWLKDRELFSEKDGLPRKAFPNGWKGENGLYSVGFTRRGLMGTSVDARRIAHDIEQQWKARGKHPGVLL

SEQ ID NO: 1204 - protein, 223 aa, Zea mays
  misc_feature (108)..(108): Xaa can be any naturally occurring amino acid
MAGKELTLLGLWASPFVLRARIALSLKGLTYAYSEENLDDKSELLLSSNPVLKKVPVLIHHGKPVCESQIIVQYVDEAFPAAAPNFLPSDPYDRAIARFWASYVDDKXGRTAEEMAEAARQAVAALETLEQAFRECSKGKAFFGGDSVGLVDVVLGGLVGWLYATEAICGVKALDAGRTPLLAAWAERFCALEGVKGLIPDVDRLLEYTKARRAVFGLPPLRP

SEQ ID NO: 1205 - protein, 193 aa, Alonsoa meridionalis
GDFGFDPLGLSDPEGTGGFIEPKWLAYGEIINGRFAMLGAVGAIAPEILGKAGLIPAETALPWFQTGVIPPAGTYNYWADGYTLFVLEMALMGFAEHRRFQDWAKPGSMGKQYFLGLEKGLGGSGDPAYPGGPFFNPLGFGKDEKSMKELKLKEVKNGRLAMLAILGYFIQGLVTGVGPFQNLLDHLADPWHN

SEQ ID NO: 1206 - protein, 481 aa, Francisella tularensis
MVIFEKTRGKNSPSVMPSKKGDVSNIPTDMLRTKKPILPEQAELDVVRHYTQLSRKNFCIDTNFYPLGSCTMKYNSRAAHKYASLAGFLERHPYASAQSVQGTLECLYDLQNLIKELTGMTGVSLAPMAGAQGEFAGVAMIKAYHHKRSDFERDEIIVPDAAHGTNPATAKVCGLKVIEIPTKKDGDIDIEALDKVLGPKTAGIMLTNPSTVGVFERNIAVIAKKVHEAGGLLYYDGANLNAIMGKARPGDMGFDVLHMNLHKTFATPHGGGGPGAGPVAVNDKLKEFLPVPMVGKKDDKFVWLEEKDVSNTIGRLSAFNGNIGVLIRAYIYGAMLGGNGLTEASEIATLNANYMMTRLKEEGFTIAYPDRRASHEFIVTLKPEFLNYGVTATDFAKCLIDKGVHAPTMYFPLLVPECLLIEPTETENVDSMEKFIQAMVEIRDIAKKDPQYLKGAPYNLPARRLDDVKAAKELDIVWQPK

SEQ ID NO: 1207 - protein, 336 aa, Zea mays
MARQSAASMLATTTPLLLSVLANIAVVESIGVSYGMSGDNLPPASTVIGMYKDNGIPLMRIYAPDQAALQAVGGTGIRVVAGAPNDVLSSLAASPAAAASWVRNNIQAYPKVAFRCVCVGNEVEGGAAQSLVPAMENVRAALVAAGLDGIKVTTSVSQAILGGYKPPSAAEFTDEAQGFMGPVLRFLARTGAPLMASVYPYFTYATNPAAMDLSYALFTAPGTVLQDGAYEYQNLFDATVDSFYVAMANHGGSGVTLVVSESGWPSAGGVAASPENAAIYNQNLINHVGRGTPRHPGAIETILFSMFNENLKQSGVEQNWGLFYPNMQRVYPIKFN

SEQ ID NO: 1208 - protein, 313 aa, Guillardia theta
FTRPMAVKRAGVRAGRSGVVRGMTMTTVEEKTKQLVGAKAALKELIDQTNANPIMVRLAWHDSGTYDDSIKTFPKAGGATGSIRFDPEIHHGANAGLTNAVKMLEPIKQQFPAVSYADLFQMASAVSIELAGGPKIPMRYGRVDAAGPRDCSPEGNLPDAEAGPSGKFGGKGGTASTEDSTAAGHLRKVFYRMGLGDEEIVALSGAHTIGRAYKDRSGLGKEVTKYTDGSKIVRADGKAGSGKAGGSSWTEKWLTFDNSYFTTIPDPNADPELLKLTSDRTLFEDPGFKPFAEKFRDSNEAFFQSYAKAHARL

SEQ ID NO: 1209 - protein, 1070 aa, Francisella tularensis
MQATNQNIWIQDKFGNFTHLNATHQVYLDFETNSIRFRIQADGFLHGYVIANFNNWQKLEEYKLTWTTDNDDGSLWLTKDVFNISTLNAGTNQYSFILVSLAGEEFKVSINDHDLIPLSFNWQVAKGTLEIKASENYVVSGFNLELIAITKSITGYQNIVDVEWQVSPQNSKITLTNGKLLIDPSVSNLTEVKVSCFAKNNPDLKAERIFTVIKEKRKGSLVHFIKKDQQYKGENFDWDLWNFNKNKPAYSVSLSHRSDFGLYGLCQKKNVIARKRIWDINWHNDWAEQTSCFKISKKHQNYYIVHGDATIYRSLEDVINKTNPRIIHAVMNEASRIIAYLSDIPRIGTSFELWVNSKKVENVGLIVKHRSKQLIFTGLPPINPHDLVEIRANNTFSAAKVLMGEYLNNFYYPNNIGVSFSDELISLRIWSPTAIKVEVLIYNEDLDNNKKQPDVVHELTAERSYGTHHIEICRKNYENKYYIYRLYFEDLDNKGQRCIKTTYAVDPYAYGVGINGRKGFLVDLNNPKVTPEQWQQSHNPNCLNREDAIIYEAHLRDFTISPESGVSEELRGKYLGAVENNTYYIDSATNQKVSTGIDSLVELGVTHIHLLPIFNFSSVDEEKNNEKDNRNWGYDPQNYNAPDGSYSINPYDPLQRIRGARNMILGFHQKGIGVIMDMVYNHMTETSNLDKIVPKYYFRTDALGNFTNGSGCGNELASEKPMVSKFIQDSVIHWVKNYKIDGIRFDLMELIDINTIKNIVSKVKQINPNVIIYGEPWKGGDSPLINGTHRGTQRNQQFSIFNDYFRDAIRGNNNPGSGFINGDPHNPSNIGNVIEGLHGSIYSLTAMPGESVNYIDAHDNYTLWDQVEKSQSHDIPQGYYRKNLPENIFEHRFVRQNALALGIILTAQGIPFIHGGSEFLRTKQGDHNSYKSGDNINAFHWSDKLRYKAFFDYIAGLIRIRKEHPAFRMRDRETIEKHLNITTAHHDSKSGVIISHFKNNTNGDSWQDIIVIYNATSIDGYDVNALMPISAGKIWHIVANHEKAGVDTIQTVNSSELPGLKSYSLMIIHS

SEQ ID NO: 1210 - protein, 152 aa, Oryza sativa
MAGRGEMPMRPVRPGPPMQYRGPPPMARARVQPVDREKTCPLLLRVFTKVGGHHQNEEFAVRGKEPKDEVQIYTWKDATLRELTDLVKEVALAARKRNARLSFAFVYPDKHGRFVVKEVGSTFSYGHGRGDDAKTLAELGFQIGDYLSVAIY

SEQ ID NO: 1211 - protein, 555 aa, Atriplex gmelini
MWSQLSSLLSGKMDALTTSDHASVVSMNLFVALLCGCIVIGHLLEENRWMNESITALLIGLATGVVILLISGGKSSHLLVFSEDLFFIYLLPPIIFNAGFQVKKKQFFRNFITIVLFGAVGTLVSFTIISLGALSIFKKLDIGTLELADYLAIGAIFAATDSVCTLQVLNQDETPLLYSLVFGEGVVNDATSVVLFNAIQSFDLTRIDHRIALQFMGNFLYLFIASTILGAFTGLLSAYIIKKLYFGRHSTDREVALMMLMAYLSYMLAELFYLSGILTVFFCGIVMSHYTWHNVTESSRVTTKHAFATLSFVAEVFLFLYVGMDALDIEKWRFVSDSPGISVAVSSILLGLVMVGRAAFVFPLSWLMNFAKKSQSEKVTFNQQIVIWWAGLMRGAVSMALAYNQFTRSGHTQLRGNAIMITSTISVVLFSTMVFGLLTKPLIMFLLPQPKHFTSCSTVSDVGSPKSYSLPLLEGNQDYEVDVGNGNHEDTTEPRTIVRPSSLRMLLNAPTHTVHHYWRKFDDSFMRPVFGGRGFVPFVPGSPTEQSTNNLVDRT

SEQ ID NO: 1212 - protein, 373 aa, Haemophilus somnus
MAKRDYYEILGVQKGADDKEIKRAYKRLAMKYHPDRTKGDKESEEKFKEINEAYEVLADKEKRAMYDQYGHAAFEQGGGAGGFGGFSGADFGDIFGDMFGDIFGGGRSRQRVVRGEDLRYDIEISLEEAVKSCKKDIQINTLVHCGTCHGSGAEAGSKIESCPTCHGAGRVRRQQSFFVTEQTCPHCHGTGKKIEKPCHTCHGEGRVHKTQNLTVTIPMGVDTGNQLRLAGKGAAGENGAPAGDLYVVIHVKKHHIFERDGNNLYCEVPISFTMAALGGEVEIPTLDGRLKVKIPAETQTGKLLRLRGKGITSRGYAGDLICEIVIETPIKLNEEQKELLRKLEESLEGKTLQRPKSSGFLDGVKKFFDNLGK

SEQ ID NO: 1213 - protein, 423 aa, Francisella tularensis
MDNHNSSHQLYKKAMALVLAGGRGSRLYNLTDTRAKPAVYFGGKFRIIDFALSNCLNSGIRRIGVVTQYKSHSLLRHLQRGWGFLRGELNEFIDLLPAQQRVDEEHWYRGTADAVYQNIDILRSYGPEYVIVLAGDHIYKMDYSIMLRDHAQSGYKCTVGCVEIAKEEAYAFGIMGIDENRKITSFIEKPKKNAPTIPGTTDRCYASMGIYIFNSDYLYDLLEEDITNKESSHDFGKDIIPRVVSENQALAHPFSMSCVPRGEGIEPYWRDVGTIDAFWEANLDLAANMPELNIYDKDWPVWTAQEQLPPAKFVPDRNGNHGVITNTLASGGCIVLGSEISKSLMFSKVRVLAGCKIDQCVIMPEVVVGENCRLKKVVIDKGCDIPAGMVIGEDPIEDAKNFYRTDKGVVLVTKKMIDELKEK

SEQ ID NO: 1214 - protein, 78 aa, Anthoceros formosae
MEKQNLIDMEGVVTESLPNAMFRVCLDNGCQVLTHISGKIRRNYIRILPGDRVKVELSPYDLTKGRITYRLRTKSSNP

SEQ ID NO: 1215 - protein, 589 aa, Rhodopseudomonas palustris
MPQSYFDVTTARSGGYYNFPPVGLLYLAAAARAADPALGIHLIDINHQLLKAAHGDGFDYGLWRDLVRDAIKACATPHVGVSYMFGTTKPCFTEVIDLIRSEFPQVPVLCGGVQATFDYREILASGLCDIVARHEGEQQLIGYLGALAGNPDAVPVGMAFTEAGAIVELGAPPPDNPVNWDVTPFYDAIRIEEYHRYGGLGAFSRYVGADKPFATVLAARGCRARCTFCTVRNFNGFGLRQRTVQDVIDEVKHLVTDHGIRSIDWLDDDLLWDRERALALFRGLAEQVPGLEWTASNGLIAVAIDDEVMQAMVASGLRAFKIGVESGNDAMLKTIKKPTTKPKLRARAELFARYPQVFVSTNFIIGFPDETFGQMMDSYDLAVELASDWASFYICQPLKGTEMFSAFQSLGDARTKEERYDKTINPGRSAERGEFGYRFAPDRVLRTGWEVFEIDRGSVPDLEQQKEIWFSFNLIANFLDNPNFRPSGNAAKLARWIEAIHDGYPYDASMAAALAHAYHLLGDVKRHAHHRADFLRLTATSAYWQNRVAQFPELLVLAHLEQPPDWFTGPMPRGLTRPLPQPQRRQVHA

SEQ ID NO: 1216 - protein, 498 aa, Cryptococcus neoformans
MPTLRKTGDRPAGTGLAKPPSVPSPRAPSKPSAPPPPAPSGPPSRTAPPAPPAPPAPPAPPAPPAPPAPPAPTRHVPPPARATPPAPPAPTSSRAPPRVPPAPPAPSRTAPPAPAPPAPPAPAPPAPAPPAPPAPPAPPAPAPPARNAVHRKEPAPPLPGRSPAPSLPNRPTNSVPARAVPPPPPRPSSMTGGRAPPPPPPRPTGPPTLPSRPASSYAAPNRALPPAIPSRTDSSNLAPPTPPRRPSSVSAPPAPPPPAPAPPAPAPPAPPAPAAPAPRRMIPPPARSIPSPAPRVVQPEPEPEPEPEYYGQEEETAPPPLPAGRPASRLPPPPPSAPPPPPPGPSPASRAAPPAPARAPPAPARAPPAPARAPPSPALERNRPHPAGTAFAPPPPPGISPAAGTNRSSLAPPILASRPRPQSLHASRTNVAQRSSEAVDSDGGADGDSGAEDQVPEPPAVVGSWTFPMKGMFPAPRPWSGGRKTYVSGNMHGGGIGF

SEQ ID NO: 1217 - protein, 426 aa, Mycobacterium avium
MSAPLADIDPDIAGLLGQELGRQRDTLEMIASENFVPRAVLQAQGSVLTNKYAEGLPGRRYYGGCEYVDVVENIARDRAKALFDADFANVQPHSGAQANAAVLHALMTPGERLLGLDLANGGHLTHGMKLNFSGKLYDVGFYGVDPTTHLIDMDAVRAKALEFRPKVIIAGWSAYPRVLDFAAFASIADEVGAKLWVDMAHFAGLVAAGLHPSPVPHADVVSTTVHKTLGGPRSGLILGKQEYAKSINSAVFPGQQGGPLMHVIAAKAVALKIAGTEEFADRQRRTLSGARILAERLSGADVAAAGVSVVSGGTDVHLVLVDLRNSELDGQAAEDLLHEIGITVNRNAVPNDPRPPMVTSGLRVGTPALATRGFGGAEFSEVADVIATALAGGRGADLAALRDRVTRLARDFPLYEGLEDWALVGR

SEQ ID NO: 1218 - protein, 517 aa, Zea mays
MVGGGEGDRVGGGVGVGGGQQFVDRSKVRILLCDGDASSSREVLRLLCNCSYHVTCAKSPRQVINILNYEGGEIDIILAEVDLPVSKCFKMLKYIARNKDLRHIPIIMMSNRDEVSVVVKCLRLGAAEYLVKPLRTNELLNLWTHVWRRRRMLGLPEKNFFNDNFELVLSEPSDANTNSATLLSDETDDRPKENTNQETGTSNQLEYESNPSVAERDQRDKIGAPGSALDASQSSTPGRMFSRPIKTNLKVAESSAFLAYVKSSTPATSSFDSGLQRGDSRLDSLDNHGNCSSATDRSDTGTDVNIRNKEAFEMPVQYPMVCFSSSSMHMERSNEGHNDTSGTPPAYHFPFYYPGMVEHNMALSSVQNFQANINSAQAHTPPAMLHQYNVFSQCHSLPMISPFQFNTSGMSMHSSHLPTQNVWSSASSTPTPDETCNRSERRAAALAKFRQKRKERCFDKKVRYVNRKKLAETRLRVRGQFVRHASNMDIISTGDDISEDEDDDPTSREVDMISSPE

SEQ ID NO: 1219 - protein, 151 aa, Oryza sativa
MDPYAILKCRSQEQRSSIASVLWCIADEWNDLTVRIIPKECIAMCNFCYVDCGKGSNPEWNENFVFTVSDKATELLIKLLDSDTGSADDFVGEATIPLEAVYTEGSIPPTLYNVVKDEHYCGEIKVGLTFTPEDVRQRGLPEDFGGWKQSR

SEQ ID NO: 1220 - protein, 242 aa, Rhodobacter capsulatus
MSGFVSFVSSGPGDPELLTLKAADRLAKADVVLFDDLSAGADPGAMPARGAELIAVGKRAGRPSPKQDHVSRLLVDHALTGQRVVRLKSGDSGLFGRLEEELDALTGAGIGYEIIPGVPSACAAAAASGLPLTRRLTARRVQFVTGADVTGDLPEGLNWAALADKGATTVVFMGKRTFPKLAADLIAHGLAPDTPALLAEAVGHPGQSVTRSTVTDLAASLAAERSDKPALILYGPLYAPEA

SEQ ID NO: 1221 - protein, 478 aa, Rhodopseudomonas palustris
MRFLPVFLDLATGPVVLVGAGEMARAKLRLLLGAGASVRWYVTDGDRDLAGLTEPERSRISFPEGAPLHADLTGAIALLCAGAGDVAAPLAAKARALGVPVNVMDELSHSTFIFPAIVDRGDVVVAIGTGGSSPVVARRLRELIETVVPARIGELAALIGRWRTPIKARIPEFPLRRRFWERVVDGPIGRAVLEGRLTDAETELKTIDDATDYARHSLGRRADGHVSIVGAGPGDPDLLTLKALRALSDADVVFYDELVSPEILDRIRRDAKRVPVGRRVGQPGIGQDAINKLLIETARSGQRAVRLKGGDPFVFGRGGEEVEALREAGVSYSVVPGISAALGAASQFEVPLTYRHEALRITFLTAHKAKDAEAVDWSALTDQKMTVVVYMGMSAAPTIRDGLLAAGRAADTPVGVFARVTRSDAVSAVGTLNDLPALVDEVDGGPALLVIGDVVAHSAPWRQQQLLQLVSTYQMAAE

SEQ ID NO: 1222 - protein, 311 aa, Unknown
  Shewanella sp. MR-4
MFFEGAEKKLEIRLTPKLASLRLREYGFWSTLVACANAEILSTSSNHACDAYLLSESSLFVWDYKILILTCGNSTLIEAACYFINALGAEHIAALCYQRKNEYQAQLQSTSFADDIAKLRLLIPGEAFRMGHLDSHHHYVFCAENQSVSSSETSLELMMYHIRGELAEYLKLPTQTEHGIYLQLGLQQLFGDFQLDMHCFQPAGFSLNAIRGADYFTLHITPSMGQGDNSYVSFETNLDLAVYPHPVVARLLDLFSPISWDLINFNQPINTAGFPAHICLGQGLVTTGSGSQISFRHYQQLEPQILQPEFI

SEQ ID NO: 1223 - protein, 470 aa, Oryza sativa
MEADSGKLFVGGISWETDEDRLREYFGRFGEVTEAVIMRDRNTGRARGFGFVVFTDAGVAERVTMDKHMIDGRMVEAKKAVPRDDQSITSKNNGSSIGSPGPGRTRKIFVGGLASNVTEVEFRRYFEQFGVITDVVVMYDHNTQRPRGFGFITYDSEDAVDKALHKNFHELNGKMVEVKRAVPKEQSPGPAARSPAGGQNYAMSRVHSFLNGFNQGYNPNPIGGYGMRVDGRYGLLTGARNGFSSFGPGYGMGMNSESGMNANFGANSSFVNNSNGRQIGSFYNGSSNRLGSPIGYVGLNDDSGSLLSSMSRNVWGNGNLNYPNNPTNMSSFAPSGTGGQMGITSDGINWGGPTPGHGMGNISSLGLANLGRGAGDSFGLPSGSYGRSNATGTIGEPFSAPPNAYEVNNADTYGSSSIYGDSTWRFTSSEIDMPPFGNDLGNVDPDIKSNIPASYMGNYTVNNNQTSRGQ

SEQ ID NO: 1224 - protein, 171 aa, Staphylococcus epidermidis
MNINTAYFAGGCFWCMTKPFDTFDGIEKVTSGYMGGHLVNPSYEEVKTGSTGHYEVVKIEYDVALFSYHKLLEIFFSVIDPLDDGGQFQDRGSQYKTAIFYSNEHQRQLAEQYICELQDSFNADKAIATKILPASTFYEAEAYHQDFYKKNPERYEQEQQDRASYVKNNHM

SEQ ID NO: 1225 - protein, 399 aa, Clostridium perfringens
MKHLNIKDDLFWVGALDPNLRVFDIIMYTPYGTTYNSYVVKGSEKTAIFETVKAEFFDQYIARLKDLGVEPSEIDYIVVSHTEPDHAGSIGKILELAPKAKIVASPIAINYIKEIVNGDFESIPVKDGDSISLGNKTLKFMSVPFLHWPDTIYTYVEEDKTLITCDSFGSHYSCEEMFDDLIPNEEEYMEALKYYFDCIMGPFKPYVLKALDKIKGLDIEIICPGHGPILRSNPYKVVNLYKEWSTPAPAKEVKKASIFYVSAYGYTKQLAEKIAEGIKSTGNLDINLFNIIEHDMTELVGEVGSSDAILFGSPTIVNELVEPVRDLMAKLNPVIHGGKIAGAFGSYGWSGEAVPRIESRLKELRMNMPVEGLRIKFKPSEEEAQKAFDFGVEIGNALK

SEQ ID NO: 1226 - protein, 167 aa, Haloarcula marismortui
KPGAMYRNSSKPAYTRREYISGIPGKKIAQFDMGNNGAGPTYPAQVELVVEKPVQIRHNALEAARVAANRYVQNSGAAANYKFRIRKFPFHVIRENKAAAAAAAAAAADGMRAPFGKPVGTAARVHGANHIFIAWVNPDPNVEEAWRRAKMKVTPTINIDSSPAGNA

SEQ ID NO: 1227 - protein, 498 aa, Solanum lycopersicum
MAKKNFVLHYNLLLISLLAFLFLLTEGAPQSALVTQLPGFNGTFNSKHYAGYVNIDESHGKNLYYYFVESERNPSKDPVVLWLNGGPGCSSFDGFVYEHGPFNFDFGKPSGSLPSLHNNPYSWSKVSNIIYLDSPVGVGLSYSGNKSDYNTGDLKTASDSHSFLLKWFEIYPEFLKNPFYISGESYAGIYVPTLASEVIKGIDAGVRPAINFMGYMVGNGVADDIIDGNAIVPFQHGMGLISDDLYEEAVVACHGNFYEPVDSNCSEKLNKIDQVVYDLNVYDILEPCYHSKKPSVITTGNSRLPMSFRKLGETERPLPVRKRMFGRAWPYKAPVRAGHVPTWPEILNSVEVPCTDDRVATLWLNNADVRKAIHAEPATVIGPWELCTDKIDLDHDSGSMIPYHKNLTARGYRAIIFSGDHDMCVPFTGSAVWTKSLGYPIVDEWRPWYVNDQVAGFIQGYANNLIFMTIKGAGHTVPEYKPREALAFYSRWLEGKKI

SEQ ID NO: 1228 - protein, 165 aa, Triticum aestivum
  misc_feature (49)..(49): Xaa can be any naturally occurring amino acid
  misc_feature (62)..(62): Xaa can be any naturally occurring amino acid
  misc_feature (85)..(85): Xaa can be any naturally occurring amino acid
  misc_feature (126)..(126): Xaa can be any naturally occurring amino acid
MPRTPVRCSWQTTKTADTTSRQCRGVPDPKMTISDAAMNKNDVDKVSQXVHLVSWYKENASXEVLEAVRFACNNSMTSCAGKEAXLLMSRVRPFHVIRSYKMRSCAGAELLQTEMRGACGKSLVVXGGVVIGKVLLSVHCRRNSAFHANRGLRAAKFKFSGRRDA

SEQ ID NO: 1229 - protein, 371 aa, Rickettsia akari
MSQDYYKILGVSKTASQADLKKAYLKLAKQYHPDTTDDKDAEKKFKEINRAYDVLKDEQKRAAYDRFGHDTFQNQQSRGGGGSHAGFHHDINDIFGDFFSDFMGGGRRKPTSSKARGSDLKYDLTINLEEAFHGIEKNISFSSEVKCDTCHGSGSEKGETVTTCDACGGVGATRIQQGFFTIEQACHKCKGNGQIIKNPCKKCHGMGRCHKQRNLSVNIPAGVENGTRIRHTGEGEAGIRGGNSGDLYVDIAITPHDIYKVDGANLHCKLPISFVNAALGGEIEVPVIEGRKVNLTIPAGTQNGDQLRLRSKGMPKMRSTIRGDMITHIHIEVPKNLSKRQCELLEEFKKESISEKENDGSFFNKMKSLWS

SEQ ID NO: 1230 - protein, 162 aa, Crocosphaera watsonii
MSHNNSIGNYLIQRLLELGVNHVFGVPGDFVLGFNKLLENSDLEFINTCDEQGAGFAADAYARLRGLGVVCVTYCVGGLKIANTTAQCFAEKSPVVVISGSPGINERIKNPLLHHKVKEFDTQYKGFQEITVAATVLDNPDTAQVNRTIIHDYTSSFPQFGD

SEQ ID NO: 1231 - protein, 194 aa, Aspergillus nidulans
MASATTFYDFEPVDKKGEAYPLNQLKGKVILVVNTASKCGFTPQFKGLETLYQSIKAKRPDDFVILGFPCNQFGGQDPGSNDQIQEFCQLNYGVTFPVLGKTEVNGDNANPLWTWLKESQPGLLGLKRIKWNFEKFLISADGKVVGRWASTTKPEGLESRILEEIEKAEKQGLLASKAMQPEAAGTDGETAKLA

SEQ ID NO: 1232 - protein, 371 aa, Oryza sativa
MAVPLVLVVLPLGLLFLLSGLIINAIQAVLFLSIRPFSKSLYRRINRFLAELLWLQLVWLVDWWAGVKRSGCLGSTLAVMKKSSKFLPVIGWSMWFAEYLFLERSWAKDEKTLKWGLQRLKDFPRPFWLALFVEGTRFTPAKLLAAQEYAVSQGLPAPRNVLIPRTKGFVSAVTIMRDFVPAIYDTTVIIPKDSPQPTMLRILKGQSSVVHVRMKRHAMSEMPKSEDDVSKWCKDIFVAKDALLDKHLATGTFDEEIRPIGRPVKSLLAVWGLSGLKLKTWVEAPSFVRAKSEDQGRCFAGTTVTLFWSCLLLYGAVKLFLWTQLLSTWKGVGFTGLGLALVTAVMHVFIMFSQSERSSSAKAARNRVKKD

SEQ ID NO: 1233 - protein, 171 aa, Unknown
  Mycobacterium sp. MCS
MSDHKKAILAGGCFWGMQDLIRKQPGVVSTRVGYTGGQNDHPTYRNHPGHAESIEITYDPAQTDYRALLEFFFQIHDPTTKNRQGNDVGTSYRSAIFYVDDEQKRVALDTIADVDASGLWPGKVVTEVTPAGEFWEAEPEHQDYLERMPWGYTCHFPRPDWKLPKRADAKA

SEQ ID NO: 1234 - protein, 449 aa, Unknown
  Mycobacterium sp. MCS
MSEATVAEVPTTKPRAVNLPPALRAPMPLQGIAYAFARRQLVSWMARRHGPVFRIHIPMFGRTVMVADPQLAKQLFMAPTDAVGNIQPNLSRILGPGSVFALDGAEHKRRRRLLTPPLHGKSVKNYEKLFEEETLRESANWPEGRPFETLEPMMRITLNVILRAVFGADGEKLDELRRIIPPWVTLGSRLAVIPSPPTTFGRWTPWGRLADYRRRYDEVIDRLIDEVRADPRFGERDDVLALLLRSTYEDGTEMSRSEIADELLTLLAAGHETTASTLGWAFERISRHPDVLAKLVAEAATDDNEYRQATIFEVQRNRTVIDFAGRHVYAPTFELGEWVIPRGYSIVVALAEIHEQAEDYVDPERFSPERFVGSRPSPLVHVPFGGGTRRCIGAVFANVEMDIVLRTVLRHFVIEPTTAPGEKVHSRGVAYTPKAGGQVTLHRRPQPLA

SEQ ID NO: 1235 - protein, 476 aa, Brassica napus
MANIARQFSSVSLRRTFSRQFTGQSSHDPRRNNMRFSFGRQSSLDPIRRSSTPEEGSNRPPHQLAVPDNLDATMQLLFVECGGDVEGVRDLLDDGIDVNSIDLDGRTALHIAACEGHVEVVKLLLTRKANIDARDRWGSTAAADAKYYGNMDVYNILKARGARVPKTKRTPMVVANPREVPEYELNPQELQVRKADGISKSCQGIYQVAKWNGTKVSVMILDKDLYKDNETIEAFKHELTLLEKVRHPNVVQFVGAVTQNVPMMIVSEYHPKGDLGSYLQKKGRLSPSKVLRFALDIARGMNYLHECKPEPVIHCDLKPKNIMLDNGGLLKVAGFGLISFEKLSSDKSKVLNHGAHIDLSNYCVAPEVYRDEIFDRSADSYSFGVVLYEMIEGVQPFHPKPPEEAVKLMCLEGRRPSFKAKTKSCPEEMRELIEECWDVKAVVRPTFSEIIVRLDRIFVQCSKQGWWKDTFKFPWK

SEQ ID NO: 1236 - protein, 72 aa, Exiguobacterium sibiricum
MAKQDVIEVEGTVIEPLPNAMFKVELENGHTVLAHVSGKIRMHFIRILPGDKVTVELSPYDLTRGRITYRFK

SEQ ID NO: 1237 - protein, 366 aa, Guillardia theta
AAGAYAFTGPAPVALRHGRAGALSQRLSMAATIPKVPFSGVSPTGPSGPTLPAPGEDLEFLEAKPYWDQSGVQVNIAKQKNPLIGKIISVQRIVGPNSPGETCNIIIDHQGKLPYWEGQSYGVVPPGIDPKKNKPYGVRLYSIASTRYGDDKTGKTTTLCVRRATYWCPELKAEDPAKKGVCSNYLCDSKPGDEISLTGPSGKVMLMPEDDPNMTYIMVATGTGIAPFRSFLRRLFGEGNPAGKNFKGLAWLFLGVANKDSLLYDEEFQVYLRQNPDKMRLDYALSREGPLNKKGGKMYIQDKVEEYADEVFDALDKGAHIYFCGLKGMMPGIQDMLRGVCESKGLNFEEYLEGLKKKGQWHVEVY

SEQ ID NO: 1238 - protein, 641 aa, Unknown
  Rhodococcus sp. RHA1
MCGLLGLLTSGETSDNAVSQVDQAMHCLRHRGPDEHGTWHDDHLVFGFNRLSIIDIEHSHQPLRWGPAENPERYALTFNGEIYNYLEVRAELAEQFGAQFVTEGDSESIVAAFHYWGEDAVRRLRGMFAFAIWDTETRELFIARDPFGIKPLFLATGTGGTAFGSEKKSLLELASLIGIGTELDPRAVEHYTVLQYVPEPETLHKQIRRLESGCFARVRPGEEPVITRYFAPTFPVRPFAAGTDQARYREIAEALEDSVAKHMRADVTVGSFLSGGIDSTAIAALAMRHNPNLITFTTGFEREGYSEVDVAAESAEAIGARHVVKVVSPSEFAAAIPEIVWYLDDPVADPALVPLWFVAKEARKHVKVVLSGEGADELFGGYTIYREPISLKPFEYLPKGLRRAAGKLSERIPEGTRGKSLLNRGSLTLEERYYGNARSFNDAQLRAVLRDFRPEWTHRDVTDPIYAQSQGWDPVARMQHLDLFTWLRGDILVKADKMTMANSLELRVPFLDPEVFKVASQVPLDQKITKSTTKYALRQALEGIVPGHVLHRAKLGFPVPLRHWLRGTELFDWAHEQIAASGTDHLLDKAAITKMLNDHRDGVSDHSRRLWTVLIFMVWHGIFVENRIVPEIAEPAYPVSL

SEQ ID NO: 1239 - protein, 385 aa, Magnaporthe grisea
MGKSSKDKRDAYYRLAKEQGWRARSAFKLLQLDEGSWSQVLSRVLIKGEKFGRTAWQDDEAKFRRQMLHIFDGQGQEPVVDGQGDPSVTDAELKPRKDVKIVSIDLQPISPLPGIVTLRADITHPATVPLLLKALDPGYDPKTMSQQASHPVDLVLSDGAPDVTGLHDLDIYVQSQLLFAALNLALCVLKPGGKFVAKIFRGRNVDVLYAQLKVFFEKVIVAKPRSSRASSVEAFIVCLNFQPPAGFKASLDEPLGVGYRLPQMVQSREQSAPIIADTLMQDWSSGTWSQSPGAKTGAAPGQQSKLIEVELEDLTPKEPKQDVRWIAPFIACGDLSSYDSDASYQLPENHVSLDPVQPPTAPPYKRALEMRKLAGGAYGKTGVKA

SEQ ID NO: 1240 - protein, 569 aa, Solanum lycopersicum
MKRELNDVYYGGNKEDVHGFENINMVPTDFDPMDDTDIWLNGNFSNDFTSLQDFPCMSSSSSTSNSLPTEQSDPSSGWAVQKSDADEQDFDTISDQECLNVMDLIDGDHEFLDPMISFFNQQQKEQANEEQVSIFQGDSELALMFLDWLKQNKDNISAEDMRSIKLKRSTIESASKRLGSTKEGKKQLLRLILDWVEQHRLQKKQMREEQSIQNSAPFNFNNPNACFYNASFTDSSSVMTGPIQGYFVPPYNQTMSGSSTSQSWSQSQFIMANASQYNRFPENNITNNVAIPDQPLFSAQYDQYQIFDGSGERLARLGTCATKEARKIRMARQRRVPLHHYRHQTQNQRQISNEKSVMMGRKINNCAISQANNPGNWVYWPCAAAAPPIAMVPLADTPQSLPMERSPVQSQKHQKNGSTDKRQACKTEKNLKFLMQKVLKQSDVGHLGRIVLPKKEAESHLPQLETRDGISIAMEDIGTCRVWNMKYRFWPNNKSRMYLLENTGDFVVANGLQEGDFIVIYADIKCGKYLIRGVKVRPNGAKSDGMQPAKKIVRKIAAVASSPFAQAVG

SEQ ID NO: 1241 - protein, 468 aa, Escherichia coli
MSKQQIGVVGMAVMGRNLAPNIESRGYTVSIFNRSREKTEEVIAENPGKKLVPYYTVKEFVESLETPRRILLMVKAGAGTDAAIDSLKPYLDKGDIIIDSGNTFFQDTIRRNRELSAEGFNFIGTGVSGGEEGALKGPSIMPGGQKEAYELVAPILTKIAAVAEDGEPCVTYIGADGAGHYVKMVHNGIEYGDMQLIAEAYSLLKGGLNLTNEELAQIFTEWNNGELSSYLIDITKDIFTKKDEDGNYLVDVILDEAANKGTGKWTSQSALDLGEPLSLITESVFARYISSLKDQRVAASKVLSGPQAQPAGDKAEFIEKVRRALYLGKIVSYAQGFSQLRAASEEYNWDLNYGEIAKIFRAGCIIRAQFLQKITDAYAENPQIANLLLAPYFKQIADDYQQALRDVVAYAVQNGIPVPTFAAAVAYYDSYRAAVLPANLIQAQRDYFGAHTYKRIDKEGVFHTEWLD

SEQ ID NO: 1242 - protein, 328 aa, Ostreococcus tauri
MDGRVNADVASRRLERSLAMGKSSKDKRDIYYRKAKEEGWRARSAFKLLQIDESFDIFRGVKHAVDLCAAPGSWSQVLSRKLYLPAVRAGVSESELPKIVAIDLQPMAPIEGVTTIQGDITSLDKVLEVLSHFDGKQADLIVGDGAPDVTGLHDLDEFMQAQLILAGLTVATHILKPGGTFIAKIFRGKDVSLLYSQLKIFFPDVTCAKPKSSRNSSIGRIESPCSLERIETDVDALFLVRRGFHRVSRIRPARGVRTASSHAYFRSSSYVSYRRRGGWNRGDDVVAEQRLGAIFGSYALDDTKTRLGPVQPPTTPAYKSAIELLKRK

SEQ ID NO: 1243 - protein, 380 aa, Bacillus subtilis
MKKQCVAMLLAGGKGSRLSGLTKNMAKPAVSFGGKYRIIDFTLSNCSNSGIDTVGILTQYQPLELNSYIGIGSAWDLDRYNGGVTVLPPYAESSEVKWYKGTASSIYENLNYLNQYDPEYVLILSGDHIYKMDYGKMLDYHIEKKADVTISVIEVGWEEASRFGIMKANPDGTITHFDEKPKFPKSNLASMGIYIFNWPLLKQYLEMDDQNPYSSHDFGKDIIPLLLEEKKKLSAYPFKGYWKDVGTVQSLWEANMDLLKEDSELKLFERKWKIYSVNPNQPPQFISSDAQVQDSLVNEGCVVYGNVSHSVLFQGVTVGKHTTVTSSVIMPDVTIGEHVVIENAIVPNGMVLPDGAVIRSEKDIEEVLLVSEEFVEKELI

SEQ ID NO: 1244 - protein, 468 aa, Escherichia coli
MSKQQIGVVGMAVMGRNLALNIESRGYTVSIFNRSREKTEEVIAENPGKKLVPYYTVKEFVESLETPRRILLMVKAGAGTDAAIDSLKPYLDKGDIIIDGGNTFFQDTIRRNRELSAEGFNFIGTGVSGGEEGALKGPSIMPGGQKEAYELVAPILTKIAAVAEDGEPCVTYIGADGAGHYVKMVHNGIEYGDMQLIAEAYSLLKGGLNLTNEELAQIFTEWNNGELSSYLIDITKDIFTKKDEDGNYLVDVILDEAANKGTGKWTSQSALDLGEPLSLITESVFARYISSLKDQRVAASKVLSGPQAQPAGDKAEFIEKVRRALYLGKIVSYAQGFSQLRAASEEYNWDLNYGEIAKIFRAGCIIRAQFLQKITDAYAENPQIANLLLAPYFKQIADDYQQALRDVVAYAVQNGIPVPTFAAAVAYYDSYRAAVLPANLIQAQRDYFGAHTYKRVDKEGVFHTEWLD

SEQ ID NO: 1245 - protein, 532 aa, Oryza sativa
MAAAAARSGAHPPSFASSLGRCRVLPVVVVRRPGGAARPSPLLAPARCAAAVGTAAPKVEGGGRRSSEQGQLAVAPARLVDELVEEALVWSSQHGLVVGDKNHPVKCCPILIDPTGNSQLNHTDYRSGKAPGVGLLHAPFALLPMSFSKVYWDQAVELAPLFNELVDRVSLDGDFLQETLASFSLSFSRTKEVDSFTGRLLDIHAKMMKLNKKEDVRLGLTRSDYMIDGATDQLLQVELNTISTSSNGLACGVCELHRNLIRQHERELGLDPESVVGNTAIAQHAEALAGAWAEFNNQRFSVVLVVVQPEERDGLPVAVVYFRAGYTPNDYPSEAEWRARLLIECSSAIKCPSIAHHLVGTKKIQQELAKENVLERFLDNKADIEKVRKCFAGLWSLENDSIVMSAIESPELFVLKPQREGGGNNIYGDNLRETLISLKKDGSNELAAYILMQRIFPPASLCYLVRDGTCIRENAVSEFGIFGAYLRNKDRVIINDQCGYLMRTKAASLNEGGVTRDAGREFAVKDRESAWG

SEQ ID NO: 1246 - protein, 313 aa, Glycine max
MSTFMLKIFLLISIFQISFATRRLNELVQDQTQLLRYHNGPLLSGKISINLIWYGHFKPSQKAIVSDFITSLSPSSPHSTQPSVATWWKTTEKYYHHLSNTKKTSPLSIPLNKQILDENYSLGKSLTSKHLIQLASKGDHKNAINVVLTSADVAVEGFCTSRCGTHGSSSAGHAKNKNYKFAYIWVGNSEAQCPGQCAWPFHQPIYGPQSPPLVAPNNDVGIDGMVINLASLLAGTVTNPFGNGFYQGPAEAPLEAATACPGVYGKGAYPGYAGNLNVDSSTGASYNAHGANGRKYLLPALYDPATSSCSTLV

SEQ ID NO: 1247 - protein, 344 aa, Hyoscyamus niger
MATFVSNWSTKSVSESFIAPLQKRAEKDVPVGNDVPIIDLQQHHHLLVQQITKACQDFGLFQVINHGFPEELMLETMEVCKEFFALPAEEKEKFKPKGEAAKFELPLEQKAKLYVEGEQLSNEEFLYWKDTLAHGCHPLDQDLVNSWPEKPAKYREVVAKYSVEVRKLTMRMLDYICEGLGLKLGYFDNELSQIQMMLTNYYPPCPDPSSTLGSGGHYDGNLITLLQQDLPGLQQLIVKDATWIAVQPIPTAFVVNLGLTLKVITNEKFEGSIHRVVTDPTRDRVSIATLIGPDYSCTIEPAKELLNQDNPPLYKPYSYSEFADIYLSDKSDYDSGVKPYKINV

SEQ ID NO: 1248 - protein, 421 aa, Azoarcus evansii
MDRAIEHTKYLIAGSSHAALEAINAIRMHDAEGPITVVTRDAHLPYSPTVLPYVVSGKSAPERIFLRDDDFFARNKVAYRPKAALKALHADRNTAELADGSSVVYEKLLLATGASPAIPPIPGIDTVSYHVLRTLDDALKLRGAIAESKQAVVLGAGLVGMHAAENLVKAGATVTIVEMSEQLTSGYFDKVAADMIEQAFRDAGGKIMTGSRVVRLEPTAAGAKLTLENGTTLEADLLLVATGVKPEMDYLNGSGVEHAQGILVDDRMQTTAENVWAAATAQARGFFTGTKVMNAILPDATIQGRVAGMAMAGDPGVKDYAGAVPLNTYHFFGRHAISVGSSTVPEGGEVVTRFDEKTGRYLKAIFAADGPLTGIFGVNEFFDGGVMAQLILRRTDLTPLRSRFVANPLAVGREIMSQTWR

SEQ ID NO: 1249 - protein, 510 aa, Rhodopirellula baltica
MNSELALSETTPGFVALVGAGPGHPGLLTLRGRECLQDCEVVLYDGLSNVEMLVHAPQAVHQCVGKHGQSRIWKQDEIIAEMIRHAKEGKRVVRLKGGDPAVFARTSEEVNALKAERIPFEIVPGITAALAAGSYAGIPITHRGIASAVALVTGHEEPGKAKSDLDWPALARFPGTLVIYMGVTTAKQWTDALIGSGKDPKTPCAILRRCSLPDQQKIQCRLDEVAGHLTPASKFRPPVITIVGEVTGLAESMDWFSRRPLSGKNVLVTRPKDQANQLAKPLEELGANVIVQPAIKICPPDDWSEVDAAIDQIETFDSLVFTSRNGVKSFLDRLLDVGRDMRCLGGLKIAVVGDATANVLATYHLRADWIPESFDADALLTTLQNAEPPLKSTLVVRTQRGRDVVTDGLRASGTQVREVVAYENWDVPEMDPATRGKIDEQPLDWITLTSPATARNVHRWLGDFIGETRIAVISPLTAQTVRELGWRVDAVAASATMQSLTQAILDAETT

SEQ ID NO: 1250 - protein, 1111 aa, Geobacter sulfurreducens
MARRTPLSDDTPLWYRDAVIYQLHVKAFADSDGDGVGDFRGLMGKLDYLQSLGITAIWILPFYPSPLRDDGYDIADYYNVNPSYNTLREFREFLREAHARRIRVITELVLNHTSDQHPWFQRARRAKPGSVHRDYYVWSDTPDRYRETRIIFQDFETSNWSWDPVAKAYYWHRFYSHQPDLNFDNPRVQSEVLRIIDYWLGMGVDGVRLDAVPYLFEREGTNCENLPETHDFLKRLRGHMDASFPNRMLLGEANQWPEDAVAYFGEGDECNMLFHFPLMPRMYMAIEMEDRFPVVDILDQTPAIPEGCQWAIFLRNHDELTLEMVTDEERDYMYRIYASDPKARINLGIRRRLAPLLGKDRRRIELMNALLFSLPGTPVIYYGDEIGMGDNYYLGDRNGVRTPMQWSPDRNAGFSGANPQRLFLPVIIDPEYHYEAVNVDIQERNPTSLLWWMRRIIAVRRRYRAFSRGAMEMLYPANHKVLAFLRRHEDEVILVVVNLSRFAQAINLDLQEFAGISPEDLFSRNRFPVIREATYPLTLGPHDHFWFLLRRREAPLQAEEELPRIRLRGELPWWETLRQTRGDAHLERVTTDYLKRSGWFRGKARAIIGYVLRDTVLLRQGERVFPIFFLEVRYQDGPPETYLIPVAFLTGAGAKRVSAESPRAAIAALSVGDEEGILCDAVHDREFRDALLALALGRRRLHGEENSLIVPVHAGAGRIGSREEMRHLASELPKAEQTNSIITYGDRHVLKLYRKVEPGINSEVEMARFLTAKSSYPNVAPFQGSLELRHPGVEPGAIGLLQGYVQNQGDGWRLSLHLLGQYFERILSCRGELPPPPSRFSSLMDGSACTVPEPAAELIGGFYLEMAGLLGRRTAELHLALAAGGNDPAWRPEEYSTLYQRSVYQSMRNQARRSLQLLAQHHKDLPAEALASADRILSAEKELLACLRPIVGRRIQAMKSRIHGNFRLEKVLFTGKDFMIIDLEGEPDRPLGERRIKRSPLRDVAGMIRSFHNATLTALARHGAGHPGDIPLLEPWAEACWYHVSCRYLAGYLEQMGTSPLVPTERSDLETLLRSFLLDNALHELGYALANRPERVSSYLRGVETVLREFR

SEQ ID NO: 1251 - protein, 450 aa, Desulfovibrio desulfuricans
MQHHDIPGAAPQPIDKLLAPFRRFFAIEASSGILLMAATVLALVWANSGFSASYHALWSNKVTVGFGDYALSKALILWINDGLMAIFFFVVGLEIKREILAGELASPRQAALPIAAAIGGMLVPAGIYLALNGGTAAASGWGVPMATDIAFALGILSLLGDRVPLSLKVFLTAVAIVDDLGAILVIAFFYTANLSFSFLMLGFAAFAVMLLLNWLGVRRVTPYLLVGLVLWFALLKSGVHATIAGVLGAMAIPARSALAPAVLRGTARQALSVFENALQGDTPVLASQDKSHAIHHVEMLTEKAGTPLQRLEHALHPWVAWFIMPVFALANAGVTVSAEMVSMLFEPLSLGIFFGLLLGKQGGVTLAVWLLVKTGIAKLPKGVGLGMYYGIGWLAGIGFTMAIFIATLAFEDPAHIEAAKMSILCASFVAGFGGYMLMRVLLRGREPEKA

SEQ ID NO: 1252 - protein, 182 aa, Magnetospirillum magnetotacticum
MARRGWTVADIPSQAGRRAVVTGASAGLGYETALALAGAGAAVVLAVRDAAKGARAAEAIARAHPGADLAVRLIDTASLASVRAFAADWPARQPIDRLILNAGIAAVPSREESVDGFERQLATNTLGHVALTGLLLPVLSPTAGSSRWRASPIAAAGSASTTSTGARVTGRRPPTVRASSRS

SEQ ID NO: 1253 - protein, 320 aa, Unknown
  Silicibacter sp. TM1040
MSVAVLGAGAFGTALAISLARKAPTTLWCRSKDHADEIRSTRENTRRLPGAPLPDALAVTSDIACLGAHDVILLAVPMQKMRGFLTAHHAALSGKTLVACCKGIELDSGLGPVAVLRDTVPDATAALLTGPSFAADIALGLPTALTLACDPDETGKALQATLSTDNLRLYRTTDLTGAEIGGALKNVIAIACGAVIGARLGDSARAALMTRGYAEMQRLALARGARPETLAGLSGFGDLTLTCGSELSRNFRLGLSLGRGEAFDPSITVEGAATARATAKTAQEMGLEMPITQTVTNLLDQRLTISDAADQLLKRPLKEE

SEQ ID NO: 1254 - protein, 347 aa, Datura metel
MATLVSNWSTNNVSESFIAPLEKRAEKDVALGNDVPIIDLQQDHLLIVQQITKACQDFGLFQVINHGVPEKLMVEAMEVYKEFFALPAEEKEKFQPKGEPAKFELPLEQKAKLYVEGERRCNEEFLYWKDTLAHGCYPLHEELLNSWPEKPPTYRDVIAKYSVEVRKLTMRILDYICEGLGLKLGYFDNELTQIQMLLANYYPSCPDPSTTIGSGGHYDGNLITLLQQDLVGLQQLIVKDDKWIAVEPIPTAFVVNLGLTLKVMSNEKFEGSIHRVVTHPIRNRISIGTLIGPDYSCTIEPIKELISQENPPLYKPYPYAEFAEIYLSDKSDYDAGVKPYKINQFPN

SEQ ID NO: 1255 - protein, 141 aa, Aspergillus nidulans
MARTKQTARKSSLCKSTGGKAPRKQLASKAARKAAPSTGGVKKPHRYKPGTVALREIRRYQKSTELLIRKLPFQRLVREIAQDFKSDLRFQSSAIGALQESVEAYLVSLFEDTNLCAIHAKRVTIQSKDIQLARRLRGERS

SEQ ID NO: 1256 - protein, 443 aa, Aquifex aeolicus
MTAVSQEIMNYIEEKVNRARSVLRELTSLKTSVKNETLLKVAELIDKNRDYIKEENRKDVEKAKEMGLRPAVVDRLVLNDKRIDGMVKVLKDVASLPDPVGEIIKMWNLPNGLKVGRMRVPLGVIFIVYESRPNVTIEASSLCMKSSNAVILRGGKEAINSNKALVNLIKEACRETGFPEDAVQFIDRSEREIVWEILKMEGKIDVAIPRGGESLIRAVVEHAKVPVIKHYKGVCNIYVDDEADLEKAYHIVYNAKVQRPSVCNAVENLVINRKILKEFFPKMAYYLGKAGVELRCDEESLQVIKENPKLSFVNAKPATEEDYYEEFLDLILAVKVVDDVDEAIAFIEKYGSKHSDAIITENYTKAMKFLREVDSAAVYVNASTRFTDGNEFGLGAEMGISTDKIHARGPMALEELTIPKFVILGEGQVRDNFGVPEEWMKEF

SEQ ID NO: 1257 - protein, 473 aa, Bordetella pertussis
MTLFPIFADLTGRRVLVVGGGAVAVRKTQALLQAGAEVVVGAPRLDPALAALAEQGGIARLDGGFEPAWLAGAWLVVAATDDRAVNAAVSEAARARRVFCNVVDDAELSSFQVPSVVDRSPLIVAISSSGVAPVLARRLRERIESLFDHSLGQLAALAARYRPRIRAARPDLGQRRRFYDWLLDGPVAARLRQQQPGLAEQELEQALRAPQAAPRGSVVLVGAGPGDPGLLTLKALRALNEADIILYDRLVSEGVLALARRDAERVPVGKLPGKGHDATQARIHALMLAQARAGRRVVRLKGGDAFIFGRGGEELEYLRAHGVPYEVVPGITAALACAAYAGMPLTHRDHAQSVRMVTAHCRADQDTLDWAGLARDQQTLAFYMGVGQLDYVTARLLEHGRAPATPFALIENGSRPEQRVVTGTLADLPEIARRRGVRPPALLVIGEVAALADTLQWFGQHQRGLPGPQALAA

SEQ ID NO: 1258 - protein, 272 aa, Corynebacterium glutamicum
MAVVTMRELLDAGVHFGHQTRRWNPKMRRFIFTERNGIYIIDLQQTLTYIDQAFEFVKETVAHGGTVLFVGTKKQAQEAVQVEADRVGMPYVNHRWLGGMLTNFQTVSKRLNRMKELQAMDAAENGYEGRTKREVLMLTRERTKLERVLGGIAEMTRVPSALWIIDTNKEHIAVAEAHKLNIPVVAILDTNCDPDVVDFPVPGNDDAIRSTALLSRVISTAVEEGKKAREERQLAAAKDAAGDAKPEAEEAPAAAEAEEAPAAEAEEAPAAE

SEQ ID NO: 1259 - protein, 152 aa, Escherichia coli [sequence omitted]

SEQ ID NO: 1260 - protein, 551 aa, Gibberella zeae
METNWKPFMKSTADDWTSIPDPAQRKRIQNRLSQRARRMRQKKAITQSDSGSVTTDASSAGDAMPSPDQGQSFAQHDLNTVVVDTLGTSPLADSHFIILADMTACAALAVIAECLNLDCQPRPGFHIKALFLELPSAIAPTDLQKLVPHKPYLDMLPWASLRDKLLQSVSVINEDEFMADMRSGNLRVWGQVPWDPMGWEVTPDFARRWWFLMDAGIHLAPRSATMSATFTQLFPSKPAYKEEHIPSLNAKVFLVTGGTNGVGLELVNILYSKGGTVYIPCRSETKAAKTIKTIQTSHPDSPGQLKYLPLDLNDLTSVAACASAFLEQETRLDVLWNNAGISYAPPDEVTVQGYEPHMGINCLAPFLLTKLLLPVLKRTASISSEPSTRVIFVASGMVDSSPLGGIPLEELHPGKPSRDLARNYTISKTGNWFLASEFDRRMRTDGIIFIAQNPGNLLTNIWERVPWFLKAPIRILLHPPIKGAYSELWAGLSTEIKLEDGGRYGVPWGKWHPGPRKDLLLSLKTKDDGGSGVAVAFWDWCEKETASFVKD

SEQ ID NO: 1261 - protein, 582 aa, Triticum aestivum
MDTHIGSVDGPSPAAVNGAVGCPASAPGCPIMSSHPVVFAVPGDFNLTLLDHLVDEPGLRLVGCCNELNAGYAADGYARARGVGACAVTFTVGGLSVLNAIAGAYSENLPVICIAGGPNSNDYGTNRILHHTIGIPDFSQELRCFQTVTCHQAVVTNLDDAHEQIDTAIATALRESKPVYLSISCNLPGLPHPTFTRDPVPFFLAPRMSNKMGLEAAVEATVEFLNKAVKPVLVAGPKLRVAKAGKAFVDLVDASGYAYAIMPSAKGFVPETHPHFLGTYWGAVSTAFCAEIVESADAYLFAGPIFNDYSSVGYSFLLKKDKAIIVQPERVIVGNGPAFGCVMMKEYLSALAKRVQKNNTAYENYKRIFVPEGHPLKGEANEPLRVNVLFKHIQDMLTGDSAVLAETGDSWFNCQKLKLPEGCGYEFQMQYGSIGWSVGALLGYAQGASDKRVIACIGDGSFQVTAQDVSTMLRCEQNSIIFLINNGGYTIEVEIHDGPYNVIKNWNYTALVEAIHNGEGKCWTAKVKCEEELTAAIETALGEKKDSLCFIEVIAHKDDTSKELLEWGSRVSAANSRPPNPQ

SEQ ID NO: 1262 - protein, 294 aa, Oryza sativa
MMGYVDFGSRLRDSGGELPNWGRWWLLTWCGRWIPTVYWVISLLLLLLGVAGVRLVDWGAAGCSLQLQMVDSSEGLRRLAALLFKCCSLDSSNRPNGLQDPERLARETVFNVNEIEALYELFKKISSAVVDDGLINKEEFQLALFKTNRKDSMFADRVFDLFDTKHNGILGFEEFARALSVFHPNAPIDDKIDFAFKLYDLKQQGFIEKQEVKQMVVATLAESGMNLSDEIIEGIIDKTFEEADTKHDGKIDKEEWRNLVLRHPSLLKNMTLPYLRDITTTFPSFVFNSQVEDA

SEQ ID NO: 1263 - protein, 293 aa, Kineococcus radiotolerans
MNPTAGRGGGRVAGAHVLATLQRLGHRVTDLTGSDLAASSRAARERAGELDALVVVGGDGLVHAALGAVAGTPTALGIVPAGTGNDLARGLGLPLGDPARAAGLVSSALREGRHRAVDAVRVRGAARSSWYGSVLASGVDALVNERANSWRWPRGPARYTLAALRELAVVSGVGMRITLDGEVQERDCLLVAVANTPCYGGGMRMAPHADPTDGLLDVVVVDAMPRLAALRLLPRVRRGAHLDVAAVHVHRARSVTLEALPGGREPHPHADGEPLEHLPLTCDVVPGALRVLA

SEQ ID NO: 1264 - protein, 330 aa, Thermococcus kodakarensis
MFSLGGFSRGGEYEKKTWDVLIIGAGPAGFTAAIYAARYGLETLIISKDLGGNMALTDLIENYPGFPEGISGSELTNRMHEQVKKLGVDVIFDEVVRIDPAECAYYEGPCKFTVKTANGKEYKARTIIIAVGAAPRKLRVPGEEELTGKGVSYCATCDGPLFKGKKVIVVGGGNTALQEALYLKSIGVDVTLVHRRQQFRADKILQDRFKESGIPAILDTVVTEIIGKDKVEAVRLKNVKTGEETVMEVDGVFIFIGYEPKTDFVKHLGITDEYGYIPVDMYMRTKVPGIFAAGDITNVFKQIAVAVGQGAIAANSAKEFLEEWKNKNSE

SEQ ID NO: 1265 - protein, 801 aa, Chlamydomonas reinhardtii
MTNPANQPPPFLIKTYDLVDDPSTDNIVSWGADGHSFIVWKPPEFARDLLPKHFKHNNFSSFVRQLNTYGFRKVDPDRWEFANEHFVRGKKEQLRDIHRRKPSATHNATGTGGGASGAAAGAAAATPGAPVPSNALVAAGQTAPAIEIGAYGGFREEIDNLKRDKNVLMVELVRLRQQQATADAKIRDLTGRLENTEAKQQTMINMFAAAFKNPAMFQRMLSTMASSGVQRLTAAPAYSGGAGAAGGRRKRRARGETSVTDIGEDIAGTGVGITEAIDADMLETGGANHMAVNGVHGAAGSPPSHGHGADDTSSNGSATDATGAANGYGHQLVAYNPAVAAAAAAAGAAGGSSAAAVSGGAASTDALSEMMMRSFQSLLSGAEDMTGDVTGALNSLAIGQGGGVGGGGAHVGHALGAHMVPSAAAPHVTIQEQPSTSAAAAAAAAAGGGTPTTSSVVLMGSSAPGVVVNSTGGAVVDPTSGAAGLISTAIQPYQGPAALPGLPQGVAVGGVTGLSGLGPGTTLLAPGAMATAPHAPGAHPTPSAFVITKPEPMLGGAPGPVLPVGTPGMVPVQPSTGPGSSAAMTASALPTSAFAALAGVPAVPMPVPAVPMAGAAGPSVPIPMPGSAAATPVPMVPVVMSPPPPGHTMIPIQTATMAPPTQAMGAAGLRVPSGLPAINNMALTPAAAAAAAAAAAAAAMPGSGGLFDATPTSAAGLPVNDNPTVTSPPADADGVDGMLGGLSGLDLMTSLPSGELVLPSDGDFGDDVWAQIMSAASAQAPDAAGGLGGLDLNPVSAALEH

SEQ ID NO: 1266 - protein, 181 aa, Thermus thermophilus
MKGMFTPGNGPVQISAEAIKKRVEELGREIARDYQGKTPHLICVLNGAFIFMADLVRAIPLPLTMDFIAISSYGNAFKSSGEVELLKDLRLPIHGRDVIVVEDIVDTGLTLSYLLDYLEARKPASVRVAALLSKPSRRQVEVPIHYLGFEIEDAYVYGYGLDRAQFDRNLPFITSIRPEEE

SEQ ID NO: 1267 - protein, 468 aa, Escherichia coli
MSKQQIGVVGMAVMGRNLALNIESRGYTVSIFNRPREKTEEVIAENPGKKLVPYYTVKEFVESLETPRRILLMVKAGAGTDAAIDSLRPYLDKGDIIIDGGNTFFQDTIRRNRELSAEGFNFIGTGVSGGEEGALKGPSIMPGGQKEAYELVAPILTKIAAVAEDGEPCVTYIGADGAGHYVKMVHNGIEYGDMQLIAEAYSLLKGGLNLTNEELAQTFTEWNNGELSSYLIDITKDIFTKKDEDGNYLVDVILDEAANKGTGKWTSQSALDLGEPLSLITESVFARYISSLKDQRVAASKVLSGPQAQPAGDKAEFIEKVRRALYLGKIVSYAQGFSQLRAASEEFNWDLNYGEIAKIFRAGCIIRAQFLQKITDAYAENPQIANLLLAPYFKQIADDYQQALRDVVAYAVQNGIPVPTFAAAVAYYDSYRAAVLPANLIQAQRDYFGAHTYKRIDKEGVFHTEWLD

SEQ ID NO: 1268 - protein, 363 aa, Geobacter sulfurreducens
MARKVGILTGGGDCPGLNAVIRGVVKSSIIRRGWEVVGIRDGFDGLLYNNRIVPLGLNEVRGILPRGGTILGTSNRGNPFSYPVEADGKTVLTDVSDEVVANIKKQGIDALVAVGGDGSLKIALELMNKGIPVVGVPKTIDNDLMETDVTFGYNTALETATDALDKLHSTAESHHRVMIMEVMGRYAGWIALESGISGGADVILIPEIPYDISAVCRAVDERRRRGSSFSIIVVAEGAFPRGGNRVVQKRADETNTIERLGGIGQYVARQLGDCLDMDVRVMVLGHLQRGGSPSTFDRCLGSRFGVAAIDLIEQEQYGRMVCLRGRDIKSVSIERAVRKLKLVNPGGQMVTAAEELGIVVGRR

SEQ ID NO: 1269 - protein, 153 aa, Mesembryanthemum crystallinum
PPIIFNAGFQVKKKQFFKNFSFILMFGVLGTIISFCLISSGAVLLLKKIGLTQLNLNDYLALGAIFSATDSVCTLQVLNQDETPLLYSIVFGEGVVNDATSIVLFNAVQSLDLSNLSSMTALALLGTFLYLFFTSTILGILVGLLSAYVIKKL

SEQ ID NO: 1270 - protein, 468 aa, Escherichia coli
MSKQQIGVVGMAVMGRNLALNIESRGYTVSIFNRSREKTEEVIAENPGKKLVPYYTVKEFVESLETPRRILLMVKAGAGTDAAIDSLKPYLDKGDIIIDGGNTFFLDTIRRNRELSAEGFNFIGTGVSGGEGGALKGPSIMPGGQKEAYELVAPILTKIAAVAEDGEPCVTYIGADGAGHYVEMVHNGIEYGDMQLIAEAYSLLKGGLNLSNEELAQTFTEWNNGELSSYLIDITKDIFTKKDEDGNYLVDVILDEAANKGTGKWTSQSALDLGEPLSLITESVFARYISSLKDQRVAASKVLTGPKAQPAGDKAEFIEKVRRALYLGKIVSYAQGFSQLRAASEEYNWDLNYGEIAKIFRAGCIIRAQFLQKITDAYAENPQIANLLLAPYFKQIADDYQQALRDVVAYAVQNGIPVPTFAAAVAYYDSYRAAVLPANLIQAQRDYFGAHTYKRIDKEGVFHTEWLD

SEQ ID NO: 1271 - protein, 708 aa, Vibrio angustum
MNPIVKTFQYGNHTVTLETGVMARQATAAVMVSMDDTSVFVSVVGKKTAVEGQDFFPLTVNYQERTYAAGKIPGGFFKREGRPSEGETLTARLIDRPIRPLFPDDFKNEVQVIATVVSVNPAVSPDIVTMIGTSAALAISGIPFNGPIGAARVGYINDQFVLNPSNVELEESRLDLVVAGTKDAVLMVESEADRLSEEQMLQAVVFGHDQQQVAINAINEFAAEVATPAWDWVAPQENTALKNKIAELAEAKLVDAYQITEKMARYDRIHEIAGEVNDAILAEDAEANSKEIHTIFHDLEKTVVRGRIIAGNPRIDGREKDMVRALDVRTGVLPRTHGSSLFTRGETQALVTATLGTQRDAQIIDGLTGETKDHFLLHYNFPPYCVGETGFVGSPKRREIGHGKLAKRGIAAVMPSVDEFPYTVRVVSEITESNGSSSMASVCGTSLALMDAGVPIKASVAGIAMGLVKEGDDFVVLSDILGDEDHLGDMDFKVAGTDDGITALQMDIKIEGITKEIMQIALNQAKGARKHILSVMDNAINTPREDISEFAPRIHTMKINPEKIKDVIGKGGAVIRALTEETGTTIEIEDDGTVKIAATEGTAAKEAIRRIEEITADVEVGRIYTGKVMRIVDFGAFVSVIGTKEGLVHISQISQDRVEKVSDYLQMGQEVQVKVLEIDRQGRIRLSMKEAVETPAAEAPAQNEQPQG

SEQ ID NO: 1272 - protein, 936 aa, Ruminococcus albus
MGKGKFLKRSLAGLSAAAMMFTGNTAATVTAAVIDKENPNNYHHYAEALQLALCFYDANKCGDEVADDGYYSWRANCHVKDGYIPLQPMSPMPEIGKGKTDDQLQEDQGLGAGDDGKTKPNLGDTDPSLYAGVNMSQNFIDKNKKYLDPDGDGTLDLTGGWHDAGDHVKFGLPGSYSASTVGWGYYEFRDSYKELGLDKHVEDELHWINDYFMKVTFMDDDDNVIAYCYQVGEGNNDHNYWCPPELQVEDTMVASSSCAVKRPAYFATEEMPASDQCAGAAASLAINYLNFKDTEPEYAKKSLKYAKALYDFAVKTHVEEWKPGEVPSCSSLGYDGGFYTSSYDYDELAWAAVWLYYCTEDYDYINDIIAVDETTTNAKGAHPYTGYMKRIITDTGNCWQNIWVHCWDTVWGGVFAKLAPVTNTARDWYIFRYNLEFWSGCAESVDSSDWGYEPVHGHKYFGMDDYLWNTKMTADQIADLPISETSGDFIAKSPKGWAVVSGYGSARYNTAAGLCACVYAKTTNDQTFLPWARAQMEYILGKNPMGYAYEVGYGNNFASHPHHRSSHCSATQSMDDPITQVHTLWGALVGGPDLKDNHVDETKDYIYNEVTDDYNAGFCGDLAGLYHYYGRKGGIDAKENSIIKNFDMSSNAKGFDQVDENGNPLPVGYFVSGGKAQEKKDGIQLKVVLHNRTVDPPRFECNVKARYFFNIKELLDAGYGIDYITARIDYDQVAGYSNNKSHAELSDPVKYDDKGTYYVDITWKDCKFYGSRVYQFALTTKMDPEKFVYPEWDSSNDYSYSDLVSFEDDNSAAAITDKIALYADGKLIWGSEPDGTTPETFVNDEPTENPSAKILYGDVNCDGKVNMADVTAIYQYGNNKRKYPLTAQGMRNADCVDAGKGLTNDDAKAIKAVVISALKVSDLPISSTALKKVSVK

SEQ ID NO: 1273 - protein, 468 aa, Escherichia coli
MSKQQIGVVGMAVMGRNLALNIESRGYTVSIFNRSREKTEEVIAENPGKKLVPYYTVKEFVESLETPRRILLMVKAGAGTDAAIDSLKPYLDKGDIIIDGGNTFFLDTIRRNRELSAEGFNFIGTGVSGGEEGALKGPSIMPGGQKEAYELVAPILTKIAAVAEDGEPCVTYIGADGAGHYVKMVHNGIEYGDMQLIAEAYSLLKGGLNLSNEELAQTFTEWNNGELSSYLIDITKDIFTKKDEDGNYLVDVILDEAANKGTGKWTSQSALDLGEPLSLITESVFARYISSLKDQRVAASKVLTGPKAQPAGDKAEFIEKVRRALYLGKIVSYAQGFSQLRAASEEYNWDLNYGEIAKIFRAGCIIRAQFLQKITDAYAENPQIANLLLAPYFKQIADDYQQALRDVVAYAVQNGIPVPTFAAAVAYYDSYRAAVLPANLIQAQRDYFGAHTYKRIDKEGVFHTEWLD

SEQ ID NO: 1274 - protein, 353 aa, Unknown
  Frankia sp. CcI3
MSYQAEYIWIDGTEPEPLMRSKTRIIRDGKEPEIWGFDGSSTNQAPGSNSDCVLRPVFVTPDPLRGGDNLLVLCEVELTDFTPHPTNTRAAARTVAEKYADMTPMFGIEQEYTFFKDGRPYGWPEVGYPAPQGPYYCGVGGSKMPGRQIVERHAQACLDAGLAIEGTNAEVMMGQWEFQIGVLPAPAIGDQIWLGRWLLHRIAEDYGVEVSFAAKPIPGDWNGAGAHTNFSTRQTMEGWDAIVACCEALGTRVLEHVTHYGHGIQDRLTGKHETAPWNKFSWGASDRGASIRIPWAVEKAKKGWLEDRRPNANMDPYLVSALMIDTCCSALAGDKPTLFVPSQTTPTPAEATV

SEQ ID NO: 1275 - protein, 157 aa, Griffithsia japonica
MSATKLSDLQGLKDIEGGAIDPSRFAGKVVFAMNVASACGYTKPGYELLKRLTDKFAPADFVAVAIPCNSFLWQESGSAEDVKTFALARADKLLVTEKAAVNGNHPHPIVALAKQAFPGRVMWNFDGRFVFDRNGVPVARFGNSAKPEEIEAAIANA

SEQ ID NO: 1276 - protein, 855 aa, Arabidopsis thaliana
  misc_feature (766)..(766): Xaa can be any naturally occurring amino acid
MAKSSADDEELRRACEAAIEGTKQSIVMSIRVAKSRGVWGKSGKLGRQMAKPRVLALSVKSKGPRKKAFLRVMKYSSGGVLEPAKMYKLKHLSKVEVITNDPSGCTFTLGFDNLRSQSVAPPQWTMRNTDDRNRLLVCILNICKDVLGRLPKVVGIDIVEMALWAKDNTPVVTTQRSTEDGEPVAESVTESDLKVTVEKELVSQAEEEDMEALLGTYVMGIGEAEAFSERLKRELQALEAANVHAILESEPLVDEVLNGLEAATNIVDDMDEWLGIFNIKLRHMREDIESIETRNNKLEMQSVNNKALIEELDKVIERLRVPSEYAASLTGGSFDEADMLQNIEACEWLAKALRGLEVPNLDPIYANMRAVKEKRAELEKLKATFVRRASEFLRNYFASLVDFMVSDKSYFSQRGQLKRPDHADLRYKCRTYARLLQHLKGLDKNCLGPLRKAYCSSLNLLLRREAREFANELRASTKVSRNPTVWLEGSTGSSQNANTDTSAVSDAYAKMLTIFIPLLVDESSFFAHFMCFEVPALAPPGGAGNDKKSQSNNDDGNDDDDLGIMDIDETDKKPGKNSPDLTALNESLQDLLDGIQEDFYAVVDWAYKIDPLRCISMHGITERYLSGQKADAAGFVRLLLGDLESRVSMQFSRFVDEACHQIERNERNVRQMGVLPYIPRFAALATRMEQYIQGQSRDLVDQAYTKFVSIMFVTLEKIAQQDPKYADILLLENYAAFQNSLYDLANVVPTLAKFYHQASEAYEQAXIPFQLGLSKVELRKMLKSSLSGSVDKSIAAMYKKLQKNLASEELLPSLWDKCKKEFLDKYESFVQLVAKVYPSENVPGVTEMRGLLASM

SEQ ID NO: 1277 - protein, 633 aa, Bacillus cereus
MCGFVGCLCENPREFSETEKHQFENMNTMIFHRGPDDEGYFRDEHVQFGFRRLSIIDLEAGHQPLTYENDRYVIIFNGEIYNYVELREMLLEKGATFATQSDTEVIIALYAHMKEKCVDYLRGMFAFMIWDREEKKLFGARDHFGIKPLYIAQQGDTTFFASEKKSIMHVMEDKGVNPTSLQHYFTYQYGPEPETLTIDVNKIEPGHYFVKEIGKEMEIHRYWKPYFNASSATKEEHIQAIRDVLYDSVKVHMRSDVPVGSFLSGGIDSSIIASIAREMNPNLLTFSVGFEQRGYSEVDVAKETAEKLGVKNHNVFISAKEFMDEFPKNHWHMDDPLADPAAVPLYFVAKEARKHVTVVLSGEGADELFGGYNIYREPNSLKMFSYIPSPGKSVLKALSGALKEGFKGKSFLERGCTPIEERYYGNAKIFREEEKAELMKYYNESVNYMDITKPLYNEIKDYDDVSKMQYIDMFTWLRGDILLKADKMTMANSLELRVPFLDKEVFDVASKIPTEFKIANGTTKAILREAARGIVPDHVLDRKKLGFPVPIRHWLKDEMHDWAINIINESKTEHLIDKQYVLNLLEAHCADKGDYSRKIWTVLAFMVWHQIYVEHKYDTNKFHEETKRAYSLV

SEQ ID NO: 1278 - protein, 180 aa, Bacteroides thetaiotaomicron
MKSFILMVITMVCAISLEAQNKSFYDFNVTTIDGKEFPLSSLKGKKVLVVNVASKCGLTPQYAKLQELYDKYKDKNFVIIGFPANNFMGQEPGSNEEIAQFCSLKYDVTFPMMAKISVKGKNMSPLYQWLTEKKLNGKEDAPVQWNFQKFMIDENGNWVGFVAPKESPLSEKIVTWIEQE

SEQ ID NO: 1279 - protein, 119 aa, Brassica napus
MADRVKGPWSEEEDEQLRRMVEKYGPRNWSAISKSIPGRSGKSCRLRWCNQLSPEVEHRPFSPEEDETILSARAKFGNRWATIARLLNGRTDNAVKNHWNSTLKRKFVGGGRDCDLVAV

SEQ ID NO: 1280 - protein, 493 aa, Candida albicans
MLSSTLRRSVRAQSKNLPAFARRTYAVSPSAQALISKSVQDVDPEMADILNQERTRQKNSITLIPSENFTSKAVMDLLGSEMQNKYSEGYPGERYYGGNEIIDKAEALCQKRALEAFGLDPSQWGVNVQPLSGAPANLYAYSAILEVGDRIMGLDLPHGGHLSHGYQTNTTKISYISKYFQTMPYRLNEETGIIDYDTLEKNAQLFRPKVIVAGASAYSRVIDYKRMRQIADKVGAYLLSDMAHISGLVSAGVTDSPFPYSDIVTTTTHKSLRGPRGAMIFFRKGIRKVTKKGKEIPYELERKINFSVFPGHQGGPHNHTISALAVALKQCTEPEYVKYQQEVVSNAKHFADALVSKGFKLVSDGTDTHLILVDLRSRNIDGARVEAVLERANIATNKNTVPGDVSALFPSGLRVGTPAMTTRGFGPEEFDKVAEFIDQAVNIAIELKAQEQGKVPKELLASFKKLADESDKVKQLDKEVVSWVSKYPVPGEL

SEQ ID NO: 1281 - protein, 159 aa, Saccharophagus degradans
MASIYDINIQSLQGQLIGFSDFKGKALLIVNTASKCGFTPQYEGLQQLHQQYASEGLVIIGCPCNQFGKQEPGDAKAISEGCLINYGVDFLITEKIHVNGANTHPLYRYLKTALPGFMGNNIKWNFTKFLIGKDGTPIKRFAPFTKPASMEGAVKKALG

SEQ ID NO: 1282 - protein, 759 aa, Glycine max
MECEVELQGGDLHAGVVTEPNPIGFGTMENEHTLAVAEREMWLNSDQDEFLGVNDASMFYADFPPLPDFPCMSSSSSSSSALPFPVKTMTCSTRTTTTTTTSSSSSSSSWAVLKSDAEEDAEKNHCNRYMHDQLDATLSSTASMEVSQQKNLDPGLGGPVGECMDDVMDTFGYMELLEANDFFDPASIFQNEDNENPLVDFGTLEQHVPLHDEQHEMLHHQQGRTEEVDHQVPVCEEIQGDEEGGDGVGVDDEMSNVFLEWLKSNKDSVSANDLRNVKLKKATLESAARRLGGGKEAMKQLLKLILEWVQTSHLQNKRRKENNGSSISSVLQAQFPDPSGQNNNQNTQSGSFAPESNTCFNNQTPWLSSQTFATDQAPLMVPPQQFQQPMVGYVGDPYTSGAASNNITTSHNHNSNNPYQPGAEQYHMLESAHSWPHSQFNVACHYSQSFGDNNVIFPQGGFGGGYGNNQYPYQFFHGPGDTLMRLGPSATKEARKKRMARQRRFLSHHRHHNGNHQNSGSDPHARLGGGDNCTTGLAAPHHANPTANWMYWQAMTGGAAGPLAPPAEPPAVDRSALQTQNCHQSRVASDRRQGWKPEKNLRFLLQKVLKQSDVGSLGRIVLPKKEAETHLPELEARDGISITMEDIGTSRVWNMRYRYWPNNKSRMYLLENTGDFVRANGLQEGDFIVIYSDVKCGKYMIRGVKVRQQGVKPETKKVGKSQKNQHGTGTNASTTACTAANNGTPSSPKTKAEKSSKLI

SEQ ID NO: 1283 - protein, 230 aa, Robiginitalea biformata
MKNIKRSLLLTAGLILAISCQTKAKKGETAESGRQATAPQMEKEVPQDLSAYETAYFASGCFWCVEAIFESVKGVAEAESGYAGGTEENPTYEQVSYGRTTHAEAVKVYYDPEVVSFFELVQVFFGSHDPTTPNRQGPDRGPQYRSIAFYENDSERQIITAYMEALEEQRVYDRPIVTEVSPLTQFYKAEEYHQDYERKHPDNPYIQNVSVPRLNRFKANFQDFLKEDIH

SEQ ID NO: 1284 - protein, 217 aa, Debaryomyces hansenii
MDQKQSELVEKYQESKLRKQIKDDEVHESESDDDLLELLEDDEAISKYREARIQQLSAEFKRIDDEETERNGSLGSVIEISDEKQIMEIVTNSELTLVHFYQPEFDKCKIMNSRLTVIAEKYLNLKVLTIKAESAPFLVTKLKIKVLPFVVIYKNGKEINRIVGFEKLGNDPNNISIESLEHFLYANGITNRRIVNYGSIQSRTKPINEDSDDGLDV

SEQ ID NO: 1285 - protein, 321 aa, Debaryomyces hansenii
MVHHNVTIIGSGPAAHTAAIYLSRAEIKPTLYEGMLANGTAAGGQLTTTTDVENFPGFPKGINGTELMDQMREQSVRFGTDIITETISKCDLSSRPFKLWTEWNEDSEPITTDAVVIATGASAKRMHLPGEDTYWQQGISACAVCDGAVPIFRNKPLAVVGGGDSACEEALFLTKYGSKVYLLVRRDQLRASNIMQKRVQNNDKLEILWNSEAKEAKGDGKLLQNISVYNNKTKETKDLPVNGLFYAIGHIPATQIFAKQLETDDQNYILTKPGTAETSIPGVFAAGDVQDKRYRQAITSAGTGCMAALDCEKFLSEEEAK

SEQ ID NO: 1286 - protein, 420 aa, Mannheimia succiniciproducens
MLQNHSIAEFDPVLWDAIQNENRRQEEHIELIASENYVTKAVMEAQGSQLTNKYAEGYPGKRYYGGCEYVDIVEQLAIDRAKELFGADYANVQPHSGSQANAAVYGALLNAGDTILGMDLAHGGHLTHGAKVSFSGKIYNSVLYGITAEGLIDYEDVRVKALESKPKMIVAGFSAYSQVVDWAKMREIADEVGAYLFVDMAHVAGLIAAGLYPNPLPHAHVVTTTTHKTLAGPRGGLILSACGDEEIYKKLNSSVFPANQGGPLMHVIAAKAVCFKEALQPEFKAYQAQVLKNAKAMVEVFKQRGFEVVSKGTENHLFLVSFVKQGLTGKAADAALGEANITVNKNSVPNDPQKPFITSGIRVGSPSITRRGFNEADASTLAGWMCDVLESIGKDNYDQVIAETRAKVLEICKRLPVYGD

SEQ ID NO: 1287 - protein, 1533 aa, Magnaporthe grisea
MYPGSSQSRPYQVPPPPPMSPPLSQMHQQMSFVPPPPPPLNRYQTTPNLGASAPPPPPPGPPPASALNPQAPWNGAWGGVPAPRQAYDNRSGMYAQAPIQQYNPQAHAATAPGLNIPPPPLQTDAPMSDTYNPGQDPMFDGFMPDLSFDLEQETMGSSQTWQTTSSSSTNTASVNDNVQSNAPTEERTRRNNSASITGTQSSSNVPGIPSDITASWSLDKVIAWLQMNSFSRDWQETFKSLNIHGAQFLELGSGHFGRGNFGMMHQQVYPKLAKVCTASGTGWDQPREREEGKRMRRLIRGLVHARAVPDSARVPSSHGRQGSINSRGNDKGTHDGSDSPNTPIMKTPSSQSRSTTIPTFPDGSSFSNHRGVLKNIDIDRHSSPKLNGDSPAASPNPVMASSTPKSSTLSVSPHSSRFGNNVRNSTDSVKAIYGSGIPADAQKMMSNSNLDELINGRGARQSPSDLGDNSAGTDSPVSARDTKLPFRQRMQAKDIDGNLSSPNGEGSLSPQMYRNGLGLDDYLRFKKPGGSIYLMATADGWNYRVVDVTDVETVLDLRSEISRGLGIPDEDGVEFYLTELGKSDHSQPLDDNQLMNHNKSRADAEGTLKLFVKPPPMSQQSTWSAGDTGQRHRFGTSSSMSRQQNTLKDDQSEEARLRAQREYKAEIDRKGREYLAIRKAKLESNNNGLSSSTEGIGIVGKPVDFDTPRHSPYEDKNTDRMFPTRNAPAPPVAPSATLNRVNSLMTGQRRVQGSMDGYPSQRVPPGVGTTTSPKEMSEDRRRQPMSGSQPMGGITSALVDMGRNLGGVALPNRGVSANNVPSKPSPPYRVATAPVSGRDFVSPDNRAAFPRSQTAGDLSPISQMPANFAAYQEPNPSPRGFGAAPVSSAAHKRAPSGPDIDFTEPEVSFDRPAPSTAQNEAQSDDDSGDDSDDGLFVIPIAARKASMKKAKSRASVTFDASDSGDGKRPALTVNTARDRKSVSFNSPQSARTGDDDDDSGRQRRTPKSDMWDSEDGKLGRRKSFKMDVWANRPPAEALINNLEDFFPGMDVDQPVLEEGDQEQNIDGSPVAPSPIAEVDETQSPGHLQINATPLNSLPPSRVQSMYNESDTLGSDESTLKALERPPSFQSLAQRSVRRSGGLGRMKSIREKARGAHEAHKRYTQTSMAAPQGLSRSGGTPATETQPTQNNSSALLRRKSTKMFNANIVQIRPNRDSMLVPDIPQDSISSSSRGAPKHPTTFRWFKGQLIGKGTYGRVYLGMNATTGEFLAVKEVEVNPRAAAGDKKRMKELVAALDQEIETMQHLDHVNIVQYLGCERKETSISIFLEYISGGSIGSCLRKNGKFEESVVQSLTRQTLSGLAYLHREGILHRDLKADNILLDVDGTAKISDFGISKKTDNIYGNDKSNSMQGSVFWMAPEVIRSQGEGYSAKVDIWSLGCVVLEMFAGRRPWAKEEAVGAIYKIANGEIPPIPEDVQDTISPIAVAFMMDCFTVDSHDRPTANKLLSQHPFCELDPNYNFLDSELYAKIRGTY

SEQ ID NO: 1288 - protein, 106 aa, Unknown
  Silicibacter sp. TM1040
MSTVAVTDATFDAEVKNSDVPVVVDFWAEWCGPCKQIGPALEELAAEYGDKVKIAKVDVDSNPNAAAAMGVRGIPALFVFKDGQVVSNRAGAAPKAALKSWIDESI

SEQ ID NO: 1289 - protein, 442 aa, Guillardia theta
EREKWRTKRNKRGQLEGGREEEIEGRETSSIMPCATHRGCLWSCRSSWSCFLVSRSLLVVAVVALASTAFALEDGSPSKPKKALKSQTPVNYFANFLKPSKSEVAVDFGAFNIPGKAAWSIKAGSYFGLWYFFNIFYNVANKKALNALNLPWLQSLACVGVGIPYIALIWALGVRDTPKIDNKLLPSIIQQSSLHAAGNVGGNVAFGAGALGFAHVLKSCEPAFTAIFSGLINGKWQHPFVYATLIPIMGGVAYASASEVNFNMLQFVSAMVSNVAFSLRAVLGKKTMSDRSIREVAKLDGPNTFSVLQIGATLLTIPFVVAVEGWRTLAPWTHPSWKAAIGKLDHAGAMITEGYLWKQLILSGLMFQLYYESAFLALDAVSPVTHSIGNNIKRVVIVITSVIIFGQKMSTQSMIGSSIAIAGVFLYAQVSEMYSNIANRAK

SEQ ID NO: 1290 - protein, 137 aa, Mycobacterium smegmatis
MTRTRRSDATARRYYHFRRMLFSLHQNASAQGSSMTAEPVPTAEPGGKVTILFERERVSVPRRPNETLLESARRAGMTPPFSCEAGNCGTCMAKLLEGTATMRVNDALDDDEVAEGYVLTCQAVPDCDTVTVSYDDD

SEQ ID NO: 1291 - protein, 140 aa, Mesembryanthemum crystallinum
KKQFFRNFITIIVFGALGTLVSFTIISLGAMEFFKKLDIGSLELGDYLAIGAIFAATDSVCTLQVLHQDETPLLYSLVFGEGVVNDATSVVLFNAIQNFDLTHIDHRIAFKFAGNFLYLFFTSTLLGAITGLLSAYIIKK

SEQ ID NO: 1292 - protein, 197 aa, Gloeobacter violaceus
MEPRIASTVRTTRETDIQIRLDLDGTGRVQAETGVPFLDHMLAQIATHGLIDIDVSAQGDLHIDDHHTNEDVGIAFGQCLAKALGDKRGISRFGHFAAPLDEALVQVVLDLSGRPHLSYGLEIPTQRVGSYDTQLVREFYQAVVNNSSMTLHLRQWAGINSHHIIEASFKAFARALRLAVEIDPRRAGSLPSSKGAL

SEQ ID NO: 1293 - protein, 108 aa, Nitrosomonas europaea
MSQHIHYVTDASFESEVLQCPVPVLVDYWAEWCGPCRMIAPLLDEIASEYGDRLKIAKLNIDENQSTPQKYGIRGIPTLMIFKNGNIEATKVGALSKSQLTAFVDSHL

SEQ ID NO: 1294 - protein, 705 aa, Crocosphaera watsonii
MTLKTLPGESYPIGATVEKDGKHGVNFCIFSKEATFIELLLFAGQNDPQPSHTIPLDTKTNRTHYYWHIFVEGLKAGQIYAYRVHGPFDLSQGHRFNPEKVLLDPYAKAIVGSSIYNREAAKQPGDNCAQALRGVVVDTETYDWEGDWTQKPRLRQPYSKSVIYEMHVGGFTRHPNSGVAPEKKGTFAGLIEPEKIAYLKSLGITAVELLPIHYFDVEDVKPGLQNYWGYSTIGFFAPHSYYSSDQSPLGPVNEFRDMVKALHKEGIEVILDVVFNHTAEGDERGPTLNFRGIDNSTYYILEEDHSQYKNYAGCGNTFRGNHPIVGRFILDCLHYWVTEMHVDGFRFDLASILSRDSSGTPLEDLRGTTPDILWIIESDPVLAGTKLIAEAWDAAGLYDVGRFVELADWFAEWNGPFRDDVRCFVKGDDGMVPRLASRILGSPDIYHREDVDINRSINFVTCHDGFTLNDLVSYDEKHNEGNGEDNCDGDNHNNSWNCGVEGETNDSVINTLRLQQIKNFFTILFLSQGTPMILMGDEIKRTQRGNNNVYCQNNELSWFNWDGVESEYDLWCFLRRLIYFTQGLELFNQEERLEVAYNNPNHPHISWHGVKLGEPDWSDYSHCLAFSLRHPEKKEYLHVMLNAYWEPLEFELPWLGDDEHWYRVVDTSLPIDKTICELDVAVEVTTGNYTTNGRSCVVLMAKAKH

SEQ ID NO: 1295 - protein, 714 aa, Unknown
  Mycobacterium sp. MCS
MAAAPKPNVTPEVWPGKAYPLGATYDGFGTNFALFSEAAERVELCLFDADGEQTACVTLPEVDGFVWHGFIPNIEPGQRYGYRVHGPYDPPNGQRCNPNKLLLDPYAKAIDGTFDWGQPLFSYNFGDPDSRNDDDSADCMPKSVVINPYFDWGTDRPPNHEYADTVIYEAHVKGLTQTHPDIPEQIRGTYSAVAHPVIIDHLKALGVNAIELMPVHHFANDSTLLDKGLSNYWGYNTIGFLAPDPKYSSSLTPGGQVQEFKAMVRTLHEAGIEVILDVVYNHTAEGNHMGPTLSFRGIDNAAYYRLVDDDKRYYMDYTGTGNSLNAGHPHALQLIMDSLRYWVTEMHVDGFRFDLASTLAREFYDVDRLATFFELVQQDPTVSQVKLIAEPWDVGPGGYQVGNFPPQWTEWNGKYRDTVRDYWRGESATLDEFASRLTGSSDLYEHTSRRPVASINFVIAHDGFTLRDLVSYNEKHNEDNGEDNNDGESHNRSWNCGVEGPTDDPQVNALRSRQQRNFLTTLLLSQGVPMIAHGDELGRTQHGNNNVYCQDNELSWIDWSTVDTELMAFTQKVSELRAAHPVFRRRRFFSGRPVRQRGAPGLPDIAWFAPDGSEMTDEDWDSGFAKSIAVYLNGQGIPDLDVRGQRVTDDSFLLCFNAHHEPLEFAMPAAEFARAWLPVINTADDDDARESVTAGAKIEVAERSVLVLQAVNEP

SEQ ID NO: 1296 - protein, 1258 aa, Arabidopsis thaliana
MVSDADASTSSSSIDIMPSANIQNDVPEPSVHTSHRRTRKPAYLQDYYCHSVASLTIHDISQFLSYEKVSPLYHSFLVCIAKAKEPSTYNEAKEFLVWCGAMDDEIGAMETTHTWEICTLPPNKKPIGCKWVYKIKYNSDGTIERYKARLVAKGYTQQEGIDFIETFSPVCKLTSVKLILAISAIYNFTLHQLDISNAFLNGDLDEEIYMKLPPGYAARQGDSLPPNAVCYLKKSIYGLKQASRQWFLKFSVTLIGFGFVQSHSDHTYFLKITATLFLCVLVYVDDIIICSNNDAAVDELKSQLKSCFKLRDLGPLKYFLGLEIARSAAGINICQRKYALDLLDETGLLGCKPSSVPMDPSVTFSAHSGGDFVDAKAYRRLIGRLMYLQITRLDISFAVNKLSQFSEAPRLAHQQAVMKILHYIKGTVGQGLFYSSQAEMQLQVFSDASFQSCKDTRRSTNGYCMFLGTSLISWKSKKQQVVSKSSAEAEYRALSFATDEMMWLAQFFRELQLPLSKPTLLFCDNTAAIHIATNAVFHERTKHIESDCHSVRERLVAGLFKLIHVNSHLQLADPFTKPLYPTPFKLMMSKMAGLEALICFIFLFLFSFLTSFKASAQNPFYLNHDCPNRTTYSSNSTYSTNLKTLLSSFASRNASYSTGFQNIRAGQTPDRVTGLFLCRGDLSPEVCSNCVAFSVNESLTRCPNQREAVFYYEECILRYSHKNFLSTVTYEGELIMRNPNNISSIQNQRDQFIDLVQSNMNQAANEAANSSRKFSTIKTELTSLQTLYGLVQCTPDLARQDCFSCLTSSINRMMPLFRIGARQFWPSCNSRYELYAFYNETAIGTPSPPPLFPGSTPPLTSPSIPGKSGNSTVLVVAIVVLAVLLFIALVGYCFLAQRTKKTFDTASASEVGDDMATADSLQLDYRTIQTATNDFAESNKIGRGGFGEVYKGTFSNGKEVAVKRLSKNSRQGEAEFKTEVVVVAKLQHRNLVRLLGFSLQGEERILVYEYMPNKSLDCLLFDPTKQTQLDWMQRYNIIGGIARGILYLHQDSRLTIIHRDLKASNILLDADINPKIADFGMARIFGLDQTQDNTSRIVGTYGYMAPEYAMHGQFSMKSDVYSFGVLVLEIISGRKNSSFDESDGAQDLLTHTWRLWTNRTALDLVDPLIANNCQNSEVVRCIHIGLLCVQEDPAKRPTISTVFMMLTSNTVTLPVPRQPGFFIQSSPVKDPTDSDQSTTTKSTPASIDDELITDLYPR

SEQ ID NO: 1297 - protein, 275 aa, Burkholderia vietnamiensis
MTDPTRSATPFRVAALQMVSTPDVARNLADAGHLIEQAAADGAQLVLLPEYFCFMGHRDTDKLALAEPYRDGPIQQFLAQAAQRHRVWVIGGTLPLQAPEPDRVLNTTLVFDPSGREAARYDKIHLFNFEKGDESFDEARTIRAGDTVVAFDAPFGRVGLSVCYDLRFPELYRRMGDCALLVVPSAFTYTTGRAHWETLLRARAVENQCYVLAAAQGGKHENGRRTWGHSMLIDPWGEIVAVRDEGAGVVAGALDPQRIADVRQSLPAWRHRVLA

SEQ ID NO: 1298 - protein, 296 aa, Antirrhinum majus
GKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGF

SEQ ID NO: 1299 - protein, 192 aa, Staphylococcus aureus
MIYQKQRNTAETQLNISISDDQSPSHINTGVGFLNHMLTLFTFHSGLSLNIEAQGDIDVDDHHVTEDIGIVIGQLLLEMIKDKKHFVRYGTMYISMDETLARVVVDISGRPYLSFNATLSKEKVGTFDTELVEEFFRAVVINARLTTHIDLIRGGNTHHEIEAIFKAFSRALGIALTATDDQRVPSSKGVIE

SEQ ID NO: 1300 - protein, 429 aa, Triticum aestivum
  misc_feature (170)..(170): Xaa can be any naturally occurring amino acid
MAQAVVPAMQCQVGVRGRSAVPARQPAGRVWGVRRTARATSGFEVLALGPETTGVIQRMQQLLDMDTTPFTDKIIAEYIWVGGSGIDLRSKSRTISKPVEDPSELPKWNYDGSSTGQPPGEDSEVILYPQAIFKDPFRGGNNILVICDTYTPQGEPVPTNKRHMAAQIFXSDPKVHWHKCPWFGIEQEYTLMQRDVNWPLGWPVGGYPGPQGPYYCAVGSDKSFGRDISDAHYKACLYAGIEISGTNGEVMPGQWEYQVGPSVGIDAGDHIWASGYILERITEQAGVVLTLDPKPIQGDWNGAGCHTNYSTLSMREDGGFDVIKKAILNLSLRHDLHIAAYGEGNERRLTGLHETASISDFSWCVANRGCSIRVGRETEAKGKGYLEDRRPPSNMDPYTVTALLAETTILWEPTLEAEALAAKKLALKV

SEQ ID NO: 1301 - protein, 210 aa, Cyclotella cryptica
MMKLALLSALAGSTAAFAPAATRASSSALNAFSAADLPGALPPVGFFDPLGFAEKADEKTLKRYREAEVTHGRVAMLAVVGFLVGEAVEGSSFLFDAQISGPAITHFTQVPDGWDALIVTFIGAAEAQRAQIGWVDPADASYDQPGLLRDNYYPGDIGFDPLGLKPEDPEELNIMITKELQNGRLAMLAAAGFLAQEAVDGKGILEHFSS

SEQ ID NO: 1302 - protein, 309 aa, Xanthomonas campestris
MAPSHWRLILNGKSTDNEDLREAVGVLRKRGIQLDVRVTWEEGDAERYVAEAIADGVQTVVAAGGDGTLSEVAAALAHHQDDAATLPSLGLVPLGTANDFATAAMIPLEPLGALGLIAERAAEPIDLLRIDADHGPHWCANVASGGFGTQVTVETDAGLKKMLGGLAYLITGMSRLGRIDPISAHFTGPDFSWEGEFIALGLGNGRQAGGGQALCPEALIDDGLLDVTIVPALNGEVAATLGTLVTGGKQAALERVAVRTRLPWLEIASVQPLTLNLDGEPETSRHFRVECVAARLRMHLPIDCPLRSA

SEQ ID NO: 1303 - protein, 490 aa, Saccharophagus degradans
MSSGKLNLLDFTKENIRTLHLTWFAFFLTFVVWFSHAPLKPLIMQAFDMSLAQWKALLILNVALTIPARIVIGILVDKFGPRIVYSALLVTSGFLCVAFASSQSYEQLALLRFAMGFVGAGFVIGIRMVGEWFPARQVGLAEGVYGGWGNFGSAAAAFTLPTLALIFGGDDGWRYAIGITGVIAGFYGIFFYWRARNTPKGSTYFKPKKSGGLEVTSKRDFWFYIAMNVPMYLILAVLAWKLSPSGVNLLTQTAVNVLYVGLVALFIFQFTQIYKVNKDMLKNGAPEHDKYPFKQVAVLDWAYFVTFGSELAVVSMLPAFFLETFTDLSLAQAGMLGAAFAFMNLIARPGGGYISDRFGRRKSLSIFIAGLAVGYFVLSQVGASWPVAAAVLAVMCCSFFVQAGEGAVFAMVPLIKRRMTGQIAGMAGAYGNVGAVTFLTVYSFVDASTFFMIIGASAAVVFGIVQFIEEPQGHTTEVMEDGTVQKIEVS

SEQ ID NO: 1304 - protein, 496 aa, Saccharophagus degradans
MSTANFNVLHFSDPKVRTLHLAWIAFFITFFMWFCHVPLMPLIKDTFGLSMAEAKALLFLNVALTIPARTIVGSLVDKYGPRVMYSALLAISGCICFMFAWAQDYTQLAAARFLLGFAGAGFVIGIRLVTDWFPAKTAGAAQGIYGGWGNFGAAIANWALPAMSSILIGYVGVAYSWRVAITIAGVVAIGYSFIFYIMVRNTPKGATYFAPKKVGAMEVSNKADFVLYMIMLSPIFLAMGVICWRLSPAQVGLLSEFVTYAIWAGLLLWFCWQAFGAYKLNAEAIHEGVVGIHKYKFKQVALLDLSYAVTFGSEVAVVSMMPLMFSNEDTYAFSLAKASVMAGCFMAMNLIARPGGGWLSDKLGRKKTLMLTVAGSAIGYAGLSMMTPDWSLLAIGAVVVFCSFFVQAGAGATFGVVPTIKRRLTGQIAGMTGAYGNVGAALFLLVNSFYAPNVFFGVITGACIVVLGLLFLFMEEPKGQIAEVLPDGTVEMIDVG

SEQ ID NO: 1305 - protein, 199 aa, Cyclotella cryptica
GSAVAFAPAATRASSSGLNAFSAADLPGALPPVGFFDPLGFAEKADEKTLKRYREAEVTHGRVAMLAVIGFLVGEAVEGSSFLFDAQISGPAITHFTQVPDGWDALIVTFIGAAEAQRAQIGWVDPADASYDQPGLLRDNYYPGDIGFDPLGLKPEDPEELNIMITKELQNGRLAMLAAAGFLAQEAVDGKGILEHFSS

SEQ ID NO: 1306 - protein, 210 aa, Cyclotella cryptica
MMKLALLSALAGSTAAFAPAATRASSSALNAFSAADLPGALPPVGFFDPLGFAEKADDKTLKRYREAEVTHGRVAMLAVVGFLVGEAVEGSSFLFDAQISGPAITHFTQVPDGWDALIVTFIGAAEAQRAQIGWVDPADASYDQPGLLRDNYYPGDIGFDPLGLKPEDPEELNIMITKELQNGRLAMLAAAGFLAQEAVDGKGILEHFSS

SEQ ID NO: 1307 - protein, 522 aa, Triticum aestivum
MARGGGNGEVELSVGVGGGGAGAGGADAPAVDISLGRLILAGMVAGGVQYGWALQLSLLTPYVQTLGLSHALTSFMWLCGPIAGLVVQPCVGLYSDKCTSRWGRRRPFILTGYILICIAVVVVGFSADIGAALGDSKEECSLYHGPRWHAAIVYVLGFWLLDFSNNTVQGPARALMADLSAQHGPSAANSIFCSWMALGNILGYSSGSTNNWHKWFPFLRTRACCEACANLKGAFLVAVLFLAFCLVITVIFAKEIPYKAIAPLPTKANGQVEVEPTGPLAVFKGFKNLPPGMPSVLLVTGLTWLSWFPFILYDTDWMGREIYHGDPKGTPDEANAFQAGVRAGAFGLLLNSVVLGFSSFLIEPLCKRLGPRVVWVSSNFLVCLSMAAICIISWWATQDMHGYIQHAITASKEIKIVSLALFAFLGVPLAILYSVPFAVTAQLAANRGGGQGLCTGVLNIAIVIPQVIIAVGAGPWDELFGKGNIPAFGMASAFALIGGIVGIFLLPKISRRQFRAVSGGGH

SEQ ID NO: 1308 - protein, 546 aa, Xanthobacter flavus
MTMTVEKTRTGGADYDAVVVGAGFGGLYAVHKLRNEQGMNVKAYDNAADIGGTWFWNRYPGAVSDTESFVYRFSFDRELLQRGRWKNRYVTQPEILAYLNEVADHLDLRRSYEFNTKVSAAQFDDATGLWKVTTDKGQAVTAKYLITGLGLLSATNLPKFKGMDTFKGRILHTGAWPEGVELAGKRVGIIGTGSTGVQVITATAPIAKHLTVFQRSAQFVVPIGNTPQDAETIARQKATYDDIWKQVKSSAVAFGFEESTIPAETASPEERDRVFEAAWQRGGGFYFMFGTFSDIATSQVANDAAADFIKRKLKQIVKDPETARKLTPSDLYAKRPLCGDDYYGVYNRDNVTLADVKADPIAEFTLTGIRLASGAEHELDVVIFATGFDAVDGNYTRMDMRGRNGVSLRDMWKEGPLGYLGIMEAEFPNLFMILGPNGPFTNLPPSIETQVEWIADMVKTMEAKGLKTSEPTAQARDQWVELCRTIANMTLFPKAESWIFGANIPGKKNTVMFYLAGLGNYRKVLSGLSESGYPTIIFDRAVECVA

SEQ ID NO: 1309 - protein, 138 aa, Neisseria meningitidis
MRLLHTMLRVGNLEKSLDFYQNVLGMKLLRRKDYPEGRFTLAFVGYGDETDSTVLELTHNWDTERYDLGNAYGHIAIEVDDAYEACERVKRQGGNVVREAGPMKHGTTVIAFVEDPDGYKIEFIQKKSGDDSVAYQTA

SEQ ID NO: 1310 - protein, 295 aa, Rickettsia rickettsii
MSKIPSVNIKALLDAGVHFGHKTSRWNPKMASYIYGKRDDVHIIDLRQSVALMNVALNAIYETVKKDGKILFVSTKIQASDIIAEYAEKCGQYYVNHRWLGGMLTNWKTIAGSIEKLNKLDKTLENEEALMGYTKKEILDMSRKKDKLLLSLAGIRNLNSKPDLLVVIDTNKEHIAINEAVKLNVPIVAVVDTNSNPDNVDYPIPGNDDSIRSIRLYCSLFADAALQGLEESMKASGVDMGAMQEHTDKGLTSKNVSKLKQAKKFSKTKNIDEETNTEFEQVLNDADENKNSDNA

SEQ ID NO: 1311 - protein, 446 aa, Methanopyrus kandleri
MRVVVVGGGAAGVVAARTAREHGADVVLISADEHIAYSPCAIPFVISGEIERPEDILMRDPTHYERLGIDVRLGVRVEEVDPEEKVVTTEDGDTVEYDSMVLATGGEPLVPPIEGSELDGVFTVRRFSDIEPLLRAVQESERAVIVGAGPIGVEMAYALHERGLEVTLVEMLDRVLPQFLDDDVAAIVQERMEKEGVRVLLGSPVEAIEGDDRVEAVVVNGEEIEADLVVMAAGVRPVTDLFESIGASVLPFGVEVDPALRVKREDGGVFDDIYAAGDCVADWCPITGERVPSQLGTVAVRQGKIAGKNAAGGPRATWMGTLNTAVIRVFDLEAAGAGLTQTRAEELGLEVVSATVETTTRARYYPGGEPIAVKLIADADTHRIVGVQSVGGERVRERVDGVALAIRLAAKVEDLLSWDYSYSPPVARVIEPIYEAAELLREELHS

SEQ ID NO: 1312 - protein, 387 aa, Zea mays
MIPSVRISPGSAAFSGSSLRLKLHSIPSISSLKPSKYVVSSLKPLYLAPLDGPHTSELKSWRQPLEFRCAASAADDKESKTQVVPVQLEGAQRLKISIYFATWWALNVIFNIYNKKVLNAFPYPWLTSTLSLACGSAMMLFSWATRLVEAPKTDLDFWKVLFPVAVAHTIGHVAATVSMSKVAVSFTHIIKSAEPAFTVLVSKFLLGETFPVPVYLSLLPIIGGCALAAVTELNFNMVGFMGAMMSNLAFVFRNIFSKRGMKGKSVSGMNYYACLSIMSLVILTPFAIAMEGSQMWAAGWQKAVAEVGPNVVWWIAAQSVFYHLYNQVSYMSLDQISPLTFSIGNTMKRISVIVSSIIIFHTPVRPVNALGAAIAILGTFLYSQAKA

SEQ ID NO: 1313 - protein, 215 aa, Oryza sativa
  misc_feature (79)..(79): Xaa can be any naturally occurring amino acid
  misc_feature (112)..(112): Xaa can be any naturally occurring amino acid
  misc_feature (185)..(185): Xaa can be any naturally occurring amino acid
MGRRPARCYRYCKNKPYPKSRFCRGVPDPKIRIFDLGRKRARVDEFPLCVHLVSDEYEQLSSEALEAGRICANKYLVKXCGKDAFHIRMRVHPFHVIRINKMLSCAGADRLXTGMRGAFGKPLGTVARVNIGQVIMSARVKDQHKAQTVEAFRRAKFKFPGRRKIFVSDQWGFTKFTREDYERLXQQGQLPYDGADVKYLPHHGPLDAWRKRQAV

SEQ ID NO: 1314 - protein, 439 aa, Aquifex aeolicus
MSYIPHSEEETKEILSKLGLESLEDLFSHIPKELFAKDFSFPEPKSEEELRRIFERACEDTELPLYFIGAGAYDRIIPSVIWQILSRGEFLTPYTPYQAEASQGTLQAIFEYQSLICELTGMDVANASMYDGASALAEAVLMARAIKGKGDTVVLSKALNPLYRRTVKTYLRGYEDKIVEVPYTEEGTTDLNNLEEVLKESEVHALAVQYPNFFGFVEPLKEIGELCKKYEVPFVVFVDPIALSILKPPAEFGADIVVGEGQQMGIPLSFGGPYVGFFATKKEHVRKMPGRLVGMGEDIEGKRAFTLVLQTREQHIRRERATSNICTNQNLMALANLLYMVLLGKEGMKKVAVQSLSKALYFKKELMKKGFEEVFTGKHLWEFPLRHESLKAIYRKLLKEKIVLGLPLDRFYEDLKNTTLIAVTEKRTKEEIDSVLALL

SEQ ID NO: 1315 - protein, 208 aa, Brassica napus
MGGFREFGADQHSSSSNIFHSITAIVIWLGSVHLNVAIVLSSLIFLPPSLSLLVLGLLFLLIFIPIDDRSKYGRMLARYICKHACSYFPVTLHVEDYEAFQPTRAYVFGYEPHSVWPIGAVALADLTGFMPLPNIKVLASTAVFYTPFLRQIWTWLGLAPASRKNFASYLDSGYSCILVPGGVQETFHMKHDVENLFLSSRRGFVRIA

SEQ ID NO: 1316 - protein, 412 aa, Vigna unguiculata
MALFSGAASARIIPSVSLSSSRSFFSLSSSSSSLQCLRSSPRISHLFLNQRRAEVRVSSGGYGTVSAPKSFASDPDQLKSAREDIKELLRSKFCHPILIRLGWHDAGTYNKNIEEWPQRGGANGSLRFEIELKHAANAGLVNALKLLQPIKDKYSGVTYADLFQLAGATAVEEAGGPKLPMKYGRVDVSGPEQCPEEGRLPDAGPPSPADHLRQVFYRMGLNDKEIVALSGAHTLGRARPDRSGWGKPETKYTKDGPGAPGGQSWTVQWLKFDNSYFKDIKEKKDEDLLILPTDAALFEDPSFKVYAEKYAEDQETFFKDYAEAHAKLSNLGAKFDPPEGIVIDESPNAGAEKFVAAKYSTGKRELSEAMKQKIRAYEAVGGSPDKPLQSNYFLNIMIIIAVLALLTSLLGN

SEQ ID NO: 1317 - protein, 113 aa, Mannheimia succiniciproducens
MSKQSKQEKLPPPHKNGYNSHHSKKLPQKCGKNFIIFLEDTMAKEDCIEMQGTILETLPNTMFRVELENGHVVTAHISGKMRKNYIRILTGDKVTIEMTPYDLNKGRIIFRSR

SEQ ID NO: 1318 - protein, 246 aa, Crocosphaera watsonii
MTLYQPFLDYAISLMQDQLSLQPYPIPEGFERKEEMTGKGKRQQRVVTSSYAFKSPKLRQIRAAHVQGGSSLQVLNFVIFPQLTYDLPFFGADLVTLPGGHLIALDMQPLFHDKAYQQQYTEPILPLFKSHQQHLPWGGDFPEEAKPFFSPAFLWTRPQETEAVITRVFSAFKDYLQAYLNFVEQAKPITDSQRLEDILQAQRRYIAYRADKDPARGMFTRLYGQAWTEEYIHGFLFDLERQMVTV

SEQ ID NO: 1319 - protein, 300 aa, Clostridium perfringens
MVFNSLLSLIGNTPILKANNLFEGNNVFVKLEKFNPGGSIKDRAALGMIEEAEKNGLLKENGVIVEPTSGNTGIAIAMIGKIKGYKVIITMPETMSKERRDMIKAYGAEIILTEGSKGMKGAIEEAERLASTNGYFMPQQFLNEANAKKHYETTAEEIIRDIPDLDVFIAGVGTGGTITGVGRKLKEYNPNIKIVAVEPSDSAVLSGENSGPHKIQGIGAGFVPKIYDSSVVDEIIKVKNEDAYTMAKNFADKEGILVGISSGAALKGAKYILKNIEKDKKVLVIAPDGGEKYFSTGLYE

SEQ ID NO: 1320 - protein, 364 aa, Vigna unguiculata
MALFSGAASARIIPSVSLSSSRSFFSLSSSSSSLQCLRSSPRISHLFLNQRRAEVRVSSGGYGTVSAPKSFASDPDQLKSAREDIKELLRSKFCHPILIRLGWHDAGTYNKNIEEWPQRGGANGSLRFEIELKHAANAGLVNALKLLQPIKDKYSGVTYADLFQLAGATAVEEAGGPKLPMKYGRVDVSGPEQCPEEGRLPDAGPPSPADHLRQVFYRMGLNDKEIVALSGAHTLGRARPDRSGWGKPETKYTKDGPGAPGGQSWTVQWLKFDNSYFKDIKEKKDEDLLILPTDAALFEDPSFKVYAEKYAEDQETFFKDYAEAHAKLSNLGAKFDPPEGIVIDESPNAGAEKFVAAKYSTGKE

SEQ ID NO: 1321 - protein, 596 aa, Unknown
  Mycobacterium sp. MCS
MDHSSGSPAHPDHDPAEGSHIEDGVVEHPTAGDFGHARMVPEDRTWFKRAVFYEVLVRAFHDSDADGSGDLRGLTERLDYLQWLGVDCLWLPPFYDSPLRDGGYDIRDFYKVLPEFGTVEDFVTLLDAAHRRGIRVITDLVMNHTSDSHPWFQESRRDPDGPYGDFYVWSDTSDRYADARIIFVDTEESNWTFDPVRRQFYWHRFFSHQPDLNYDNPAVQEAMLDVLRFWLDLGIDGFRLDAVPYLFEREGTNCENLPETHAFLRHCRKVIDDEYPGRVLLAEANQWPADVVAYFGDPDTGGDECHMAFHFPLMPRIFMAVRRESRFPISEILAQTPEIPDMAQWGIFLRNHDELTLEMVTDEERDYMYSEYAKDPRMKANVGIRRRLAPLLENDRNQIELFTALLLSLPGSPVLYYGDEIGMGDIIWLGDRDGVRTPMQWTPDRNAGFSKATPGRLYLPPNQDAIYGYQAVNVEAQRDSSNSLLNWTKTMLGVRRRHDAFAIGAFRELGGSNPSVLAFVRETATDTVLCVNNLSRFPQPIELNLQQWNGFTPVEMTGYVDFPSIGALPYLLTLPGHGFYWFQLRAPDPEPEGVQP

SEQ ID NO: 1322 - protein, 497 aa, Moricandia nitens
MERARRLAYRGIVRRLVNESKRHRKGEITPHHVPSVVPHAPARYISSLSPYLSNHRSVNVGARHHHNHHQTRSISVEAVKPGDTFPRRHNSATPDEQAHMAKLCGYDHIDSLVDATVPKQIRIDSMKFSKFDEGLTESQMIAHMTELASKNKVFKSFIGMGYYNTHVPTVIIRNILENPAWYTQYTPYQAEISQGRLESLLNFQTMITDLTGLPMSNASLLDEGTAAAEAMAMCNNIQKGKKKTFVIASNCHPQTIDICKARADGFDLKVVTKDLKEIDYSCGDVCGVLVQYPGTEGEVLDYGEFVKNAHANGVKVVMATDLLALTVLKPPGEFGADIVVGSAQRFGVPMGYGGPHAAFLATSQEYKRMMPGRIIGVSVDSTGKQALRMAMQTREQHIRRDKATSNICTAQALLANMAAMYAVYHGPAGLKSIAERVHGLAGIFSLGLKKLGVAEAQDLPYFDTVKIKCSDAHAIADAAVKSEMNLRVVDSNTVSLL

SEQ ID NO: 1323 - protein, 468 aa, Escherichia coli
MSKQQIGVIGMAVMGRNLALSIESRGYTVSVYNRSREKTEEVVAENPGKKLVPYYTVKEFVESLETPRRILLMVKAGAGTDAAINSLKPYLDKGDIIIDGGNTFFQDTIRRNRELSAEGFNFIGAGVSGGEEGALKGPSIMPGGQKDAYEMVVPILTKIAAIAEDGEPCVTYIGADGAGHYVKMVHNGIEYGDMQLIAEAYSLLKGALNLSNEELASIFNEWNEGELSSYLIDITKDIFNKKDEEGKYLVDVILDEAANKGTGKWTSQSSLDLGEPLSLITESVFARYISSLKDQRVAASKVLSGPQAKLASDKAEFVEKVRRALYLGKIVSYAQGFSQLRAASEQYNWDLNYGEIAKIFRAGCIIRAQFLQKITDAYAENKDIANLLLAPYFKHIADEYQQALRDVVSYAVQNGIPVPTFSAAVAYYDSYRSAVLPANLIQAQRDYFGAHTYKRIDKEGVFHTEWLE

SEQ ID NO: 1324 - protein, 1938 aa, Bacillus sp.
MKKRFQRGMAGLLSILLIVSMFAGYLPARAAAETGDKRIEFSYERPDGNYEGWNLWVWGTGVKDDQIDFTEFKEGKAYADIAVSDNADKVGFIIRKGDWEEKDFDGDRSITINKIDNITKVHVTSQQEKFGQIPDGSPPVVADGNADFFFRDKELYAAGEMDKVEKVELSILGEKYEMNGEPEKERFTYTLSDLPTGEHEYTYLVTVDGQTEEVTDPYNTVDGRSVVEYVTSDVQVSASFIPAKVDYNQNAVVKVDIESETETKIREMSINLSEIGGKEKATIDPALNELTVAVKQGVTAGVKNLPITAIDEFGNRHEGSATLEVQARTITGEKADFDWDQSVVYFMLTDRFFDGDSSNNDPHGIGYDTSKSGTYQGGDFKGITQRLDYLDELGINTIWISPVVDNIKFDVRHSEGPDTPYYAYHGYWADNFGELNPHFGSMADFHEMIDAAHERGIKIMVDVVLNHTGYGLKPGDSSSVANFPTDEDRARFDGMLRDGGSGEVRGELAGLPDFLTENPDVREQVVQWQTDWIEKSRTAKGNTIDYFRVDTVKHVEDTTWMAFKNALTKAMPEHKLIGEAWGANVNDDLGYLNSGMMDSLLDFDFKNYARDFANGQLDAVQQKLEARNSKLNNTATLGQFLGSHDEDRFYEVVEGDLGKYQVAASLQLTAKGQPVIYYGEELGLPGKNDYPYYTNRQNMPWDDVDGNEILEHYQKLLAFRNDNPNTFAKGDRKKVAGSDSEGYLLFSRTYGENSVYVGLNTEAAAKDVTLNFGSSEAVVTDRYSGQEYQANEEGQVTFSIPAMEDGGTVLLEVENGAVPPVEEEPTEPGEIEENTLRIHYQRTDNSYENLGLWLWGDVAAPSENWPSGGTPFQAGNVTDYGAYVDVELAEDAQNIGFLVLNTTNGDKDGGDKAVELFSPDLNEIWIKQGSDEVFLYEPVDLPANTVRIHYERTNADYEGWGLWNWEDVESPSDGWPNGAADAAGIGKYGAYYDIKLKEDANKIGFLFVNKQSGGQTGDMTFDMLKQYNQLFVKEGEDKVYTNPYGTVPLALVSGEVLSDKLISLTFTRTEGLDLEELKEQLEIKDVDGNDVSFTDVTIEGEKTVHVHGEFDLEKIPFSVTYLDRTISVKSGWKLIDEMYAYDGKLGAELHEDGTATLKVWSPKADNVSVVLYDKVDQNEVVDTIEMVKGDRGVWSVKLTKDNTGLDSLKGYYYHYEITHGDVTNLALDPYAKSMAAWNNEAGDKVGKAAIVDIGSIGPELDYADIPGFEKREDTIIYEVHVRDFTSDPNIGEDLKAQFGTFASFVEKLDYIQELGVTHIQLLPVMSYYFSNEFESGERMLEYASTGTNYNWGYDPHNYFSLSGMYSENPEDPELRIKEFKNLINEIHKRDMGVVLDVVFNHTAQVHIFEDLVPNYYHFMDADGTPRTSFGGGRLGTTHEMSRRVLVDSIKHWVDEYKVDGFRFDMMGDHDAESIQIAFDEAKKLNPNIVMIGEGWVTFAGDEGEPVQAADQQWMQYTEAVGSFSDEFRNELKSGFGSEGQPRFITGGAVNVQQIFDNIKAQPHNFMADQPGDVVQYIEAHDNLTLYDVIAQSIKKDPEIAENDLEIHKRIRVGNAMVLTSQGTAFLHAGQEFGRTKQWRAPATEAPYKSTYMTDADGNPFVYPYFIHDSYDSSDIINRFDWEKATDAEKYPVNNVTRDYTAGLIELRRSSDAFRLGSRELVDSNVTMVDAPEIKEQDLVVAYRSVSTAGVEYYTFVNADTSSRTLTLGQDLTEGVVVVDAEEANVAGVAEPAGFELTAEGITLEPLTTVVVRVGEQEGTDPGDGDGDGNTPPPGDGDGDGNTPPPGDGDGDGNTPPPGNGNGNNPGTPPGKGGENPGKGKNDKTPPGKGGDNPGKGNKLPLTATGTLNYILFGAIMLVLGTLLYLGVRRKAGLKEKTL

SEQ ID NO: 1325 - protein, 377 aa, Schizosaccharomyces pombe
MATSQVLHILPKPSYEHAFNSQRTEFVTTTATNQVELYEQDGNGWKHARTFSDHDKIVTCVDWAPKSNRIVTCSQDRNAYVYEKRPDGTWKQTLVLLRLNRAATFVRWSPNEDKFAVGSGARVISVCYFEQENDWWVSKHLKRPLRSTILSLDWHPNNVLLAAGCADRKAYVLSAYVRDVDAKPEASVWGSRLPFNTVCAEYPSGGWVHAVGFSPSGNALAYAGHDSSVTIAYPSAPEQPPRALITVKLSQLPLRSLLWANESAIVAAGYNYSPILLQGNESGWAHTRDLDAGTSKTSFTHTGNTVEGREEEGPVSFTALRSTFRNMDLKGSSQSISSLPTVHQNMIATLRPYAGTPGNITAFTSSGTDGRVVLWTL

SEQ ID NO: 1326 - protein, 92 aa, Zea mays
REKISKIKNGKTNVVYNVLKGAPPPPQLFMGYTWNKPFFREFLGFPPGRVRGAKFWPKNGCVGKVFGGRNLFLTFQQGTQVGEETPAPNSNG

SEQ ID NO: 1327 - protein, 213 aa, Ostreococcus tauri
MTFFIFVKCVIHHSSASPITNSPRSPARGAAEARRRHNSTSTGGKAPRKQLATKAARKSAPATGGVKKPHRYRPGTVALREIRKYQKSTELLIRKLPFQRLVREIAQDFKTDLRFQSSAVLALQEASEAYLVGLFEDTNLCAIHAKRVTIMPKDVQLARRIRGERARTPHPRSVSNQHGVHLNTTKFKRFLPSNPPCKPQSRARSVQVRFCCN

SEQ ID NO: 1328 - protein, 238 aa, Ostreococcus tauri
MKDAMRIASRLDRALVERQVYEMARAVEASVDDELHRLEKMDGDELEDIRRRRLEAMKTSAKTRKSLLERGHGVVNDLDDERGFFDKMKGEDKMIVHFYRRGSWPCEVMDAHCAAIARKHAETLVCRIDAEKSPFLTDKLKIWMLPTLACIRNTKVVDYIVGFDDVGGTDDFPTEHLRLVLASKGVITYEGGDNDVDANPRRAGRGPPKDDEAAERPTNIRRGAQMALNSDDEDSDFD

SEQ ID NO: 1329 - protein, 500 aa, Oryza sativa
MAGSGRPPAAQKKILQSLRPPLPFAASSRSPFAAPNDYHRFPAGGAAAAAASGSGGIGAGGAGGGGDIEEGLVIRTPTRDADRYGKNLIHAVVGAKQKRKAPEESDVAESSDCMITSPGFAVSPMLTPVSGKAVKTSKSKTKNNKAGPQTPTSNVGSPLNPPTPVGTCRYDSSLGLLTKKFINLLKQAPDGILDLNNAAETLEVQKRRIYDITNVLEGIGLIEKTLKNRIRWKGLDDSGVELDNGLSALQAEVENLSLKEQALDERISDMREKLRGLTEDENNQRWLYVTEDDIKGLPCFQNETLIAIKAPHGTTLEVPDPDEAGDYLQRRYRIVLRSTMGPIDVYLVSQFDEKFEDLGGGATPSGHANVPKHQPTEVFNTTNAGVGQCSNSVAVDNNIQHSQTIPQDPSASHDFGGMTRIIPSDIDTDADYWLISEGDVSITDMWKTALLNMETADVQWDESLDTDVFLSEDVRTPSSHNQQPSAVGGPQMQVSDMHKP

SEQ ID NO: 1330 - protein, 373 aa, Bordetella bronchiseptica
MAKRDYYEVLGVAKNASDEDLKKAYRKLAMKYHPDRNPDSKEAEEKFKEAKEAYEVLGDEQKRAAYDRYGHAGVDPNAAGMGGGMGGGFADAFGDIFGEIFGAGRRGGGGPQVYRGADLKYALEITLEQAASGFDTEIRVPSWENCDTCHGSGAKAGTSPKTCRTCGGSGAVRMQQGFFSVQQTCPTCHGTGKEITDPCPSCDGVGRTRRNKTLQVKIPAGIDDGMRIRSSGNGEPGINGGPPGDLYVEIHIKQHKIFQRDGDDLHCELTIPFTTAALGGELQVPTLGGKAEISIPEGTQSGKTFRLRAKGIRGVRGSYPGDLYCHVVVETPVRLSDEQKAILRQFEASLNDGGDRHSPQSKSWTDRVKEFFS

SEQ ID NO: 1331 - protein, 702 aa, Arabidopsis thaliana
MSGSVSGCGSGGCSIVWFRRDLRVEDNPALAAAVRAGPVIALFVWAPEEEGHYHPGRVSRWWLKNSLAQLDSSLRSLGTCLITKRSTDSVASLLDVVKSTGASQIFFNHLYDPLSLVRDHRAKDVLTAQGIAVRSFNADLLYEPWEVTDELGRPFSMFAAFWERCLSMPYDPESPLLPPKKIISGDVSKCVADPLVFEDDSEKGSNALLARAWSPGWSNGDKALTTFINGPLLEYSKNRRKADSATTSFLSPHLHFGEVAWANEGNEAGEESVNLFLKSIGLREYSRYISFNHPYSHERPLLGHLKFFPWAVDENYFKAWRQGRTGYPLVDAGMRELWATGWLHDRIRVVVSSFFVKVLQLPWRWGMKYFWDTLLDADLESDALGWQYITGTLPDSREFDRIDNPQFEGYKFDPNGEYVRRWLPELSRLPTDWIHHPWNAPESVLQAAGIELGSNYPLPIVGLDEAKARLHEALSQMWQLEAASRAAIENGSEEGLGDSAEVEEAPIEFPRDITMEETEPTRLNPNRRYEDQMVPSITSSLIRPEEDEESSLNLRNSVGDSRAEVPRNMVNTNQAQQRRAEPASNQVTAMIPEFNIRIVAESTEDSTAESSSSGRRERSGGIVPEWSPGYSEQFPSEENGIGGGSTTSSYLQNHHEILNWRRLSQTGYVKSAFGGAKGEEHHKGCNSGEIWLDCKPSTFGTV

SEQ ID NO: 1332 - protein, 357 aa, Coccidioides immitis
MAPKTHISNAENLKKYMELDQRGKIMAEYIWIDACGGVRSKTKTVNKVVKSADELPEWNFDGSSTGQAPGDNSDVYLRPVAIFPDPFRRGENILVLCETWDSDGSPNKYNYRHEAARLMRANAHEHFWFGLEQEYTLLGPDGWPYGWPKGGFPGAQGPYYCGVGTGKVHCRDIVEAHYKACLYAGINISGINAEVMPAQWEYQVGPCEGIDLGDQLWMSRFLLNRVAEEFGAIISFAPKPIPGDWNGAGLHTNVSTEAMRNEGGMKVIEAAMKKLETRHFEHIAVYGEGNEDRLTGRHETGSIDKFSWGVADRGGSIRIPRQVAKDGKGYFEDRRPASNADPYQITGIIVETLCGAS

SEQ ID NO: 1333 - protein, 298 aa, Bacillus cereus
MKLGLIGLGKMGFPLAEHLYEDKHEVVVYDVNKELVEKAGKLGITARHTLKEMIAELEAPRTIWVMVPAGEVVESVLKDVYPLLDEGDIVIEGGNSFYKDTLRRAEEAKSFGLHYVDIGTSGGVEGARYGACLMVGGEKEIYDQLEPLFKDLAVENGYSYAGRVGSGHFLKMVHNGIEYGMMQAIAEGFEVLDKSDFDFNYEDVAKVWANGSVIRGWLMDLTEKAFAEDPKLDGIKGVMNSSGEGKWTVETALELQAAAPVIAMSLFMRYRSQEDDTFHGKVVSALRNQFGGHEVVKK

SEQ ID NO: 1334 - protein, 472 aa, Staphylococcus aureus
MENTVKYRKFILPIVVGLLIWALTPFKPDTVDPTAWYMFAIFVATIIACITQPMPIGAVSIIGFTIMVLVGIVDMKTAVAGFGNNSIWLIAMAFFISRGFVKTGLGRRIALHFVKLFGKKTLGLAYSIVGVDLILAPATPSNTARAGGIMFPIIKSLSESFGSKPKDESSRKMGAFLVFTEFQGNLITAAMFLTAMAGNPLAQNLASSTSNVHITWMNWFLAALVPGLVSLIVVPFIIYKIYPPTVKETPNAKSWAENELATMGKIALAEKFMIGIFVIALTLWIVGSFIHIDATLTAFIALALLLLTGVLTWQDILNETGAWNTLVWFSVLVLMADQLNKLGFIPWLSKSIATSLGGLSWPIVLVILILFYFYSHYLFASSTAHISAMYAALLGVAIAAGAPPLFSALMLGFFGNLLASTTHYSSGPAPILFSSGYVTQKRWWTMNLILGFVYFIIWIGLGSLWMKVIGIF

SEQ ID NO: 1335 - protein, 360 aa, Bacteroides fragilis
MKKEFTRIAIKVGSNVLTRQDGTLDVTRMSALTDQIAALHKAGVEVILISSGAVASGRSEIRTLRKLDSVDQRQLFSAVGQAKLINRYYELFRDHGIAVGQVLTTKENFGTRRHYLNQKNCMTVMLENGVIPIVNENDTISVTELMFTDNDELSGLIASMMNAQALIILSNIDGIYNGSPSDPDSLVIREIGQGKDLSNYIQTSKSSFGRGGMLTKTNIARKVADEGITVIIANGKRDNILINLIEHPEETVCTRFIPASQPVSSIKKWIAHSEGFAKGEIHINEQATEVLNSDKAVSILPVGITRIEGEFEKDDIVRIIDYRGTPVGVGKVNCDSMQARDSIGKHGKKAVVHYDYLYIE

SEQ ID NO: 1336 - protein, 629 aa, Candida albicans
MTPIQQTPSVHNTIDDSSNGFPNQISLGEYLFYRISQANPKLKSIFGIPGDFNLNLLEHVYSPIIAEREIKFINTCNELNCAYAADGYSRVIGGMSAMITTFGVGELSAINGIAGAFAEHCPVLHIVGTTSMKDRLRAPNEMINIHHLVPNHDPLKPPNHDVYKSMVENISVVQESLDYDTKKNLIKIDNVLKKIIQEARPGYLFIPCDVPDLPVPGKMLFSDPFTAATRYTNSILSKQVLNDVTNAILEKMYDAKNPSIFSDCLTTRFGFQNDLNRFIDQIPETVKLFTANLARNLDESRNNFVGVYNGNGSSDDKTKQEFESSDFILTLGFFPNEMNTGGHTSNFSMIKDVVIVHPDYIKVNHQIYHIKQNDGERLFTLGEFLCTLTEKFDPSKLSVAAAEPKKIYQYQPSQQYSPSNLDYIPQGKLIDHFNSTLKPNDLFILETSSFVFGLPDMKFPTNVQLLTSPYYGSIGYAVPATFGATLAVNDLKSDRRIIVVQGDGSAQMTVQELSSFVRYKEILPNMPHIYLINNDGYTIERKIKGPNRSYNDINGKWKWRNLLNVFGGVEGEMYDSCVLKNSSELDQFFNGDKTKPISSHKLQFYEIIAGKFDVPQRVDNMMCISKNKN

SEQ ID NO: 1337 - protein, 510 aa, Pinus radiata
MRAFCDVSLVFGLFFLFWVGHANANYTIESYQHSKHPKPNFHGASHNYRDALSKAILFYEGQRSGKLPGSQRMTWRRDSALSDGFSQHVDLVGGYYDAGDNVKFGFPMAFTTTMLSWSVLEFGGFMGGELANSKDAIRWATDYLLKATAHPGTIYVQVGDPNTDHKCWERPEDMDTARTVYKIDSQHPGSDVAAETAAALAAASLVFRKSDPQYSKRLIHTAMRVFDFADKHRGAYSDSLRSCVCPFYCSYSGYEDELLWGAAWLHKATRNPTYLNYIQSKGQSLGADESDNIFGWDNKHAGARVLLSKEFLLRNVKSLHDYKGHADNYICSLLPGVSYSQAKYTPGGLLYTLSDSNLQYVTSSSFLLFTYAKYLSSSKHVVTCGSMTFSPKRLRTIAKRQVDYILGDNPLKMSYMVGYGSHYPERIHHRGSSLPSKGNHPQAIPCNAGFQSLYSNAPNPNILVGAVVGGPDSMDRFPDDRNDYEQSEPTTYINAPFVGSLAYLAHSTMS

SEQ ID NO: 1338 - protein, 723 aa, Listeria monocytogenes
MSEKQVFSTEWAGKTLSVEVGQLAKQASGAALIRYGDTVVLTAAVGSKKPRPGDFFPLTVNYEEKMYSVGKVPGGFLKREGRPSDRATLTARLIDRPIRPLFAEGFRNEVQITSTVFSVDQDCSPEMAAMLGSSVALVISDIPFEGPIAGVDVGRIDGKYVINPTIEQAEKSDISLTVAGTYDAINMVEAGAKEVSEEAMLEAIMFGHEEIKRLCEFQQQIIAAVGKEKREIELFVSDPELEAEVKAASEGKMKTAIKTEEKKAREAAIEEVKEEILESYKAKELENESEILSEVAHILEMIEKDEMRRLISQDKIRPDGRKVNEIRPLSSEVGMLPRVHGSGLFTRGQTQALSVCTLAPLREHQIIDGLGTEEYKRFMHHYNFPQFSVGETGPRRAPGRREIGHGALGERALQYVIPSEEEFPYTIRLVSEVLESNGSSSQASICGSTLAMLDAGVPIKAPVAGIAMGLVKLGDDYTILSDIQGMEDHFGDMDFKVAGTKDGITALQMDIKIDGLSRQILDEALTQAKEGRLHILEHLTSTISAPREELSAYAPKIITLNIKPEKIKDVIGPGGKQINAIIDETGVKIDIEQDGTVYIASQDQAMNRKAIAIIEDIVREVEVGEVYTGKVRRIEKFGAFVELFKGTDGLVHISELAHERVGKVEDILKLGDEVTVKVIEVDQQGRVNLSRKALLEKKEQPEGDKKPQAEKKFYPKTKKPESK

SEQ ID NO: 1339 - protein, 479 aa, Gloeobacter violaceus
MSSIAIVWHRRDLRVHDNPALWQASRTGGQVLAVFIVDPTIVERDDTAPARIYFLRESVLELQKAYRTIGGRLAVRVGEPVQQLVALAQAVGAGAVYFNDDIEPYARERDARAAEALRAAGITVHACAEILLHPAGEVLTAAGGKPYTVYTPFWRQWSAKPKPKPFPTPERLEAPTVEEQSFPELAQLGRPFAGELLVSPGEQSGLEQLEAFAREGLYRYGERRDLPGCDGTSRLSAHLKFGTVGIRAVWARTMDAWKQAEHDRDRAGLAVWQQELGWREFYKYELFHLPQLAGRPFRREFENFQWDEDQERFERWCQGETGYPIVDAAMRQLNTVSWMHNRLRMIVASFLTKDLLLPYGWGERYFMQKLVDGDLSANNGGWQWAASVGTDPKPLRIFNPSTQAGRYDPKAVFIRRWLPELEGVDTALLVTSERLPPLMRAQHRYAQPIVEHKRQQQVFKERYRAVRAQQADPGARDSE

SEQ ID NO: 1340 - protein, 480 aa, Oryza sativa
MVLSVRAVSGKSDLDFSDPSWKEKYQEDWNRRFSLPHITDIYDLKPRLTTFSLKKNRTDGGSLSADKWNGYVNKDDRALLKVIKYASPTSAGAECVDPDCSWVEHWIHRAGPRKEIYYEPAEVKAAIVTCGGLCPGLNDVIRQIVFTLEIYGVKNIVGIQFGYRGFFEKGLKEMPLSRKVVENINLSGGSFLGVSRGGAKTSEIVDSIQARRIDMLFVIGGNGSHAGANAIHEECRKRKLKVSVVAVPKTIDNDILFMDKTFGFDTAVEEAQRAINSAYIEARSAYHGIGLVKLMGRSSGFIAMQASLSSGQIDVCLIPEVSFTLDGEHGVMRHLEHLLEKKGFCVVCVAEGAGQDLLQKSNATDASGNVILSDFGVHMQQKIKSHFKDIGVPADVKYIDPTYMVRACRANASDAILCTVLGQNAVHGAFAGFSGITSGICNTHYAFLPITEVITKPKRVNPNSRMWHRCLTSTGQPDFH

SEQ ID NO: 1341 - protein, 508 aa, Unknown
  Shewanella sp. MR-4
MQNHSNLNDIGVIGLGVMGKNLALNIADNQYRVSAFDLDPVKVNGVLQQEKQERVGQDLRITGCANLSEMLASLAQPRILVLSVPAGAPVDGVCHALISAGIEADDIVIDTGNSLWTDTVEREKRYQGKFIFFSSAVSGGEVGARFGPSLMPSGDLGAWQHVAPIWKAIAAKVDPQTGLPIERFEPGNPVTEGEPCTTYIGPAGAGHYVKMVHNGIEYADMQLICEAYQLMHDGLGMSAAQVGEVFERWNKGSLNSYLMGISAEVLKQADPLTGLPLVEMILDKAGQKGTGLWTAVSSLQIGCPAPTIAEAVYARAVSTQKSLRVELSKKLAGPVSVAMDDAQKAVLIDALESALYCAKVCCYAQGFQLMAMTAQEQKWQLDFAEIAKIWRAGCIIRATFLQSITQAYQADADLSCLLMADTFATTLSEKQTEWRSAVAAAVMQGIPVPCISSALAYYDSYRSETLPANLLQGQRDFFGAHTFERSDKPAGEKYHLDWSAPNRVLIKL

SEQ ID NO: 1342 - protein, 492 aa, Arabidopsis thaliana
MSDLQANKDAAAVNRQSSSSSADLNGPSPMRKMISVASIAAGIQFGWALQLSLLTPYVQLLGVPHKWSSFIWLCGPVSGLLVQPSVGYFSDRCKSRFGRRRPFIAMGALLVAVAVVLIGYAADFGHSMGDKVDEPVKMRAVVIFALGFWILDVANNTLQGPCRAFLGDLAAGDAKKTRTANAFFSFFMAVGNVLGYAAGSYTNLYKIFPFTMTKACDIYCANLKSCFFLSITLLLVVTIIALWYVEDKQWSPKADSDNEKTPFFGEIFGAFKVMKRPMWMLLIVTALNWIAWFPFLLYDTDWMGREVYGGDSKGDDKMKKLYNQGIHVGGLGLMLNSIVLGFMSLGIEGISRKMGGAKRLWGAVNIILAVCLAMTVLVTKKAEEHRRIAGPMALPTDGIRAGALTLFALLGIPLAITFSIPFALASIISSSSGAGQGLSLGVLNMTIVIPQMVVSFGVGPIDALFGGGNLPGFVVGAIAAAISSVVAFSVLP

SEQ ID NO: 1343 - protein, 134 aa, Mannheimia succiniciproducens
MNEVIKTLNNLRRLRSMAKELSIEQLENIIEKFQLVIEEKKAEELEIKRLEEERKNRLEKYRELLKEDGITADELAQILAGKNNTAKAKRAPLSAKYKYINENGEQKTWTGQGRMPKAIQLQLNAGKSLSDFAI

SEQ ID NO: 1344 - protein, 515 aa, Zea mays
MAGGGEGDRVGVGGAQQFVDRSKVRILLCDGDATSSREVLRLLCNCAYHVTCAKSPRQVVNILNYEGGEIDIILAEVDLPVSKCFKMLKYIARNKDLRHIPIIMMSNRDEVSVVVKCLRLGAAEYLVKPLRTNELLNLWTHVWRRRRMLGLPEKNFFNDNFELVLSEPSDANTNSTTLLSDETDDRPKGNTNQETGTSKQLEYESNPSVAEPDQREKMEGVPGSALDASQKSSPRRAFSRPIKTNLRVAESSAFLAYVRSSTPATSSFDSELQRGGSRLDSLDNQGNCSSATDKSDTGTDVNIRNKEAFEMPAQYPMVWFSSSNMHMERSSEGHNDTSGTPPAYHFPFYYPGMVEHNMALSSAQDFQANINNAQAHTPPTMLPQYNVYPQCHGLPVIPSFQFNPSGMSTHSSHLPTQNVWSSASSTPPVPEETCSRSERRAAALAKFRLKRKERCFDKKVRYVNRKKLAETRARVRGQFVRQPTNTDVISIGDDISEDEDDDPSSREVDMVSSPE

SEQ ID NO: 1345 - protein, 307 aa, Exiguobacterium sibiricum
MIAKSVRDLVGNTPLYEITSFDLPAGTRILAKLEWMNPGGSVKDRLGIQLVDAAIEQGYVTRGGTIIEPTAGNTGIGLALAAKKYDLQVICVVPEKFSQEKQTLMRALGATVVNTPTELDMQGAIDKAKELGQTIPNSYVPLQFENEENPVTYQRTLGPELMAELDQIDWFVAGCGSGGTFAGTAAYLKERLGTKGAIVEPEGSVLNGGPAGPHKTEGIGTAKWPSLVSRDLVDEIHTISDHDAFTKVHELAAREGLLVGSSAGAALVAALDLAHRFPGSTIVTVFADSAERYLSQQIFEKVDETHA

SEQ ID NO: 1346 - protein, 1075 aa, Burkholderia vietnamiensis
MKRMLFNATQQEELRVAIVDGQKLIDIDIETAGREQRKGNIYKGVVTRIEPSLEACFVNYGEDRHGFLPFKEVARQYFKEGIDMRSARIQDALREGQELIVQVEKEERGNKGAALTTFISLAGRYLVLMPNNPRGGGVSRRIEGDERQELRETMAQLQIPDGMSMIARTAGIGRSAEELQWDLNYLLQLWRAIEAASQSGNSGQPMLIYLESSLVIRAIRDYFQPDIGEILIDTTEIYDQARAFMDIVMPDNVSKVKRYHDDVPLFSRFQIEHQIETAYSRTVPLPSGGAIVIDHTEALVAIDVNSARATKGADIEETATRTNLEAADEVARQLRLRDLGGLIVIDFIDMESAKSQREVEQRLKDALKHDRARVQMGKISRFGLMELSRQRLRPALSEGSHVTCPRCNGTGHIRDTESSALQVLRIIQEEAMKENTAAIHCQVPVEVTAFLLNEKRQEINKIESRFKVGIVLIPNKHLDTPHYKARTPCVTTDARLDDPRASWKMAEEAARELESETGYSKRTADVKPKQEAAVKGITPERPAPSPAAPRPAEPVAVAPAPAPAPVAPASGGFIGWLKGLFGMAPAAAPAPAPVAPAPVSEPAARPARERTEKSEQRGGDRNRNRRGGPQAQGGRDQAAAGRGQSPRLEREGKEAREPREPREGREPREAREPREGREPRENREGREGREGREGRGPREGREPREPREIREPREAREPREPRERAEQLEAGDAAGRGERQERGERRERGERGERGERRKPTQHAATLETVNRGENHPDEEADQAAAVALPGADAAADAEASGEERRRRRRGRRGGRREREEEGAVAEQGVGDEAAVQEVATESSAAAPAHTAAAAAPVAVAAVAAAGAVVAETAVEQHAEAAAPAAVEPQPAPVRVEATPVAPLEPAIAAPAAATASVAPAAAVEAGPAPVAVSPTDAFEVPAEPAAVEAPQSAPVEHAAPAPVVAVEAAPAPAEPARVEAAPVEAARVEAAPVETVAAPAPATPAPAAAAPVSAGLEVVLEQAGLVWVNTDADKFRAAQEAASRLPRAARVPRERKPLPPADSTPMQQVETSQR

SEQ ID NO: 1347 - protein, 451 aa, Bacillus subtilis
MTHVRLTTPKALTFFPTEHELTYLRDFVKTAHHNIHEKTGAGSDFLGWVDLPEHYDKEEFARIQKSAEKIQSDSDVLLVVGIGGSYLGARAAIEALNHAFYNTLPKAKRGNPQVIFIGNNISSSYMRDVMDLLEDVDFSINVISKSGTTTEPAIAFRIFRKLLEEKYGKEEAKARIYATTDKERGALKTLSNEEGFESFVIPDDVGGRYSVLTAVGLLPIAVSGVNIDDMMKGALDASKDFATSELEDNPAYQYAVVRNVLYNKGKTIEMLINYEPALQYFAEWWKQLFGESEGKDEKGIYPSSANYSTDLHSLGQYVQEGRRDLFETVLNVEKPKHELTIEEADNDLDGLNYLAGKTVDFVNKKAFQGTMLAHTDGNVPNLIVNIPELNAYTFGYLVYFFEKACAMSGYLLGVNPFDQPGVEAYKVNMFALLGKPGFEEKKAELEKRLED

SEQ ID NO: 1348 - protein, 401 aa, Arabidopsis thaliana
MEPPKEQQNTPEKSISDAPATISSAFPPSGCCTNCGGPTISEAPPPLASFPEMSPPPNYRPIRAPAINLPHNSQAIILSPVPHAEQVPVVSPPYHFQSPVKRIHSPDDIRRFHESASCKNFLGFVVSLSESIRGFKISDPCHISPTVAAIVSILETLLQWIDEIPPAQQSARYGNVSFRSWHERLRERGESLILEFLPEEFKESVIEIVPYFFDSFGNSSRIDYGTGHETNFAAWLYCLARMGIVKEEDYHSLVARVFVKYLELMRKLQMVYCLEPAGSHGVWGLDDYHFLPFIFGSSQLIDHKYMKPKSIHNDDILENFSSEYMYLSCIAFVKKVKKGLFAEHSPLLDDISGVPNWKKVNSGLLKMYRVEVLEKVPIMQHFLFGWLIKWYDSSFFLLSRF

SEQ ID NO: 1349 - protein, 901 aa, Ostreococcus tauri
MPKCRVKFPSDLAKGTEVDAETIEDALQAFITKKPELKEILSSEKFRDFILVLSENQPENRDVIVPLDGKMSIAKDATYQAHLSRSYDLRSMTHPTRGYVVGRFRGERVPTFVAGEDAPVEWQMRRMKSEVNGTSMTLTGGKKSHRGTFVGTRDAQGASYFVLMSRGKEFVAMPCEEWYTFSHRAPRRVLTLEEAEAKMEAGKRAVGEAWGRMDKSAEPGGGRRRDLPGVDSIATTKTRGRSLVRLEERARKTRRERTGSTTRNGTTMRTSDAEDEGLDKEGLAVKKLLGKQEKMDGTQFSDSDSDSELEEDFNPDKDDIGVNVVGSFVKQSKKLEAEETKAATSPPAMMKSASVSSIGVKRSASDAAVDTAPPAYSNRSHHHRYRSQESGQHHGETHHQDVSQEGTAEQHRRRRGAQGGDQKLARHEKATKRRPSLSVEVIGLSSFTALARNRRPPMNSPTRHRESLRPRRSCRLKTFFARSPRRRRCTSLLPSYSSSLPDSEEEDFPAPQPAGDLTKRELATFDGKDPTKPILLAAKGVIYDVTRGRDFYGAGASYNAFAGKDCSRALGKVSLDAENLSANVRDFAASERDTLNGWVAKFQDKYPVVGKVKDGDYNGTLVANASIQLSTFGLARLLRELTKSETRHFDALSRHRGVALDAPRQTSVQLIGAGPGGADSLTLGAAKALARCDVVVHDDLGASSSSVLALATKPNVEFVSVGKRGGAARSWTQKDICALLVELGKSGKTVVRLKGGCPSTFARVSEEIKALRDAGVSYAMLPGVSSALSAPLSVGIPLTDRELGRHYSVCGAHDPSSIDFSAFSRIDTCVFLMVGRTLPLVVEALQGDARKAPSTPCCVIRNGMQPDERSWFGSLCDIVDKTTGESLSPCVLIVGEVVTLA

SEQ ID NO: 1350 - protein, 112 aa, Corynebacterium glutamicum
MKLITAIVKPFTLTDIKDALEQAGVQGMTVTETQGFGQQKGHTEVYRGAEYAVDFVPKVKIEVIISDAQAEEVINIIVETARTGKVGDGKVWMTNIEELVRVRTGERGEAAL

SEQ ID NO: 1351 - protein, 457 aa, Methanopyrus kandleri
MKVLLVQPPFEDDIARVLGVRGFPIGLVYLAAKLEKEGFSVDILDCPAEGVEMEDLRGRIRGYDAVGITATTPVAPSAYKVAKLAKDEGAFVFLGGPHPTFMDREALRESPADVVIRGEGESTTVEVLEAVDRWEESDLSNIPGITYREGSKIVRNPDRQEPEDLDSLPLPAYDKVDLDQYSADSVRFVPVITSRGCPFRCLFCASSRIFGPKWRGKSPDRVVEEISYLVEELGVERLEFVDDVFTAHKRRVREICEKMREEGIDVPWDCGARADTLTPELARTIREHGCRTVYVGAESASNETLKRINKGITVQDVIACRKVAKRHGLRILLSFILGFPWEDREDVFRTIKFARRLEPDYVQFTVCTPYPGTPLYDLAKERGLIEVHDWSKYTTVDPVMRTEHLSTRELGRLLQRAYLSFYLNPRYLLNALREGKLFLFKRIVKSGIRAVLSYLSR

SEQ ID NO: 1352 - protein, 515 aa, Pinus radiata
MKVVSEACVAFSLAYVYVLLLIGTATVEATPFHRIIPPLQSLYGRRGPSLSHDYRDALTKSILFYEGQRSGKLPLNQRMRWRGDSALSDGAAGHVDLTGGYYDAGDNVKFGFPMAFTTTMLSWSVLEFGGRMGDNLDHAKAAIRWATDYLLKATARPGVIYVQVGDPNLDHKCWERPEDMDTSRNVYKIDADHPGSDVAAETAAALAAASMVFRTTDPIYSRHLLQTAMQVFDFADKHRGAYSDSLQSEVCPFYCSYSGYNDELLWGAAWLQRASRNVSYISYIQSHGQNLGGEDNVNIFSWDDKHAGARVLLAKEVLLRNSKSLEEYRGHADNFVCSLLPGTPNSQAQYTPGGLLYKMSDCNLQYVTSTTFLLFTYPKYLRVSKQVVRCGNMVVTPTRIRTLAKRQVDYILGDNPLRMSYMVGYGAKFPERIHHRGSSLPSIYQHPQIIPCNDGFQSLYSNAPNPNRLVGAVVGGPDNNDHFSDERNDYAHSEPTTYINAPLVGSLAYLAHSFA

SEQ ID NO: 1353 - protein, 327 aa, Bifidobacterium longum
MGRMSERNEHNDGNTQTAYFAGGCFWGLERYFQNVDGVTDTTVGYAQSTVESPTYEQVCAGGTDAAETVKVEFDPAQVSLRTLTLLFLEVIDPFSVDQQGEDRGRQYRTGMFYTDETQRAVYVAALEQLVDRQPQRPAVLVEPLRNFYPAEAHHQDYLVNNPGGYCHVPIAAIANVKRRQKYVERIWDLTLEQFAVTQNAATERPFVNEYDEEFEPGIYVDIVSGEPLFSSQDKFDSGCGWPAFSRPIAGDLLTEHEDHRIPGRDRIEVRTSDTQIHLGHVFTDGPADRGGLRYCMNSAALRFVPRSRMAEEGYGDWISVVDGDEQA

SEQ ID NO: 1354 - protein, 88 aa, Magnetospirillum magnetotacticum
MHGLTVTEVKGYGRQKGHTEIYRGAEYAVSFLPKLKIEVAVASDLVTSVIDTIAGAARTGQIGDGKIFVMPLEKAVRIRTGETDADAL

SEQ ID NO: 1355 - protein, 462 aa, Unknown
  Nocardioides sp. JS614
MNSLLDLIGNTPLLRLSTSMGSLNGAKGPIVLAKVEYLNPGGSVKDRIATRMIEAAEASGELQPGGTIVEPTSGNTGVGLAMVAQAKGYRCVFVCPDKVSEDKRNVLKAYGAEVVVCPTAVEPEHPDSYYNVSDRLASQPGAWKPDQYSNPHNPRSHYETTGPEIWAQTEGRVTHFVAGVGTGGTISGTGRYLKEQNSSVQVIGADPAGSVYSGGTGRPYLVEGVGEDFWPEAYDRDVADRIIEVSDADSFAMTRRLAREEALLVGGSSGMAVHAAVQLAHELAGTPEGEDAVIVVLLPDSGRGYLTKVFNDDWLAQYGFPVDGAERSVQSVGEVLRGKSGRLPDLVHTHPNETIAEAVAILQEYNVSQMPVVRAEPPVVAAEVVGSVSERTLLDLLFTGSAKLTDSVGEHMAPPLPTIGSTEPASEAVAALEGADALLVHEDGKPVGVVTRHDLLAYLARG

SEQ ID NO: 1356 - protein, 447 aa, Thermococcus kodakarensis
MKYDVVVIGGSAGGLTAAISAKRFYPDKSVLVIKKEDVSMIPCGIPYIFGTLRSVEDDVLPTERFLKPLGIDVLVDEVTEINPKSKTLLTKSGREIGWEKLVLATGSRPQIPDIPGVELEGVYTVSKDYHYLKELKKRVEDAEKVVIIGGGFIALEVGDEIRKLGKDVTIVVRSRLLRNSFDPEFSEMIENRLKEVGINVVYGHVERLVGRERVEGVKLVEGGEIPADLVILSTGYRPNVELAVKTGLKVTRYGIWTDEYMRTSCPDIFAVGDCVEHRDFFTGKPFPLMLASTATFEARIAGANLFKLQIVRENRRTIGAYSTHVAGLTLAAAGLTEEAAKREGFEVIVGRATGPDRHPAKFEDTSMVTVKLIFSRDRGAILGAQLAGGKSVGEMINVLALAIQKRLTASELYTLQIATHPLLTASPVGYQILQAAEDALAKLRAGA

SEQ ID NO: 1357 - protein, 607 aa, Zea mays
  misc_feature (41)..(41): Xaa can be any naturally occurring amino acid
MDTHIGSVNGGGVERYRLGCPASRAGVGPMASTPGRSARRXAAGEASLGRHLARRLVQVWPNNVNALPFPLLSVVVHLIAEPGLRLVGCCNELNAGYAADGYARARGVGACAVTFTVGGLSVLNAIAGAYSENLPVICIAGGPNSNDYGTNRILHHTIGLPDFSQELRCFQTVTCHQAVVNNLDDAHEQIDTAIATALRESKPVYLSISCNLPGLPHPTFSRDPVPFFLTPRTSNKMGLEAAVEATVEFLNKAVKPVLVAGPKLRVAKAGKAFVDMVDASGYAYAVMPSAKGLVPETHPHFIGTYWGAVSTAFCAEIVESADAYLFAGPIFNDYSSVGYSFLLKKEKAIIVQPERVIVGNGPAFGCVMMKEFLSELAKRVNKNTTAYENYKRIFVPEGQPLESEPNEPLRVNVLFKHVQKMLTGDSAVIAETGDSWFNCQKLKLPEGCGYEFQMQYGSIGWSVGALLGYAQGANHKRVIAFIGDGSFQVTAQDVSTMLRCEQNSIIFLINNGGYTIEVEIHDGPYNVIKNWNYTGFVDAIHNGLGKCWTSKVKSEEELTAAIETALGEKKDCLCFIEVIAHKDDTSKELLEWGSRVSAANSRPPNPQ

SEQ ID NO: 1358 - protein, 257 aa, Pseudoroegneria strigosa
CELDNIMRLTGITGIVNGMDVSEWDPTKDKFLAVNYDVTTALEGKALNKEALQAEVGLPVDRKVPLVAFIGRLEEQKGPDVMIAAIPEIVKDEDVQIVLLGTGKKKFERLLKSVEEKFPGKVRAVVRFNAPLAHQMMAGADVLTVTSRFEPCGLIQLQGMRYGTPCACASTGGLVDTIVEGKTGFHMGRLSVDCNVVEPADVKKVVTTLKRAIKVVGTPAYQEMVKNCMIQDLSWKGPAKNWEDVLLELGVEGSEPG

SEQ ID NO: 1359 - protein, 320 aa, Gloeobacter violaceus
MHIAHDITELIGRTPLVQLNRIPAAEGALARIVVKLESFNPAASVKDRIGVSMINEAEKSGFILPGKTTLVEPTSGNTGIALAMVAAARGYRLILTMPETMSSERRALLRAYGAQLELTPGSEGMRGAIRRAEEITREVPDAFILQQFRNPANPKIHRETTAEELWRDTDGQMDIFVSGVGTGGTVTGVGEVWKVRKPGVQIVAVEPAASPVLSGGKPGSHLIQGIGAGFVPDVLRRDVIDEVIAVADEKAIEYSRRLAKEEGLLSGISTGAALWAALQLAKRPENTGKLIVFIQPSFGERYLSTALFQNEGQSPTAVAR

SEQ ID NO: 1360 - protein, 254 aa, Pseudoroegneria libanotica
DNIMRLTGITGIVNGMDVSEWDPTKDKFLAVNYDVTTALEGKALNKEALQAEVGLPVDRKVPLVAFIGRLEEQKGPDAMIAAIPEIVKDEDVQIVLLGTGKKKFERLLKSVEEKFPGKVRAVVRFNAPLAHQMMAGADVLTVTSRFEPCGLIQLQGMRYGTPCACASTGGLVDTIVEGKTGFHMGRLSVDCNVVEPADVKKVVTTLKRAIKVVGTPAYQEMVKNCMIQDLSWKGPAKNWEDVLLELGVEGSEPG

SEQ ID NO: 1361 - protein, 387 aa, Zea mays
MEAGGAGSGLNGAVQAKGTGADGGSAKPLPPCCVKARAAAPESEARCHATVVSGWFTEPRSRCGKASKVQYYNNPMWPGEANSLKVEKILYQGKSPYQEVLVFESSTYGKVLVLDGIVQLTDKDECAYQEMITHLPLCSIPSPKKVLVIGGGDGGVLREVSRHSSVESIDICEIDQLVIDVCKDFFPHLSVGFQDPRVQLHVGDAVEFLRNAPEGTYDAIIVDSSDPIGPAQELVEKPFFDTIARALRPGGVLCNQAESMWLHTHLVQDMLSICRETFKGSVRYAWTSVPTYPSGVIGFLLCAKEGPLVNFLTPINPIEKLEGATKAGREIRFYNSEMHRAAFVLPTFARRELEAYCVSTETEQAEETPAAPLKLTLASRSEIFATS

SEQ ID NO: 1362 - protein, 485 aa, Oceanobacillus iheyensis
MSNKNFPLIFERSKEGRTSYSLPELDVESFDLEAELGSEYVRQTPPELPEVSELDIIRHYTGLSNRNYGVDSGFYPLGSCTMKYNPKINEDIARLDGFSHIHPYQDVSTVQGAMAMMFDLQESLKEITGMHEVSLQSAAGAQGEWTALMMIRAFHESRGDYGRTKVIVPDSAHGTNPASAAVAGFEAVTVKSNQEGLVDLDDLRQVVGEDTAALMLTNPNTLGLFEKDILTMAEIVHEAGGKLYYDGANLNAIMGYVRPGDMGFDAVHLNLHKTFTGPHGGGGPGSGPVGVSEELAAFLPKPLIVKKNDGYDFDENRPQSIGRVKPFYGNFGINLRAYTYIRTMGAEGLKKVSEYAVLNANYMMRQLEDVFELPYPQHCKHEFVLSGSKQKKLGVRTLDMAKRLLDFGYHPPTIYFPLNVEEGLMVEPTETESKETLDGFIDTMRTIAKEVEENPEIVQEAPHQTIVKRMDETRAARKPVLRYHP

SEQ ID NO: 1363 - protein, 448 aa, Listeria monocytogenes
MAKHRYLPMTEQDEKEMLDVIGVKSIDDLFQDIPEKIRFKRDYDLKPAKSEPALLRELSKLASKNANTSEYASFLGAGVYSHYIPTVVDHVISRSEFYTAYTPYQPEISQGELQAIFEFQTMIAELTGMDLANSSMYDGGTALAEAAMLASGHTKRKKILISGAVHPESSNVLKTYATGQHIEVEVIPELDGKTDIEALKKALSDDIAGFVAQYPNFYGQVEPLAELEKLVHENNSLLLVSSNPLSLGLLTPPGEFGADIVVGDSQVFGIPESFGGPHCGFFAVTNKLMRKVPGRLVGETVDENGKRGYVLTLQAREQHIRRDKATSNICSNQALNALASSVAMATLGKTGLVEMAKQNLDKSHYAKQKFREKGFEVLFSDGFFNEFVVKLSKPIKEVNKSLLDEGIIGGYDLGFYEEKYKHHMLVAVTEMRTKEEIDAFVASLEGAK

SEQ ID NO: 1364 - protein, 529 aa, Thermosynechococcus elongatus
MDALALWQHYQDWLYYHPELEFYVDVSRMGLTPEVVHRLEPAFERAFEQMKELEAGAIANPDEGRMVGHYWLRDPDLAPSPELRSQIRDAIAQVKQFSQQVHSGAIAPPQGGHFTEILSIGIGGSALGPQFVAAALAPVHPPLNIHFLDNTDPAGFERVFAELGDRLRTTLVLVISKSGGTPETRNGMLEAQARFQRAGLAFADHAVAVTLPGSGLAQVAESNGWLAIFPMFDWVGGRTSELSTVGLLPAALQGIDIDDLLMGAKLMDQATRVPNIRQNPAALLALAWHHAGKGRGEKDMVILPYKDSLLLFSRYLQQLVMESLGKETDLNGNIVHQGIAVYGNKGTTDQHAYVQQLRDGLPNFFVTFIEVLRDGQEPSIEVEPGITAGDYLSGLLLGTRQALYEKNRPSLTVTIPEVTPKTVGALIALYERAVGLYGFLVNINAYHQPGVEAGKKAAAANLALQRQIVKVLEQSDEPLDLGAIAGAINAPDQLERIYLILRHLAANDRGIEQLGDPAQPSQLQFRWQR

SEQ ID NO: 1365 - protein, 449 aa, Oceanobacillus iheyensis
MEFRYLPMTNQDKQEMLDAIGIKSTEELFSDIPEHVRFKGEMNLKAPISEYELTKELTELASRNIHTKEYTSFLGAGVYDHYIPSVVDHVISRSEFYTAYTPYQPEISQGELQAIFEFQTMISELTGLPVANSSMYDGGTALAEAVNLSAAHTKRKKVLVSKAVHPEYRAVIDSYTRGQSIDIVEIDTVNGVTDLAQLDQAIDETIAGVVVQYPNFFGQLEPMKKIEQLLENHQKTMLIVSSNPLALGYLTPPGEFGADIVTGDTQVFGIPAQFGGPHCGYFATSKKLMRKVPGRLVGETVDEEGTRGYVLTLQAREQHIRRDKATSNICSNQALNALASSVAMSSIGKHGLRKLASVNMQKARYARKKLLEAGVELAFDGSFFNEFVIKVPGSVSKINKQLLDKGIIAGYDLAKDDKSLEGYMLIAVTEVRTKQEIDQFVKELGDIHV

SEQ ID NO: 1366 - protein, 257 aa, Elymus repens
CELDNIMRLTGITGIVNGMDVSEWDPIKDKFLAVNYDVTTALEGKALNKEALQAEVGLPVDRKVPLVAFIGRLEEQKGPDVMIAAIPEIVKDEDVQIVLLGTGKKKFERLLKSVEEKFPGKVRAVVRFNAPLAHQMMAGADVLAVTSRFEPCGLIQLQGMRYGTPCACASTGGLVDTIVEGKTGFHMGRLSVDCNVVEPADVKKVATTLKRAIKVVGTPAYQEMVKNCMIQDLSWKGPAKNWEDVLLELGVEGSEPG

SEQ ID NO: 1367 - protein, 103 aa, Lactobacillus johnsonii
MVDEITDATFEEETSEGVVLIDFWATWCGPCKMQSPVIDQLSEEMDDVKFTKMDVDQNQETARNLGIMAIPTLLIKKDGKIVDRLTGYTPKEKLEQILDQYTD

SEQ ID NO: 1368 - protein, 186 aa, Oryza sativa
MSAQIVPAPEHVCYVHCNFCNTIFAVSVPSNSMLNIVTVRCGHCTSLLSVNLRGLVQALPAEDHLQDNLKMHNMSFRENYSEYGSSSRYGRVPMMFSKNDTEHMLHVRPPEKRQRVPSAYNRFIKEEIRRIKANNPDISHREAFSTAAKNWAHFPNIHFGLGSHESSKKLDEAIGAPSPQKVQRLY

SEQ ID NO: 1369 - protein, 256 aa, Elymus repens
ELDNIMRLTGITGIVNGMDVSEWDPTKDKFLAVNYDITTALEAKALNKEALQAEVGLPVDRNVPLVAFIGRLEEQKGPDVMIAAIPEIVKEEDVQIVLLGTGKKKFERLLKSVEEKFPGKVRAVVRFNAPLAHQMMAGADLLAVTSRFEPCGLIQLQGMRYGTPCACASTGGLVDTIVEGKTGFHMGRLSVDCNVVEPADVKKVATTLKRAVKVVGTPAYQEMVKNCMIQDLSWKGPAKNWEDVLLELGVEGSEPG

SEQ ID NO: 1370 - protein, 207 aa, Brassica napus
  misc_feature (195)..(195): Xaa can be any naturally occurring amino acid
MDPCPFIRLTINNLALKAPQAAKTSSSVVHPSPSTSFCKIKLKNFPPQTAAIPYIPLDATQFPEIQTLAATFHLSSSDVARLSSRSIFASKPCLKIFIYTGRAGGACGVNPGRHVAEVSVPLDLAGAQGKQCVFHNGWISVGKGAGKESSFHLNVKAEPDPRFVFQFEGEPECSPQVVQIQGSIRQPGFTCNLGXADTSDRTMRSRS

SEQ ID NO: 1371 - protein, 527 aa, Pseudomonas putida
ASVHGTTYELLRRQGIDTVFGNPGSNELPFLKDFPEDFRYILALQEACVVGIADGYAQASRKPAFINLHSAAGTGNAMGALSNAWNSHSPLIVTAGQQTRAMIGVEALLTNVDAANLPRPLVKWSYEPASAAEVPHAMSRAIHMASMAPQGPVYLSVPYDDWDKDADPQSHHLFDRHVSSSVRLNDQDLDILVKALNSASNPAIVLGPDVDAANANADCVMLAERLKAPVWVAPSAPRCPFPTRHPCFRGLMPAGIAAISQLLEGHDVVLVIGAPVFRYHQYDPGQYLKPGTRLISVTCDPLEAARAPMGDAIVADIGAMASALANLVEESSRQLPTAAPEPAKVDQDAGRLHPETVFDTLNDMAPENAIYLNESTSTTAQMWQRLNMRNPGSYYFCAAGGLGFALPAAIGVQLAEPERQVIAVIGDGSANYSISALWTAAQYNIPTIFVIMNNGTYGALRWFAGVLEAENVPGLDVPGIDFRALAKGYGVQALKADNLEQLKGSLQEALSAKGPVLIEVSTVSPVK

SEQ ID NO: 1372 - protein, 418 aa, Pseudoalteromonas tunicata
MLERSMNIADFDPELFEAINKETARQEEHIELIASENYCSPRVLEAQGSQLTNKYAEGYPGKRYYGGCEHVDVVEQLAIDRANELFGTDYANVQPHAGSQANAAVFQALLQPHDTVLGMSLAHGGHLTHGSHVNFSGKTYNAIQYGLNEETGEIDYAQVEALALEHKPKMIIAGFSAYSGIVDWAKFREIADKVGAYLFVDMAHVAGLIAAGVYPSPIPFAHVVTTTTHKTLAGPRGGLIVSACGDQEIYKKLNSAVFPGGQGGPLCHIIAAKAVAFKEALQPEFKVYQAQVVKNAQAMVEVLQERGYKVVSGKTDNHLFLLDLIDKDITGKDADAALGNANITVNKNSVPNDPRSPFVTSGLRIGSPAITRRGFKEAESKELAGWICDVLDNINDASVQAQVKEKVKAICKKLPVYA

SEQ ID NO: 1373 - protein, 72 aa, Geobacter sulfurreducens
MSKEEAIEVEGTVIEPLPNAMFRVELENGHVVLAHISGKMRKYFIKILPGDKVTVELSPYDLTRGRITYRAK

SEQ ID NO: 1374 - protein, 112 aa, Burkholderia pseudomallei
MKLITAIIKPFKLDETREALSALGVSGITVTEVKGFGRQKGHTELYRGAEYVVDFLPKMKIEAAVSDDLVDQAVEAIERAARTGKIGDGKIFVTSIEQVIRIRTGETGADAL

SEQ ID NO: 1375 - protein, 332 aa, Candida albicans
MPFVNKSGFFDPSTAPYYDPKETRKVVFITGGNSGIGWYTVLHLYLHGYIVYVAGRTESKVLKAIDDIKAEAENRQAKETTKHPLGELNYIHIDLLDLSTVTKAVDEFAEKEKILDVLINNAGLMGVPYEVTKDDYEIQYQVNFVAHYLLTLKLLPFLQSAVKIGVTPRIINLASIGHNFQFKHFTPEQNKLDKFPNSVFTWVRYGIAKSSQIQFAKELANHYPDILSVSVHPGVILGTELYNHWKNIPIIGIGARGIFALSDKLIGVSNEEGSLATLRAALDPSLTLKENGEYLITGGKIDEPSKIASNTQYSKETWDWNYEQLKKRGYNI

SEQ ID NO: 1376 - protein, 167 aa, Blumeria graminis
MGPTTTLYDFMPKDKNGEPVPLEKYKGQVVLIVNTASKCGFTPQFEGLEKLYKSVSSTHPGKFTILGFPCNQFGGHDPGSNDEIQNFCRINYGVTFPMLGKVNVNGDTADPLFEWLKVEKPGIMGMKRVKWNFEKWLVSKDGKPIKRYSSTAGPEGFQSLIIEEIEK

SEQ ID NO: 1377 - protein, 579 aa, Unknown
  Nocardioides sp. JS614
MTHGPFDVWAPLPRRLRLAVAGETVAMRRGEGDWWTPAGPVPAGAELDYGYLVDDGEAPRPDPRSRRQPGGVHQLSRTFDPASYPWTDQAWTGRQLAGSVVYELHVGTFTPEGTFDAALEKLPHLREIGVDLVELMPVNAFNGTHNWGYDGVGWFAVHEGYGGPAGYQRFVDGCHAAGLGVIQDVVYNHLGPSGNYLPELGPYLKQGANTWGDFLNLDGPGSDEVRRYILDNVRMWLADYHVDGLRLDAVHALNDAGHQHLLEELAAEVAALSAHQRRPLTLIAESDLNDTRLVRPREAGGYGLDAQWSDDFHHAVHVALTGETAGYYADFEPLSALAKVCERGFFHDGTWSSFRGRDHGFPVDLRTMPTWRLVVCSQNHDQIGNRARGDRITEVLDDDQLACAALLTLCGPFTPMLFMGEEWAASTPFQFFTSHPEPDLGTATAEGRIAEFERMGWDPAVVPDPQDPATFERSKLDWAEATRGRHARMLDVYRRLARLRREHEALTDPSFGSVRCTADEHTRVFTMRRGDLLVAVNFGDAAATVETAAATLLFQTGAGLTLDAGRLSLPPHAGALVGP

SEQ ID NO: 1378 - protein, 447 aa, Corynebacterium glutamicum
MTVDEQVSNYYDMLLKRNAGEPEFHQAVAEVLESLKIVLEKDPHYADYGLIQRLCEPERQLIFRVPWVDDQGQVHVNRGFRVQFNSALGPYKGGLRFHPSVNLGIVKFLGFEQIFKNSLTGLPIGGGKGGSDFDPKGKSDLEIMRFCQSFMTELHRHIGEYRDVPAGDIGVGGREIGYLFGHYRRMANQHESGVLTGKGLTWGGSLVRTEATGYGCVYFVSEMIKAKGESISGQKIIVSGSGNVATYAIEKAQELGATVIGFSDSSGWVHTPNGVDVAKLREIKEVRRARVSVYADEVEGATYHTDGSIWDLKCDIALPCATQNELNGENAKTLADNGCRFVAEGANMPSTPEAVEVFRERDIRFGPGKAANAGGVATSALEMQQNASRDSWSFEYTDERLQVIMKNIFKTCAETAAEYGHENDYVVGANIAGFKKVADAMLAQGVI

SEQ ID NO: 1379 - protein, 640 aa, Corynebacterium diphtheriae
MCGLLGMLSSTGQASKYAAAIESALPCMHHRGPDEAGTWHDDHAVFGFNRLSIIDLEHSHQPLRWGPEGEPDRYAMTFNGEIYNYVELRKKLQDLGYTFNTSGDGETIAVGFHHWGADVVLHLRGMFGIAIWDTKEQRLFLARDQFGIKPLYFATTEAGTVFASEKKCILGMADAIGLDLGLDQRAIEHYIDLQYVPEPESLHQHIRRLESGCFAFVSVGGNVEQTRYFRPQFPAQEFPKDKEQDLFDRIAKALEDSVEKHMRADVTVGSFLSGGIDSTAIATLAKRHNPNLLTFTTGFEREGYSEVDVAAESAAAIGVEHIVKIVSPEEYANAIPQIMWYLDDPVADPSLVPLFFVAQEARKHVKVVLSGEGADELFGGYTIYKEPLSLAPFEKIPSPLRRGLGKVAEVFPDGMRGKSLLQRGSMTMEERYYGNARSFNFDQMKRVIPWAKKEWDHREVTAPIYAQSEHMDPVARMQHLDLFTWMRGDILVKADKINMAHSLELRVPFLDKEVFEVAETIPYDLKIANGTTKYALRKAMEQIVPPHVLHRKKLGFPVPMRHWLAGDELFGWAQDTINESMTDQYFDKAAVLAMLNEHKNGVSDHSRRLWTVLAFMIWHGIFVEHRIDPGIEKRDYPVYL

SEQ ID NO: 1380 - protein, 733 aa, Unknown
  Nocardioides sp. JS614
MQVWPGRAYPLGATFDGSGTNFALFSEVADRVELCLFDAEGSEGYRETRVELTEVDAYVWHCYLPAVQPGQRYGYRVHGPWDPENGQRCNPNKLLLDPYAKATSGEIDWDQSLFSYNFGDPEDSDARNDEDSAPHMTHGVVINPFFDWEGDRRLDYDYNESIIYEAHVKGLTQLHPDIPEELRGTYAALGHPAITEHLTKLGVTAIELMPVHQFIQDSTLLDKGLRNYWGYNTLGFFAPHADYAATGQPGQQVQEFKSMVKAMHAAGIEVILDVVYNHTAEGNHLGPTLSFKGIDNAAYYRLVEDDQRYYMDYTGTGNSLNVRHPHSLQLLMDSLRYWVTEMHVDGFRFDLASTLAREFYDVDRLSTFFELVQQDPVVSQVKLIAEPWDIGPGGYQVGGFPPQWTEWNGKYRDTVRDFWRGEPSLGEFASRLAGSADLYEHSGRRPVASINFVTAHDGFTLRDLVSYDEKHNEANGEDNNDGESHNRSWNHGVEGPTDDPEILEFRAREQRNFIATLLLSQGVPMLLHGDEMGRTQQGNNNTYAQDSELSWVHWDEADKPLVEFTAALSRLRRAHPTFRRKRFFTGGTVRVPDGGDGDRLNDIVWLHLDGRPMEDNDWTQSDSGAGAQALGMYLNGHGIAGRDERGGPIVDNHFLLYFNADGPAEVTLPPDEYADAWDVVVDTGGLVDDQTALAAGSTCSMASRSLIVLREHREPEAEVDHSVAASVAQARRG

SEQ ID NO: 1381 - protein, 488 aa, Listeria monocytogenes
MNLEETMPLVFERSIPGRIGFSLPESDVPETNAGDYFDQAYIRSIPADLPELSELEIMRHYTNLSNHNFGVDSGFYPLGSCTMKYNPKINEKVARFPGFANIHPNQPESSVQGALELLYDLQTSLVEITGMDEVTLQPAAGAHGEWTGLMLIRAFHEKNGDTKRTKVIIPDSAHGTNPASAAVAGFDVVTVKSNEKGLVDVADLKKVVGEDTAALMLTNPNTLGLFEKDIVEMAEIVHEAGGKLYYDGANLNAIMAKVRPGDMGFDVVHLNLHKTFTGPHGGGGPGSGPIGVKKELIPFLPTPVLTKKEDIYTFDYNYPDSIGRVKPYYGNFGINVRAYTYIRTMGPDGLKLVTEYAVLNANYMMRKLQEAYDLPFDQVCKHEFVLSGNRQKKLGVRTVDIAKRLLDHNFHPPTVYFPLIVGEAIMIEPTETESKETLDSFIDTMLKIAKEAEENPEIVQEAPHSTYVKRLDETRAARKPILRYQKEV

SEQ ID NO: 1382 - protein, 219 aa, Clostridium perfringens
MVSGTHYGNLQKVRGGKRTFGITPHIPGGFITPEQLEKIAKVTKKYNGVIKITSGQRLLITNLKGEDLPKIWDELGMEPAVKKQNSVKNVEMCPAGFCKRSKFNTIGTGMKLLNKYKHMDMPCRTKIGVAGCRNACGSVYSKDVGVIADKTGFLVTAGGSAGHNPRMADILIKDVDEKEALRIVDKIFEVYKGEAEAGEKLGDFIDRIGIEVFKEKTLA

SEQ ID NO: 1383 - protein, 212 aa, Xanthomonas campestris
MPMPSRSKSSQRWLKEHFADPFVKKAQAEGMRSRAAYKLEELLQRDRLLKPGMVVVDLGAAPGGWSQQVRKSMGASGRVVALDILEMPPLAGVEFLHGDFREQAVLSEFEAMLGDVPVDLVLSDMAPNKSGMDAVDQPRMMHLAELAMEFADTHLKVGGAFLIKLFQGVGSDDYIRELRRRYEKVTIRKPAASRKRSAEVYVLGQGKRAQIK

SEQ ID NO: 1384 - protein, 304 aa, Nitrosomonas europaea
MEFGMVGLGRMGGNMARRLARQSRKIAVMNRSFDVAEALVKETGHIACRDYTELVAVLEKPRIIWLMLPAGDVTETALSTLLPLLSPGDLIVDGANAHYQDDAPRAARCAERGIEFVDAGVSGGIWGLENGYCIMFGGSDTAAARLKPYLEVLAPTPTTGWLHTGPVGSGHYVKMIHNGIEYGMMQAFAEGFALMKDKSGFNLDLAEIAELWRHGSVVRSWLLDLSADFLAEDQMFDDIAPFVADSGEGRWTALASIEQGIPAPVIMLSLMMRFTTQGRNDYAAKMLAKMRHGFGGHAIKKGEQ

SEQ ID NO: 1385 - protein, 179 aa, Mannheimia succiniciproducens
MKKHHVDILISEQEVKARIQQLGAEITAYYRQQQVEKLIVVGLLRGSFMFMADLVREIKLPVEIEFMTTASYGSGMTTNHDVKITKDLDGDIKNQHVLIVEDIIDTGYTLEKVREILNLRTPASLKICTLLDKPSRREVEVPVDWIGFRIPDEFVVGYGIDYAQHHRNLGYIGKVVLEE

SEQ ID NO: 1386 - protein, 94 aa, Triticum aestivum
MEIPLEDIRRALMRTRANDPDKVQELMDSIRVIGLQVPIDVLEVDGVYYGFSGCHRYEAHQRLRLPTIRCKVRRGTKETLRHHMPMNWWPPMHG

SEQ ID NO: 1387 - protein, 466 aa, Glycine max
SYVGPPPTSGYATDNIIRVLRGERIGTVFHKDAHLWTSIKEVSAHEMAVAARNSSRRLQVLNSEERRKILLAMADALEINESVIRLENGADVADAEEMGYEKALISRLTLRPEKISSLVKSVRMLADMEEPIGQILKRTELADKLILEKISCPLGVLLVIFESRPDALVQIAALAIRSGNGLLLKGGKEAQRSNAILHKVITSVMPDTVGDKLIGLVTSREDIPDLLKLDDVIDLVVPRGSNKLVSQIKGTTKIPVLGHADGICHVYVDKTANIDMAKKIIRDAKIDYPAACNAMETLLVHVDLSRNGGLDELVAELQREGVQLYGGPRASNLLNISETHSFHLEYSSLACTVEIVDDVFAAIDHIHHHGSAHTECIVAEDSEVAEAFLSQVDSAAVFHNASTRFCDGTRFGLGAEVGISTGRIHARGPVGVEGLLTNRWILRGSGHVVNSDRGVTYTYKDLPVKA

SEQ ID NO: 1388 - protein, 118 aa, Cylindrocladium gordoniae
RSTGAKAPRKQLASKAARKSAPSTGGVKKPHRYKPGTVALREIRRYQKSTELLIRKLPFQRLVREIAQDFKSDLRFQSSAIGALQESVESYLVSLFEDTNLCAIHAKRVTIQSKDIQL

SEQ ID NO: 1389 - protein, 257 aa, Elymus repens
CELDNIMRLTGITGIINGMDVSEWDPTKDKFLAVNYDITTALEGKALNKEALQAEVGLPVDRKVPLVAFIGRLEEQKGPDVMIAAIPEIVKDEDVQIVLLGTGKKKFERLLKSVEEKFPGKVRAVVRFNAPLAHQMMAGADVLAVTSRFEPCGLTQLQGMHYGTPCACASTGGLVDTIVEGKTGFHMGRLSVDCNVVEPADVKKVATTLKRAVKVVGTPAYKEMVKNCMIQDLSWKGPAKNWEDVLLELGVEGSEPG

SEQ ID NO: 1390 - protein, 468 aa, Escherichia coli
MSKQQIGVVGMAVMGRNLALNIESRGYTVSIFNRSREKTEEVIAENPGKKLDPYFTVKEFVESLETPRRILLMVKAGAGTDAAIDSLKPYLDKGDIIIDGGNTFFQDTIRRNRELSAEGFNFIGTGVSGGEEGALKGPSIMPGGQKEAYELVAPILTKIAAVAEDGEPCFTYIGADGAGHYVKMVHNGIEYGDMQLIAEAYSLLKGGLNLSNEELAQTFTEWNNGELSSYLIDITKDIFTKKDEDGNYLVDVILDEAANKGTGKWTSQSALDLGEPLSLITESVFARYISSLKDQRVAASKVLSGPQAQPAGDKAEFIEKVRRALYLGKSVSYAQGFSQLRAASEEYNWALNYGEIAKIFRAGCIIRARFLQKITDAYAENPQIANLLLAPYFKQIADDYQQALRDVVAYAVQNGIPVPTFAAAVAYYDSYRAAVLPANLIQAQRDYFGAHTYKRIDKEGVFHTEWLD

SEQ ID NO: 1391 - protein, 426 aa, Hordeum vulgare
AQAVVQAMQCQVGVRGRTAVPARQPAGRVWGVRRAARATSGFKVLALGPETTGVIQRMQQLLDMDTTPFTDKIIAEYIWVGGSGIDLRSKSRTISKPVEDPSELPKWNYDGSSTGQAPGEDSEVILYPQAIFKDPFRGGNNILVICDTYTPQGEPIPTNKRHMAAQIFSDPKVTSQVPWFGIEQEYTLMQRDVNWPLGWPVGGYPGPQGPYYCAVGSDKSFGRDISDAHYKACLYAGIEISGTNGEVMPGQWEYQVGPSVGIDAGDHIWASRYILERITEQAGVVLTLDPKPIQGDWNGAGCHTNYSTLSMREDGGFDVIKKAILNLSLRHDLHIAAYGEGNERRLTGLHETASISDFSWGVANRGCSIRVGRDTEAKGKGYLEDRRPASNMDPYTVTALLAETTILWEPTLEAEALAAKKLALKV

SEQ ID NO: 1392 - protein, 171 aa, Hordeum vulgare
YNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGK

SEQ ID NO: 1393 - protein, 468 aa, Escherichia coli
MSKQQIGVVGMAVMGRNLALNIESRGYTVSIFNRSREKTEEVIAENPGKKLVPYYTVKEFVESLETPRRILLMVKAGAGTDAAIDSLKPYLDKGDIIIDGGNTFFQDTIRRNRELSAEGFNFIGTGVSGGEEGALKGPSIMPGGQKEAYELVAPILTKIAAVAEDGAPCVTYIGADGAGHYVKMVHNGIEYGDMQLIVEAYSLLKGGLNLSNEELAQTFTEWNNGELSSYLIDITKDIFTKKDEDGNYLVDVILDEAANKGTGKWTSQSALDLGEPVSLITESVFARYISSLKDQRVAASKVLSGRQAQPAGDKAEFIEKVRRALYLGKIVSYAQGFSQLRAASEEYNWDLNYGEIAKIFRAGCIIRARFLQKTTDAYAENPQIANLLLAPYFKQIADDYQQALRDVVAYAVQNGIPVPTFAAAVAYYDSYRAAVLPANLIQAQRDYFGAHTYKRIDKAGVFHTEWLD

SEQ ID NO: 1394 - protein, 1001 aa, Oryza sativa
MAAAAATSTLLLLLLLLLLATATHGAAADTVSSPASPEAAALLNLSAALGDPSGYLSTHWTHDTAFCSWPRLSCDADGSRVLSLDLSGLNLSGPIPAAALSSLSHLQSLNLSNNILNSTFPEGLIASLKNLRVLDFYNNNLTGALPAALPNLTNLVHLHLGGNFFFGSIPRSYGQWSRIKYLALSGNELTGEIPPELGNLTTLRELYLGYFNSFTGGIPPELGRLKELVRLDMANCGISGVVPPEVANLTSLDTLFLQINALSGRLPPEIGAMGALKSLDLSNNLFVGEIPASFASLKNLTLLNLFRNRLAGEIPEFVGDLPNLEVLQLWENNFTGGVPAQLGVAATRLRIVDVSTNRLTGVLPTELCAGKRLETFIALGNSLFGSIPDGLAGCPSLTRLRLGENYLNGTIPAKMFTLQNLTQIELHDNLLSGELRLDAGVVSPSIGELSLYNNRLSGPVPVGIGGLVGLQKLLVAGNRLSGELPREIGKLQQLSKADLSGNLISGEIPPAIAGCRLLTFLDLSGNRLSGRIPPALAGLRILNYLNLSHNALDGEIPPAIAGMQSLTAVDFSDNNLSGEVPATGQFAYFNATSFAGNPGLCGAFLSPCRSHGVATTSTFGSLSSASKLLLVLGLLALSIVFAGAAVLKARSLKRSAEARAWRLTAFQRLDFAVDDVLDCLKEENVIGKGGSGIVYKGAMPGGAVVAVKRLPAMGRSGAAHDDYGFSAEIQTLGRIRHRHIVRLLGFAANRETNLLVYEYMPNGSLGEVLHGKKGGHLQWATRYKIAVEAAKGLCYLHHDCSPPILHRDVKSNNILLDAEFEAHVADFGLAKFLRGNAGGSECMSAIAGSYGYIAPEYAYTLKVDEKSDVYSFGVVLLELIAGRKPVGEFGDGVDIVHWVRMVTGSSKEGVTKIADPRLSTVPLHELTHVFYVAMLCVAEQSVERPTMREVVQILTDLPGTAAATAMDAPSHGSGKEQDRSAEMQQQDGSRESPPQQDLLSI

SEQ ID NO: 1395 - protein, 100 aa, Arabidopsis thaliana
  misc_feature (76)..(76): Xaa can be any naturally occurring amino acid
RPRVRASSMLSSATMVASPGQGNKVAPFNGPKSSGAFPGNRKGNNDITSNISNGRRVNCMQVWPPIGKKKFETLSXLPDLNESELAKGIDQLIRNKLNPC

SEQ ID NO: 1396 - protein, 257 aa, Elymus repens
CELDNIMRLTGITGIVNGMDVSEWDPTKDKFLAVNYDITTALEGKALNKEALQAEVGLPVDRKVPLVAFIGRLEEQKGPDVMIAAIPEIVKDEDVQIVLLGTGKKKFERLLKSVEEKFPGKVRAVVRFNAPLAHQMMAGADVLAVTSRFEPCGLIQLQGMRYGTPCACASTGGLVDTIVEGKTGFHMGRLSVDCNVVEPADVKKVATTLKRAVKVVGTPGYHEMVKNCMIQDLSWKGPAKNWEDVLLELGVEGSEPG

SEQ ID NO: 1397 - protein, 189 aa, Brassica napus
RNRKSKSDIGEGSLPELMAEPANVKSMSFVGTHEYLAPEIIRNEGHGSAVDWWTFGIFIYELLHGATPFKGQGNKATLYNVIGQPLRFPEHSQVSSTAKDLIKGLLVKEPQKRIAYKRGATEIKQHPFFEGVNWALIRGQAPPHVPEPVDFSCYERKEKEKEFLPVLAAAVADGGKEKKVCDKATRGGS

SEQ ID NO: 1398 - protein, 250 aa, Aspergillus nidulans
MARRPARCYRYCKNKPYPKSRFNRGVPDPKIRIFDLGRKKANVDDFPLCVHLVSNEYEQLSSEALEAARICANKYVLTATEPDFRDEKKDMRREETILTMDYRYLVKIAGKEGFHLRVRVHPFHVIRINKMLSCAGADRLQTGMRGAFGKPQGKVARVNIGQIILSVRTRDSHRATAIEALRRSMYKFPGRQKIIVSKNWGFTPVRREDYVQLRQEGKLKQDGAYVQFLRGHGQIEENMRRFPDAYSTEA

SEQ ID NO: 1399 - protein, 491 aa, Arabidopsis thaliana
MSDIQAKEDAAPVDRQSSSSVVVPDEPSPLRKMISVASIAAGIQFGWALQLSLLTPYVQLLGVPHKWSSFIWLCGPISGLLVQPTVGYFSDRCKSRFGRRRPFIATGALLVALAVILIGFAADFGHTMGDKLDEAVKIRAVGFFVVGFWILDVANNTLQGPCRAFLGDLAAGDAKKTRTANAIFSFFMAVGNVLGYAAGSYTNLHKIFPFTVTKACDIYCANLKSCFIISITLLIVLTIIALWYVEDKQWSPNADSDNEKTPFFGEIFGAFKVMKRPMWMLLAVTALNWIAWFPFLLYDTDWMGREVYGGDSAGDDKMKKLYNHGIQVGSLGLMLNSIVLGVMSLVIGVISKKIGAKRLWGAVNIILAVCLAMTVLVTKKAEEHRKIAGRMALPTNAIRDGALSLFAILGIPLAITFSIPFALASIISSSSGAGQGLSLGVLNMAIVIPQMIVSFGVGPIDALFGGGNLPGFVVGAIAALISSVVALTVLP

SEQ ID NO: 1400 - protein, 104 aa, Zea mays
  misc_feature (94)..(94): Xaa can be any naturally occurring amino acid
PSLCSLHSSLHLQHCRLIHLLEWLALSAADASFFSAGGLEGYEKRLEITFSEAPRSGDPHGRGERALYRAQIDSDLDLARCTIASELSHKDFDXMVLSESSYVY

SEQ ID NO: 1401 - protein, 367 aa, Geobacillus kaustophilus
MELFQYMEKYDYEQVLFCQDKESGLKAIIVIHDTTLGPALGGTRMWMYNSEEEALEDALRLARGMTYKNAAAGLNLGGGKTVIIGDPRKDKNEAMFRAFGRFIQGLNGRYITAEDVGTTVADMDIIYQETDYVTGISPEFGSSGNPSPATAYGVYRGMKAAAKEAFGSDSLEGKVVAVQGVGNVAYHLCRHLHEEGAKLIVTDINKEAVARAVEEFGAKAVDPNDIYGVECDIFAPCALGGIINDQTIPQLKAKVIAGSANNQLKEPRHGDMIHEMGIVYAPDYVINAGGVINVADELYGYNRERAMKKIEQIYDNIEKVFAIAKRDNIPTYVAADRMAEERIETMRKARSQFLQNGHHILSRRRAR

SEQ ID NO: 1402 - protein, 347 aa, Rhodopseudomonas palustris
MPAFPLNAWYAAAWDADIKHALFPRTICGKHVVMYRKADGTVAALEDACWHRLVPLSKGRLEGDTVVCGYHGLKFNPQGRCTYMPSQETINPSACVRSYPVVERHRFVWLWMGDPVLADPALVPDMHWNDDPAWAGDGKTIYAKCDWRLVVDNLMDLTHETYVHGSSIGNEAVAEAPFDVTHGDRTVTVTRWMKGIEPPPFWAAQLGKPGLVDRWQIIRFEAPGTVTIDVGVAPAGTRAPEGDRSQGVNGFVLNTMTPETDTTCHYFWAFVRNYRLSEQRLTTEIREGVSGIFREDEIILEAQQRAMLENPDRVFYNLNIDAGAMWSRKLIDRMVAQESAPKLQAAE

SEQ ID NO: 1403 - protein, 257 aa, Elymus repens
CELDNIMRLTGITGIINGMDVSEWDPTKDKFLAVNYDITTALEGKALNKEALQAEVGLPVDRKVPLVAFIGRLEEQKGPDVMIAAIPEIVKDEDVQIVLLGTGKKKFERLLKSIEEKFPGKVRAVVRFNAPLAHQMMAGADVLAVTSRFEPCGLIQLQGMRYGTPCACASTGGLVDTIVEGKTGFHMGRLSVDCNVVEPADVKKVATTLKRAVKVVGTPAYKEMVKNCMIQDLSWKGPAKNWEDVLLELGVEGSEPG

SEQ ID NO: 1404 - protein, 554 aa, Unknown
  Shewanella sp. MR-4
MFCIQCEQTIRTPAGNGCSYAQGMCGKLAATSDLQDLLIYMLQGVSVYATKARELGVVDPEVDTFVPKAFFSTLTNVNFDDERIIAYAKQAAEYRESLKNAYEAACEAAGKSAESLPPVAQFVLGTSKPEMLSQAPVALLNKDKNDIHEDILGLRLLCLYGLKGAAAYMEHARVLGKTDAEIAGRFHEIMAFLGEPSVDADKLFITAMDIGQLNYRIMAMLDAGETEAFGHPEPTVVNTKAVKGKAILVSGHDMKDLELILEQTAGKGINVYTHGEMLPALAYPAFKKYAHLVGNYGSAWQNQQKEFANFPGAVVMTSNCIIDPNVGQYSDRIFTRSIVGWPGVTHVVGDDFSVVIDKALALDGFQYDEIPHNITIGFARNALMAAAPTVVENVKNGSIKHFFLVGGCDGDKSERSYFTDLAKSAPKDSVILTLGCGKYKFNKLEFGDINGIPRLLDIGQCNDAYSAIQLAIALSQIFECDINELPLNLVLSWFEQKAIVVLLTLLSLGVKNIRTGPTPPAFLTANLAKILEEKFGLRNTTTVEADLKTMLNVA

SEQ ID NO: 1405 - protein, 1072 aa, Vibrio vulnificus
MTESISLTLTNNESSRFLIRQRLLSILQAFGYDACRCDIHMLRIGEFVRITLADIQRFTLSFELDDDSLKVILASSELDPQTCSFPACVHTFQREKAIGVSIPSLIPLSDEILNQLTQFLAKPSRDELMSELKAKNQELAVHQAGLEKEIELRTADLKASEELSRTIIDGAPSSVAIVNESLFISLWNSTAQNVYGYSSEEATGENILTLLNMSLPDALSHVLSAPLALQNQPDVEGGFFEVETTTKEGHMVPIDLGVSIFELNGACHAALFLRDVTSRKAVEKELNDAKAKAEEAVEVKSMFLANMSHEIRTPMNAIIGMSHLALKTDLTPKQHDYVSKIHSSATLLLGIINDILDFSKIEAGKLSIETTEFYLDDVFHNVSMVTGQKAFEKGLELIFDLPRETPRCLLGDPLRLGQIIINLVNNSVKFTEKGEITVSVHHIRNVEDLVELEFRISDTGIGMTDKQMKSLFTAFTQADGSTTRKYGGTGLGLSICRRLVELMGGQIRVESEAGKGSHFIFNVLVKADPANSSAPSIVPQSLEKIRILVVDDNEHALEIMQEMLSTLPGKVALANSGQQAVDCIRKASEQREKFDLIFMDWNMPEMDGIETSRLIRESFASEYQPQIVIVTAYDKEDVLDATNDLDIAGFLSKPVGQSYLFDLLVELFGRDRNPTTQIRKKELPTHDSKNDLKGLKVLLTEDNEINQQIAVELMEGNGLLVTVANNGQEALDHLEAMAKGESHFDIIFMDLQMPVMDGYEASHRIRANSSYDTIPLIAMTAHAMVEERERCLNLGMNDHISKPIDPEILFNTIRKWCPRTLNEKDESPVDAEQSQTQQLDSSIESAATPKSTERAAAEKRTLETLESLDYKNGLLRVAGNQTLYRRLLSQLMDKEISAPERLTIALDKQDTEQAIIIAHSLKGSASNLGAIRLSDIASRLEMAIQHGKERAEIDKLNKELDGYLEHFFQDLALALGRPKPSSDKRLELKDEELMIIHTLDSLLDSLDAYAIEFLDEHYVLLNTLLKSEDFEACCRCVNDCDFESASKSLRKAVSIYPLDLGKLSGEKNGRES

SEQ ID NO: 1406 - protein, 336 aa, Bacteroides thetaiotaomicron
MRIGILTSGGDCPGINATIRGVCKTAINHYGMEVIGIHSGFQGLLTKDIESFTDKSLSGLLNQGGTMLGTSREKPFKKGGVVSDVDKPALILQNIQEMGLDCVVCIGGNGTQKTAAKFAAMGVNIVSVPKTIDNDIWGTDISFGFDSAVSIATDAIDRLHSTASSHKRVMVIEVMGHKAGWIALYSGMAGGGDVILVPEIPYNIKNIGNTILERLKKGKPYSIVVVAEGILTDGRKRAAEYIAQEIEYETGIETRETVLGYIQRGGSPTPFDRNLSTRMGGHATELIANGQFGRMIALKGDDISSIPLEEVAGKLKLVTEDHDLVIQGRRMGICFG

SEQ ID NO: 1407 - protein, 517 aa, Candida albicans
MKNFNALSRLSILSKQLSFNNTNSSIARGDIGLIGLAVMGQNLILNMADHGYTVVAYNRTTAKVDRFLENEAKGKSILGAHSIKELVDQLKRPRRIMLLVKAGAPVDEFINQLLPYLEEGDIIIDGGNSHFPDSNRRYEELAKKGILFVGSGVSGGEEGARTGPSLMPGGNEKAWPHIKEIFQDVAAKSDGEPCCDWVGDAGAGHYVKMVHNGIEYGDMQLICEAYDLMKRVGKFEDKEIGDVFATWNKGVLDSFLIEITRDILYYNDPTDGKPLVEKILDTAGQKGTGKWTAVNALDLGIPVTLIGEAVFSRCLSAMKAERVEASKALKGPQVTGESPITDKKQFIDDLEQALYASKIISYTQGFMLMNQAAKDYGWKLNNAGIALMWRGGCIIRSVFLAEITAAYRKKPDLENLLLYPFFNDAITKAQSGWRASVGKAIQYGIPTPAFSTALAFYDGLRSERLPANLLQAQRDYFGAHTFKVLPGQENELLKKDEWIHINWTGRGGDVSSTTYDA

SEQ ID NO: 1408 - protein, 333 aa, Chara vulgaris
MAEPVKVLVTGAAGQIGYALVPLIARGHLLGPDQPVILHMLDIAPCMDSLKGVEMELLDAAYPLLRGIVATSDVVEAATGVKVACMVGGFPRKAGMERKEVMGKNVSIYKEQATALEKYADKDVKVVVIANPANTNALVLKEYAPGIPSKNITCLTRLDHNRALGQIAQRVGVPVINVKNVAIWGNHSSTQYPDVNHGVVKTTEGVEKSIREAVADDEWLNGEFIKVVQQRGAAIIKMRKFSSALSAASAVCDHVSNWIRGTPAGTWVSMGVFSDGSYGVPAGLIYSFPVTTKNGDWEIVQGLPIDDFSRAKMDATAAELVEEKALADSIIKE

SEQ ID NO: 1409 - protein, 356 aa, Ustilago maydis
MSTASTSSSSKKHKVVIVGSGNWGSAIARIAGQNTQRHSDTFQREVQMYVFEEDYNGKPLSQVINETHENPKYLPGCKLPDNVIANPNPVDAVKDATLLVFVLPHQFIRSVCKQLKGHVNPDAHAISMIKGVEVKDGKISIFADVIQEALGVSCSALSGANIANEVAQDKFSETTIGHRPDAKGRENAELFFKLFDTPTFKVGIIEDVAGVSLCGALKNVVAIAAGFTDGLGWGDNAKAAVMRIGLMEMKRFSEEFFEGIKPETFTETSAGVADLITTCLGGRNRKCAEAFVKTGKPFDQLEKELLNGQKLQGTETAREVHELLAARGKVDDYPLFKAVYSIAYEGIDAHDLTSRL

SEQ ID NO: 1410 - protein, 150 aa, Lysichiton camtschatcensis
MTRRYWNINLEEMMEAGVHFGHGTRKWNPRMAPYISAKRKGIHITNLTRTARFLSEACDLVFNAASRGKHFLIVGTKNKAADSVASAAIRARCHYVNKKWLGGMLTNWSTTETRLQKFRDLRAEQKMGKINRLQKRDAAMLKRQLSTLKT

SEQ ID NO: 1411 - protein, 158 aa, Rhodopseudomonas palustris
MASIYDFTAKSLVGKDVSLKQFEGKVLLIVNTASACGFTPQYKGLEALQEKYGPRGFSVLGFPCNQFGAQEPGDEAQIAQFCSTNYGVTFPMFAKIDVNGAGAHPLYKFLKDEKGGLLGSAIKWNFTKFLVDRSGRVVSRHAPTTTPEALSKEIETLL

SEQ ID NO: 1412 - protein, 332 aa, Burkholderia pseudomallei
MKVAVLGAGAWGTALAAHLAVRHDTLLWARDAALVAELAARRENARYLGGVALPPGLRYEADLATALSHAQADDALCVIAAPVAGLRALCRAMRDARRVPAHFVWVCKGFEADTRRLPHQMVAEELPDHASYGVLSGPSFAREVAQGLPVALTVASASAACRERTLAAFHHGAMRIYTGDDVVGVEVGGAVKNVLAIATGIADGLGLGLNARAALVTRGLAEMSRLGVALGGRAETFTGLTGLGDLILTATGDLSRNRSVGLQLAAGRSLDDILAALGHVAEGVRCARAVLSIARERGVDMPITEAVCAVLFDGVAPRDAVSGLLRRDAKAE

SEQ ID NO: 1413 - protein, 167 aa, Saccharomyces cerevisiae
MQEFYSFSPIDENGNPFPFNSLRNKVVLIVNVASHCAFTPQYKELEYLYEKYKSHGLVIVAFPCGQFGNQEFEKDKEINKFCQDKYGVTFPILHKIRCNGQKQDPVYKFLKNSVSGKSGIKMIKWNFEKFVVDRNGKVVKRFSCMTRPLELCPIIEELLNQPPEEQI

SEQ ID NO: 1414 - protein, 356 aa, Methanopyrus kandleri
MNVDAVVLAGGFGTRLRPLTWDTPKPLVPILGKPLIEWVIRSLPRDVVHVHIAAGFSSEKLERYVESDPLPRKLHLKVEPKPLDTAGAIKFACRDSTADAFVAFNGDIVSSLDVRQMLKFHREHDGIATIALYPVPEDEVSRFGVVDLDDDDRILDFVEKPEPEEAPSNLINAGAYVLDREVLDYIPEGRPVSIEREIFPKLAEEGLLYGFKFEGYWVDVGLPETYLEAHRVLMEHECSGKSVVGARITDTDLKPPVVAAPMTELRSSEIGPYVYVGERTEINGSVIENSVILDDVEIIDSEVRNTIVAEGCKIENARLDGCVLGHDAEVCGCNLKGVRVAPGKEAERDLEDEWVI

SEQ ID NO: 1415 - protein, 150 aa, Symplocarpus foetidus
MTRRYWNIDLEEMMEAGVHFGHGTRKWNPRMAPYISAKRKGIHITNLTRTARFLSEACDLVFNAASRGKHFLIVGTKNKAADSVASAAIRARCHYVNKKWLGGMLTNWSTTETRLQKFRDLRAEQKMGKINRLPKRDAAMLKRQLSTLKT

SEQ ID NO: 1416 - protein, 447 aa, Bordetella pertussis
MKLQSLDDFLRRVAARDPQQAEFMQAVQEVMLSLWPFIEKHPHYAEHALLERLVEPERVIQFRVCWTDDQGQAQVNRAFRIQHSSAIGPFKGGMRFHPTVNLSVLKFLAFEQTLKNALTTLPMGGGKGGSDFDPKGKSDAEVMRFCQALMLELHRHLGPDTDVPAGDIGVGAREVGFMAGMMKKLSNSAASVFTGKGLCFGGSLIRPEATGYGTVYFAQEMLQRAGLSFDGMRVSVSGSGNVAQYAIEKAMALGAKVVTISDSCGTVIDEAGFTHEKLLALMHIKNDLRGRLDTYASQFGLRYEAGVRPWHVPVDVALPCATQNELDENDARTLIRNGVKCVAEGANMPATLDAAKAFIAAEVLYAPGKASNAGGVAVSGLEMSQNSARLPWTREQVNARLHAIMRDIHENCVRHGHGAGNYVNYVDGANIAGFVKVADAMRQQGLY

SEQ ID NO: 1417 - protein, 582 aa, Aspergillus oryzae
MAHITARINVAEYVFHRLRQLGVCSIYGVPGDFNLVALDYVRPSGLHWVGCSNELSAGYAADGYARVKGLAALMTTSGVGELSALNAIAGAYAEKVPLVHIVGTPPTYLQDQNAILHHSLGDGNSRLYASIYRSFTCAQANLTLASHAPVLIDETLRQCLLHSRPVYIEIPANMAKVIISASRLEEGIDTSLSLNEGSEVEQTVVKELLKSLYSASQPLIILDGWVSRYGLEQEADDIVRLAGFPVVTTPFGKGTANETYPNFCGVYTGAAGNSDFMRWVKSRDLVIRFAPMNADTNTFGFTALTSEAITIELHKFTINIRGENYLNMNTKSILRKIISELDPSRFAYDESCIEPRRLNMTGALDSPRPEASITQDIFWRYVSQFFHSDDIILTETGTPYAGGCDFVLPPNAKIINSALWLSIGYTLGASCGAALAQREMVKQGLRNKGRTILFEGDGSFQMTAQVLSDIIRNRLDLIIFLINNDGYTIERYIHGMEAYYNDIQPWRYLESPWYFGARKDDLEYPVFTKQVRTWADLERVLQSEHIIRGRGLSMIEVILEKDDAHPLLKRQMKIAKDQNGNS

SEQ ID NO: 1418 - protein, 646 aa, Unknown
  Mesorhizobium sp. BNC1
MCGFGGYFGAGVSEAEPLLRRMASAIAHRGPDERGTAVLDGAGLCHTRLSIVGLADGQQPMSLDGGRLTIAFNGEIFNYVELREALIARGRTFRTASDTEVILHLYDEKGPDCLADLNGDFAFAIWDAPRRRMFLARDRMGVRPLFYTSVGDRLFFASEVKTLLQVPGVEAEMDPFALDQMFTLWAPIAPRTAFKNIHELEPGHMMLVEEGRQAIRPYWSLSFPEHGAPSRHTDERAVAEELRALLTDATRLRMRADVPVGSYLSGGLDSSVISALAAGMTPEILRTFSVAFESAEHDESAFQNEVAAALGTMHASVNCGDGDIAAVFPDVIRFTERPILRTAPAPLFKLSALVRERGLKVVLTGEGADEVFAGYDIFKEARVRRFCARQPGSRMRPHLFRKLYPYLPGLKQQSAEYLAAFFGAGADSLDDPLFSHKPRMRATGAAKLFFSAQLRETLAGYDAAEELASRLPQEFPRWHPLHQAQYLESRFLLPGYILSSQGDRMAMAHGIEGRFPFLDHRLVEFATTLPPEMKLKGLVEKHILREATKGLLPESILRRTKQPYRAPDSASFRGAGEKDYVREAMSAEKLADCGLFNPASVSKLFAKSRQQPLSGFRDNAAFVGILSSQLWLETFTGSRIRAVEAA

SEQ ID NO: 1419 - protein, 503 aa, Desulfovibrio desulfuricans
MKVYLIGAGPGDPGLLTIKGRDILKRADVIVYDYLANDAFLNYAAPGAEIIYVGKKGGDHTLSQEGINRLIVEKAREGKVVARLKGGDPYVFGRGGEEAEELLDAGVNFEVVPGVTSAVAGPAYAGIPLTHRSYSSSVSFITGHEDPSKPESAHNWKALAASASTLVFFMGMKNLPEISRKLIEAGMDPDTPAALVRWGTTSRHRSLAATIATLPEEGKKAGFSSPSLIVVGHVVKLRDRLNWFEQLPLLGRGIVVTRAREQASGLAASLTQLGAEVIQFPTILIRPLEDYAPVHDAIRRLAEYDWLVFTSVNGVKHFWQQMGLLGLDSRALGGVKVAAIGPATADVLREKGIEPDFIPEKYVAEGVVKGMIERGMDGSRVLLPRARVAREVLPEELARAGARVDVLPVYETVPGDANRSHVLEMLEEGRIDCITFGSSSTVDNFFSLVEPEAMRRYEHVHMACIGPVTRKTLERYGFTCSIQPEDYTIPALVDELVRQLGAQ

SEQ ID NO: 1420 - protein, 73 aa, Leifsonia xyli
MAKKDGVIEIEGSVIEALPNAMFRVELTNGHKVLAHISGKMRQHYIRILPEDRVIVELSPYDLTRGRIVYRYK

SEQ ID NO: 1421 - protein, 196 aa, Brassica napus
  misc_feature (67)..(67): Xaa can be any naturally occurring amino acid
  misc_feature (153)..(153): Xaa can be any naturally occurring amino acid
  misc_feature (177)..(177): Xaa can be any naturally occurring amino acid
  misc_feature (189)..(189): Xaa can be any naturally occurring amino acid
MVKSSSDRVDSSSPSSSVAPFLRKCYEMVDDSSTDSIISWSTNGDNSFVISDTTVFSAQLLPKYFKXSNLSSFIRQLNIYGFRKVDADRCEFANDWFVRGQKELLKNVIRRKNVQSTSEHQSKTTTTDASQEKKSGESELWKEVDILKGDKKXLAQELVKVRQYQESTDTKMLHLEXRVQGMEESQARXMLSFLVM

SEQ ID NO: 1422 - protein, 179 aa, Unknown
  Malus x domestica x Pyrus communis
MASSMISSGTVATVSAPAQARMVAPFTGLKSSSAFPVTRKSNDITSIASNGGRVQCMQVWPPLGLKKFETLSYLPPLSTESLAKEVDYLLRKNWVPCLEFELEHGFVYRENNRSPGYYDGRYWTMWKLPMFGCTDSSQVLKELEEAKKAYPQSFIRIIGFDNVRQVQCISFIAYKPPGV

SEQ ID NO: 1423 - protein, 430 aa, Lotus japonicus
MAQILAPSTQWQTRITKTSPNASPITSNMWSSLLWKQNKKVARASKFRVLAIKSDGSTINRLEGLLNLDVTPYTDKFIAEYIWIRGTGVDVRSKSRTISKPVSHPSELPKWNYDGSSTGQAPGDDSEVILYPQAIFRDPFRGGNNILVICDAYTPQGEPIPTNKRHRAAEIFSNPKVQAEIPWYGIEQEYTLLQTDVKWPLGWPVGGYPGPQGPYYCAAGADKSFGRDISDAHYKACLYAGINISGTNGEVMPGQWEYQVGPSVGIEAGDHIWASRYLLERITEQAGVVLTLDPKPIEGDWNGAGAHTNYSTKSMREEGGFEVIKKAILNLSLRHQDHIRAYGEGNERRLTGKHETADINTFSWGVANRGCSIRVGRDTEKEGKGYLEDRRPASNMDPYVVTALLAETTLLWEPTLEAEALAAQKIQLKV

SEQ ID NO: 1424 - protein, 468 aa, Escherichia coli
MSKQQIGVVGMAVMGRNLALNIESRGYTVSIFNRSREKTEEVIAENPGKKLVPYYTVKEFVESLETPRRILLMVKAGAGTDAAIDSLKPYLDKGDIIIDGGNTFFQDTIRRNRELSAEGFNFIGTGVSGGEEGALKGPSIMPGGQKEAYELVAPILTKIAAVAEDGEPCVTYIGADGAGHYVKMVHNGIEYGDMQLIAEAYSLLKGGLNLSNEELAQTFTEWNNGELSSYLIDITKDIFTKKDEDGNYLVDVILDEAANKGTGKWTSQSALDLGEPLSLITESVFARYISSLKEQRVAASKVLSGRQAQPAGDKAEFIEKVRRALYLGKIVSYAQGFSQLRAASEEYNWDLNYGEIAKIFRAGCIIRAQFLQKITDAYAENPQIANLLLAPYFKQIADDYQQALRDVVAYAVQNGIPVPTFAAAVAYYDSYRAAVLPANLIQAQRDYFGAHTYKRIDKEGVFHTEWLD

SEQ ID NO: 1425 - protein, 459 aa, Methanosarcina barkeri
MIDRNHILLLQAPTPGPQNRIVAKPSAIPPLGLGYIASFLLNDGFEVRISDMDVEDVNVRELQQILESFSPIVVGISTTTLTFKNGLRVAKTVKHFLPTCIVCLGGPHVTVNYHEALNYPFVDIVVRGEGEITFLELCRAAAKENKLPLNIEGTAVRSKDEIITLPRRARIINLDALPFPARHLMPLHLYNIPGTILTSRGCPSNCGFCAGPVVMERKYIARSAKNVIAEVQMCIDKFRITSFYFVDDTMTHDTQRLMDICDGLRQIKIPPSITRNLKWTCESRADAVTPEILQDMRSAGCTTIQFGMESGSQQLLDQLGKKITLKQIENAVIWSREAGISPVLSMVFPHPNETEKTLQETFNFIRRLYEIGAEKIIPSLLTLFPGTRFMDQREKLGIKLLTNDTEEYNLGTPILTTRYLDLNSIANGYSQLLMLTQNLGGNEIGGIGIDDEQNNFSHP

SEQ ID NO: 1426 - protein, 247 aa, Oryza sativa
  misc_feature (36)..(36): Xaa can be any naturally occurring amino acid
MAIVAVTAGGRRPPCRRVPPAASPPARLSCRCATHXRRNVLSTMLSTSTVFLFGPKQITLAETTGGTFREYIDTFDGYSFLYPKSWIQVRGAGADIFFRDPFFLDENMSVEISSPSSSKYMTVEDLGPPEKAAERVLQQYLTEFMSTRLGVRRTSNILSASSKVADDGKLYYEVEVNIKSFASNNELAVMPQDRVQRLEWDRRYLSVLGVENKRLYELRLQSPEKVFKEEEGDLRRVMDSFRVNKTA

SEQ ID NO: 1427 - protein, 468 aa, Escherichia coli
MSKQQIGVVGMAVMGRNLALNIESRGYTVSIFNRSREKTEEVIAENPGKKLVPYYTVKEFVESLETPRRILLMVKAGAGTDAAIDSLKPYLDKGDIIIDGGNTFFQDTIRRNRELSAEGFNFIGTGVSGGEEGALKGPSIMPGGQKEAYELVAPILTKIAAVAEDGEPCVTYIGADGAGHYVKMVHNGIEYGDMQLIAEAYSLLKGGLNLTNEELAQTFTEWNNGELSSYLIDITKDIFTKKDEDGNYLVDVILDEAANKGTGKWTSQSALDLGEPLSLITESVFARYISSLKEQRVAASNVLTGRQAQPAGDKAEFIEKVRRALYLGKIVSYAQGFSQLRAASEEYNWDLNYGEIAKIFRAGCIIRARFLQKITDAYAENPQIANLLLAPYFKQIADDYQQALRDVVAYAVQNGIPVPTFAAAVAYYDSYRAAVLPANLIQAQRDYFGAHTYKRIDKEGVFHTEWLD

SEQ ID NO: 1428 - protein, 430 aa, Lotus japonicus
MAQILAPSTQWQTRITKTSPNASPITSNMWSSLLWKQNKKVARASKFRVLAIKSDGSTINRLEGLLNLDVTPYTDKFIAEYIWIGGTGVDVRSKSRTISKPVSHPSELPKWNYDGSSTGQAPGDDSEVILYPQAIFRDPFRGGNNILVICDAYTPQGEPIPTNKRHRAAEIFSNPKVQAEIPWYGIEQEYTLLQTDVKWPLGWPVGGYPGPQGPYYCAAGADKSFGRDISDAHYKACLYAGINISGTNGEVMPGQWEYQVGPSVGIEAGDHIWASRYHLERITEQAGVVLTLDPKPIEGDWNGAGAHTNYSTKSMREEGGFEVIKKAILNLSLRHQDHIRAYGEGNERRLTGKHETADINTFSWGVANRGCSIRVGRDTEKEGKGYLEDRRPASNMDPYVVTALLAETTLLWEPTLEAEALAAQKIQLKV

SEQ ID NO: 1429 - protein, 158 aa, Streptococcus intermedius
MTKIYDFSIFDQNNRSISLEIYKGNVLLIVNTATGCGLTPQYKGLQHLYTRYQNQGFEILDFPCNQFMGQAPGTAEEINRFCSLHYQTTFPRFAKVKVNGKEADPLYIWLKEQQAGPLGKRIEWNFTKFLINREGQVVKRFSSKAEPKEIEESLQKLL

SEQ ID NO: 1430 - protein, 468 aa, Escherichia coli
MSKQQIGVVGMAVMGRNLALNIESRGYTVSIFNRSREKTEEVIAENPGKKLVPYYTVKEFVESLETPRRILLMVKAGAGTDAAIDSLKPYLDKGDIIIDGGNTFFQDTIRRNRELSAEGFNFIGTGVSGGEEGALKGPSIMPGGQKEAYELVVPILTKIAAVAEDGEPCVTYIGADGAGHYVKMVHNGIEYGDMQLIAEAYSLLKGGLNLSNEELAQTFTEWNNGELSSYLIDITKDIFTKKDEDGNYLVDVILDEAANKGTGKWTSQSVLDLGEPLSLITESVFARYISSLKDQRVAASKVLSGRQAQPAGDKAEFIEKVRRALYLGKIVSYAQGFSQLRAASEEYNWDLNYGEIAKIFRAGCIIRARFLQKITDAYAENPQIANLLLAPYFKQIADDYQQALRDVVAYAVQNGIPVPTFAAAVAYYDSYRAAVLPANLIQAQRDYFGAHTYKRIDKEGVFHTEWLD

SEQ ID NO: 1431 - protein, 468 aa, Escherichia coli
MSKQQIGVVGMAVMGRNLALNIESRGYTVSIFNRSREKTEEVIAENPGKKLVPYYTVKEFVESLETPRRILLMVKAGAGTDAAIDSLKPYLDKGDIIIDGGNTFFQDTIRRNRELSAEGFNFIGTGVSGGEEGALKGPSIMPGGQKEAYELVAPILTKIAAVAEDGEPCVTYIGADGAGHYVKMVHNGIEYGDMQLIAEAYSLLKGGLNLSNEELAQTFTEWNNGELSSYLIDITKDIFTKKDEDGNYLVDVILDEAANKGTGKWTSQSALDLGEPLSLITESVFARYISSLKEQRVAASKVLSGRQAQPAGDKGEFIEKVRRALYLGKIVSYAQGFSQLRAASEEYNWDLNYGEIAKIFRAGCIIRARFLQKITDAYAENPQIANLLLAPYFKQIADDYQQALRDVVAYAVQNGIPVPTFAAAVAYYDSYRAAVLPANLIQAQRDYFGAHTYKRIDKEGVFHTEWLD

SEQ ID NO: 1432 - protein, 459 aa, Yersinia pestis
MADAPLSTAAPPSISRRNLAILITDILLFILLLNVLPFDTNANRGLAILAFIGILWLTEALHVTITALLVPLIAVGTGLMDVNTGLRSFANPIIFLFFGGFALATALHIQGLDKLIANRLLLAAKGQLMVAVLMLFGATALVSMWISNTATTAMMLPLALGVIGNLNLERERNTYVFILLGIAYSASIGGLGTLVGSPPNAIAAAQLGLDFVGWMKYGTPAMIILMPLMVATLYVILRPNLKHHFDIELEQLPWTAARRITIGIFGMTVIGWIFSSQLSQMLGGVKQFDTLVALSAVVLIGISGVASWRQIQQNTGWGVLLLFGGGLTLSVILRDSGASAVMAQGIVSIFGAYHWFIIILAVATFIIFLTELTSNTASAALLVPVFATVSEALGMPPLLLTMIIGIGASCAFMLPVATPPNAIVYGTGFIRQPEMVKVGFWLNIICIIVVSLLAWYLWY

SEQ ID NO: 1433 - protein, 219 aa, Leymus triticoides
  misc_feature (50)..(50): Xaa can be any naturally occurring amino acid
GRRRVEMEDRHVAKLALGGDPEVALFAVFDGHGGAAEFAAENMPKFMAEXVRKVDGGGSEEIEGAVKKCYLKTDEEFLKREESGGACCVAALLQKGGLTVSNTGDCRAVLSRAGTAEALASDHRASCEDERERIENLGGFIVNNRGTWRVQDSLAVSRGIGDAHLKQWVVADPDTRTLLVDPQCEFLVLASDGLWDKVDNQEAIDIARPLCIGNDKASR

SEQ ID NO: 1434 - protein, 221 aa, Leymus cinereus
GRRRVEMEDRHVAKLALGGDPEVALFAVFDGHGGKNAAEFAAQNMPKFMAEEVRKVDGGDSDEIEGAVKKCYLKTDEEFLKREESGGACCVTALLQKGGLTVSNTGDCRAVLSRSGTAATLTSDHRASREDERERIENLGGFVVNNRGTWRVQGSLAVSRGIGDAHLKQWVVADPDTRTLLVDPQCEFLVLASDGLWDKVDNQEAIDIARPLCIGNDKASR

SEQ ID NO: 1435 - protein, 994 aa, Vibrio fischeri
MKRMLINATQKEELRVALVDGQRLFDLDIESPGHESKKANIYKGKITRIEPSLEAAFVDYGADRHGFLPLKEIAKEYFPQGYTYQGRPNIKDVLKEGQEVIVQVEKEERGNKGAALTTFISLAGSYLVLMPNNPRAGGISRRIEGEERTQLKAALSTLELPQGMGLIVRTAGVGKSAEELEWDLNVLLNHWEAVKHASESNQAPFLIHQESNVIVRAIRDYLRRDIGEILIDSPKIFDRARQHIQLIRPDFLSRVKLYEGEVPLFSHYQIESQIESAFEREVRLPSGGSIVIDPTEALTSIDINSARATKGGDIEETALNTNLEAADEIARQLRLRDLGGLVVIDFIDMTPVRHQREVENRMREAVRMDRARVQIGRISRFGLLEMSRQRLSPSLAEASHHICPRCTGTGVVRDNESLALSVLRLIEEESLKDNTTQVLAVVPVSIASYLLNEKRRSVQHIEKFHDVRVIIVPNSDMETPHFEVIRIRDGEEQEMLSYLLPKKLEALREAESKEAPVVNIAPKKREEPVLQGFSAPTQAAPVAKAQPEKKAEAKTEEKPGIISRFFKAIANFFSAPEVSEKTEKKVEEEKPAQPQRRNQNRNNDRRRNNENGRNNRNNRRNGNDNRNENRRGKKQDDANATTGKQAKANDNKPTKQPKVRKEIAEQGLKLAADAQQAPAQNTEKQTEKREKTAQVKQRRQRRQLQKKVRTGKAVEAENDAVVAAQVEAQQSNTEVNTEKNTERKEGQRRNRRSPRHLRASGQRRRRRDRRPVNPSRLSSGVASPEMAMGKAYPDFARILEMKQAKQRQQEKFVDNETQAAQDKAPKVNVQIGGVAFPEMAMGKVLLPYVEASVATIKEAVQAPVVEEVKETTPAPVEVAVTEAPTATPVVNVVAETPVEPAVAEVNEVAVAEAAVKPVVEVEEVQPVVETKVAPKTQYKGHASSGMTKATGPTEIKEITVTAAEFRAERFTPKQAGSQTATSQASAAMAKTAAL

SEQ ID NO: 1436 - protein, 251 aa, Elymus repens
CELDNIMRLTGITGIVNGMDVSEWDPTKDKFLAVNYDITTALEGKALNKEALQAEVGLPVDRKVPLVAFIGRLEEQKGPDVMIAAIPEIVKDEDVQIVLLGTGKKKFERLLKSVEEKFPGKVRAVVRFNAPLAHQMMAGADVLAVTSRFEPCGLIQLQGMRYGTPCACASTGGLVDTIVEGKTGFHMGRLSVDCNVVEPADVKKVATTLKRAVKVVGTPAYHEMVKNCMIQDLSWKGPAKNGTGGRGERAG

SEQ ID NO: 1437 - protein, 194 aa, Zea perennis
IVNGMDVSEWDPSRDKYIAVKYDVSTAVEAKALNKEALQAEVGLPVDRNIPLVAFIGRLEEQKGPDVMAAAIPQLMEMVEDVQIVLLGTGKKKFERMLMSAEEKFPGKVRAVVKFNAALAHHIMAGADVLAVTSRFEPCGLIQLQGMRYGTCNVVEPADVKKVATTLQRAIKVVGTPAYEEMVRNCMIQDLSWK

SEQ ID NO: 1438 - protein, 118 aa, Brassica napus
  misc_feature (16)..(16): Xaa can be any naturally occurring amino acid
  misc_feature (21)..(21): Xaa can be any naturally occurring amino acid
  misc_feature (39)..(39): Xaa can be any naturally occurring amino acid
  misc_feature (42)..(42): Xaa can be any naturally occurring amino acid
  misc_feature (53)..(53): Xaa can be any naturally occurring amino acid
  misc_feature (56)..(56): Xaa can be any naturally occurring amino acid
  misc_feature (60)..(60): Xaa can be any naturally occurring amino acid
  misc_feature (64)..(64): Xaa can be any naturally occurring amino acid
  misc_feature (67)..(67): Xaa can be any naturally occurring amino acid
  misc_feature (82)..(82): Xaa can be any naturally occurring amino acid
  misc_feature (84)..(85): Xaa can be any naturally occurring amino acid
  misc_feature (89)..(89): Xaa can be any naturally occurring amino acid
  misc_feature (93)..(95): Xaa can be any naturally occurring amino acid
  misc_feature (97)..(97): Xaa can be any naturally occurring amino acid
  misc_feature (99)..(99): Xaa can be any naturally occurring amino acid
MASSMLSSAAVVTSPXQATMXAPFTGLKSSAAFPVTRKXNNXITSIASNGGRXSCXKVWXTSWXRRXLRPSSYLPDLTEVQXVXXKVDXLPPXXXGXPXVPVGTGFFGTSPTVYALLF

SEQ ID NO: 1439 - protein, 352 aa, Legionella pneumophila
MKKILFIDRDGTLVEEPFDFQVDSLDKIKLTSGVIPALLQLQKAGFTFIMVSNQNGIGTVAFPEEDFAVCHEFILDLFSSQGILFDEIFICPHTPEDNCICRKPKTGLLESYLKETAFAKQYSWVIGDRDTDKEFADNLGVNFLPISKTHTWEMVASAIINDARKASVQRKTKETAVDLSVQLDSDQTSVIDTPIPFFTHMLEQVAKHGGFDLRLQASGDLEVDEHHLIEDTAIALGEAIRTALGDKWGINRYGYTLPMDESLATIAIDISGRSFCDFKGQFTREFIGGMATEMIPHFFQSLSSALGATIHIEVTGINHHHMIEACFKVLGRALRQACSRTNNYLPSTKGVL

SEQ ID NO: 1440 - protein, 518 aa, Arabidopsis thaliana
  misc_feature (226)..(226): Xaa can be any naturally occurring amino acid
MAMAMALRRLSSSIDKPIRPLIRSTSCYMSSLPSEAVDEKERSRVTWPKQLNAPLEEVDPEIADIIEHEKARQWKGLELIPSENFTSVSVMQAVGSVMTNKYSEGYPGARYYGGNEYIDMAETLCQKRALEAFRLDPEKWGVNVQPLSGSPANFHVYTALLKPHERIMALDLPHGGHLSHGYQTDTKKISAVSIFFETMPYRLDESTGYIDYDQMEKSATLFRPKXLIVAGASAYARLYDYARIRKVCNKQKAVMLADMAHISGLVAANVIPSPFDYADVVTTTTHKSLRGPRGAMIFFRKGVKEINKQGKEVLYDFEDKINQAVFPGLQGGPHNHTITGLAVALKQATTSEYKAYQEQVLSNSAKFAQTLMERGYELVSGGTDNHLVLVNLKPKGIDGSRVEKVLEAVHIASNKNTVPGDVSAMVPGGIRMGTPALTSRGFVEEDFAKVAEYFDKAVTIALKVKSEAQGTKLKDFVSAMESSSTIQSEIAKLRHEVEEFAKQFPTIGFEKETMKYKN

SEQ ID NO: 1441 - protein, 974 aa, Rhodopseudomonas palustris
MTSLDPRTEMRARPSSHRTSRQGTMNPVKALEKHGQAIWLDFLARGFIAKGDLKKLIETDGVKGVTSNPSIFEKAIGASDEYDGAIGEALKKGDRSVGDLYETLAVEDIQNAADVLRPVYDKLEHRDGFVSLEVSPYLAIDTKGTLAEAERLWRAVNRENLMIKVPATREGLPAIKQLVSKGISVNVTLLFSQKVYVQVAEAYIAGLEALIASGGDPAHVASVASFFISRIDSAVDAALDDKIAKANDPSEKERLEELKGKVAIANAKLAYQDYKRLFSGDRWAKLEACGAKPQRLLWASTGTKNKAYSDVMYIEELIGQNTVNTVPPATLDAFRDHGEPRNSLEKDLDEARAVIKGLASTGVSLDAITDKLVTEGVQLFADAFDKLLGAVAFKRETVLAGRVGKQTLSLPGELANSVKQHTEAWRSAGKIRKIWSRDESVWTDHDEGKWLGWLHAPSVAKTKLTEYQDFAKWVKSQGFTDAVVLGMGGSSLGPEVIAETFPQQDGFPKLHVLDSTDPAQVRALEASVKLASTLFIVSSKSGGTTEPNVMKAYFFARVTEAIGADQAGRHFVAVTDPGSSMEKVATEQKFAKIFHGDPTIGGRYSVLSPFGLVPAAAAGIDLAKLLDSALAMVRSCGTDVPPQQNPAVQLGLVMGCAGLEGRDKVTITSSKAIADFGAWAEQLIAESTGKEGKGLIPIDGEPLADPSAYGNDRLFIDLRTEAETDAAHEAKLAALEAAGHPVVRIVLKSTEAIGQEFFRFELATAVAGAVLGINPFDQPDVESAKIKTRELTAAFEKSGALPAETPALSTAEADLYTDAGNAAALRKAGADGTVASWLKAHLSRVSAGDYVALLAYIERNAAHIEALQDIRLKVRDHRKVATCAEFGPRFLHSTGQAYKGGPDSGVFLQITADDAADLPVPGQSASFGVIKAAQARGDFDVLTERGRRALRVHLKGDLGAGLKSLGTAIKQALE

SEQ ID NO: 1442 - protein, 493 aa, Debaryomyces hansenii
MIPTTLRTLRTSSKRLPGSFSRCYALSANAQSLISKAVKDVDPEMAEILQQERNRQKSSITLIPSENFTSKAVMDLLGSEMQNKYSEGYPGERYYGGNEIIDKAESLCQKRALEAFDLNPEEWGVNVQPLSGAPANLYAYSAVLEVGDRIMGLDLPHGGHLSHGYQTPTTKISYISKYFQTMPYRLNEETGLIDYDTLEANAMLFRPKVIVAGTSAYSRIIDYKRMRQIADKVGAYLLSDMAHISGLVSAGVTDSPFPFSDIVTTTTHKSLRGPRGAMIFYRKGVRKVTKKGKEILYDLDKKINFSVFPAHQGGPHNHTISALAVALKQTSYPEFKEYQKDVVANAASFASELQSKGFTLVSGGTDTHLILVDLRSKNIDGARVEAVLERANIAANKNTVPGDKSALFPSGLRVGTPAMTTRGFGASEFARVAEFFERAVQISIDLKAQEQGSSSKELLASFKQLANSSSAVQELATEVKDWVSTYPVPGDLP

SEQ ID NO: 1443 - protein, 346 aa, Rhodopseudomonas palustris
MQIGMIGLGRMGGNIVRRLMKDGHHAVVYDRDPQAIETLTREGATGAGGLEDLVRKLDAPRAVWVMLPAGQITETTIEQLAKLLAAGDVVIDGGNTFWQDDIRRAKTLKETSIDYVDVGTSGGIWGFERGYCMMIGGDKAVVDRLDPIFATLAPGIGDIPRTPGRDDRDPRVEQGYLHAGPVGAGHFVKMVHNGIEYGLMQAYAEGFDILKNASSDSLPEAHRFDLDIADIAEVWRRGSVIPSWLLDLTATALAKNDQLDNYSGFVEDSGEGRWTINAAIEEAVPAEVLTAALFARFRSRREHTFAEKILSAMRAGFGGHKEPQQHPEPEQQAAPQQKLKPKAERA

SEQ ID NO: 1444 - protein, 550 aa, Yersinia pestis
MFCVQCEQTIRTPAGNGCSYAQGMCGKTAETSDLQDLLVAVLQGLSAWALQARELGIIDSQIDSFAPRAFFSTLTNVNFDSDRIVEYAKDAILLRHSLAVRCRLLDSTITVDHPLAELQLVADDIPSLLQQSQQFALNNDKADVGDDIHGLRMLCLYGLKGAAAYMEHAHVLGQSDEQIYAEYHAYMAWLGTQPRDVDTLLNNAMGIGKMNFNVMAILDQGETQAYGDPQPTSVNVRPVAGKAILISGHDLKDLHMLLEQTQGTGINIYTHGEMLPAHGYPELKRYPHLVGNYGSGWQNQQTEFAKFPGPILMTSNCIIDPNVGNYGDRIWTRSIVGWPGVNHLDGDNFAPVIEQALGMAGFPYSELEHLITVGFGRQTLLNAADTVIDLVASKKLRHVFLVGGCDGSRTERSYFTDFARSVPQDCIIMTLACGKYRFNKLDFGTLEGLPRLLDVGQCNDAYAAIMLAVKLSEKLGCTVNDLPLSLVLSWFEQKAIVILLTLLSLGVKNIYTGPTAPGFLTDNLMAILYEKFGMQPITTVEQDMQAILGH

SEQ ID NO: 1445 - protein, 333 aa, Thermus thermophilus
WGLGSRTGPGSKRLQGLLDDRQRLMYDGATALAEGVLLALRETGRMGVLVSQGVHPEYRAVLRAYLEAVGAKLLTLPLEGGRTPLPEVGEEVGAVVVQNPNFLGALEDLGPFAEAAHGAGALFVAVADPLSLGVLKPPGAYGVDIAVGDGQSLGLPMGFGGPHFGFLATKKAFVRQLPGRLVSETVDVEGRRGFILTLQAREQYIRRAKAKSNITTNAQLTALMGAMYLAALGPEGLREVALKSVEMAHKLHALLLEVPGVRPFTPKPFFNEFALALPKDPEAVRRALAERGFHGATPVPREYGENLALFAATELHEEEDLLALREALKEVLA

SEQ ID NO: 1446 - protein, 618 aa, Spinacia oleracea
MASSLSNLYSSTSLKPKISHLPTITKNPISGPKSLSFKPISSVARDTPADLSTSSSSSTNNLPSLQKKKADGSLEKDPRALWARYVEWLYQHKDLGLYLDVSRIGFSDEFVKEMEPRFEKAFKHMEGIEKGAIANPDEGRMVGHYWLRNSSLAPTTFLKNQIDVTLDRVWQFANDVISGKIKAPTGERFTHILSVGIGGSALGPQFVAEALAPDNPPLKIRFIDNTDPAGIDHQIAQLGPELATTLVMVISKSGGTPETRNGLLEVQKAFRDAGLVFAKQGVAITQENSLLDNTARIEGWIDRFPMFDWVGGRTSEMSAVGLLPAALQGIDIKEMLAGAALMDEATKIPVLRSNPAALLAMSWYWASDGVGSKDMVVLPYKDSLLLFSRYLQQLVMESLGKEFDLDGNKVNQGLTVYGNKGSTDQHAYIQQLRDGVHNFFATFIEVLRDRPPGHDWELEPGVTCGDYLFGMLQGTRSALYANNRESISVTVQEVTPRSVGAMVALYERAVGLYASLVNINAYHQPGVEAGKKAAAEVLALQKRVLAVLNEASCKDPVEPLTIEEVADHCHCPDDIEMIYKIIAHMAANDRVILAEGDCGSPRSIKAFLGECNVDELYA

SEQ ID NO: 1447 - protein, 160 aa, Myrica gale
MSTVEGREFSEDQEALVVKSWTVMKLNAGELALKFFLKIFEIAPTAQKLFSYLKDSNVPLERNSKLKSHATNVFMMTCESAVQLRKAGKVTVTESSLKRIGDVHFKLQVVDEHYEVTRFALLETIKEAVPEMWSPEMKNAWGEAYDQLVSAIKTEMKPPS

SEQ ID NO: 1448 - protein, 266 aa, Oryza sativa
HALNSPLLNTALTSHLQSHGGRAPHATTAAPTTAHGLHRRLWHCRPGGGGGVRPEDGAQDPGAIRVAERRREAGVGGGAGHARGRRGRAPRRRRRGAAPRRGAGGRRVRHARVLPGVSEEMKELSLTIMELLELSLGVERGYYREFFADSSSIMRCNYYPPCPEPERTLGTGPHCDPTALTILLQDDVGGLEVLVDGEWRPVSPVPGAMVINIGDTFMALSNGRYKSCLHRAVVNQRRERRSLAFFLCPREDRVVRPPPSAATPRH

SEQ ID NO: 1449 - protein, 291 aa, Burkholderia mallei
MRKTTVAVTQMACDWNVDANLSRAERLVRDAAARGAQIVLLQELFETPYFCIDQHPAHLALAQPYEGHPWLMRFASLARELGVVLPVSFFERAGQTQFNSVAIFDADGRALGIYRKTHIPDGPGYTEKYYFTPGDTGFRVWDTAYGRIGVGICWDQWFPECARAMALAGAELLLYPSAIGSEPHDASIDSRAHWRNAQRGHAAANLMPVAASNRVGVERGASGEIVFYGSSFIAGADGEMIVECDRHGEAIATAEFDLDALAYRRRGWGVFRDRRPECYRALSEGAADRVR

SEQ ID NO: 1450 - protein, 506 aa, Oryza sativa
MAAMMASITSELLFFLPFILLALLTFYTTTVAKCHGGHWWRGGTTPAKRKRMNLPPGAAGWPLVGETFGYLRAHPATSVGRFMEQHIARYGKIYRSSLFGERTVVSADAGLNRYILQNEGRLFECSYPRSIGGILGKWSMLVLVGDPHREMRAISLNFLSSVRLRAVLLPEVERHTLLVLRAWPPSSTFSAQHQAKKFTFNLMAKNIMSMDPGEEETERLRREYITFMKGVVSAPLNLPGTPYWKALKSRAAILGVIERKMEERVEKLSKEDASVEQDDLLGWALKQSNLSKEQILDLLLSLLFAGHETSSMALALAIFFLEGCPKAVQELREEHLGIARRQRLRGECKLSWEDYKEMVFTQCVINETLRLGNVVRFLHRKVIKDVHYKGYDIPSGWKILPVLAAVHLDSSLYEDPQRFNPWRWKSSGSSGGLAQSSSFMPYGGGTRLCAGSELAKLEMAVFLHHLVLNFRWELAEPDQAFVFPFVDFPKGLPIRVHRIAQDDEQE

SEQ ID NO: 1451 - protein, 202 aa, Corynebacterium glutamicum
MTVAPRIGTATRTTSESDITVEINLDGTGKVDIDTGLPFFDHMLTAFGVHGSFDLKVHAKGDIEIDAHHTVEDTAIVLGQALLDAIGDKKGIRRFASCQLPMDEALVESVVDISGRPYFVISGEPDHMITSVIGGHYATVINEHFFETLALNSRITLHVICHYGRDPHHITEAEYKAVARALRGAVEMDPRQTGIPSTKGAL

SEQ ID NO: 1452 - protein, 256 aa, Arabidopsis thaliana
MGKQINIESSATHHQDNIVSVITATISSSSVVTSSSDSWSTSKRSLVQDNDSGGKRRKSNVSDDNKNPTSYRGVRMRSWGKWVSEIREPRKKSRIWLGTYPTAEMAARAHDVAALAIKGNSGFLNFPELSGLLPRPVSCSPKDIQAAATKAAEATTWHKPVIDKKLADELSHSELLSTAQSSTSSSFVFSSDTSETSSTDKESNEETVFDLPDLFTDGLMNPNDAFCLCNGTFTWQLYGEEDVGFRFEEPFNWQND

SEQ ID NO: 1453 - protein, 275 aa, Bacillus cereus
MELWFTEKQTKHFGITARINRTLHTEQTEFQKLDMVETEEFGNMLILDGMVMTTEKDEFVYHEMVAHVPLFTHPNPENVLVVGGGDGGVIREVLKHPSVKKATLVEIDGKVIEYSKKYLPSIAGALDNERVEVKVGDGFLHIAESENEYDVIMVDSTEPVGPAVNLFTKGFYAGISKALKEDGIFVAQTDNPWFTPELITTVFKDVKEIFPITRLYTANIPTYPSGLWTFTIGSKKHDPLEVSEERFHEIETKYYTKELHNAAFALPKFVGDLIK

SEQ ID NO: 1454 - protein, 1002 aa, Aquifex aeolicus
MKVVIVGNGIAGTALVEEILRLSSGKDIRIQVFGDEKFIGYNRVLITEVLAGRKTLSEIYIKRWQWYEEKGVRLEIGKKVERLFPNKKILVTKDGEFYRYDKAIIATGSKPFIPPSIKGVNKKGVFTYRTAKDVFEILDYARVSKRAVVIGGGLLGIEVTKALRDIGLEVFLVHILDTLMEQQLDKTASELLRKDLEDMGIKVLLKKVTEEILGEKKAEGVRFSDGDELLADFVIIATGIRPNVEVGVNSGLKVNKGIVVNDYLETSASDIYAVGECIEHRGKTYGLVAPIMEQVKVCAHNVVHGNEKKYTGSLTYAMLKVAGVNLFSAGEINEKDGDEVVAFLDNGRSLYRKAVIRNNKIVGTILYGDVRGNNYLLDLIKSGKDISEERPYFLIKHILPKGTTGVEELKDNDIVCNCNAVTKGEIVKCIKEGCKTLEEIQERTKASTSCGSCIELVEEILKHYVKEKPKRVNKIEVIKKELHPFDLEFKKRLEKYFSEGELENIPEEDRDVRLKWYGIFYRKATPGYFMVRIRVPNGRLSYEQAKVVSHISEKFCRGEVEITSRQQLQIRWIKLKDLPEILEALNRVGLSTLQTGMDNVRNVTGDPLTGLAEDSLIDTLRLSQEITNIFLGKKKYADLPRKLNVAVLGSQTDCINALFNDVCFYLSEKDGKLGFNLYLGGKIGSGGPKKAIDMDMFVEPYEVPEVFKATLDIYSTFGNRENRSKNRLYFLLQEWGVERFREELEKRLYKAIPSKGKDLVNKTGEREGIINLRNGTYAVCVVVPAGKIKAKDFRQIAELARKYGSRELRLSVYQNIYIPNIPEENLNPLLGEEIFEKFSTVSSPFTMHLIACAGSDTCSFGVIPNKSDAVRVAKYLSERLKLDIPVRMHWSACAKGCGQHGSGDIGFVGTKTKLNGKAVLAVDVFVGGSPTKEGFKVIQGLPLDKVEEASYLLLNYYLENRLEGESFADFAHRVGVDKLKVVLTSLLQEGECKLLKPESISK

SEQ ID NO: 1455 - protein, 433 aa, Neisseria meningitidis
MPSETARPLYADTCAAHTLVWFRQNLRIRDNAALCAAVAEGLPVIGIWIDDAETDNPRRAAFYRQSAAELAQGLAGRGIPLYTAASPAELVRLAVRLNIRAVIADESHTFADKLADNALWHELDKHGIALTFVNDRAVFGKTDLIPDGGTAHTDFDRYREVWLDRFSKQPPAGPDLFAAYRQPFPENLSAPPPAALSDGIFLPQNSGETAAWRQWRRFLEQADSYSVLKDFPSRKHTSLMGAYLSAGCISPRLLARESLERRLNAWADNIIRRDFFLQLALQHTDDDPSDGNPEHTLRLTLWQQGQTGIPIIDAAMRCLHKTGSLHPALRRLSADFFCHVLNLPRREGEIWFARQLTDFDAAINQGNWWLAASRHTCPDIAAASYRTDPDGTFIKRHIPELAHLSADTVHTPWRFACSVDTHGYPAYPVAGIP

SEQ ID NO: 1456 - protein, 496 aa, Unknown
  Marinobacter sp. ELB17
MSEEILINVTPVETRVALVENGMLQEAYIERASRKGIVGNIYKGKVVRVLPGMEAAFVDIGLERAAFIHASDVVTSQPGSDDISDGPRMVPDIRTLLREGQSLVVQVTKDPIGTKGARLTTQLSIPSRYLVFMPGVNHIGISQRIEDDAERARLKAIVDGAASEQASSVAIQGGYIIRTAAEAASADDLTADMKYLHRLGQSINERMGKVQAPAVIYQDLPLFIRTIRDLIRPQTEKVRIDSRESHQRVMEFVHEFVSEFADKVEYYPGERPIFDLYSVEDEIQKALSRKVQLKSGGYVIIDQTEAMTTIDINTGAFVGHRNLEETIFKTNLEAARAISRQLRLRNLGGIIIIDFIDMDDAEHKRQVHRMLEKMLERDHAKTKITGVSELGLVEMTRKRTTESLGQVLCEPCPICDGRGFLKTGETVCYEIFREILRVNRAYDTESYLVMASQRVVDLLVDEESDNVADLETFICKTIRFQVEPFYSQEQYDVVLL

SEQ ID NO: 1457 - protein, 244 aa, Aquifex aeolicus
MGKVYLIGAGPGDPELLTLKAYRILRKADVVLYDALVNREILHFARQDSLKIYVGKRDGKHSLPQEEINELLHRFALSYKIVVRLKGGDPFVFGRGGEELLYLKSRGVEVEIVPGITSAISAPSSAFIPVTHRGIASSFAVVTGHPNREIKWEDLVNIDTLVVLMGVKNREKIARELIGAGRNPDEPVAFIEKATTPEQREVFSTLKEVAQNPPEVNPPAVMVVGKVVEIGAKVLCERIIGVTL

SEQ ID NO: 1458 - protein, 450 aa, Clostridium perfringens
MKKGLVVDLSKAAPYLKSHEVAYMQETINQAHNKLHNGTGAGNDFLGWVDLPVNYDKDEFARIKEAAKKIQSDSDVLVVIGIGGSYLGARAAIEMLTNNFYNSMSKDKRKTPAIFYAGNNISSSYMADLLKAIDGLDVSLNVISKSGTTTEPAIAFRILKDYMEKKYGKEEAKKRIYATTDAKKGALKTLADAEGYETFVIPDDVGGRFSVLTAVGLLPIAAAGINIDEMMEGAADAREEYANPSLADNECYKYAAARNALYNKGKAIEILVNYEPSVHYFNEWWKQLYGESEGKDNKGLFPAAVDFSTDLHSMGQYIQEGRRDIFETVINVGSPREEIVIEVNDENIDGLNFLAGKTMDYVNKQAFRGTLLAHNDGEVPNLVVNVPELTPYYFGRLVYFFEKACGISGYVLGINPFDQPGVEAYKKNMFALLGKPGFEDLKAELEERLK

SEQ ID NO: 1459 - protein, 121 aa, Unknown
  Mycobacterium sp. MCS
MTTIYEQIGGAEALEGVVEDFYGRVLADEQLSGFFTGTNMARLKGRQVEFFAAALGGPEPYTGAPMRQVHQGRGITMHHFNLVAGHLTDALHAAGVPEALVGQIIGAVAPLADEIATARTA

SEQ ID NO: 1460 - protein, 102 aa, Oryza sativa
MTESRETTRSGSPSADGGEEGEVAAARRRREPEASAAYFTAGLTALFACLAALLVFLPLVLPPLPPPPSLLLLVPVGLMAVLLALAFLPADGRRSSIASSCV

SEQ ID NO: 1461 - protein, 500 aa, Idiomarina baltica
MLKIKSTDSNRTLLSLDDSYLFDDVHDWRAQRLTEIDLKPAKQQLVIGEYKNVTEGRKVTHTLCRSRAAIEALQQPTHSFTAIVNKIRSSQWLGVTGKPITDVVNIGVGGSDLGPQMASFALKEFDDESSSSAVDVHFVSSMDGGQLYAVLPIVDPETTLFVIASKSFGTIDTFANVDTVKCWVNHVMSESAWLEHHVIGVSSNKEKMTAYGIPEHHQLSFDEGVGGRFSLWSTIGLSIAVSIGMAPFCKMLAGALAVDEHFLTVPDNDNVPVRLALNGVYLRQQKGINNLAILPYDGRLRMLPSYLQQLDMESNGKQATRDNKSLHQPTGPILWGGFGPNGQHAFYQHLHQGYDDFAADFVLVLNRSATRFPPQVAASLQQQQRLSVANCLAHRRLLWWGDKSVESPRDNYPGSHASNLLLLDELTPESFGALIAVYEHKIFIQGLLWDVNSFDQPGVEKGKKYALSVLDALSDNQSEDFDDVTNALIDYYRQHINRDS

SEQ ID NO: 1462 - protein, 115 aa, Methanosarcina barkeri
MTKMCKIEAIIKPMKLHEVKDALEEAGYPSLTVTDVKGRGQQKGIVQQWRGKKYCVDLLPKTKIEIAAPEDKIEEIIKIIQSSAYTGEIGDGKIFVTPIETVVRIRTGERNGDAL

SEQ ID NO: 1463 - protein, 136 aa, Mannheimia succiniciproducens
MMRILHTMLRVGDLDRSVKFYQDVLGMRLLRTSENPEYKYSLAFLGYDDEDKTAVIELTYNWGVTEYELGSAFGHIAIGVDDIHATCEAVKAHGGKVTREPGPVKGGSTVIAFVEDPDGYKIEFIENKNAKAALGN

SEQ ID NO: 1464 - protein, 668 aa, Exiguobacterium sibiricum
MKQTADMLTLTPEELDERYAYKGSDLGATFDEHTIRVRLWAPTAERVVIRLYRTLRARKVEELELTADQQGTFVVELDRAVYEGYFYTFQASINGQKVEAVDPYAKAVGTNGKRGALIDPSAIHPERWIEERPLFHSSQDAVIYELHVRDATSHPASGVIERGTFRGLTEAGTRTPAGGLTGLDYLTDLGVTHVQLLPIYDFGSVNEAAPNDPDNYNWGYDPVNYFAPEGSYSSNPDDPAARIRELKALIQALHDRGIRVVMDVVFNHVYDAETAPLGQFVPGYFFRQAADGTLSNGSFCGNDTASERFMMRKFILDCVTYWAKEYHLDGFRFDLMGLHDVETMIQVRHALDRIDPSILIIGEGWDLDTPLAADQKANYFNAPQMPGIAHFNNGLRDGVKGDVQTPADRGFISGAFERTNEVKRGIAGNVSSQGFADEPNQVVSYVEAHDDLTIWDKLSVSKPEDTDEIRRKRQMLANAIILTGQGIPFLHAGQEFFRTKNGIRDSFNSGEVVNQLDYERAEQFRAGVEYVKGLIALRRQYPMFRLENTAMIRKHLRFLEEGEGIIAYELKRTYEGYVERQRVYHNATDHDVTIELPSGEFEILVEEGVVKIHAPRLHEEKQLVVKALSTTVIAERKADYKKYAVAGGAALTILGLLYAANKRRKNNK

SEQ ID NO: 1465 - protein, 301 aa, Unknown
  Shewanella sp. MR-4
MNKLTDFERYVIEEKGTERPFSGEYYKHDAKGVYLCKKCHAPLYRSEDKFNAHCGWPAFDDEIPGAVSRHVDADGRRTEIVCSQCGGHLGHVFEGEYLTPKNIRHCVNSVSMVFQAADEVTISTHKTAFATFGAGCFWCVEAIFKSLKGVLNVSSGYSGGEASDADYKSVCSGLTGHAEVVHIEFDPAQISFTTLLQVLFESHDPTTLNRQGNDKGPQYRSVVFAHDAAQIEETNAMITKLTEARVFDAPIVTQVVAFESFYPAEDYHNDYFALHGEQPYCQIVVRPKVEKIRALFAELQA

SEQ ID NO: 1466 - protein, 248 aa, Zea mays
GLCLLLLSPSSSPFPCSCFQKGLSPVMGATSPSGLELTMAVPGLSSSSGSEGFVCNNNISNNGGGNMRDLDMNQPASGGEEEDFLMGGVEEDEEERGAGGPHRPKKLRLSKEQSRLLEESFRLNHTLSPKQKEALAIKLKLRPRQVEVWFQNRRARTKLKHTEMECEYLKRCFGSLTEENRRLQREVEELRAMRMAPPTVLSPHTRQPLPASALTMCPRCERVTAATCPRITRPAASPFHPRRPSAAF

SEQ ID NO: 1467 - protein, 187 aa, Orobanche anatolica
FGHDIKKWNPKMAPYISAKHKGIHITNLIITARFLSEACNLVFDAASMGKQFLIVGTKKQAAYLVARAAKKAQCHYVNKKWFGGMLTNWSLTEMRLYKFGDLIMKKKMRRFKSLPKKGAAVEKRQLSRLQKSLGGIKYMTKLPDIVIIIDQHKEYTALQECITLEIPTICLIDTNCDPDLATISIPA

SEQ ID NO: 1468 - protein, 233 aa, Glycine max
MAAKPDLKLLGMSVSPFVIRVRMALHMKGVSHEYIEQDLFNKSELLLESSPVEKKVPVLIHDGKPVCDSPAIVQYIDEVWAATGPPILPADPYERAVARFWTAYVDDKLFPAYAGTAKAATEEERTQQINEMFAVMGQLEEAFAQCSNGKAFFAGDSIGNLDIAVGCNLLLLEVLRSMYGVEFVDTGRTPLLAAWAKRFGETDAAREVVPDVHVAVEYAKKRQAYWAAAAATK

SEQ ID NO: 1469 - protein, 429 aa, Sorghum bicolor
MGLSTAYSPVGSHLAPAPLGHRRSAQLHRPRRALLATVRCSVDAAKQVQDGVATAEAPATRKDCFGVFCTTYDLKAEDKTKSWKKLVNIAVSGAAGMISNHLLFKLASGEVFGQDQPIALKLLGSERSFQALEGVAMELEDSLYPLLREVSIGIDPYEVFEDVDWALLIGAKPRGPGMERAALLDINGQIFADQGKALNAVASKNVKVLVVGNPCNTNALICLKNPPHIPAKNFHALTRLDENRAKCQLALKAGVFYDKVSNVTIWGNHSTTQVPDFLNAKIDGRPVKEVIKDTKWLEEEFTITVQKRGGALIQKWGRSSAASTAVSIADAIKSLVTPTPEGDWFSTGVYTTGNPYGIAEDIVFSMPCRSKGDGDYELATDVSMDDFLWERIKKSEAELLAEKKCVAHLTGEGNAYCDVPEDTMLPGEV

SEQ ID NO: 1470 - protein, 72 aa, Nitrosomonas europaea
MAKEETIQMQGEVIETLPNATFRIKLENGHIVLGHISGKMRMNYIRILPGDKVTVDLTPYDLTRARITFRTK

SEQ ID NO: 1471 - protein, 236 aa, Lactuca sativa
MTRRYWNINLEEMMEAGVHFGHGTRKWNPKMAPYISAKRKGIHITNLTRTARFLSEACDLVFDAASRGKQFLIVGTKNKEADSVAWAAIRARCHYVNKKWLGGMLTNWSTTETRLHKFRDLRTEQKTGGLDRLPKRDAAMLKRQLSHLQTYLGGIKYMTGLPDIVIIVDQHEEYTALQECITLGIPTICLIDTNCDPDLADISIPANDDAISSIRLILNKLVFAICEGRSGYIRNP

SEQ ID NO: 1472 - protein, 159 aa, Chelidonium majus
FMEAYCEMLTKYEQELTKPFKEAMLFLSRIECQFKALTVSSSSDSVGHDAVDRNGSSDEDVEASDNYIDPQAEDRVLKGQLLRKYSGYLGSLKQEFLKKRKKGKLPKEARQQLLEWWSRHYKWPYPSESQKIALAESTGLDQKQINNWFINQRKRHWKP

SEQ ID NO: 1473 - protein, 187 aa, Orobanche coerulescens
FGHGIKKWNPKMAPYISAKHKGIHITNLVKTARFLYEACNLVFDAASRGKQFLIVGTKKKAANSVACAAIKARCHCVNKKWLGGTLTNWSTTESRLNQFRDLRIKQKMGRFKRLPKRDAAVGKRQLSRLQTYLGGIKYMTGLPDIVIIIDQHEEYTALRECITLGIPTICLIDTNCDPDLADLSIPA

SEQ ID NO: 1474 - protein, 447 aa, Salmonella enterica
MDQTCSLESFLNHVQKRDPHQTEFAQAVREVMTTLWPFLEQNPRYRHMSLLERLVEPERVIQFRVVWLDDKNQVQVNRAWRVQFNSAIGPYKGGMRFHPSVNLSILKFLGFEQTFKNALTTLPMGGGKGGSDFDPKGKSEGEVMRFCQALMTELYRHLGPDTDVPAGDIGVGGREVGFMAGMMRKLSNNSACVFTGKGLSFGGSLIRPEATGYGLVYFTEAMLKRHGLGFEGMRVAVSGSGNVAQYAIEKAMAFGARVVTASDSSGTVVDESGFTPEKLARLCEIKASRDGRVADYAREFGLTYLEGQQPWSVPVDIALPCATQNELDVDAARILIANGVKAVAEGANMPTTIEATDLFLEAGVLFAPGKAANAGGVATSGLEMAQNAARLSWKAEKVDARLHHIMLDIHHACVEYGGDNKHTNYVQGANIAGFVKVADAMLAQGVI

SEQ ID NO: 1475 - protein, 257 aa, Elymus repens
CELDNIMRLTGITGIINGMDVSEWDPTKDKFLAVNYDITTALEGKALNKEALQAEVGLPVDRKVPLVAFIGRLEEQKGPDVMIAAIPEIVKDEDVQIALLGTGKKKFERLLKSVEEKFPGKVRAVVRFNAPLAHQMMAGADVLAVTSRFEPCGLIQLQGMRYGTPCACASTGGLVDTIVEGKTGFHMGRLSVDCNVVEPADVKKVATTLKRAVKVVGTPAYKEMVKNCMIQDLSWKGPAKNWEDVLLELGVEGSEPG

SEQ ID NO: 1476 - protein, 187 aa, Orobanche bartlingii
FGHDIRKWNPKMAPYISATCKGIHITNLIKTARFLSEACNLVFDAASRGKQFLIVGTKKKTANSVACAAIKARCHCVNKKWLGGTLTNWSTTERRLHQFRDLRIEQKMGRFKRLPKRDAAVSKRQLSRLQTYMGGIKYMTGLPDIVIIVDQHEEYTALRECITLGIPTICLIDTNCDPDLADLSIPA

SEQ ID NO: 1477 - protein, 557 aa, Vibrio fischeri
MTESFAQLFEEFLNETEFQQGSIVKGTVVAIENGFVLVDAGLKSEAAIPAEQFKNAAGELEVEVGSEVDVALDAVEDGFGETQLSREKAKRHEAWIQLEKAYEDAETVMGVINGKVKGGFTVELNGIRAFLPGSLVDVRPVRDTLHLEGKELEFKVIKLDQKRNNVVVSRRAVIESENSVERDELLASLQEGMEVKGIVKNLTDYGAFVDLGGVDGLLHITDMAWKRVKHPSEIVNVGDEINVKVLKFDRERTRVSLGLKQLGEDPWVAIAKRYPEGHKLSGRVTNLTDYGCFVEIEEGVEGLVHVSEMDWTNKNIHPSKVVNVGDEVEVMVLEIDEERRRISLGLKQCKANPWQTFAEAQAKGDKVTGKIKSITDFGIFIGLDGGIDGLVHLSDISWNATGEDAVREYKKGDEISAVVLAVDAERERISLGVKQMEEDPFNNYLADNKKGTLVNGTVSAVDAKGATITLADSVEGYIRTSELSRDRVEDASLILSVGDSVEAKFTGVDRKNRVVNLSIKAKDEADEQEAMASLNTKSEDGGFGNAMADAFKAAKGE

SEQ ID NO: 1478 - protein, 512 aa, Ceratopteris richardii
MDYDGHMRASMSSNICNVMNYAEGQVGSMVALMTTDHGTEGEQNRNHNPQHTSQHEQPQNQSSHSRNDRRQQLRSLNQTTMSSSLPTSSLTYYNAAMVEPYLQSALLQSTHTFNQSNNVETHPHIISALDQLETSVVVSAEEEKPHIGIRPKPVQSAQFPSSIDCNYVLSSSGQSVLVSPGANSTTHESQAAVASVSRDMENAHASADRSDVIRSKIMSHPTYPRLVMAYVNCHKIGAPPEVATSLEEISKKYQSFRSSSPAPTGADPELDNFMETYCNVLQKYHDELMQPYKEAMTFFRKIELQLNALSKGTVRLCHTGDDKADANCNSGQHGLISGGSSGEEDAEEGDVSCGEVDFHEEMIDPLADDQKVKEQLLRKYSGYIYKLKQEFLKKKKKGKLPKNAREKLLDWWNQHYKWPYPSEAEKAALAETTGLDQKQINNWFINQRKRHWKPSEDMQYVMVDSPTAHHHHHVLHGHAHLTPHPLAPYAVMETMDAAAAAAAAVTMLPSLQ

SEQ ID NO: 1479 - protein, 240 aa, Ceratopteris richardii
MQETYCNVLQKYHDELMQPYKEAMTFFRKIELQLNALSKGTVRLCHTGDDKADANCNSGQHGLISGGSSGEEDAEEGDVSCGEVDFHEEMIDPLADDQKVKEQLLRKYSGYIYKLKQEFLKKKKKGKLPKNAREKLLDWWNQHYKWPYPSEAEKAALAETTGLDQKQINNWFINQRKRHWKPSEDMQYVMVDSPTAHHHHHVLHGHAHLTPHPLAPYAVMETMDAAAAAAAAVTMLPSLQ

SEQ ID NO: 1480 - protein, 318 aa, Silene latifolia
NFLFKSPKEDSPLKATDFGLSDFIKPSRKFTDIVGSAYYVAPEVLKRKSGPESDVWSIGVITYILLCGRRPFWDKTEDGIFKEVLRNKPDFRRKPWPSISNSAKDFVRKLLVKDPFVRPTAAQALSHQWVREGGSALDIPIDISVLHNMRQFVKYSRMKQFALRALASTLNDDELANLRDQFDAIDVDKSGTISLEEMRQALAKDLPWKLKDSRVMEIVEAIDSNTDGFVDFTEFVAATLHVHQLHELDNEKWQELSQRAFEKFDVDKDGYITPDELRMQTGLKGSMEPLLEEADIDKDGRISLAEFRRLLRSASMSS

SEQ ID NO: 1481 - protein, 72 aa, Yersinia pestis
MAKEDNIEMQGTVLDTLPNTMFRVELENGHVVTAHISGKMRKNYIRILTGDKVTVELTPYDLSKGRIVFRSR

SEQ ID NO: 1482 - protein, 318 aa, Silene latifolia
NFLFKSPKEDSPLKATDFGLSDFINRSRKFTDIVGSAYYVAPEVLKRKSGPESDVWSIGVIMYILLCGRRPFWDKTEDGIFKEVLRNKPDFRRKPWPSISNSAKDFVRKLLVKDPLVRLTAAQALSHQWVREGGNALDIPIDISVLHNMRQFVKYSRMKQFALRALASTLNDDELANLRDQFDAIDVDKSGTISLEEMRQALAKDLPWKLKDSRVMEIVEAIDSNTDGFVDFTEFVAATLHVHQLHELDNEKWQELSQRAFEKFDVDKDGYITPDELRMHTGLKGSMEPLLEEADIDKDGRISLAEFRRLLRSASMSS

SEQ ID NO: 1483 - protein, 373 aa, Rickettsia rickettsii
MSQNYYQILGVSKTASQADLKKAYLKLAKQYHPDTTDAKDAEKKFKAINAAYDVLKDEQKRAAYDRLGHDAFQNQQSRGGGGNHGGFHPDINDIFGDFFSDFMGGSRRSSRPTSAKVRGSDLKYNLTINLEEAFHGIEKNINFSSAVKCNTCHGSGSEKGETVTTCDACSGVGATRMQQGFFTIEQACHKCQGNGHIIKNPCKKCHGMGRYHKQRNLSVNIPAGVENGTRIRHTGEGEAGIRGGNSGDLYVDITIKPHDIYKVDGANLHCKLPISFVNAALGGEIEVPVIEGGKVSLTIPAGTQNGDQLRLRSKGMSKMRSTIRGDMLTHIHVEVPKNLSKRQRELLEEFKKESINEKENDGSFFNKMKSLWS

SEQ ID NO: 1484 - protein, 195 aa, Oryza sativa
MAAAARWWVAAVVVAVAAMAGAAKGDFAADKAECADKLMALATCLTYVEEKATARAPTRDCCAGLGQVVAGSKKCLCVLVKDRDEPALGFRINVTRAMDLPSGCSIAATFSDCPKMLNMSPDSKEAEIFKQYAREHESNNATKPAPAAAAAATGSAGKATAATGDAGVGRRQRSSLAARAVAAAVLAAVFGLTVA

SEQ ID NO: 1485 - protein, 259 aa, Geobacillus stearothermophilus
MTNGKVYIVGAGPGDEKLITVYGLECIQQADVIIYDRLINKNLLKYAKKDAELIYCGKEPGKHALIQEWIHELLVEKAQQGKIVTRLKGGDPCVFGRAGEEAEVLAHHGIPFVIVPGVTAGIAAAAYAGIPVTHREYAASFTIVTGHGRQEKGDDRLHWEGLAKGSDTIAFYMGVGNLSYICQKLIEHGKPSNTPVAVIEWGTTERQRTAVGTLQTIADVVKKAGLSHPAIILVGEVVRLRETIQWFAEMNRGETVATT

SEQ ID NO: 1486 - protein, 57 aa, Unknown
  Polaromonas sp. JS666
MTQSMTWMCLICGWIYDEAAGAPEHGIAPGTPWAQVPMNWTCPECGARKEDFEMVQI

SEQ ID NO: 1487 - protein, 334 aa, Solanum chilense
MNRAKDPVRVLVTGAAGQIGYALVPMIARGVMLGADQPVILHMLDIPPAAEALNGVKMELVDAAFPLLKGVVATTDAVEACTGVNVAVMVGGFPRKEGMERKDVMSKNVSIYKSQASALEKHAAPNCKVLVVANPANTNALILKEFAPSIPEKNITCLTRLDHNKGPWQISERLSVQVSDVKNVIIWGNHSSSQYPDVNHATVSTPAGDKPVRELVADDAWLNGEFISTVQQRGAAIIKARKLSSALSAASSACDHIRDWVLGTPEGTFVSMGVYSDGSYNVPSGLIYSFPVTCKNGEWSIVQGLPIDEFSRKKLDLTAEELSEEKALAYSCLA

SEQ ID NO: 1488 - protein, 320 aa, Yersinia pestis
MSTAKHSKLIILGSGPAGYTAAVYAARANLKPVLITGMEKGGQLTTTTEVENWPGDPEGLTGPALMERMHEHAEKFQTEIIFDHISSVDLQNRPFRLFGDGAEYTCDALIIATGASARYLGMASEEAFKGKGVSACATCDGFFYRNQKVAVVGGGNTAVEEALYLANIAAEVHLIHRRDTFRSEKILIDRLMEKVKNGNIVLHTDRTLDEVLGDDMGVTGVRLKSTHSDETEELAVAGVFIAIGHSPNTGIFSDQLALENGYIKVQSGLQGNATQTSIPGVFAAGDVMDHIYRQAITSAGTGCMAALDAERYLDGLANDK

SEQ ID NO: 1489 - protein, 298 aa, Leifsonia xyli
MAVVTMRQLLDSGVHFGHQTRRWNPKMKRFILTERSGSYIIDLQQSLTYIDKTYDFVRETVAHGGTILFVGTKKQAQQAIAEQATRVGQPYVNQRWLGGLLTNFQTVSKRLARMKELEELDFEGTTSGFTKKELLIKKRELDKLHKSLGGIRNLSKTPSALWVVDTKKEHLAIDEAKKLGIPVIAILDTNCDPDEVQYPIPGNDDAIRSVSLLTHIVADAAAEGLIQRHQKPEEGVEAAEPLAEWEQELLAQPAAEVQASAETEKAADADLAEAKADSAAVVAEGEAAADAVAETPAE

SEQ ID NO: 1490 - protein, 479 aa, Gluconobacter oxydans
MSSSQNRPAIVWFRDDLRMADHPALHEAAASGWPLICLYILDDVTPALHPLGAAARWWLRGALADLRRNLEKQGGTLLTLSGSAEKLLPQLAKQTDAASVHWHHRLHERERAQDNRIRRTLEEQECEVHAQWGTVLVDPDTVQTKQGGFYKVCGSFWKALQTHAVPEPLEAPSRLSFHAIPASVLSDARLNEDSLCPQAPDWAAGFRKTWEPGEAEGQEHLEDFLKNSVAGYPRGRDRVAEEGTSRLSPYLASGAVSPRQVWAALQKHGAHTDGPRIFLSELGWREFARYTLYHLPKLPFENLSPKFSGMHWRRSAADLKAWQRGQTGVPIVDAGMRQLWQTGWMHNRARMIVGSFLTKHLLIDWKEGDAWFRDTLVDADFANNAMNWQWVAGTGIEATPFFRIFNPTRQAEKFDPNGDYIRQWVPELRRLSGKALFEPWAAKDEELEKAGVRLGKSYPRPIVDLKEGRDRALQAFRSL

SEQ ID NO: 1491 - protein, 447 aa, Oryza sativa
MALLQFGGTLAPKLGEKPQLLPRSPALTRVIYADPRFLVSKSGSGGRLKHLVSPTASLQSRTSSRLFNHAPSPRFRHRRSSRFIVRADADFYSTLGVSRNASKSEIKSAYRKLARSYHPDVNKDPGAEQKFKDISNAYEVLSDDEKRSIYDKYGEAGLKGAGMGTGDYSNPFDLFESLFEGFGGMGGMGGRAARNRPMQGDDEAYNLVLNFKEAVFGVEKEIEITRLEGCNTCDGTGAKPGTKPTTCKTCGGQGQVVSSTRTPLGIFQQVSTCNTCGGTGEFSTPCNTCGGDGRVRKTKRISLKVPAGVDSGSRLRVRSEGNAGRRGGPPGDLYVFIDVLSDPVLKRDGTNILYTCKVSYIDAILGTTVKVPTVDGMVDLKIPSGTQPGTTLVMSKKGVPLLGKSNARGDQLVRVQVEIPKRLSSDERKLIEELANLNKAQTANSRR

SEQ ID NO: 1492 - protein, 666 aa, Aquifex aeolicus
MKRFQCPYCGVGCGLYINEKGKVKGDFEHPANLGDICKKPLYLPKVLNRGRIAKPMYRENKSHSFREISWEEAYEILKEKLISFSPDETYFYLSGQLLTEDIYVANKFVKGFLRTNNVDANSRLCMASAVTAYKLAFGSDGVPCTYEDVDDADAFLFIGSNAAVAHPVLFKRVLKRRKEEEKVIIVTVDPLETETAKRSDVFIQIKAGTDTVFLNSVLYVLHKEGWIDYRFIYNYTEGFEEALEVAMKFPPDVAASICSVKPEDVYLVAELFAHSKKLISFWCQGLNQSLNGTMKNLALINLHLATGRLNEKGCPFSLTGQPNAMGGREVGYLTNGLPGYRDVRNKADRAFMEKFWGVKGIKKEPGPTITEAIDMILKDRIKFLWVVCTNPAVSLPNLEKVKRALEKVFLVVQDAYWNDTCEFANLILPAAQLGEKEGVMTGSDRTVTFCERFSEPFGESKPDWLIFTELARKMGAEELFPYSSPKEIFEEFKASTKGRLCDMSNLSYENLPARWGKRWLYEDLKFPTESGKARFHPARVDVAAEEGMFILLTGRLKNNWHTMTRTGKSPELLKGEIPPFVIMNPRDAEELGIEEGEEVILSAKGKEITRVVRFGNVKRGHIFAPFGYPSEYGEPTNLLTSDRTDPYSKEPDLKYSGVDVFVKVNR

SEQ ID NO: 1493 - protein, 487 aa, Yersinia pseudotuberculosis
MSTHLVWFRNDLRVTDNLALHAACQDPQASVIAVFIATPVQWAAHGMAPRQAAFLRQNLQHLQAALAARGIPLHYHQCDDFQASNTWLVDFCQQQQVDSLFYSQQYELNERLRDDALAVQLSGRAITCQSFHDSVLLAPGTVLTGNNEMYKVFTPFRRAFIQRLLMSDNHCVPAPKARHAPPVLLSPLPFDYPQQSVDSQLFPAGEDAALQRLRRFCREQVQDYRQYRDLPAVPGTSCLSPYLVLGVLSPRQCFNRLWAESPEMLENADSGAFTWLNELIWREFYRHLLVAYPRLCQHHPFIGWTDGLVWNRSESQLKAWQQGQTGYPIVDAAMRQMNETGWMHNRLRMISASFLVKDLLIDWRQGERYFMSQLVDGDLAANNGGWQWAASTGTDAAPYFRIFNPTTQGERFDKDGVFIRRWLPELAAVPDSDIHQPWRWAERQQQHLDYPVPLVDHKQARLATLAAFEAAKRDSTRIPNRKEPSCY

SEQ ID NO: 1494 - protein, 421 aa, Mesorhizobium loti
MADLKRTQPLARDAMAYVLAGGRGSRLKELTDRRAKPAVYFGGKTRIIDFALSNALNSGIRRLGVATQYKAHSLIRHLQRGWNFLRPERNESFDILPASQRVSETQWYEGTADAVYQNIDIIEAYGPEYMVILAGDHIYKMDYELMLRQHVDAGADVTVGCLEVPRMEATGFGVMHVDAKDNIIAFVEKPADPPGIPGNPEFALASMGIYVFKTKFLMEQLRRDAADPGSSRDFGKDIIPYIVQHGKAIAHRFTKSCVRSTMENEAYWRDVGTVDAYWEANIDLTDVTPELDLYDRDWPIWTYAELKPPAKFVHDEDGRRGSAVSSLVSGDCIVSGASLKKSLIFTGARINSYSALEEVVMLPDVHVGRNAKLKRVVIDHGVRIPEGLVVGEDPVLDAKRFRVSEKGICLVTQDMINKLGL

SEQ ID NO: 1495 - protein, 638 aa, Bifidobacterium longum
MTQTNNLYDVVVIGGGPAGLTAGLYLARARYRVLILEKDDFGGQITITNEVVNYPGVGRTTGRALTQTMRQQAQDFGAEFLSAEATGLDVDGDIKTVHTSRGDLKTFGILIATGASPRKLGFEGEAEYAGRGVAYCATCDGEFFTGKEVLVVGGGFAAAEESVFLTKYASKVTVLVREPDFTCDAAVAAEAKNNPKIDVRYQVELKGVTAGQGGLREASILNLATGQTETWKPADAGTFGVFVFAGYVPATDLVRGVVELDDHGYVVTHDYLRTSVPGVYAAGDLRVKNLRQVVTATADGAIAAVELERYAKQMSEKTGLVPPRPTASAYEESEAKAASAASAAGTTPAPAPAKRSADAAAAASAAKKPGELFSAAVKQQLGVVFGRMTRPVTLALELDGTPLSAELQGFIGEMVALSGGKLNSVAVDAAGLITAVDGASVPTSLVVGEPLSVTLPDGTELPTYGSLDDSGRATFDVAGVLPLARPTVRICVPAEGDGKAGKDGNGSLVFTGLAFHGVPSGHEFNSFVLGLYNAAGPGQPLGDDLVERAKSITDPLNIMILVSLTCTMCPETVLASQRIASLSPAVRAEAYDVSHFPELKDQYGAMSVPCIVITHADGTQQVEFGKKSIPQMLELVGA

SEQ ID NO: 1496 - protein, 775 aa, Aquifex aeolicus
MSVEEKARIGNSEEPIIIETGKYAKLTDGSVVVRQGGTAVLVTAVMSDEPITDVDFTPLAVDYRERASAYGRIPGGFTKREGKPTDREILVSRVIDRPIRPLFPEGFFHDVIITALTLSADDKYDPDVLAITGASAALHISRIPFEGPIAGVRVCRVNGEFVANPTYEQRKEADLDIVMAGTKDAIVMVEGGGKEIPEEVLADALFFGLDAIKEVIEAQERLREKVGKPKFEYQKVELPEDILKALEEECTPKILEAFNIKDKKERYSTLDKIVEEFIEAHQIPEELHFAVKYFYKKLESRLMREKVLKEGVRIDGRKPNEIRPIWIEVHPFERPHGNAIFTRGQTQAYVTVTLGTPDEALIIETIAEGEVFKRFMLHYSMPPFSVGEAKPWGPPRRREIGHGALAERAIEPLLPPEEEYPFIIRVVSDILESNGSTSMATVCGASLALFDAGVPMKDNKHVAGIAMGLILEKDRYVILSDILGDEDHLGDMDFKVAGTKDGITSVQMDIKVKGITKEIMLDALKQAREGRLYILEKMYEAIPEPRKEPHPYTPKVEVVDVPEEKAPLIIGPGGSTVKKIYDETGVKVWVGEQGKVYLFVFPGGDVEKAKQMIQDIVREVEVGAVYKGTITRVEPYGVFVELWPGKIGLLHVSKMAEPVRSATEKYKVGEEIIVKVLDLDELGRPRFTTIGIEDVGTEKKEVKPKVGDVYEGKVVRVEPYGAFIEYAPGKVGLLHVSKMKERVKDARQKYKVGDVVKVKVVEIDEQGRPKFTDDV

SEQ ID NO: 1497 - protein, 374 aa, Oryza sativa
MHHHRDFAIEGVQGSLSELMLKLARSYHPDVNKDPGAEQKFKDISNAYEVLSDDEKRSIYDKYGEAGLKGAGMGTGDYSNPFDLFESLFEGFGGMGGMGGRAARNRPMQGDDEAYNLVLNFKEAVFGVEKEIEITRLEGCNTCDGTGAKPGTKPTTCKTCGGQGQVVSSTRTPLGIFQQVSTCNTCGGTGEFSTPCNTCGGDGRVRKTKRISLKVPAGVDSGSRLRVRSEGNAGRRGGPPGDLYVFIDVLSDPVLKRDGTNILYTCKVSYIDAILGTTVKVPTVDGMVDLKIPSGTQPGTTRLTLCRTLAVRLPLPSPVVSVRKPGGGGCAGGEEWLQQDGLLCMGGSAGGLWRWPRCSPATDPAAAAFTRDGA

SEQ ID NO: 1498 - protein, 178 aa, Corynebacterium diphtheriae
MPTPDFVLQLREKIGNDPLFLPGVTAVVIKDVPEGAPITAVPEVLLVKRADNGEWTPVTGIVDPGEQPHSAAVREVKEETGLDVTVEALLGVGAVGPVTYPNGDVSHYMDTAMRCEVVGDSTPRIGDDENTEVRWFSVMQMPPMKPRFRLVVGDAVAQLRRPEGFRPRMGYEKRERRR

SEQ ID NO: 1499 - protein, 304 aa, Aspergillus fumigatus
MQIFVKTLTGKTITLEVESSDTIDNVKSKIQDKEGIPPDQQRLIFAGKQLEDGRTLSDYNIQKESTLHLVLRLRGGMQIFVKTLTGKTITLEVESSDTIDNVKSKIQDKEGIPPDQQRLIFAGKQLEDGRTLSDYNIQKESTLHLVLRLRGGMQIFVKTLTGKTITLEVESSDTIDNVKSKIQDKEGIPPDQQRLIFAGKQLEDGRTLSDYNIQKESTLHLVLRLRGGMQIFVKTLTGKTITLEVESSDTIDNVKSKIQDKEGIPPDQQRLIFAGKQLEDGRTLSDYNIQKESTLHLVLRLRGG

SEQ ID NO: 1500 - protein, 607 aa, Zea mays
MCGILAVLGCADEAKGSSKRSRVLELSRRLKHRGPDWSGLRQVGDCYLSHQRLAIIDPASGDQPLYNEDQSVVVAVNGEIYNHLDLRSRLAGAGHSFRTGSDCEVIAHLYEERGEEFVDMLDGVFSFVLLDTRHGDRAGSSFFMAARDAIGVTPLYIGWGVDGSVWISSEMKALHDECEHFEIFPPGHLYSSNTGGFSRWYNPPWYDDDDDEEAVVTPSVPYDPLALRKAFEKAVVKRLMTDVPFGVLLSGGLDSSLVAAVAVRHLAGTEAARRWGTKLHSFCVGLEGSPDLKAAREVAEYLGTLHHEFHFTVQDGIDAIEDVIYHTETYDVTTIRASTPMFLMSRKIKSLGVKMVISGEGSDELFGGYLYFHKAPNKEGLHRETCRKVKALHQYDCLRANKATSAWGLEARVPFLDKEFINAAMSIDPQWKMVRPDLRRIEKWVLRKAFDDEEQPFLPKVHILYRQKEQFSDGVGYSWIDGLKTHAASNVTDKMLSNAKFIFPHNTPTTKEAYYYRMVFERFFPQKSAILTVPGGPSVACSTAKAIEWDTQWSGNLDPSGRAALGVHLAAYEHQHDPEHVPAAIATGSGKKPRTIRVAPPGVAIEG

SEQ ID NO: 1501 - protein, 187 aa, Orobanche artemisiae-campestris
LGHDIRKWNPKMAPYISANRKGIHITNLIKTARFLSEACNLVFDAASRGKQFLIVGTKKKTANSVACAAKKARCHCVNKKWLGGTLTNWSTTESRLHQFRDLRIEQKMGRFKRLPKRDAAVSKRQLSRLQTYMGGIKYMTGLPDIVIIVDQHEEYTALRECITLGIPTICLIDTNCDPDLADLPIPA

SEQ ID NO: 1502 - protein, 880 aa, Unknown
  Mycobacterium sp. JLS
MGPSHEATSRQYPIPSLAPMSTSISNGPARNVVVVGHGMVGHRFVEALRARDDAGAWRITVLAEETDAAYDRVGLTGYTEHWDRALLALAGNDYAGDDLVDLRLGQRVTSIDRAARTVKTADGTAFAYDALVLATGSYAFVPPVPGRDLPACHVYRTFDDLDAIRADAARARETSRAPVGVVIGGGLLGLEAANALRGFGLTAHVVERSPRLMSQQLDDAGGALLSRMIADLGIEVHLDVSTDAITPAQRNRPLRRSEEDDSLRVMLGDGSFIDAGVVVFAAGVRPRDELARDAGLAIAERGGVLTDLGCKTSDPSIYAVGEVAAIEGRCYGLVGPGYTSAEVVADRLLGGAAEFPEADMSTKLKLLGVDVASFGDAMGRTPDCLEVVVNDAVNQTYAKLVLSDDAKTLLGGVLVGDASAYGVLRPMVGEQLPGDPMALIAPAGSGGAEGGLGVGALPAAAQICSCNNVTKGDVTDAIAGGCCDVPGLKACTKAGTSCGSCVPLLKQLLEAEGVEQSKALCEHFSHSRAELFEIVSATEIRTFSGLLERFGTGKGCDICKPTVASILASTSSEHILDGEQAALQDSNDHFLANIQRNGSYSVVPRVPGGDITPEQLILIGEIARDFDLYTKITGGQRIDLFGARVEQLPEIWRRLVEGGMESGHAYGKALRTVKSCVGSDWCRYGQQDSVQMAINLELRYRGLRAPHKIKMGVSGCARECAEARGKDVGVIATEHGWNLYVGGNGGMTPKHAQLLAGDLDDETLIRYIDRFLMFYIRTADRLQRTAPWVEQLGLDHLREVVCDDSLGLASEFEAAMARHVEGYSCEWKGVLEDPDKLSRFVSFVNAPDVPDPTVTFTENAGRKVPVPIGMPSIRPLQETP

SEQ ID NO: 1503 - protein, 167 aa, Mesembryanthemum crystallinum
QSIDIDGKKVKAQIWDTAGQERFRAVTSAYYRGAVGALVVYDITRRTTFDSISRWLDELKTHSDTTVARMLVGNKCDLDDIRAVSTDEGKSLAEEHGLFFIETSAKDSTNVKTSFEIVIKEIYCSVSRKVLNSDSYKAELSVNRVSLVNDDKQKQNQGYISSSCCSG

SEQ ID NO: 1504 - protein, 187 aa, Orobanche hederae
WGHDIRKWNPKMAPYISANRKGIHITNLIKTARFLSEACNLVFDAASRGKQFLIVGTKKKTANSVACAAIKARCHCVNKKWLGGTLTNWSTTERRLHQFRDLRIEQKMGRFKRLPKRDAAVSKRQLSRLQTYMGGIKYMTGLPDIVIIVDQHEEYTALRECITLGIPTICLIDTNCDPDLADLSIPA

SEQ ID NO: 1505 - protein, 257 aa, Elymus repens
CELDNIMRLTGITGIINGMDVSEWDPTKDKFLAVNYDITTALEGKALNKEALQAEVGLPVDRKVPLVAFIGRLEEQKGPDVMIAAIPEIVKDEDVQIVLLGTGKKKFERLLKSVEEKFPGKVRAVVRFNAPLAHQMMAGADVLAVTSRFEPCGLIQLQGMRYGTPCACASTGGLVDTIVEGKTGFHMGRLSVDCNVVEPADVKKVATTLKRAVKVVGTPAYKEMVKNCMIQDLSWKGPAKNWEDVLLELGVEGSEPG

SEQ ID NO: 1506 - protein, 430 aa, Ceratopteris richardii
MATNAVSSTHSASSLSYYSTRIVEPYLQSELLQGTQGFHRPHTSHCQRQVTSSVESLELSAVAGERGKADTAIAIDRSQGFEILSPTCNYVVSSNGETVLANPSLDSTGHANHEEGPSLPSRSMADRDDLIRTKIVSHPSYPRLVMAYVNCYKIGAPEDAALILEEVSRKYQEIRSSSSEVIGADPELDNFMELYCNVLQRYHEELTHPYKEAMAFFKKIELQLDAISKGSLSLSQSGETKTEANSDSAWHGQTGAAPSIEDEPEEGDMSSGEVDFHDEMIDPLAEDQKLKEQLLRKYSGYIFKLKQEFLKKKKKGKLPREARQMLLDWWTQHYKWPYPSEAEKTALAESTGLDQKQINNWFINQRKRHWKPSEDMQYVMMDSPAGQTQHTFLRPHSHIASQHLSPYTVLQTMEVAAGAAPSATMMSSLH

SEQ ID NO: 1507 - protein, 975 aa, Unknown
  Burkholderia sp. 383
MKLEHPDRLMNRTPLSLAALETHDAFAERHIGPDAASQQAMLDTLGFASRAALIDAVIPASIRRAETLPLGPFAQPKSEAEALAALRVLADKNEVFRSYIGQGYHDTHTPAVILRNVLENPAWYTAYTPYQPEISQGRLEALLNFQQMVADLTGLAISNASLLDEATAAAEAMTLLQRTGKPTSNVFYVADDVLPQTLEVIRTRALPVGIEVKTGPAADAAQANAFGVLLQYPGVNGDVRDYRALTEAIHAAGGHVVVAADLLALTVLTPPGDWGADVAIGNTQRFGVPMGFGGPHAAYLAVRDEFKRQMPGRLVGVTVDAQGKPALRLALQTREQHIRREKATSNVCTAQALLAIMASMYAVYHGPHGLKTIALRVNRIAALLAAGVKQLGFATVNDTFFDTLTIDTGARTAQVHEFAKAKRINLRRVSDTQVGVSVDETTTRDDLADLLAVFAQAAGGTAPAVDALDAGLAGVAALPAGLERTSAYLTHHVFNRHHSETEMLRYLRSLSDKDLALDRSMIPLGSCTMKLNATSEMLPVTWPEFGGIHPFAPAEQTVGYREMIDQLEQMLVAATGYAAVSLQPNAGSQGEYAGLLIIHAYHASRGEAHRDVCLIPASAHGTNPASAHMAGMKVVVVACDAQGNVDIADLKAKADEHAKDLAAIMITYPSTHGVFEQNVREICEIVHAHGGQVYVDGANMNAMVGLTAPGQFGGDVSHLNLHKTFCIPHGGGGPGVGPVAVGAHLAKFLPNQRSTGYTREEDGIGAVSAAPYGSASILPISWMYIAMMGAKNLTAATETAILNANYIAKRLAPHYPVLYSGPGGLVAHECILDLRPIKESSGISVDDVAKRLMDYGFHAPTMSFPVPGTLMVEPTESESQEELDRFIAAMIAIRDEIRAVEEGRADREDNPLRHAPHTAAVVTANEWLHAYSREQAAYPVASLGTNKYWPPVGRADNVYGDRNLFCSCVPMSEYA

SEQ ID NO: 1508 - protein, 72 aa, Vibrio fischeri
MAKEDAIELQGTVLDTLPNTMFRVELENGHVVTAHISGKMRKNYIRILTGDKVTVEMTPYDLSKGRIVFRAR

SEQ ID NO: 1509 - protein, 187 aa, Orobanche owerinii
LGHDIRKWNPKMAPYISANRKGIHITNLIKTARFLSEACNLVFDAASRGKQLLIVGTKKKTANSVACAAKKARCHCVNKKWLGGTLTNWSTTESRLHQFRDLRIEQKMGRFKRLPKRDAAVSKRQLSRLQTYMGGIKYMTGLPDIVIIVDQHEEYTALRECITLGIPTICLIDTNCDPDLADLPIPA

SEQ ID NO: 1510 - protein, 317 aa, Staphylococcus warneri
MAEQVDFDVAIIGAGPAGMTAAVYVSRANLSTVMIERGMPGGQMANTEEVENFPGFEMVTGPDLSTKMFEHAKKFGAQYQYGDIKSVEDKGDYKVINLGNKEITARAVIISTGAEYKKIGVPGEQDLGGRGVSYCAVCDGAFFKGKKLFVIGGGDSAVEEGTFLTKFADNVTIVHRREELRAQKILQDRAFKNDKIDFIWSHTLKTINDKDGKVGSVTLESTKDGSEQTLDADGVFIYIGMKPLTTPFLDLGITNDVGYIETNEDMSTKVSGIYAAGDVRDKGLRQIVTATGDGSIAAQSAIAYIEHLNDQSEILSI

SEQ ID NO: 1511 - protein, 104 aa, Staphylococcus warneri
MATITVTEKTFNKTIEKGVTLVDFWATWCPPCQMQSPVLEELSDELEGKVIIGKVDVDEEKALAAKYQIQSIPTLLIFKDGELVNTLIGFNPKPNLENVLTKYL

SEQ ID NO: 1512 - protein, 776 aa, Zea mays
MDSSRSWIFTELGQPTYCPETFPEVPFERPTPPIIFFDEEHIFEEESSSSTTATPRNPSDPKQAGGDLDSIATAALSASEEIPQSLLVIDLERATSKCIRTHAVNDVPAVHSIIKGLQLERIGLAGSAPDLDTLTTARHCGSELSCQLGSNKRDVSLRVGCDQSYEWVDPETLDRSFVVLDNACATHEVFEVLPLSFPAAWVNVGKLPTTLCWKIPWPPPVLWVNLHAGGRYITSLLEECQLVFTIFFGGVCSLAKIQWPYMVLEYLANLHVIHGKIHMHPVQVCVRSYAVMPSAKGLVAETHLHFIGTYRGVVSTAFCTEIVESADAYIFAGSIFKDYSSVGYSFLLKKAKAIIVQPERVGVGNGLSFRCLMMKEYWTEIAKKVKKNTTTYENYKRNFVPEGQALESEPNEPLRVNVLFKYIQKMMTVNSVVMAETDDSWFNCHKLKLPESCGYQFQMQYGLIGWSMGALLGYAQGANHKILSPLTALHPLVAVCYDHDIIMDAAGFGDELVVISLGADCQIIASYHRWPFGQTGTGHFSPIGGYQVRQDMVLILDVARFIPLQFFWEAMNTTNDSTLRGSMLISRKVAESSLLYTVSCRDENWKIMPKFCVEDLPSLLKAGIGACVGLVTSGLSVVSSGQGNFSVFVWDPGDSGLVTSSLSAVSSDQGKFSVFVWDPGDRGLVTYGLRVVSIARVTAIMSGTYARGAATTSSPKMRQTQFRWRAEERHDAFNNDANPQIKLILHRQRLGGKPYFKEWGMLDILGVVDELWVMWA

SEQ ID NO: 1513 - protein, 155 aa, Orobanche minor
  misc_feature (1)..(1): Xaa can be any naturally occurring amino acid
XPKMAPYISANRKGIHITNLIKTARFLSEACNLVFDAASRGKQFLIVGTKKKTANSVACAAKKARCHCVNKKWLGGTLTNWSTTESRLHQFRDLRIEQKMGRFKRLPKRDAAVSKRQLSRLQTYMGGIKYMTGLPDIVIIVDQHEEYTALRECIT

SEQ ID NO: 1514 - protein, 257 aa, Elymus repens
CELDNIMRLTGITGIVNGMDVSEWDPTKDKFLAVNYDITTALEGKALNKEVLQAEVGLPVDRKVPLVAFIGRLEEQKGPDVMIAAIPEIVKDEDVQIVLLGTGKKKFERLLKSVEEKFPGKVRAVVRFNAPLAHQMMAGADVLAVTSRFEPCGLIQLQGMRYGTPCACASTGGLVDTIVEGKTGFHMGRLSVDCNVVEPADVKKVATTLKRAVKVVGTPGYHEMVKNCMIQDLSWKGPAKNWEDVLLELGVEGSEPG

SEQ ID NO: 1515 - protein, 389 aa, Unknown
  Shewanella sp. MR-4
MEKAIRNFLSQESAGGILLLVAVALAMLMANSPLAGLYQGFLGTEVQVRVGALDLHKPLLLWINDGLMALFFLLIGLEVKRELLEGALSSVAQASLPTFAAIGGMLVPAGIYLLFNYGDPVTQAGWAIPAATDIAFALGIMALLGSRVPVALKVFLLALAIIDDLGVIVIIALFYSTDLSTISLIIASIAIVGLVALNRKGVTALAPYGVLGLVLWVAVLKSGVHATLAGVIIAFCIPLRAKDGSSPSEHLEHSLHPWSTFLILPVFAFANAGVALGNMSLNTLISPVPVGIALGLMLGKPIGVMLFSYAAVKLRLAQLPNGIGWKQIAPVAAMCGIGFTMSMFIASLAFEQADPMYGDLARLGTLIGSILAALIGYFWLSKVLPKQGV

SEQ ID NO: 1516 - protein, 469 aa, Vibrio vulnificus
MIMNSTNLKLLSLFVLGSVLWFLPVPDGLTEQAWQMMVIFVTTVLSLILAPLPLGAMALLGLTAATLLGVLPIKTALNGFAHPTIWMIAAAFFISRGFITTGFGRRVGYWFISKLGHNSLGLAYGLVLTDLLFAPATPSTTARCGGIIAPLFRSVASAYDSDPEKGTQNRIGAFLVQCIFQCNAITCAMFLTSMAGNPLAANFAKEQGVEITWAGWAAAAIVPGLLCLFLIPLAMYLFFPPELKKTPEMRAIAKEKLQQMGAMTRDEIMVCATFIGMVTLWVLGPTLGIHATVTALIGLVFLLLSRTITWDAVLSEKEAWHTITWFAVLIMMASELNKLGFIKWFSNGIGESLSGFGWATTIILLLLVYYYSHYLMASAMAHISAMYSAFLAIAISAGAPPMLAAIVLGIFSNLYMSTTHYSSGPAPILFGAGFHSLQNWWKIGFVFSLIVIPIFIFVGGMWWKVLGLW

SEQ ID NO: 1517 - protein, 318 aa, Silene dioica
NFLFKSPKEDSPLKATDFGLSDFIKPSRKFTDIVGSAYYVAPEVLKRKSGPESDVWSIGVITYILLCGRRPFWDKTEDGIFKEVLRNKPDFRRKPWPSISNSAKDFVRKLLVKDPFVRPTAAQALSHQWVREGGSALDIPIDISVLHNMRQFVKYSRMKQFALRALASTLNDDELANLRDQFDAIDVDKSGTISLEEMRQALAKDLPWKLKDSRVMEIVEAIDSNTDGFVDFTEFVAATLHVHQLHELDNEKWQELSQRAFEKFDVDKDGYITPDELRMHTGLKGSMEPLLEEADIDKDGRISLAEFRRLLRSASMSS

SEQ ID NO: 1518 - protein, 318 aa, Silene dioica
NFLFKSPKEESPLKATDFGLSDFINRSRKFTDIVGSAYYVAPEVLKRKSGPESDVWSIGVIMYILVCGRRPFWDKTEDGIFKEVLRNKPDFRRKPWPSISNTAKDFVRKLLVKDPLVRLTAAQALSHQWVREGGNALDIPIDISVLHNMRQFVKYSRMKQFALRALASTLNDDELANLRDQFDAIDVDKSGTISLEEMRQALAKDLPWKLKDSRVMEIVEAIDSNTDGFVDFTEFVAATLHVHQLHELDNEKWQELSQRAFEKFDVDKDGYITPDELRMHTGLKGSMEPLLEEADIDKDGRISLAEFRRLLRSASMSS

SEQ ID NO: 1519 - protein, 212 aa, Arabidopsis thaliana
MEENNGNNNHYLPQPSSSQLPPPPLYYQSMPLPSYSLPLPYSPQMRNYWIAQMGNATDVKHHAFPLTRIKKIMKSNPEVNMVTAEAPVLISKACEMLILDLTMRSWLHTVEGGRQTLKRSDTLTRSDISAATTRSFKFTFLGDVVPRDPSVVTDDPVLHPDGEVLPPGTVIGYPVFDCNGVYASPPQMQEWPAVPGDGEEAAGEIGGSSGGN

SEQ ID NO: 1520 - protein, 318 aa, Silene diclinis
NFLFKSPKEDSPLKATDFGLSDFIKPSRKFTDIVGSAYYVAPEVLKRKSGPESDVWSIGVITYILLCGRRPFWDKTEDGIFKEVLRNKPDFRRKPWPSISNSAKDFVRKLLVKDPFVRPTAAQALSHQWVREGGSALDIPIDISVLHNMRQFVKYSRMKQFALRALASTLNDDELANLRDQFDAIDVDKSGTISLDEMRQALAKDLPWKLKDSRVMEIVEAIDSNTDGFVDFNEFVAATLHVHQLHELDNEKWQELSQRAFEKFDVDKDGYITPDELRMHTGLKGSMEPLLEEADIDKDGRISLAEFRRLLRSASMSS

SEQ ID NO: 1521 - protein, 413 aa, Eurotium herbariorum
MSSVSHYQRKHKVTVVGSGNWGCAIAKIVAENTASNPSLFEKDVQMWVFEEKVEIPKDSRHYDPSSPLCQGQQNLTEVINQTHENIKYLPGVSLPHNLKANPSIVDAVQDSTILVFNLPHQFIVRTCEQIKGKILPYARGISCIKGVDVNEEGAHLFSETIGNTLGTYCGALSGANIANEVAREKWSEPTIGYDTPHLDSKAPARSAESTAGVVHFEHKDVSGQYSKTKLQPLPNEFPPVDHETLKTLFHRPYFHIRVNSDVAGVSLAGALKNIVALAAGWVDGLGWGDNAKAAIMRVGLLGMVKFGERFFGATIDNRTFTDESAGVADLITSCSSGRNFRCAKLSIQRKQHISEIEKTELNGQSLQGTLTAIEVNHFLKKQGSESDFPLFTACYHILQGTMQPEVIPSYIER

SEQ ID NO: 1522 - protein, 202 aa, Arabidopsis thaliana
MAENNNNNGDNMNNDNHQQPPSYSQLPPMASSNPQLRNYWIEQMETVSDFKNRQLPLARIKKIMKADPDVHMVSAEAPIIFAKACEMFIVDLTMRSWLKAEENKRHTLQKSDISNAVASSFTYDFLLDVVPKDESIATADPGFVAMPHPDGGGVPQYYYPPGVVMGTPMVGSGMYAPSQAWPAAAGDGEDDAEDNGGNGGGN

SEQ ID NO: 1523 - protein, 389 aa, Salmonella enterica
MDTLRHPKRALIVDIPVQMDDGTIRHFEGYRVQHNLSRGPGKGGVRYHPDVDLNEVMALSAWMTIKCAALNLPYGGAKGGIRVDPFSLSEGELERLTRRYTSEIGIIIGPQKDIPAPDVGTNGKVMAWMMDTYSMNHGTTVTGVVTGKPIHLGGSLGREKATGRGVFVSGLEAARRANIAVEGARVAVQGFGNVGSEAARLFAGAGARVVAIQDHTATLFNATGIDMKALTAWQTEHKQIAGFPGAETIASDAFWRLEMDILIPAALEGQITRQRAEALTCKLVLEGANGPTYPDADDVLASRGILVVPDVVCNAGGVTVSYFEWVQDMASFFWSEEEINARMDKIMTDAIVHVWEKAAEKSCSLRTAAYIVACERILLARKDRGIYPG

SEQ ID NO: 1524 - protein, 318 aa, Silene diclinis
NFLFKSSKEDSPLKATDFGLSDFINPGRKFHDIVGSAYYVAPEVLKRRSGPESDVWSIGVITYILLCGRRPFWDKTEDGIFKEVLRGKPDFGRKPWPTISNSAKDFVRKLLVKDPLVRLTAAQALSHQWVREGGNALDIPIDISVLHNMRQFVKYSRMKQFALRALASTLNDDELANLRDQFDAIDVDKSGTISLEEMRQALAKDLPWKLKDSRVMEIVEAIDSNTDGFVDFTEFVAATLHVHQLHELDNEKWQELSQRAFEKFDVDKDGYITPDELRMHTGLKGSMEPLLEEADIDKDGKISLAEFRRLLRSASMSS

SEQ ID NO: 1525 - protein, 318 aa, Silene vulgaris
NFLFKSSKEDSPLKATDFGLSDFINPSRKFTDIVGSAYYVAPEVLKRKSGPESDVWSIGVITYILLCGRRPFWDKTEDGIFKEVLRNKPDFRRKPWPSISNSAKDFVRKLLVKDPLVRLTAAQALSHQWVREGGSALDIPIDISVLHNMRQFVKYSRMKQFALRALASTLNDDELANLRDQFDAIDVDKSGTISLDEMRQALAKDLPWKLKDSRVMEIVEAIDSNTDGFVDFTEFVAATLHVHQLHELDNEKWQELSQRAFEKFDVDKDGYITPEELRMHTGLKGSMEPLLEEADIDKDGRISLAEFRRLLRSASVSS

SEQ ID NO: 1526 - protein, 244 aa, Brassica napus
  misc_feature (228)..(228): Xaa can be any naturally occurring amino acid
MEEDNHEKQLDDGGSSSLFKTCFNALNALSGIGILSVPYSLARGGWLSLSLLLLLAATAFYTSLLITKCMNADRTIKTYPDIGERAFGRPGRIIVSVFMHLELYLVTTGFLILEGDNLHNLFPGFNIKLMGLRLNGKQSFMASVALVIMPTLWWDSLSVLSYVSMSGVLATAVTLGSISWVGAFDGIGFHQSGKLINWSGIPTALSLYAFCYGAHPVLPTLYSSMKSXHQFTRSTYFFILCTIG

SEQ ID NO: 1527 - protein, 464 aa, Pseudomonas fluorescens
MEYLPLFHNLRGSRVLVVGGGEIALRKSRLLADAGAQLRVVAPEIEAQLQELIVASGGESLLRGYVEADLDGCTLIIAATDDESLNAQVSADAHRRCVPVNVVDAPALCSVIFPAIVDRSPLVIAVSSGGDAPVLARLIRAKLETWIPSTYGQLAGLAARFRAQVKGLFPDVQQRRAFWEDVFQGPIADRQLAGQGAEAERLLQAKIAGKAPHAPGEVYLVGAGPGDPDLLTFRALRLMQQADVVLYDRLVAPAILELCRRDAERIYVGKRRADHAVPQEQINQQLVTLAQQGKRVVRLKGGDPFIFGRGGEEIEELAAHGIPFQVVPGITAASGCSAYAGIPLTHRDYAQSVRFVTGHLKDGTSNLPWSDLVAPAQTLVFYMGLVGLPTICEQLIKHGRGADTPAALVQQGTTSNQRVFTGTLGNLPALVAEHEVHAPTLVIVGEVVQLREKLAWFEGAQSEV

SEQ ID NO: 1528 - protein, 116 aa, Glycine max
VSSVTEALDCSQVRSAEDAQLIEEAREATRSGERMSWEQYGALRRKIGGTYTDFFKSYVEVDGAYVEEGWVDKTCKVCKKDSKGEARQVDKLGRYVHVACLEKANAGNFLTRLSSR

SEQ ID NO: 1529 - protein, 320 aa, Unknown
  Nostoc sp. PCC 7120
MRVARNITELVGRTPLVQLNRIPQEEGCVAQILVKMESMNPSSSVKDRIGVSMINAAEQEGLIAPGKTVLVEPTSGNTGIALAMAAAAKGYRLILTMPETMSGERRAMLRAYGAELELTPGMEGMSGAIRRAQEIVNTTPHAYMLQQFRNPANVKIHRETTAEEIWEDTDGQVDMIVAGVGTGGTITGVAEVLKARKPSFQAIAVEPANSPVLSGGKPGPHKIQGIGAGFVPQVLKTQLIDEVITVTDEEAIAYGRRLAREEGLLSGISSGAALFAAIRVAQRPENAGRLIVLIQPSFGERYLSTPLFQDLETKATASIS

SEQ ID NO: 1530 - protein, 320 aa, Unknown
  Vibrio sp. Ex25
MIKKIGVLTSGGDAPGMNAAIRGVVRTALSEGLEVFGVYDGYLGLYEGRIEKLDRSSVSDVINKGGTFLGSARFPEFKEVEVREKAIENLKKHGIDALVVIGGDGSYMGAKKLTEMGYPCIGLPGTIDNDIAGTDYTVGYLSALNTVIDAIDRLRDTSSSHQRISIVEIMGRHCGDLTLMSAIAGGCEYIITPETGLDKDKLISNIQDGIAKGKKHAIIALTELMMDANELARDIEAATGRETRATVLGHIQRGGRPTAFDRVLASRMGNYAVHLLIEGHGGRCVGIVKEQLVHHDIIDAIENMKRPVRNDLYKVAEELF

SEQ ID NO: 1531 - protein, 727 aa, Saccharophagus degradans
MLFGRRKKNPIVIRDKGVTEWKYATCGYCSVGCSIEIGVNKEGTPVTTRGVGGADVNRGKLCIKGLTEAQIFQAAGRGAEPKIRNKTFEDWQITDWDTALDKTAAEFKRIQEKYGRDSVAVISTGQIMTEEFYTLGKLVRGVIGTNNYDGNTTLCMASAVSGYKRSFGSDGPPGCYEDFEHTDCLLAFGSNLCEQHPIIYWRLKEALEKRKFPVIVVDPRVTMFAQFADIHLPITPGTDLVLLNSLAHVILKEGLADQEYIERCCSGYEDFAAEVEKFDPTSAAKICGIDEDTIRHVARLYAKAGAAMSIWTMGINQSTHGSDGVCGINNLNLITGNIGKPGGTSLSITGQCNAMGTREWSSCSGLPGYRALENAEHREEIGKFWGVDPEFFPKKRGLFQTDIFPAIETGQIKALWVVATNPMTSMPNSARIRKTMEKLEFCVVQDSYEDVETAQYAHVYLPGSVWAEKKGCFTNTERRVNITTPVMAPYGNSKPDVWIFSQMAKRWEQGAKMSFPLDTADVFDEMKQLSKGDHRILDISGMSHELIEQKRGIQWPMREGDSEGTQRLYADGKFCYPDGKAKLMAMPWVDNNEVPDEDYPFWMNSGRVVEHFHTRTKTGKVGNCNKFSPTPYMEMNPDAAEELGIKHMSYVRLVSRRGDAVVMVQLTHRVAFNAVFIPFHFHDCVNRLSLGLLDPYSRQPAFKQCTVRIEHVDQKEAAKLNVEMRAF

SEQ ID NO: 1532 - protein, 172 aa, Streptomyces coelicolor
MAAQTQRAVLAGGCFWGMEELIRRLPGVTATRVGYTGGDVPNATYRNHGTHAEAIEILFDPEATDYRALLEFFFQIHDPSTKNRQGNDIGLSYRSAIYYVDDEQKRIAEDTIADVDASGLWPGKVVTEVEPVGPFWEAEPEHQDYLQRYPDGYTCHFPRPGWRLPARSGSEG

SEQ ID NO: 1533 - protein, 551 aa, Nocardia farcinica
MSTLADVSSDITASAAWRKLHDHHGALAQRHLREIFAEDPERGRELTLQVADLHIDYSKHRATRETLQLLVELAREAGVEAHRDAMFAGEHINTSEDRAVGHVALRLPAGRTMTIDGADAGAQVHEVLRRMGEFTDALRSGQWRGATGERIETVVNIGIGGSDLGPVMVHQALRHYADAGITARFVSNVDPADLVAELTGLNPATTLFIVASKTFSTLETLTNATAARRWLVAALGEDAVAKHFVAVSTNAERVSAFGIDTANMFGFWDWVGGRYSVDSAIGLSVMATIGKERFAEFLAGMHAVDTHFATAPLEANAPVLLGLLGIWYANFFGAESRAVLPYSNDLARFPAYLQQLTMESNGKSVRADGTPVTTATGEIFWGEPGTNGQHAFYQLLHQGTRLIPADFIGFARPTDDLPTADGTGSMHDVLMSNLFAQTKVLAFGKTAEEIAAEGTAPNLVPHKVMPGNRPSTTILAPQLTPAVVGQLIALYEHQVFVEGVIWGIDSFDQWGVELGKQQALALAALLTAAEDPAPQDDSSTDALIRWYRAHR

SEQ ID NO: 1534 - protein, 74 aa, Thermosynechococcus elongatus
MSKQDAIEIEGTVTESLPNAMFRVDLDNGFNVLAHISGKIRRNYIKILPGDRVKVELTPYDLTKGRITYRLRKK

SEQ ID NO: 1535 - protein, 599 aa, Debaryomyces hansenii
MQFPEEDTAIDETTSLVRSRRPTHSILDAPLGSFKGPNSLHNFASSFTRAQSFAASKIDNDIRKKRSFFYNDDNDQHDSVVEDELFDPELMVPSARGERLSVVLHDVIHKNLILSGTDLNMSPNNDVFYQDDIINALNLSKSRKNSTYTGGAMPIHISKRKSFPSPSFSSIRSSISMATTASRFNLTKIEDKEGNIVTVLEGQSTAPQTIFNSINVLIGVGLLALPVGILKAGWVIGVPLLACCGLTTYWSATLLSKAMDTDKTIMTYADLGYAAYGSMAKLFISLVFSMDLLGAGVSLIVLFSDSLYALLGDEVVWTKTKFKLISFFVLTPFTFLPLPILSIFSLFGIISTISITLLVLVCGFLKPDSPGSLISIMPTNMWPQSIPDLLLAIGILMAPFGGHAIFPNLKSDMRHPHKFTGTLSTTYSITLVTDLSMGILGFLMFGAYCNNEITNNLLLTSGYPVWCYPLLSGLICLIPLAKTPLNAKPIISTLDILFSFDKLSGNSFRRFINSFGKLVIRIGVNAVFVGLAILFPEFDRVIGILGSSICFLVCIILPCLFYLKLCNNSVQAFEKAIVSIVIFISIILAFVGTWAVLNF

SEQ ID NO: 1536 - protein, 142 aa, Helianthus annuus
MAAATTTLTGTMASTSFLRPQPTTSMKPSVMFGLKSSNRGGVTMMATYKVTLITPEGKTEFDCADDTYILDHCEDAGIDLPYSCRAGSCSSCTGKVISGTVDQSDQSFLDDDQIEAGWVLTCVAYPTSDVVIETHKEEEMTG

SEQ ID NO: 1537 - protein, 189 aa, Orobanche teucrii
FGHGIKKWNPKMAPYIYISAKHKGIHIINLIKTARFLSEACNLVFDAASRGKQFLIVGTKKQTANSVACAAIKARCHCVNKKWLGGTLTNWSTTESRLNQFRDLRIEQKMGRFKRLPKRDAAVCKRQLSRLQTYMGGIKYMTGLPDIVIIVDQHEEYTALRECITLGIPTICLIDTNCDPDLADFSIPA

SEQ ID NO: 1538 - protein, 242 aa, Vibrio angustum
MATVSMRDMLQAGVHFGHQTRYWNPKMKPFIFGARNRVHIINLEKTVPMFNAALAEIEKIAARKGKVLFVGTKRAASESIKEAAISCDQYYVNNRWLGGMLTNWKTVRQSIKRLKDLEAQSTDGTFDKLTKKEALMRTREMEKLEKSLGGIKNMGGLPDAMFVIGADCEHIAIKEANNLGIPVFAVVDTNSDPDGVDFVIPGNDDAIRAIQLYTGAVAQTVKEARNQDIAVQAEEDGFVAEA

SEQ ID NO: 1539 - protein, 149 aa, Glycine max
  misc_feature (106)..(106): Xaa can be any naturally occurring amino acid
MAHDTTVGLSMAGVVAPFTGLKCMAGFPTRKTNNDITSIASNGGRVQCMQVWPPVGKKKFETLSYLPDLDDAQLAKEVEYLLRKGWIPCLGFELEPRFVYREHNRXPGYYDGRYWTMWKLAMFGWPGASQEWNELKELPLYTGAGYCYH

SEQ ID NO: 1540 - protein, 458 aa, Unknown
  Bradyrhizobium sp. BTAi1
MSMQHVVSDPIRLTAPRRNSLTHIPGDEGWPIIGKTFEVLADPKGHVERNARKYGPVYRSHMFGEVNVVLLGPEANELVLFDQAKLFSSAHGWGHILNLLFPRGLMLLDFEEHRMHRKALSVAFKAGPMKSYLTGLDRGIAARIAQWKQTPGEMLFYPAIKQLTLDLAATSFLGTEIGPEVDAINRAFVDMVAASVAPIRKPLPGTQMARGVKGRQRIVAYFSEQIPLRRAKGDGDDLFSHLCRATDDHGALLSTQDIVDHMSFLMMAAHDTLTSSITSFIAQLAAHPEWQQKLRDEVASLGLVAGAPMASEHLEKMKLTEMAFQETLRLMPPVPSLPRRPIRDFTFKGYAIPAGTGVGVNPMFTHHMPEIWPEPERFDPLRFTDEAQRGRHRFAWVPFGGGAHMCLGLHFAYMQVKCFARHFLSNIEVSFAPGYRPNWQVWPIPKPRDGLRVMLKAV

SEQ ID NO: 1541 - protein, 187 aa, Orobanche lutea
FGHGIKKWNPKMAPYISAKRKGIHIINLIKTARFLSEACNLVFDAASRGKQFLIVGTKKKTANSVACAAIKARCHCVNKKWLGGTLTNWSTTERRLHQLRDLRIEQKMGRFKRLSKRDAAVGKRQLSHLQTYMGGIKYMTGLPDIVIIVDQHEEYTALRECITLGIPTICLIDTNCDPDLADLSIPA

SEQ ID NO: 1542 - protein, 815 aa, Exiguobacterium sibiricum
MKTIIVGGVAGGATAAARLRRLDETAEIILLERGKEISFANCGLPYYIGDVIKDRNKLLVQTPEGMNARFNLDVRNLSEAIRINRQQKTVTTRKVDTGEEYEESYDQLILSPGAKPIRPGIPGLAEATNVFTLRNIPDTDKMRQYVDESRPAHATVIGGGFIGLEMAENLVERGARVTLIEMSDQVMAPVDPEMAAIVHEHLRAKGVELILADGVSRFEEAGTRVVLTSGKTIQTEMNILSIGVMPESNLASEAGLKLGIKQTIQVDETLRTSDPAIFAIGDAIEVKDYITGEPVHVPLAWPANRQGRLVADIIAGRDVRYTGTLGTAVAKVFDLTVASTGNNEKRLRQSGRRYEAIHLHPGSHAGYYPGASPISMKLLFDPVDGTIFGAQAIGMTGVEKRIDVLATAIKGGLTVLDLPDLELSYAPPYSSAKDPVNMAGYIASNIVLGDSENVHWHEIDQIVTDGGLLLDVREPSENELGSIPGSVNISLPTLRQSLDELPKDQPIYVTCQVGLRGYVASQLLKQNGFDVKNLSGGYKTWATVNRDREARSQVREETAVTTIKSEPKQVTKEQITLLDTCGLQCPGPILELKTKIDQLQDGDQVFVKASDPGFLPDVQAWAKKLGHTVHTAEMNKGVVEVLLEKGNATNQPVQSAAATADDATMVVFSGDLDKALASFVIAQGAQAMGKQVTMFFTFWGLNVIRKPDAPAVDKAPMERMMGMMMPKHAGELPLSNMNMAGAGQKMMKKVMKDKQVDALETMMAKAQAAGVRMIACTMSMDIMGIKKEELLDDIDYGGVASYLGATDGSNLNLFI

SEQ ID NO: 1543 - protein, 187 aa, Orobanche sintenisii
FGHDIRKWNPKMAPYISATRKGIHITNLIKTARFLSEACNLVFDAASRGKQFLIVGTKKKTANSVACAAIKARCHCVNKKWLGGTLTNWSTTERRLHQFRDLRIEQKMGRFKRLPKRDAAVSKRQLSRLQTYMGGIKYMTGLPDIVIIVDQHEEYTALRECITLGIPTICLIDTNCDPDLADLSIPA

SEQ ID NO: 1544 - protein, 429 aa, Unknown
  Rhodococcus sp. RHA1
MTTTTECGFGRTPEHRESDYRENAATQPRVDAATVRGGEPLLRVTWSDPVTEARGYLVVHTLVSDLATGGTRMRAGCTMSEVEDLAKGMAAKTAVFDLPVGGAKGGIDFDPKDPRAIGVLERFCQAMRPWLAAHWVTAEDLGVPQHLLDDVFARLGLQQSYHAAISRAEDPQRTLRRVRAALNAPVPSGFLLGDVIGGYGVAQACIGTVNAYGWTPADTTVAIQGIGTMGGGAAWYLYEAGMRVIAVADAFGTLYCPDGLDVPALLDLRDCYGEIDRSRVPSHVQRLPSTAVIATAADILVPAAISYAITSDNVHQVAAKVLIEAANAATTPRAEAVLTGRGIPVVPDFVANAGAVAWAWWVLLSQVGTDPEDSFLRLRTEMLAKVALLLGQWKLDGVAPRQTAWDLVGANRHAPAPTDPLAVPALTIP

SEQ ID NO: 1545 - protein, 380 aa, Ralstonia solanacearum
MAKRDYYEVLGVGKNASDDEIKKAYRKLAMKYHPDRNPDSKEAEEKFKEAKEAYEMLSDADKKAAYDQYGHAGVDPNMAGGFGAGAQGFGGFAEAFGDIFGDIFGQAQQGGRRGAGPQMYRGADLRYSMEITLEQAAHGYDTQIRVPHWDECDHCHGKGAEPGSSVETCPTCHGAGQVRVSQGFFTMQQTCPKCHGNGKYIPKPCSKCHGQGKVKSQKTLEVKIPAGIDEGMRIRSSGNGEPGINGGPPGDLYVEIHIKAHSVFERDGDDLHCQMPISFAVAAMGGDIEVPTLGGRVTFNVPEGTQAGKTFRLRGKGIKGVRSGYAGDLYVHVVIETPVRLTEHQRELLRQFDKSVHEGGSRHSPQEQSWLDKVKNFFSS

SEQ ID NO: 1546 - protein, 151 aa, Unknown
  Candidatus Blochmannia sansabeanus
KPFIFGVRNKIHIINLETTILMFKQALVELNKIASLKGKILFVGTKRAASEAIKKTALACNQFFVNHRWLGGMLTNWKTVRQSIKRLKDLETQSQDGTFKKLTKKEALILNRELINLENSLGGIKNMGGLPDAIFAVGATHEHIAIKEANS

SEQ ID NO: 1547 - protein, 382 aa, Vibrio fischeri
MMSLPIVIIGSGFASYQLIKTIRRTNNDCPIHVFTNDSGDDYNKPDLSHVFSKQQSPEEVVTLSGGDFAEQYNVILHRHTWVESIDTEIQAITANGEQYAYGKLVLATGSQTFIPPFHGDGCGDILTLNSLKEFAGIQQKVLESKKVLVVGGGLIGTELAMDLANAGKMVTLVEPNTHLLANMVPDFISLPLEKACKEKGITVNLSDCVQAVNKQEQGYRVTTSNGHSYYVDCVISAAGLKPNTKLATEANLMVNRGIVVDLNLQTSANNIYALGDCAEIEGKVMAYLQPILLSANALAKTLLGTDTALSMPNMMVKVKTPNYPIQLAGNTSTDIERWSVDIDTQGLCAKAYNINNQLTGFVVTNERVKNAFPLFRELNTTN

SEQ ID NO: 1548 - protein, 158 aa, Unknown
  Candidatus Blochmannia vafer
TRYWNPQMKPFIFGVQNKIHIIDLDKTILMFNKALVELKKITTLKGKILFVGTKRAARESIKSTALICGQFFVNHRWLGGMLTNWKTVRQSIKRLKELENQSQDGTFQKLTKKEVLILKHELRGLENSLGGIKNMGGLPDAIFTVGAIHEHIAIKEAN

SEQ ID NO: 1549 - protein, 178 aa, Pseudoalteromonas tunicata
MTTQTELATFGGGCFWCIDAAFRQVKGVVQVLSGYAGGEIVAPTYQQICTGQTGHAEVVQIEFDPTVVTFDTLLAMFFVLHDATQLNRQGNDIGTQYRSVIFYHSDQQQQSIQEKIAALQPTLSAPIVTELSPAPVFYSAEQYHQDYYNANPNQGYCSIMIAPKIAKFSAIFTNYLIE

SEQ ID NO: 1550 - protein, 496 aa, Vibrio fischeri
MTIHIKNNVNWVGQRDWEVSDFHGTEFKMTKGTSYNSYLIQEEKTVLIDTVDHRFSHQFIQNLEMEIDLASIDYIVINHAEEDHSGALAALMEKIPGTPIYCTENAIDSIVGHHHHPEWNFNPIKTGDALDIGNGKQLIFVEAPMLHWPDSMMTYLTGDAILFSNDAFGQHYCDERLFNDEVDQTELMDQCLRYYANILTPFSALVTAKIKEVLSFNLPVDMIATSHGCVWRDNPTQIIHQYLEWADNYQEDRITIFYDSMSNNTRMMADAIAQGIHDVDPAVAVKVFNVSRQDKNDILTSVFRSKGILVGSSTMNNVMMPKIAGMLEEIAGLRFRAKKAGAFGSYGWNGGAVDRIHSRLTDAGFETAVGLKAKWRPDGQAMKLCREHGQFIAKQWALAPLTTTFNTINVDKKIQTIEEPVVLVEPSAELEKPATEVTSSKDAKQCMLCSVCNWVYDPEIGEPNQGVEPNTPWSSVPNDFLCPECHLGKDVFVEIK

SEQ ID NO: 1551 - protein, 498 aa, Geobacillus kaustophilus
MSMNWGMAMHNDQPLIFERSKPGRIAYSLPALDVPAVDVSELVPADYLRTEEPELPEVSELDLMRHYTALSKRNHGVDSGFYPLGSCTMKYNPKINENVARLAGFAHIHPLQPEKTVQGALELMYDLQEHLKEITGMDAVTLQPAAGAHGEWTGLMMIRAYHEANGDFNRTKVIVPDSAHGTNPASATVAGFETVTVKSTADGLVDLEDLKRVVGPDTAALMLTNPNTLGLFEEQIVEVAEIVHAAGGKLYYDGANLNAILGKARPGDMGFDVVHLNLHKTFTGPHGGGGPGSGPVGVKADLVPFLPKPVIEKGENGYYLDDDRPQSIGRVKPFYGNFGINVRAYTYIRSMGPDGLKAVSEYAVLNANYMMRRLADYYDLPYDRHCKHEFVLSGRRQKKLGVRTLDIAKRLLDFGFHPPTIYFPLIVEECMMIEPTETESKETLDAFIDAMIQIAKEAEENPEIVQEAPHTTVVKRLDETTAARKPILRYQKPKHSDN

SEQ ID NO: 1552 - protein, 178 aa, Glycine soja
MASSMISSPAVTTVNRAGAGMVAPFTGLKSMAGFPTRKTNNDITSIASNGGRVQCMQVWPPVGKKKFETLSYLPDLDDAQLAKEVEYLLRKGWIPCLEFELEHGFVYREHNRSPGYYDGRCWTMWKLPMFGCTDASQVLKELQEAKTAYPNGFIRIIGFDNVRQVQCISFIAYKPPSF

SEQ ID NO: 1553 - protein, 448 aa, Geobacillus kaustophilus
MLHRYLPMTEEDKQEMLKTIGVASIDDLFADIPEQVRFRGELKVKPAKSEPELWKELAALAEKNASVKQYVSFLGAGVYDHYIPAVVDHVLSRSEFYTAYTPYQPEISQGELQAIFEFQTMVCELTGMDVANSSMYDGGTALAEAVLLSAAHTKRKKVLISTAVHPQYREVVRTYAKGQKLEVKEIPYDGGITDLKALEAEMGDDVACVVVQYPNFFGQIEPLKAIAPLAHEKKSLFVVASNPLALGVLTPPGAFGADIVVGDMQPFGIPTQFGGPHCGYFAVKAPLMRKIPGRLVGQTTDEDGRRGFVLTLQAREQHIRRDKATSNICSNQALNALAASVALSALGKRGVKEMAAMNIQKAHYAKVELEKRGLSSPFAGPFFNEFVIRLGRPVSDVNDRLLEKGIIGGYDLGADYPELAGHMLVAVTELRTKEEIDRFVNELGDGHA

SEQ ID NO: 1554 - protein, 316 aa, Pseudomonas fluorescens
MNDAKHSRLIILGSGPAGYSAAVYAARANLKPTVITGLQAGGQLTTTTEVDNWPGDVEGLTGPVLMERMQRHAERFDTEIVYDHIHTAQLQQRPFILIGDSGTYSCDALIIATGASAQYLGLPSEEAFAGKGVSACATCDGFFYRNQVVAVVGGGNTAVEEALYLSNIAKEVHLVHRRDKLRAEKILQDKLFDKAANGNIRLHWNQHLEEVLGDASGVTGARLKDSHSGETKDLPLAGVFIAIGHKPNTDLFQGQLEMRDGYLLVRGGSEGNATATGIQGVFAAGDVADHVYRQAITSAGAGCMAALDAEKFLDDN

SEQ ID NO: 1555 - protein, 157 aa, Triticum aestivum
  misc_feature (47)..(47): Xaa can be any naturally occurring amino acid
  misc_feature (57)..(57): Xaa can be any naturally occurring amino acid
  misc_feature (81)..(81): Xaa can be any naturally occurring amino acid
  misc_feature (91)..(91): Xaa can be any naturally occurring amino acid
  misc_feature (133)..(133): Xaa can be any naturally occurring amino acid
  misc_feature (137)..(137): Xaa can be any naturally occurring amino acid
MIAMLSSYSRTMCRDAAHITSGASSHHEDVLRQDGCLFCKQIGKVMXCVYALFGAAXLRNETSSVDWWTLKSLSKEEKEMXHLYERREFIXTGDEEAVEEFIKTEGALGTAIGNKDLVDTNVYYDKIQKQVQXKSFXQEAQRLRLRMWNEVSHVFQE

SEQ ID NO: 1556 - protein, 461 aa, Burkholderia mallei
MATDQDNDGLKRGLKNRHIQLIALGGAIGTGLFLGIAQTIRMAGPSVLLGYALAGVVAFFIMRQLGEMVVDEPVAGSFSYFASKYCGHFTGFLSGWNYWVLYVLVSMAELSAVGIYVQYWWPGVPTWISALVFFVVINAVNLASVKSYGETEFWFSIVKVAAIIGMIGFGGYLLLSGHAGPDAGVANLWRHGGFFPNGIGGLAMAMAVIMFSFGGLELVGITAAEADDPSHSIPRATNQVIYRILIFYIGALGVLLSLYPWQKVVTGGSPFVLIFHALSSDIAANVLNLVVLTAALSVYNSCVYCNSRMLYGLAQQGNAPQALARVNRRGIPIAALGVSAFATALCVVINYFMPGKAFELLMGLVVSAIIINWAMISVIHLRFRQAKRAAGETTRFRSLGYPLTNYFCLAFMAAILVVMFRTPELRLSVYLIPVWLVVLALGYRFRQRGAGYALGGGVSAR

SEQ ID NO: 1557 - protein, 557 aa, Yersinia pestis
MIESFAQLFEESLKTIETRPGSIVRGVVVSIDKDIVLVDAGLKSESAIPAEQFKNAQGELEIQVGDEVDVALDAVEDGFGETLLSREKAKRHEAWLMLEKAYEEAATVTGVINGKVKGGFTVELNGIRAFLPGSLVDVRPVRDTLHLEGKELEFKVIKLDQKRNNVVVSRRAVIESENSAERDQLLENLQEGMEVKGIVKNLTDYGAFVDLGGVDGLLHITDMAWKRVKHPSEIVNVGDEITVKVLKFDRERTRVSLGLKQLGEDPWVAIAKRYPESTKLTGRVTNLTDYGCFVEIEEGVEGLVHVSEMDWTNKNIHPSKVVNVGDVVEVMVLDIDEERRRISLGLKQCKSNPWQLFAETHNKNDRVEGKIKSITDFGIFIGLDGGIDGLVHLSDISWNVAGEEAVREYKKGDEIAAVVLQVDAERERISLGVKQLAEDPFNNYLSVNKKGAIVTGKVTAVDAKGATVELAGGVEGYLRAFEATRDRVEDATLVLNVGDEVEAKYTGVDRKNRVISLSVRAKDEADEKDAIATVNTKPEESNFSSAMAEAFKAAKGE

SEQ ID NO: 1558 - protein, 167 aa, Solanum lycopersicum
MAEGSPKSIYDFTVKDIQGNEVPLSNYRGKVLLIVNVASKCGLTDSNYKELNILYEKYKDQGFEILAFPCNQFLWQEPGTNEEIQQTVCTRFKAEFPVFEKIDVNGDNAAPLYKFLKSEKGGFLGSAVKWNFTKFLVDKEGKVVERYAPKTPPLQFEKDIKNLLGVA

SEQ ID NO: 1559 - protein, 510 aa, Burkholderia mallei
MCGIGAIFSTQRASVDGIERSLSALMSKIAHRGDASRFNENLIRERFGLATNRLAIVERDHARQPVSDHERDLHVVLNGQIYNYKELRDELAARGHRFSHAGDAEVLLRAYLEYGPSFATKLDGMFSFVLFDNLNGKFLIGRDHVGIKPLYYAQRDGVWYVASELKALTHVNARIETLAPGTLFDGKETIRYVSYDASRPVSRDSFDEAKARVRTPLEESVRRRVDTDLPICVMFSGGIDSAIVLRLAHRYHPDVTAISFGLPGSNDIEIAHRYCAEHGIRHVIYTFTKQDLLENIDDAVYYGEFFEKIDAIDSAIAHFGYYIANKLGLKVALCGEGSDEIFGGYDLFKTHAQPGALSLYRLNNLHRTDLQRVDRASMRNTVEARVPFMDAELIDYVLSLDFSYKLHGGVEKHILREAFRDVLPGYIIDRPKIRMPDGSGVKNVIIDHIDSLGDAPPDDAARRLGEIGLSDRSALFFARKYLECNFPFPTQRFKQAGKDFSESGYFDFIS

SEQ ID NO: 1560 - protein, 484 aa, Corynebacterium glutamicum
MTNGDNLAQIGVVGLAVMGSNLARNFARNGNTVAVYNRSTDKTDKLIADHGSEGNFIPSATVEEFVASLEKPRRAIIMVQAGNATDAVINQLADAMDEGDIIIDGGNALYTDTIRREKEISARGLHFVGAGISGGEEGALNGPSIMPGGPAKSYESLGPLLESIAANVDGTPCVTHIGPDGAGHFVKMVHNGIEYADMQVIGEAYHLLRYAAGMQPAEIAEVFKEWNAGDLDSYLIEITAEVLSQVDAETGKPLIDVIVDAAGQKGTGRWTVKAALDLGIATTGIGEAVFARALSGATSQRAAAQGNLPAGVLTDLEALGVDKAQFVEDVRRALYASKLVAYAQGFDEIKAGSDENNWDVDPRDLATIWRGGCIIRAKFLNRIVEAYDANAELESLLLDPYFKSELGDLIDSWRRVIVTATQLGLPIPVFASSLSYYDSLRAERLPAALIQGQRDFFGAHTYKRIDKDGSFHTEWSGDRSEVEA

SEQ ID NO: 1561 - protein, 392 aa, Pseudomonas syringae
MHNPTPRTESPSALAFIKRFFAAEAAGGLILMAAALAALIVANSPLADSYFAALHTVLAGMSVEHWINDGLMAIFFMLVGLEIKREMLAGQLASWSQRALPGFAALGGMVVPALIYVAFNWGQPDTIGGWAIPAATDIAFALGVLSLLGKRVPLSLKIFLSALAILDDLGAVLIIALFYTSDLSIPMLLAALGSIAVLVALNRLSVKKLLPYLIVGALLWFFMLQSGIHATLAGVALALCIPLGKPDEEASSPLLHLEEKLHPWVAFAVVPVFGFANAGVSLSGITVDKLLDPVPLGVALGLLIGKQVGIFALAALAIRAGLARLPDGSNWGQLYGVAALCGIGFTMSLFIGALAFPGAPELVDEVKVGVLIGSVLSALLGVVVLRRFGARG

SEQ ID NO: 1562 - protein, 323 aa, Debaryomyces hansenii
MPSFNKSFVMNHTCLRIKDPKVSIPFYTENLGMKLIATLPFPDSKFTLYMLAYDNGDNNNDVSWSAREGVLELCHNHGVENDESYTLNNGNGEKFRGFGHICVSVDNIEAAEAQFLSKGVKFQKKLSDGRQKNIAFALDPNGYWIELIEHGQGKASDKTDSTHYKLNHTMIRVKDPKKSLDFYRNVLGMKLFSTSVHEGAKFTLYFLGYEHDASFKEDTLSRDEQSKKQGLIELTHNWGTESDNDFEGYHNGNSTENGAIQGYGHTCVSCSDPGKFCKEINEEFGEANIDWAVQWGKGGIKQLAFIRDPDGYSIEIINSVFKQ

SEQ ID NO: 1563 - protein, 230 aa, Brassica napus
  misc_feature (222)..(222): Xaa can be any naturally occurring amino acid
MKQEEQEREDLYHTDDDEDEESQAHSSVPSTPLSRNDSNTDAVPWPRSYRQSMDLLTGVTPPISTNLVSSFRKRRQSSAFGSFASSSSKQSLLIDKDETQNSIVTSIKSLTDSHLKLSVPDDLSIPQENRKCTISQSVINGVNVLCGGALLTMPYALKEGGWLGLLILFSFGIITLYTGILLKRCLENSPGVHTYPDIGQAAFGTTGRILLSIFLYMDLYAXCVEYIIMM

SEQ ID NO: 1564 - protein, 432 aa, Kineococcus radiotolerans
MGLPSLTGGHVTVAGPIVPLVATPNVLAIVLAGGEGKRLMPLTADRAKPAVPFGGTYRLIDFALSNLVNAGYRKVVVLTQYKSHSLDRHISQGWRMSNLFGSYIASVPAQQRVGQRWYLGSADAIYQSLNLVSDERPDIVVVVGADHVYRMDFSQMVDAHIASGSPCSVAAIRQPISLADQFGVIQTAPGSNRIAEFLEKPKDPQGLEDSPHEVLASMGNYVFDADALVDAVTRDSENEGSKHDMGGDIVPDFVSRGQASVYDFKDNEVPGATDRDRAYWRDVGTLDSYFEAQMDLISVLPVFNLYNYEWPIITAQDYYPPAKFVHGWQGTYGHAVNSIVSQGTVVSGALVEKSVVSPNVRLDSWAHVSESVLMDGVQVGRHAVVQRAIVDKFVTVPDDARIGVDPEEDRARGFHVTDSGITVVGKGQTIPT

SEQ ID NO: 1565 - protein, 318 aa, Prochlorococcus marinus
METIETDVVIVGGGPAGCSCALYTSRADLRTVILDKNPDVGALAITHQIANYPGVSSEMSGEALLKLMRDQATQYGADYRRAQVFGIDSSGDWKTIYTPEGTFKAKALVVASGAMGRPASFKGEAEFLGRGVSYCATCDGAFYRDREVAVVGINKEAIEEANVLTKFASKVHWITSNDPKSDDHHAQDLLSKPNVNHWSKTRLMQIEGNDGGVTGIKVKNRSIDTLQDLALEGVFVYMSGSKPITDFLGEQVAFKEDGGVLVDDFMSTTVEGVWAIGDIRNTPFKQAVVAASDGCIAAMAIDRYLNSRKSIRVDWVHA

SEQ ID NO: 1566 - protein, 432 aa, Triticum aestivum
MAERLASSASLLPSAASPSSSTRRAAVASGLRLRPSPSRFSQAARRARGGAGAAGVVPRLRAVRCMAASEAAQLKSAREDIKEILKTTYCHPILVRLGWHDSGTYDKNIEEWPQRGGADGSLRFDPELSHGANAGLTNALKLIQPIKDKYPGITYADLFQLASATAIEEAGGPKLPMKYGRVDIAAPEQCPPEGRLPDAGPRIPAEHLREVFYRMGLDDKEIVALSGAHTLGRSRPDRSGWGKPETKYTKDGPPGEPGGQSWTAEWLKFDNSYFKDIKEQRDQELLVLPTDAALFDDPSFKVYAEKYAEDQGAFFKDYAEAHAKLSNLGAKFDPPEGFSLDEDKGAVATEEKVVADPAPTSDTNGAGPQPEPFVAAKYSYKKRELSDTMKQKIRAEYEGLGGSPNKPMKSNYFLNIMIVIAGLAFLTSLVGN

SEQ ID NO: 1567 - protein, 72 aa, Gluconobacter oxydans
MSKEDLIEFTGTVMELLPNAMFRVTLDNEHTILAHTSGKMRKNRIRVLAGDRVNVEMTPYDLSKGRITFRFK

SEQ ID NO: 1568 - protein, 826 aa, Bacteroides fragilis
MKIIIIGGVAGGATTAARIRRSDETAEIILLEKGKYISYANCGLPYYIGDVIEEREKLFVQTPEAFGVRFRVDVRTENEVIFIDRKKKTVTVRLKSEDTYEESYDKLLISTGASPVRPPLPGIDSTGIFTLRNVADTDRIKAYVNNRPPRRAVVIGAGFIGLEMAENLHALGAQVSIVEMGNQVMAPIDFSMAALVHQHLMEKGVNLYLEQAVASFEQAGKEVKVVFKNGQSILADIVILSIGVRPETTLARAAELTIGEAGGIAVNDYLQTSDESIYAIGDAIEFRHPITGKPWLNYLAGPANRQGRIVADNLLGAQIPYEGAIGTSIAKVFDMTVASTGLPGKRLKQAGIVYASSTTHPASHAGYYPDAMPMSIKITFDPQTGKLYGGQIVGYDGVDKRIDELSLVIKHEGTIYDLMKVEQAYAPPFSSAKDPVAIAGYVAENIILGRVKPVYWRDLRDIELKDVFLLDVRTPDEFALGSLPGAVNIPLDEIRDRIAELPSNKPIYTFCAVGLRGYLVYRILIQHGFKEVYNLSGGLKTYRAATAPIILHENEETDDTPSAQDSPAEPSVAAEAPQTTTAANPKTIRVDACGLQCPGPVLKMKKTMDTLVPGERVEIVATDPGFSRDAAAWCNSTGNKFISKDSTGGKSVVVIEKGEPQACNLTTTCDSKGKTLIMFSDDLDKALATFVLANGAAATGQKVTIFFTFWGLNVIKKLHKPKVEKDIFGKMFGTMLPSSSLKLKLSKMSMGGMGGKMMRYIMHRKGIDSLESLRQQALENGVEFIACQMSMDVMGVKREELLDEVTVGGVATYMERADNANINLFI

SEQ ID NO: 1569 - protein, 225 aa, Glycine max
  misc_feature (200)..(200): Xaa can be any naturally occurring amino acid
SGIKQRLLSFIFQGLWNEERDDTLRIQRLRKKFYFHFQDYVDLIIWKVQFLDRHHLLIKFGSVDGGVSRNADHHPAFVAVYNMDTTEIVSFYQNSADELYLLFEQFCDHFHATSRNSMYMNFISSHSNNIHALEQLRSIKDKASSSAQFVKKMLASLPFSCQSQSPSPYFDQSLFRFDDKLISATDRHRQSTDHPIKFIXGGPEAGSMDGRAKKNSSFLFIQFWP

SEQ ID NO: 1570 - protein, 935 aa, Mannheimia succiniciproducens
MINLKIDGFDVRVDEGTTILEAAKSVGINIPTLCYLKDVSDIGSCRVCVVEVEGFEKLPTSCNTLAQEGMVIRTQTDKVVKSRRMALDLILSHHNLICFSCPSNGACELQNVAHQCGISESSFPNFRLPGIEVPHVEDNPFLGYRPDLCIHCQRCINTCANVSGCSSIKLASRGIFRAIETPFGKDWKETTCESCGNCAEACPTGAIYKKEAKSYRSWEIQRVRTTCPHCAVGCQYDLLVKDNKLVGAEGVDGPSNGGRLCVKGRFGSYKFVMSGDRLTDPLIKDRATGKFRKASWDEALDLVASKFMTLKRQYGGDSLAGFACSRSPNEDIYMVQKMVRTCFGTNNTDNCARVCHSASVEGLARTLGSGAMTNPIYDITHDVDAILLVGSNPEEAHPVIGMQIREAVRNGTKLIVVDPRDIGLTKQADIHLKLRPGTNIAFANGMCHIFIKEGLIDEKFIAEHTEGFKELKKIVKDYTPEYVAEICGIDADDLRAAARIYATAKKAPIIYCLGVTEHSTGTEGVMSMSNMAMMVGKIGREGCGVNPLRGQNNVQGACDMGASPNQYPGYQSVKDPEIRAKFEKAWGVKLPAHIGLHATDVFPAAIKGKIKGLYICGEDPVVTDPDTNHVINALKSLDFLVVQELFMTETALLADVVLPGRSYAEKDGTFSNTERRVQRVRKAITLPGNSRLDTDIICELMRRMGYNQPNLTASEIFDEMASVTPSFRGISYERLEKEPTQSLQWPCTDQYHPGTPIMHVGKFARGLGLFYPTVYTPAKELPDAQYPMMLTTGRILYHYNTRAMTGRTEGLMEIAGHSFIEINSADAKRLNIENGERVRVTSRRGTITTEARVSDKTNEGETWMPFHFADGNCNWLTNAALDQFARIPEYKVCACRIEKLPEDEAFNMKGKYITQKMVAAQWRKKMDKSIAKLVR

SEQ ID NO: 1571 - protein, 285 aa, Thermosynechococcus elongatus
MRTLTVAAIQAQLTDDVETNILHLSDLVRQAHQRGAQLIVLPELFEGHYFCKEEREIHFQRAHPVKKHPTIAHFEALARELEVVIPVSFFEKAGTVYYNSVAMIDAGGVNLGVYRKSHIPDGPGYEEKFYFRPGNTGFRVWRTRYGRIGVGICWDQWFPEAARVMTLMGAEVLVYPTAIGSEPHDPTLDTKDPWQRVMVGHAVANVIPVVAANRVGNEGGQVFYGSSFIANPRGDLVAEADRSQEAVLVHKFDLGEIERLRAAYGFFRDRRPGLYKALLTADGVI

SEQ ID NO: 1572 - protein, 187 aa, Orobanche grossheimii
FGHDIRKWNPKMAPYIYAKRKGIHITNLIKTASFLSEACNLVFDAASRGKQFLIVGTKKQVANSVACAAIKARCHCVNKKWLGGTLTNWSTTERRLHEFKDLRIEQKMGRFKRLSKRDAAVGKKQLSRLQTYMGGIKYMTGLPDIVIIVDQHEEYTALRECITLGIPTICLIDTNCDPDLADLSIPA

SEQ ID NO: 1573 - protein, 156 aa, Unknown
  Candidatus Blochmannia laevigatus
  misc_feature (5)..(5): Xaa can be any naturally occurring amino acid
YWNPXMKPFIFGVRNKIHIIDLETTSVMFKQALIELNKIAALKGKILFVGTKRAASESVKKTALACNQFFVNHRWLGGMLTNWKTVRQSIKRLKDLEIQSQDGTFKKLTKKEALILNRELINLENSLGGIKNMGGLPDAIFAVGATHEHIAIKEAN

SEQ ID NO: 1574 - protein, 187 aa, Orobanche flava
FGHGIRKWNPKMAPYISAKRKGIHITNLIKTARFLSEACNLVFDAASRRKQFLIVGTKKQVANSVACAAIKARCHCVNKKWLGGTLTNWSTTERRLHQFRDLRIEQKMGRFKRLTKRDAAVGKRQLSRLQTYLGGIKYMTGLPDIVIIVDQHEEYTALQECITLGIPTICLIDTNCDPDLADLSIPA

SEQ ID NO: 1575 - protein, 448 aa, Streptococcus suis
MSNAKAYIQASFEAVKARNPHETEFLQAVEELFSTLEPVFEAHPEYIEENILARIVEPERIISFRVPWTDKYGNVQVNRGYRVQFNSAVGPYKGGLRFHPTVNQSILKFLGFEQIFKNVLTGLPIGGGKGGSDFDPKGKTDAEIMRFCQSFMTELQKHIGPSLDVPAGDIGVGGREIGYMYGQYKRLRQFDAGVLTGKPLGFGGSLIRPEATGYGLVYFTDNMLAANGKSFKDQTVLISGSGNVAQYAVQKATELGAKVISVSDSNGYIIDETGIDFDLLVDIKEKRRARLTEYATEKATAKYFEGSVWNYDGKADIALPCATQNEINGEQAAALVKNGVYCVAEGANMPSDLDAIKVYKENGVLYGLAKAANAGGVAVSALEMSQNSLRLSWTREEVDGRLKDIMANIFNTAKETAEKYDLGTDYLAGANIAAFEQIADSMIAQGLV

SEQ ID NO: 1576 - protein, 435 aa, Unknown
  Acidovorax sp. JS42
MAQLPQRAAPSASTIGEDPRHTRKAWSVLIVSTLAFTVCFMVWMMFGVIGIPIKKMLNLSSTQFGLLTAMPVLTGSLVRVPLGIWTDRYGGRIVMALLMAATVPAIWMMGYATEYWHFLVIGLFVGLAGGSFSVGTPYVARWFPKHRQGMAMGVYGAGNSGAAVNKFIAPVILVAFGWQAVPQVYAAIMLGTLVLFWLFSHSDPAHLVPSNVSFGEQLKALKDPKVLKYCQYYSIVFGGYVALSLWMVQYYVGEYGLDIRVAALLAACFSLPGGVLRAIGGVLSDKFGAHSVTWWVMWVSWICLFLLSYPQTDFTIQTVNGPITLHVGLNVYMFTALMFVLGIAWAFGKASVFKYISDDYPKNIGAISGIVGLAGGMGGFVLPIMFGALMDWTGIRSSAFMLMYGVVWVSLIWMYFTEVRRTDVMGSGGSAPAAR

SEQ ID NO: 1577 - protein, 460 aa, Exiguobacterium sibiricum
MKEHPTELRRDLKTRQLTMIAMGCAIGTGLFLGSGLAISLAGPSVLVSYAIGAFIVLLLMGCLAEMTVAHPTSGSFGTIAEKYIGPYAGFLVRYSYWVANVLAIGVEVSAIAIYMKYWFPDVPGYIWIFVFAAALIYINATTVNTFATFEYWFSVIKISAILMFMILGAYLVFGSSSPEIGPQNFTNDGGFMPFGFSGLWIAVFISLFSFLGTELIAVTAGEAKDPDVAVPKALKATVFRLSTFYVITIALMLMIVPWQQAGGVDESPFVKVMEMLSIPGAAGIMNFIVLTAALSAMNSQLYASTRMMYSLSKATYAPRMFSRLNAKGVPLFALAVSTLGIFLAAVISSQSSVSYPFMMGISMFGAIFTWFMIFISHLYFRKAWERDGGRKLPVRMMGYPYLTALGALLLFALVITTWFTDFQIVLKFGIPWLIFLTIAYVFWKRNHPPQADQTNRSQSL

SEQ ID NO: 1578 - protein, 147 aa, Unknown
  Candidatus Blochmannia sayi
FIFGVRNKIHIINLEITITMFKKALIELSKIVSLKGKILFVGTKRAASESVKKTAIICNQFFVNHRWLGGMLTNWKTVRQSIKRLKDLEVQSKDGTFKKLTKKEVLILNRELTNLENSLGGIKNMGGLPDAIFAIGSAHEHIAIKEA

SEQ ID NO: 1579 - protein, 187 aa, Orobanche gracilis
FGHGIRKWNPKMAPYISAKRKGIHITNLIKTARFLSEACNLVFDAARRGKQFLIVGTKKKAANSVTCAAIKARCHCVNKKWLGGTLTNWSTTESRLHQFRDLRIEQKMGRFKRLTKRDAAVGKRQLSRLQTYFGGIKYMTGLPDIVIIVDQHEEYTALRECITLGIPTICLIDTNCDPYLADLSIPA

SEQ ID NO: 1580 - protein, 448 aa, Streptococcus suis
MSNAKAYIQASFEAVKARNPHETEFLQAVEELFSTLEPVFEAHPEYIEENILARIVEPERIISFRVPWTDKDGNVQVNRGYRVQFNSAVGPYKGGLRFHPTVNQSILKFLGFEQIFKNVLTGLPIGGGKGGSDFDPKGKTDAEIMRFCQSFMTELQKHIGPSLDVPAGDIGVGGREIGYMYGQYKRLRQFDAGVLTGKPLGFGGSLIRPEATGYGLVYFTDNMLAANGKSFKDQTVLISGSGNVAQYAVQKATELGAKVISVSDSNGYIIDETGIDFDLLVDIKEKRRARLTEYAAEKATAKYFEGSVWNYDGKADIALPCATQNEINGEQAAALVKNGVYCVAEGANMPSDLDAIKVYKENGVLYGLAKAANAGGVAVSALEMSQNSLRLSWTREEVDGRLKDIMANIFNTAKETAEKYDLGTDYLAGANIAAFEQIADSMIAQGLV

SEQ ID NO: 1581 - protein, 92 aa, Arabidopsis thaliana
MSNRRSRQSSSAPRISDNQMIDLVSKLRQILPEIGQRRRSDKASASKVLQETCNYIRNLNREVDNLSERLSQLLESVDEDSPEAAVIRSLLM

SEQ ID NO: 1582 - protein, 172 aa, Unknown
  Candidatus Blochmannia festinatus
HQTRYWNPKMKPFIFGVQNKIHIIDLDKTILMFNKALVELKKITTLKGKILFVGTKRAARESIKSTALICGQFFVNHRWLGGMLTNWKTVRQSIKRLKELENQSQDGTFQKLTKKEVLILKHELRGLENSLGGIKNMGGLPDAIFTVGAIHEHIAIKEANSLGIPVFSIVDT

SEQ ID NO: 1583 - protein, 187 aa, Orobanche rapum-genistae
FGHGIRKWNPKMAPYISAKRKGIHITNLIKTARFLSEACNLVFDAASRGKQFLIVGTKKQAANSVACAAIKARCHCVNKKWLGGTLTNWSTTERRLHQFRDLRIEQKMGRLKRLPKRDAAVGKRQLSRLQTYLGGIKYMTGLPDIVIIVDQHEEYTALRECITLGIPTICLIDTNCDPDLADLSIPA

SEQ ID NO: 1584 - protein, 549 aa, Desulfitobacterium hafniense
MSMFCFQCQETAKGTGCTIKGVCGKTADVANLQDLLLYVMKGIAINSLQARELGIVRQDVDKFVMEGLFATITNANFDNARFVALVREGLALRDSLKADIVKAGGVLPANLHDSAIWTADSAEEFEQKAAQVGILATENEDVRSLRELLIYGLKGMAAYAEHAFALGYEDNSIFAFMMKGLAATTDDSLSADQLVALVLEAGKYGVDVMALLDKANTTSYGNPEITKVNIGVRNNPAILISGHDLRDLEDLLKQTEGTGVDVYTHGEMLPAHYYPAFKKYAHFVGNYGNAWWKQDKEFDSFNGAILLTTNCLVPPKDSYKDRLFTTSVVGYEGVKHIPAREAGKVKDFSAVIELAKTLPAPTEIETGEIVGGFAHNQVFAVADKVVEAVKSGAVKRFFVMAGCDGRMKSRDYYTEFAKALPQDTIILTAGCAKYKYNKLALGDIGGIPRVLDAGQCNDSYSLAVIALKLKEVFGLDDVNQLPISYNIAWYEQKAVIVLLALLYLGVKNIHLGPTLPGFLSPNVAKVLVENFGIAGITTVEDDVNLFMGA

SEQ ID NO: 1585 - protein, 138 aa, Cryptococcus neoformans
MARTKQTARKSTGGKAPRKQLATKAARKQAPSQVSGGVKKPHRYRPGTVALREIRRYQKSTELLIRKLPFQRLVREIAQDFKTDLRFQSSAIGALQEASEAYLVSLFEDTNLAAIHAKRVTIQPKDLQLARRLRGERS

SEQ ID NO: 1586 - protein, 177 aa, Unknown
  Candidatus Blochmannia ocreatus
RGSHQTRYWNPKMKPFIFGIRNKIHIINLEITMLMFKQALFELKNITSLKGKILFVGTKRAARETIKKTALSCNQFFVNHRWLGGMLTNWKTVRQSIKRLKDLENQSKDGTFKKVTKKEALILNRELISLENSLGGIKNMGGLPEAIFAIGATHEQIAIKEAHSLGIPVFSIVDTCS

SEQ ID NO: 1587 - protein, 187 aa, Orobanche densiflora
FGHGIRKWNPKMAPYISAKRKGIHITNLIKTARFLSEACNLVFDAASRGKQFLIVGTKKKAANSVACAAIKARCHCVNKKWLGGTLTNWSTTESRLNQFRDLRIEQKMGRFKRLPKRDAAVGKRQLSHLQTYLGGIKYMTGLPDIVIIVDQHEEYTALRECITLGIPTICLIDTNCDPDLADLSIPA

SEQ ID NO: 1588 - protein, 182 aa, Robiginitalea biformata
MPTKSLQEATLGAGCFWCIEAVFQELRGVESVVSGYSGGTVPGKPTYREVCSGLTGHAEVVRVRFNPEEISFRDLLVVFLSTHDPTTLNRQGADRGTQYRSVVFFHDAEQEQVAREVIAEMQQYFDDPIVTEVSPLSNFYEADPEHQDFYRRNPELGYCRVVIDPKMRKLRDLFASRLKNPA

SEQ ID NO: 1589 - protein, 357 aa, Pseudomonas fluorescens
MSKFHSLTIKDVRPETRDAVSIAFDVPAELADSFRFTQGQHLVMRTQLDGEEVRRSYSICTGVNDGELRVAIKRVAGGRFSAYANESLKAGQRLEVMPPSGHFHVELDPARHGNYLAVAAGSGITPILSIIKTTLETEPHSRVTLLYGNRSSASALFREQLEDLKNRYLQRLNLIFLFSREQQDVDLYNGRIDADKCGQLFSRWIDVKALDAAFICGPQAMTETVRDQLKANGMAAERIHFELFAAAGSAQKREARESAAQDSSVSQITVISDGRELSFELPRNSQSILDAGNAQGAELPYSCKAGVCSTCKCKVVEGEVEMDSNFALEDYEVAAGYVLSCQTFPISDKVVLDFDQI

SEQ ID NO: 1590 - protein, 160 aa, Unknown
  Candidatus Blochmannia schaefferi
  misc_feature (1)..(1): Xaa can be any naturally occurring amino acid
  misc_feature (5)..(5): Xaa can be any naturally occurring amino acid
  misc_feature (158)..(158): Xaa can be any naturally occurring amino acid
XWNPXMKPFIFGVRNKIHIIDLEKTVVMFKKALIELNKIASLKGKILFVGTKRAASESVKKTAITCNQFFVNHRWLGGMLTNWKTVRQSIKRLKDLDTQFKDGTVKKLTKKEALILNRELINLENSLGGIKNMGGLPDAIFAVGATHEHIAIKEANVXGI

SEQ ID NO: 1591 - protein, 343 aa, Pseudotsuga menziesii
MSSKFGSLSSSCSSVHGTAFTVSARPSPAALRATPAITSLYADRKYDLQSFKFEPIRESIVAREMTRRYMMDMITHAETDVVIVGAGSAGLSCAYELSKNPDVKVAIIEQSVSPGGGAWLGGQLFSAMVVRKPAHLFLDEIGVPYDETEDYVVIKHAALFTSTIMSKVLARPNVKLFNAVAAEDLIIKEGRVSGVVTNWALVSMNHDTQSCMDPNVMESKVVVSSCGHDGPFGATGVKRLKSVGMIDKVPGMKALDMNTAEDAIVRLTREIVPGMIVTGMEVAEIDGSPRMGPTFGAMMVSGQKAAHLALKALGQPNALDGTLKVLPELVLASAENEITTASA

SEQ ID NO: 1592 - protein, 248 aa, Herminiimonas arsenicoxydans
MSVTMREMLEAGVHFGHQTRFWNPKMAPYIFGHRNRIHIVNLEKTLGMYQEAMKYIKQLSSNRGTVLFVGTKRQARETIAAEAARAGMPYVDQRWLGGMLTNFKTIKTSIKRLKELEALVEDGSMEKLSKKEALMFEREKIKLEKSIGGIKDMGGIPDAIFVVDVGYHKGAITEAAKLGIPVIGVVDTNHSPEGVAYIIPGNDDSSKAIMLYARGVADAILEGRASATNDLVESIKGGDDFVEVNEQA

SEQ ID NO: 1593 - protein, 276 aa, Arabidopsis thaliana
MGTLVGHILPGFFFFALGLWHLFNHIKIFSLHPKSYIAPLWFPLSKPRYLEPLVIIIASSLSISVELFLGQKNHQPFDPNDGTIPSNHLHNFEHSCISFTFITYAAFAIVFDKTRPIAHRSLINLIAALAFAQQLFLFHFHSSDHTGVEGHYHLLLQLVVFVSLVTTLLGIALPSSFILSFVRSLSVSFQGIWLMSMACMLWTPSLVPKDCFLHIEEGKHTIRCSDVKALHRAISLVNIQFSWFLVIITIFAMWFYIFLQRIYGEKIEYSQLRTKD

SEQ ID NO: 1594 - protein, 540 aa, Helianthus annuus
MDPNPSPRKMRILKYVMTKIPSFKRRQLQELENERLARPYALPETYTELSERESYTELAERVSHLTEDDILANIRAVVVEVKQIRSVIKSLGDRPDPETVDLARLRYREAESPVAGQFDENAEYDMEMEKRKRLVKRERQMYKALISLDEMHETYSDLLVVAERRLQKLYDTAKSAGKLSALDKRVSSMLPTIAEEVKEEMADILQDALMNGVERIDLSRRRLPFVPEAFGKLHTLVSLDLSSNKLTAIPESLAGLTSLEELNLSANLFESLPDTIGSLQHLQFLNVSRNKLTSLPDGICKCRSLLELDASFNQITYLPANIGYGLINLKKLIMPLNNVRSLPTSIGEMISLQVLDVHFNTLRGLPPSIGMLKKLEVLNLGSNFNDFTALPETIGSLTRLRELDICNNQIQQLPITFGRLVSLTRLVVDHNPLTVSPPEVVAEGVEAVKVYMSKRLYDMIVEEERRVMWEREEQAQQAGWFTFLFFGPAYGPGATYPYLTHRLCTSYKILPYIVAWVYSSFNLVIHCFLKCYVFSDRKQT

SEQ ID NO: 1595 - protein, 447 aa, Unknown
  Acinetobacter sp. ADP1
MKYSKMSDFLDYVKTRDQYQPEFLQAVEEVMISLWPFIEKHPEYADYGLLERLIEPERVIQFRVAWMDDQGHTQVNRAFRVQYNSAIGPYKGGMRFHPSVNLSILKFLGFEQTFKNALTTLPMGGGKGGSDFNPKNKSEAEIMRFCQALMLELHRHLGADTDIPAGDIGVGAREVGYMAGMMKKLSNDTAAVFTGKGVSFGGSLMRPEATGYGTVYFAEEMLKTRGQNFLGKTVSISGSGNVAQYAAEKAMFLGAKVVTLSDSNGTVYLENGFTEVLLAELMELKNKKRGRISEFASKHGFEYFEGQTPWHIPVDIALPCATQNELNGDDAETLIKNGVICVAEGANMPSTLEAVEKFLHAKILYAPGKASNAGGVATSGLEMSQNSIRLNWSHAEVDERLHAIMKDIHANCVKYGTKQDGSINYVDGANIAGFVKVADAMLAQGIY

SEQ ID NO: 1596 - protein, 202 aa, Barleria prionitis
GVHFGHGTRKWNPKMAPYISARRKGIHITNLTRTARFLSEACDLVFDAASRGKQFLIVGTKNKAADSVARAAIRARCHCVNKKWLGGMLTNWSTTETRLHRFRDLRMEQKTGRLNRLPKRDAAVVKRQLSRLQTYLGGIKYMAGLPDIVIIVDQHEEYTALRECLTLGIPTICLIDTNCDPDLADISIPANDDAISSIRLIL

SEQ ID NO: 1597 - protein, 957 aa, Escherichia coli
MTQTLSQLENSGAFIERHIGPDAAQQQEMLNAVGAQSLNALTGQIVPKDIQLATPPQVGAPATEYAALAELKAIASRNKRFTSYIGMGYTAVQLPPVILRNMLENPGWYTAYTPYQPEVSQGRLEALLNFQQVTLDLTGLDMASASLLDEATAAAEAMAMAKRVSKLKNANRFFVASDVHPQTLDVVRTRAETFGFEVIVDDAQKVLDHQDVFGVLLQQVGTTGEIHDYTALISELKSRKIVVSVAADIMALVLLTAPGKQGADIVFGSAQRFGVPMGYGGPHAAFFAAKDEYKRSMPGRIIGVSKDAAGNTALRMAMQTREQHIRREKANSNICTSQVLLANIASLYAVYHGPVGLKRIANRIHRLTDILAAGLQQKGLKLRHAHYFDTLCVEVADKAGVLARAEAAEINLRSDILNAVGITLDETTTRENVMQLFSVLLGDNHGLDIDTLDKDVAHDSRSIQAAMLRDDEILTHPVFNRYHSETEMMRYMHSLERKDLALNQAMIPLGSCTMKLNAAAEMIPITWPEFAELHPFCPPEQAEGYQQMIAQLADWLVKLTGYDAVCMQPNSGAQGEYAGLLAIRHYHESRNEGHRDICLIPASAHGTNPASAHMSGMQVVVVACDKNGNIDLTDLRAKAEQAGDNLSCIMVTYPSTHGVYEETIREVCEVVHQFGGQVYLDGANMNAQVGITSPGFIGADVSHLNLHKTFCIPHGGGGPGMGPIGVKAHLAPFVPGHSVVQIEGMLTRQGAVSAAPFGSASILPISWMYIRMMGAEGLKKASQVAILNANYIASRLQDAFPVLYTGRDGRVAHECILDIRPLKEETGISELDIAKRLIDYGFHAPTMSFPVAGTLMVEPTESESKVELDRFIDAMLAIRAEIDQVKAGVWPLEDNPLVNAPHIQSELVAEWAHPYSREVAVFPAGVADKYWPTVKRLDDVYGDRNLFCSCVPISEYQ

SEQ ID NO: 1598 - protein, 182 aa, Thermococcus kodakarensis
MGLRPAKIDRDVDKPAYTRREYIRGAPGPKITIFDMGNLSAEFEYEVSLHAEQAMQIRQNALEAIRIQVNRYLQKNVGRSNYHFKIRVYPFQVLRENPMATGRKADRYGNGMRRPFGKPIGLAARVRKDQKILTVWVNGQHLKFALGAMHRAKMKLPYSAYYRIYDKEGNDVTTKVLSTMKL

SEQ ID NO: 1599 - protein, 202 aa, Thunbergia alata
  misc_feature (1)..(1): Xaa can be any naturally occurring amino acid
  misc_feature (3)..(3): Xaa can be any naturally occurring amino acid
  misc_feature (12)..(12): Xaa can be any naturally occurring amino acid
  misc_feature (14)..(14): Xaa can be any naturally occurring amino acid
  misc_feature (49)..(49): Xaa can be any naturally occurring amino acid
XVXFGHGIRKWXPXMAPYISAKRKGIHITNLTRTASFLSEACDLVFDAXSGGKQFLIVGTKNKAADSVARAAIKAQCHCVNKKWLGGMLTNWSTTETRLHKFRGLRMEQKTGRLNRLPKRDAAVVKRKLSRLQTYLGGIKYMTGLPDIVIIVDQHEEYTALRECITLGIPTICLIDTNCDPDLADISIPANDDAISSIRLIL

SEQ ID NO: 1600 - protein, 306 aa, Tuber borchii
MQIFVKTLTGKTITLEVESSDTIDNVKSKIQDKEGIPPDQQRLIFAGKQLEDGRTLSDYNIQKESTLHLVLRLRGGMQIFVKTLTGKTITLEVESSDTIDNVKSKIQDKEGIPPDQQRLIFAGKQLEDGRTLSDYNIQKESTLHLVLRLRGGMQIFVKTLTGKTITLEVESSDTIDNVKSKIQDKEGIPPDQQRLIFAGKQLEDGRTLSDYNIQKESTLHLVLRLRGGMQIFVKTLTGKTITLEVESSDTIDNVKSKIQDKEGIPPDQQRLIFAGKQLEDGRTLSDYNIQKESTLHLVLRLRGGSL

SEQ ID NO: 1601 - protein, 663 aa, Yarrowia lipolytica
RRQKRVERASAAPKNHCSNTKLCERLHHHYPHLSIRQLATSPKAVVSLFATQPKSHRHKDPCSCFSSTFSKLLPTTLTNIMSNTLVKKGQGQAASNAKKIGYNKKKGGGQTKGRPAFVFKLWNMVNDPAYDEYIRWMPDGKSFQITGREQLEKIVLPRFFKHNNFSSFVRQLNMYGWHKVQDVTSGSMQSNDEVWQFKSPNFIRGREDLLDNIVRNKGTKGSDEEEEMDMTTLMDELQQIKLNQLNLTQEVNKLRTDNQLLWQENLGFKDKHKQHGETLERIMRFLASLYGNQGKVLGEAISGNRNQRLLLGNTDPAQATHMINEAAAAAAAENSGNFPFEMNDMFNNNNNNNNNSNNPNDSPSFARVQPLSSTNSPQTVTGSPREENNKTNNTNNTSNNYDKITAYDTDTGSELPDNLQDLTDLSDFTPSMLDPQTVQQSMEPPMGFGDLNKNSSLILSNNSNNSINMPQTPMRNNSTSSHSSQNMSHHNYNYQPSTPGALFPELEAFQGANDQLIRSAERPRNNLNINGNGKADDLQRQLQDHGRHIDQFTDRLKKQQGYQPQQLQHQQQPQQPQQQPTPMQAPAPTPASTISSAPTPDPTSDLFNVGDPNIVPMQDFNMDDYIDNEADMFDPEVKIEEDMPLVTELDSPAPRPKKRKAGE

SEQ ID NO: 1602 - protein, 563 aa, Kluyveromyces lactis
MSEITLGRYLFERLKQVEVQTIFGLPGDFNLSLLDNIYEVPGMRWAGNANELNAAYAADGYARLKGMSCIITTFGVGELSALNGIAGSYAEHVGVLHVVGVPSVSSQAKQLLLHHTLGNGDFTVFHRMSSNISETTAMITDINTAPAEIDRCIRTTYVSQRPVYLGLPANLVDLTVPASLLDTPIDLSLKPNDPEAEEEVIENVLQLIKEAKNPVILADACCSRHDAKAETKKLIDLTQFPAFVTPMGKGSIDEKHPRFGGVYVGTLSSPAVKEAVESADLVLSVGALLSDFNTGSFSYSYKTKNIVEFHSDYTKIRSATFPGVQMKFALQKLLTKVADAAKGYKPVPVPSEPEHNEAVADSTPLKQEWVWTQVGEFLREGDVVITETGTSAFGINQTHFPNNTYGISQVLWGSIGFTTGATLGAAFAAEEIDPKKRVILFIGDGSLQLTVQEISTMIRWGLKPYLFVLNNDGYTIERLIHGETAQYNCIQNWQHLELLPTFGAKDYEAVRVSTTGEWNKLTTDEKFQDNTRIRLIEVMLPTMDAPSNLVKQAQLTAATNAKN

SEQ ID NO: 1603 - protein, 202 aa, Amphianthus pusillus
GVHFGHGTRKWNPKMAPYISAKRKGIHITNLTRTARFLSEACDLVFDAASKGKQFLIVGTKNKAADSVAWAAIRARCHFVNKKWLGGMLTNWSTTETRLQKFRDLRLEQKTGRLNRLPKRDAAMLKRQLSRLQTYLGGIKYMTGLPDIVIIVDQHEEYTALRECMTLGIPTICLIDTNCDPDLADISIPANDDAISSIRLIL

SEQ ID NO: 1604 - protein, 363 aa, Brassica rapa
MVRFKHIKIKYYFTKMSGVRMLASSPMLLFLLSLLMAYNFDTTAGQIGVCFGQMGNNIPKPSEVVAMFKQYSIPRMRMYGPNPDALNALRGSNIEFILDVPNGDLKRLADSQAEANTWVRDNVQKYNDVRFKYISVGNEVKPGEPGAAALIQAMQNIDRALSAAGLSNIKVSTTTFMGAFADTYPPSRGRFKDEYRNFLQPVIGFLVNKRSPLLVNIYTYFGYMNRDVSLQFALLQPNSNNEFTDPNNQLRYLNFFDANLDSVYAALEKSGGGSLDVVVSESGWPTQGGPGASVPNAEAYVNNLRLHVNKNGSPKRPGKAIETYIFAMFDENGKQTSPNDEYEKYWGMFSPTTRQLKYGVKFN

SEQ ID NO: 1605 - protein, 327 aa, Oryza sativa
MAIPTKEEVEQNEEDNTFSRLQLLAQQRHAMEEFWRRSQEQIEASAGNHEHILPIDCVKNVIRPKNDAMMLSADTPTFVTKLCELFVQELTLRAWVCANSHNRDIILGTDIAEAITTTESYHFLGNVLRSHKALGSTAPDIDTSARKHIKLDQMTSLYHPTQEMQASRLAGYPPHVPIYPPIGQMGTQHKLSPFAFMMQGESLLNMKRENSLVNEVMVCTNKMSINNFDGATSIGGGSSSDVAIVVQQGETTHPFSSQNACPSLEDNYVVPMPTGHVQSFSPPTNINVKKLHQEEKNIYSQDVAEEDMSNESLEGSQKDEDLFLHEK

SEQ ID NO: 1606 - protein, 187 aa, Cistanche phelypaea
FGHGIRKWNPKIAPYISAKRKGIHITNLTRTARFLFEACNLVFDAASRGKQFLIVGTKNKVANLVAWAAIKARCHFVNKKWLGGMLTNWSTTETRLHRFRDLRMEQKMGRLNRLPRRDSAVVKRQLYRLQTYLGGIKYMTRLPDIVIIVDQHEEYTALQECITLGIPTICLIDTNCDPDLADISIPA

SEQ ID NO: 1607 - protein, 300 aa, Glycine max
MSDSLLTFYSLSAILALLPIFIFILIKRKQSKPRLNLPPGNMGWPFLGETIGYLKPYSATTIGEFMEQHIARYGTIYKSKLFAGPAIVSADAGLNRFILQNEGKLFECSYPRSIGGILGKWSMLVLVGDMHRDMRVISLNFLSHARLRTHLLKEVEKQSLLVLNSWSQNSIFSAQDEAKKFTFNLMAKHIMSMDPGDIETEQLKKEYVTFMKGVVSAPLNLPGTAYRKALKSRSIILKFIEGKMEERVRRIQEGNESLEEDDLLNWVLKNSNLSTEQILDLILSLLFAGHETSSVAIALA

SEQ ID NO: 1608 - protein, 156 aa, Unknown
  Candidatus Blochmannia vicinus
  misc_feature (1)..(1): Xaa can be any naturally occurring amino acid
  misc_feature (5)..(5): Xaa can be any naturally occurring amino acid
XWNPXMKPFIFGVRNKIHIINLETTILMFKQALVELNKIASLKGKILFVGTKRAASESIKKTALACNQFFVNHRWLGGMLTNWKTVRQSIKRLKDLETQSQDGTFKKVTKKEALILNRELINLENSLGGIKNMGGLPDAIFAIGATHEHIAIKEAN

SEQ ID NO: 1609 - protein, 187 aa, Cistanche phelypaea
FGHGIRKWNPKIAPYISAKRKGIHITNLTRTARFLFEACNLVFDAASRGKQFLIVGTKNKAANLVAWAAIKARCHFVNKKWLGGMLTNWSTTETRLHRFRDLRMEQKMGRLNRLPRRDSAVVKRQLYRLQTYLGGIKYMTRLPDIVIIVDQHEEYTALRECITLGIPTICLIDTNCDPDLADISIPA

SEQ ID NO: 1610 - protein, 634 aa, Citrus sinensis
MESCDCIDTQWPPDELLVRYQYISDILIALAYFSIPVELIYFVQKSAFFPYRWVLMQFGSFIILCGLTHFISLWTFTVHSKAVAVVMTIAKMACAFVSCITALMLVHIIPDLLSVKTRELFLKNRADELDREMGLILTQEETGRHVRMLTHEIRSTLDRHTILKTTLVELGRTLGLEECALWMPSRTGLNLELSYTLNNQIQIGSSVPINLPIVTDVFNSAQAMRLPYNCPLARIRLLVGRYVPPDIVAVRVPLLHLSNFQINDWPELPAKSYAVMVLMLPTDGGRKWRDHELELIDVVADQVAGALSHAAILEDSMRARNQLMGQNVALDSARREAEKAIHARNDFRAVMNHEMRTLMHAIIALSSLLLETDLTPEQRVMIETVLKSSNLLTTLVDDVLDLSRLEDGSLELDNGPFNLQIVLREVIKLIKPVASCKKLSMTLIMAPELPTYAVGDEKRLMQTILNIVGNAVKFTKEGYVSIIAFVAKPESLSDWRPPKFYPVSTDGHFYLRVQVNDSGCGVPPQDIPLIFTKFAQSRGSSCQTPRAGLGLAICRRFVNLMGGHIWLESEGLDKGSTVTFLVKLGICNNPGSPIHPVALKGRASHGSADLTGPKPLFRDNDQIASTKSRYQRSV

SEQ ID NO: 1611 - protein, 160 aa, Unknown
  Candidatus Blochmannia ulcerosus
  misc_feature (5)..(5): Xaa can be any naturally occurring amino acid
YWNPXMKPFIFGVRNKIHIIDLDKTIIMFNKALIELKKISELKGKILFVGTKRAARESIKSTALICGQFFVNYRWLGGMLTNWKTVRQSIKRLKNLEDQSKDGTFDKLTKKEVLVLKRELNSLENSLGGIKNMGSLPDAVFTVGAAHECIAIKEANSLGI

SEQ ID NO: 1612 - protein, 161 aa, Phelipanche purpurea
PKMAPYISAESKHRHIINLTKTARFLYEACNLVFNAASRGKQFLIVGTETITADLVEEAAIKADCHFVNKKWTGGLLTNWSITEERLKYFNYLRVKEIKGGFDCLPKKDAAVVKRQLSRFQKTLGGIKNMSGLPDIVIILYQNKNEEYKALQECITLGIPT

SEQ ID NO: 1613 - protein, 189 aa, Phelipanche purpurea
FGNHSKEWNPKMAPYISAESKHRHIINLTKTARFLYEACNLVFNAASRGKQFLIVGTETITADLVEEAAIKADCHFVNKKWTGGLLTNWSITEERLKYFNYLRVKEIKGGFDCLPKKDAAVVKRQLSRFQKTLGGIKNMSGLPDIVIILYQNKNEEYKALQECITLGIPTISLIDTDSDPDLADIPIPA

SEQ ID NO: 1614 - protein, 172 aa, Unknown
  Candidatus Blochmannia pennsylvanicus
HQTRYWNPKMKPFIFGVRNKIHIIDLETTSVMFRQALIELNKIAALKGKILFVGTKRAASESVKKTALACNQFFVNHRWLGGMLTNWKTVRQSIKRLKDLEIQSQDGTFKKLTKKEALILNRELINLENSLGGIKNMGGLPDAIFAVGATHEHIAIKEANSLGIPVFSIVDT

SEQ ID NO: 1615 - protein, 716 aa, Gluconobacter oxydans
MFDYFRKEIEWAGRPLILETGKVARQADGAVMITYGDTVVLCTAVGAKSVKPGQDFFPLTVNYQEKAYAAGKIPGGFFKREGRPSEAEVLNARLIDRPIRPLFPENFRNEVQITATVLSYDNENDPALVSLIGCSAALTLSGIPFFGPVACARIGRIDGKLVVNPTHDEIKDSTLDLMVAGTAEGVLMVESEASELSEETMLEAVTLGHTSFQPVIDAIIALAEHAAKAPWDLPSLTKEEIALRKRVEKVGNKLMADAYKERQKQARYKKVAEAKDRINEILADEGLDVELAKPMLKELEAQVVRGSILKTGIRIDGRDLKTVRPILAEVGILPRAHGSSLFTRGETQALVVATLGTGQDEQIIDALEGEYRSNFMLHYNFPPYSVGECGRMGSPGRREIGHGKLAWRAIHPLLPSKEAFPYTMRVVSEITESNGSSSMATVCGSSLALMDAGVPLPRPVAGIAMGLIKEDRGYAVLSDILGDEDHLGDMDFKVAGTADGVTALQMDIKITSITPEIMKIALEQAREGRIHILGEMAKALTEGRGEVSGNAPKITTISVPKEKIRDVIGSGGKVIREIVEYSGAKVDIGDDGTVTIAASNDEQAQKAIARIEGIVAEPEIGRIYEGKVVKTADFGAFVNFLGPRDGLVHISELAEGRVAKTSDVVKQGDAVKVKVIGFDDRGKVKLSMRVVDQATGADITESVGAKPGRPPRRDAE

SEQ ID NO: 1616 - protein, 691 aa, Sorghum bicolor
MSAVSSSSLCGGDPAMRSVVWFRRDLRVEDNPALAAAARAGGEVVPAYVWSPEEEGPYYPGRVSRWWISQSLKHLDASLRRLGAGKLVTRRSADAVVALLQLVRDTGATHVYFNHLYDPISLVRDHRLKEMLAAEGIVVQSFNADLLYEPWEVVDDERQPFTMFTAFWNRCLSMQYDPPAPLLPPKKINSGDLSMCPSEDLIFEDDSERGSNALLARAWTPGWQNADKALTAFLNGPLADYSVNRKKADSASTSLLSPHLHFGELSVRKVFHLVRMKQLVWSNEGNHAAEESCTLFLRSIGLREYSRYLSFNHPSSHERPLLAHLRFFPWVVNESYFKIWRQGRTGYPLVDAGMRELWATGWLHDRIRVVVSSFFVKVLQLPWRWGMKYFWDTLLDADLESDALGWQYITGSLPDSRELDRIDNPQFEGYKFDPHGEYVRRWIPELVRLPTEWIHHPWDAPVSVLQAAGIELGSNYPLPIVELDAAKARLQEALSEMWQLEAASRATMNNGMEEGLGDSSEVPFPEELQMEVDRATANVVMTVRRREDQMVPTMTSSLNRAETEVSADLGNSEDTRAQVPFHAHFHPRVEREDMIQNTEGPALRINGTHQHNIFQQPQNHRREALAPSVSEASSSWTGREGAVVPVWSPPAASGHSETFAADEADVSSRSYLDRHPQSHRLMNWSQLSQSL

SEQ ID NO: 1617 - protein, 147 aa, Unknown
  Candidatus Blochmannia chromaiodes
FIFGVRNKIHIIDLETTSVMFRKALIELNKIAALKGKILFVGTKRAASESVKKTALACNQFFVNHRWLGGMLTNWKTVRQSIKRLKDLEIQSQDGTFKKLTKKEALILNRELINLENSLGGIKNMGGLPDAIFAVGATHEHIAIKEA

SEQ ID NO: 1618 - protein, 189 aa, Phelipanche purpurea
FGNHSKKWNPKMAPYISAESKHRHIINLTKTARFLYEACNLVFNAASRGKQFLIVGTETITADLVEEAAIKADCHFVNKKWTGGLLTNRSITEERLKYFNYLRVKEIKGGFDCLPKKDAAVVKRQLSRFQKTLGGIKNMSGLPDIVIILYQNKNEEYKALQECITLGIPTISLIDTDSDPDLADISIPA

SEQ ID NO: 1619 - protein, 539 aa, Arabidopsis thaliana
MGSGCSSLSYSSSSTCSATVFSISSPPSSSSSLKLNPSSFLFQNPKTLRNQPPLRCGRSFKMESQKPIFDLEKLDDEFVQKLVYDALVWSSLHGLVVGDKTYQKSGNVPGVGLMHAPIALLPTGFPEAYWKQACDVTPLFNELIDRVSLDSKFLQDSLSRTKKVDVFTSRLLDIHSKMLERNKKEDIRLGLHRFDYMLGEETNSLLQIEMNTISCSFPGLSRLVSQLHQSLLRSYGDQIGIDSERVPINTSTIQFADALAKAWLEYSNPRAVVMVIVQPEERNMYDQHLLSSILREKHNIVVIRKTLAEVEKEGSVQEDETLIVGGQAVAVVYFRSGYTPNDHPSESEWNARLLIEESSAVKCPSIAYHLTGSKKIQQELAKPGVLERFLDNKEDIAKLRKCFAGLWSLDDSEIVKQAIEKPGLFVMKPQREGGGNNTYGDDVRENLLRLQKEGEEGNAAYILMQRIFPKVSNMFLVREGVYHKHQAISELGVYGAYLRSKDKVIVNEQSGYLMRTKIASSDEGGVAAGFGVLDSIYLN

SEQ ID NO: 1620 - protein, 142 aa, Unknown
  Fragaria x ananassa
MEQDFHAERFKEFLRGGYNNETPAASNIVLFMGAVTKPPNLSIVTEYLSRGSLYRLLHKPGPVLDERRRLNMAHDVAKGMNYLHRRNPPIVHRDLKSPNLLVDKKYTVKVCDLVFPVKGQHLSFIKITAGTPEWMAPEVNRD

SEQ ID NO: 1621 - protein, 150 aa, Unknown
  Candidatus Blochmannia castaneus
  misc_feature (6)..(6): Xaa can be any naturally occurring amino acid
RYWNPXMKPFIFGVRNKIHIIDLETTILMFKQALIELNKIASLKGKILFVGTKRAASEAVKKTALACNQFFVNNRWLGGMLTNWKTVRQSIKRLKDLETQSQDGTFQKLTKKEALILNRELINLENSLGGIKNMGGLPDAIFAVGATHED

SEQ ID NO: 1622 - protein, 77 aa, Lactuca sativa
MKEQKWIHEGLITESLPNGMFRVRLDNEDMILGYVSGKIRRSFIRILPGDRVKIEVSRYDSTRGRIIYRLRNKDSKD

SEQ ID NO: 1623 - protein, 75 aa, Oryza sativa
MQTAASSVVGLSAVLPAAVKGRSLQIQAPRRVALRVRAAAAAVAVEAAEVDYSSNISVFPMEACDDLGGEFCKAT

SEQ ID NO: 1624 - protein, 421 aa, Sulfolobus solfataricus
MEEVLSSSLYTQQVKKLYKVGELLGLDNETLETLSQPERIIQVKIQIRGSDGKLKTFMGWRSQHNSALGPYKGGVRYHPNVTQDEVEALSMIMTWKNSLLLLPYGGGKGGVRVDPKKLTREELEQLSRKYIQAIYKYLGSELDIPAPDVNTDSQTMAWFLDEYIKITGKVDFAVFTGKPVELGGIGVRLYSTGLGVATIAKEEAANKFIGGVEEARVIIQGFGNVGYYAGKFLSEMGAKIVGVSDSKGGVINEKGIDVGKAIEIKEKTGSVINYPEGRKVTNEELLISDCDILIPAALENVINKFNAPKVKAKLIVEGANGPLTADADEIMRQRGIAVVPDILANAGGVVGSYVEWANNKMGEIISDEEAKKLIVDRMNNAFNTLYDYHQKKKLEDHDLRTAAMALAVDRVVRAMKARGIL

SEQ ID NO: 1625 - protein, 401 aa, Oryza sativa
MAAAAVAASDAAQLKSAREDIREILKTTYCHPIMVRLGWHDSGTYDKNIEEWPQRGGADGSLRFDAELSHGANAGLINALKLIQPIKDKYPGITYADLFQLASATAIEEAGGPKIPMKYGRVDVTAAEQCPPEGRLPDAGPRVPADHLREVFYRMGLDDKEIVALSGAHTLGRSRPDRSGWGKPETKYTKDGPGEPGGQSWTVEWLKFDNSYFKDIKEQRDQDLLVLPTDAALFEDPSFKVYAEKYAEDQEAFFKDYAEAHAKLSDLGAKFDPPEGFSLDDEPAVEEKDPEPAPAPAAAPPPPPVEEKKEAEPTPVPVTVGAAVASSPADDNNGAAPQPEPFVAAKYSYGKKELSDSMKQKIRAEYEGFGGSPDKPLQSNYFLNIMLLIGGLAFLTSLLGS

SEQ ID NO: 1626 - protein, 283 aa, Brassica napus
MAENADLVEWPKKDKRRFLHVVYRVGDLDRTIQFYTECFGMKVLRKRDVPEEKYSNAFLGFGPETSNFVVELTYNYGVSSYDIGTGFGHFAISTQDVSKMVEAVRAKGGNVTREPGPVKGGGSVIAFVKDPDGYTFELIQRGPTPEPLCQVMLRVGDLDRAIKFYEKALGMRLLRRIERPEYKYTIGMMGYAEEYESIVLELTYNYGVTEYTKGNAYAQIAIGTDDVYKSAEVVKIANQELGGKITREAGPLPGLGTKIVSFLDPDGWKTVLVDNEDFLKELE

SEQ ID NO: 1627 - protein, 552 aa, Debaryomyces hansenii
MSQVYVNEKTGADSTDVSGSEQQPFQTPAFALFKNEDAKILVYKQLEDSEEFGYGEISASALKKAKKGAEGLKKKQEKQAKLQEEQRKHQDDAAKKFAEMDLISIKEDESLPQAKKIKLRTVQDNIGTRVVVQGWIHRLRLQKGLGFITLRDGTGFIQCILTGDLAKCKTTHELTLESTVTIKGVINKLPEGKSAPGGVELKVDYYEVVGLAPSGEEAFSNKVQENADPSLLLDQRHLALRGESLSAVMKVRSTLLQAIRRFFAEEGLLEVTPPCMVQTQVEGGSTLFKMDYYGEEAYLTQSSQLYLETCLPALGDVFCVQESFRAEKSHTRRHLSEYTHIESELGFIEFDDLLTHLERLITYVVKYVVEDPVAGPLIKQLNPNFVPPQMPFKRMEYIHALDWLNEHGIPNEDGEKFKFGDDIAEAAERKMTDTIGVPILLIRFPVEIKSFYMQKCADDPRVTESVDVLMPTVGEITGGSMRTYDNDELVAAIKREGLDLDSYYWFTDQRKYGTCPHGGYGLGTERILAWLCDRFTVRDCSLYPRFTGRCKP

SEQ ID NO: 1628 - protein, 556 aa, Campylobacter jejuni
MSEVNKKVQDGVDDYLEEEDFGQLLEAFDKSREEATTEGVIVEIKNDEVYVDIGKKSEGILALSEIQGDNSKLLFNVGDSIKVAVMGSRGGRSLLSHKKALRKEKVIEFIKNYQENQDDIFTVKVVGKNKGGLIVVDENDVEFFLPKSQYGFKETNNIIGKTFKVKIIKIDKDEQSIIVSRKKTLDDERRKRKELINNVAQQEDLIEGIVKKITTYGMFVDVGGVDGLVHYSEISYKGPVNPGTLYKEGDKVPVKVIKYDKERKHLSLSIKAALPDPWSEIKDTLDVGDTIKVIVSNIEPYGAFVDLGNDIEGFLHISEISWDKNIKNPKDYINKGQEIDVEVIEINPNERRLRVSLRNLLSRPFDEFMKSYKIADVVEGEITSVTSFGAFVKLGGIEGLLHNEDASWDRNDKCKDKFSQGDKIKVKIIKIDEENQKISLSAKELNSSPVQEYAKIHKVGDIVKGTIRDIKDFGVFVELSKNVDALIHKEDISTSMLENLKIGDDIEAAIVFIDEKKNRIRLSVKNLVRIKEREVLNEINNDDKVTLGDIIKDQLA

SEQ ID NO: 1629 - protein, 382 aa, Ehrlichia ruminantium
MSKSDYYDLLGLSKNATPEEIKKAYRKMALKYHPDKNPGDKAAEEKFKELSEAYDVLIDKDKRAAYDRYGHSAFSDGSGRGGFDFNSGFSTDFSDIFNDLFGGGFRGGRSSSKRQDGGTVGSDLRLDIEITLEDSFNGTKVPINYVTHVKCSSCSGSGSEGSVKSVQCNTCHGAGNTRTQQGFFTIERTCHVCNGEGEIIKNKCKKCSGSGRVRDEVNLLVTVPKGIESGDKIRLNGKGEAGYRGAQSGDLYVYPNIKKHKFFTRNGADLYCNVPIKMILATLGGHIEMPSIDGTWTKVKVPEGSQNGDKLRLKEKGMPVINSSRRGDMYIQITVETPINLTKQQKELLKKFDEEPNTVECNPQSTGFFQKVKSFWNDIRSS

SEQ ID NO: 1630 - protein, 332 aa, Staphylococcus epidermidis
MRKITVFGMGSFGTALANVLAQNGHDVLMWGKNVENVDELNTHHMNKNYLKDAKLDSSIKATVDLNKAVQFSDIYLMALPTKAIREVSKDIDQLLTSKKTFIHVAKGIENDTFKRVSEMIEDSISSEHNGGIGVLSGPSHAEEVVIKQPTTVAASSKDNNVSKLIQDLFMNDYLRVYTNNDLVGVELGGALKNIIAIASGIVAGMGWGDNAKAALMTRGLAEISRLGEKLGADPMTFLGLGGIGDLIVTCTSTHSRNYTLGFKLGQGKTAEEALKEMKMVVEGIYTTKSVYHLAQQEGVEMPITNALYEVLFEDVPVSKSVRTLMERDKKAE

SEQ ID NO: 1631 - protein, 466 aa, Yersinia pestis
MSVVPVVDVLQGRAAVGSEVTVRGWVRTRRDSKAGISFVAVYDGSCFDPLQAVVNNTLPNYQDEVLHLTTGCSVEVTGTVVASPGEGQSFEIQATAINVVGWVDDPDTYPMAAKRHSIEYLREVAHLRPRTNLIGAVARVRHTLAQAIHRFFDENGYFWVSTPLITASDTEGAGEMFRVSTLDLENLPRTDTGAVDFSEDFFGKEAFLTVSGQLNGETYACALSKVYTFGPTFRAENSNTSRHLAEFWMVEPEVAFASLDDVAGLAEKMLKYVFQAVLNERADDMKFFAERVDKDAVDRLQRFVTSDFAQVDYTDAIEILLASGQKFENDVSWGIDLSSEHERYLAEKHFKAPVVVKNYPKDIKAFYMRMNEDGKTVAAMDVLAPGIGEIIGGSQREERLDVLDARLAEMGLNKEDYWWYRDLRRYGTVPHSGFGLGFERLISYVTGVQNVRDVIPFPRTPRNASF

SEQ ID NO: 1632 - protein, 191 aa, Debaryomyces hansenii
  misc_feature (133)..(166): Xaa can be any naturally occurring amino acid
MHSHHSHSGTYVSHAADDLESIVRKAQSMGFTIFCLTEHMPRLENKFLYPEEIEKNYSIRELDDDLKRYLEHAKKLQDKYNAEGRMKILIGFEVEGIDESHIEYSSKTIIKENPYVNMSVGSVHYVNQIPIDXXXXXXXXXXXXXXXXXXXXXXXXXXXXXXXXXXIIIIFNVWELFNLCLVLFYLLIIEY

SEQ ID NO: 1633 - protein, 202 aa, Angelonia pubescens
GVHFGHGTRKWNPKMGPYISAKRKGIHITNLTRTARFLSEACDLVFDAASKGKQFLIVGTKNKAADSVAWAAIKARCHCVNKKWLGGMLTNWSTTETRLHKFRDLRMEQKTGRLNRLPKRDAAMLKRQLSRLQTYLGGIKYMTGLPDIVIIVDQHEEYTALRECITLGIPTICLIDTNCDPDFADISIPANDDAISSIRLIL

SEQ ID NO: 1634 - protein, 975 aa, Xanthomonas campestris
MSQTPSSLRDLEHHSAFVERHIGPNDAEIAQMLGVVGHDSLDAMTDAIVPSNIKSPAALALPDAITEEEALARIRAIASKNQVQRTFIGQGYYGTHTPKVILRNILENPAWYTAYTPYQAEISQGRMEALINFQTMCADLTGMQIANASLLDEATAAAEAMTLAKRSAKSKSDTFFVHDAVHPQTQELLRTRAEPLGIVLRVGTPDEAMQAECFGVLLQYPDSFGHIGDHAALADAVHAQGGLVAVATDLLALTLIAAPGEWGADIVVGNSQRFGVPFGFGGPHAAFMACRDAYKRSMPGRLIGVSIDAAGNPAYRLTLQTREQHIRREKATSNICTAQVLLAVMASMYAVYHGPEGLTRIARRTHRLAAILAAALRSAGVTVGEHFFDTLHVKAIDADAIHAKAHAAGINLRAIDSEAVGISLDETSTRADVVALAQLFGAQADIDALDAATADALPQGMRRTSAFLQHPVFNTHHSEHELLRYMRSLADKDLAMDRTMIPLGSCTMKLNATAEMIPVTWPEFGAIHPLAPPEQSAGYAQLIEELEAMLVECTGYDAVSLQPNSGAQGEYAGLLAIRAYHRSRNEAHRDICLIPESAHGTNPASAQMCGMTVVVTKCDANGNVDVDDIRAKAEKYSDRLAALMITYPSTHGVFEEDVVAICEAVHAHGGQVYTDGANMNALVGVAKPGKWGSDVSHLNLHKTFCIPHGGGGPGVGPCAVKSHLAPFLPKTLPNAGIRAGENQKAAIHGSGSNFGEGEVGMVSAASYGSASILPISWMYVTMMGSAGLRKATQVALLNANYIAKRLSAHYKTLYTGRNGLVAHECILDVRPLEKTSGIGAEDIAKRLIDFGFHAPTLSFPVAGTLMVEPTESESQHELDRFIDAMIQIREEIRAIEDGRLDREDNPLKHAPHTATQVSASEWTHAYPRELAAFPLPSLKQQKYWPPVGRVDNVYGDKNVMCACIPVDAYKDDVVA

SEQ ID NO: 1635 - protein, 202 aa, Bacopa caroliniana
GVHFGHGTRKWNPKMAPYISAKRKGIHITNLTRTARFLSEACDLVFDAASKGKQFLIVGTKNKAADSVAWAAIRARCHFVNKKWLGGMLTNWSTTETRLHKFRDLRMEQKTGRLNRLPKRDAAMLKRQLSRLQTYLGGIKYMTGLPDIVIIVDQHEEYTALRECITLGIPTICLIDTNCDPDLADISIPANDDAISSIRLIL

SEQ ID NO: 1636 - protein, 508 aa, Debaryomyces hansenii
MRILNASYSRMPSRCASLNFRSYFSSLKPTIKDLFISPPSIESTISTQGHIKSIRQFKNIGFIDLSDGTTFHNLSVVLQDPESTLSELHLKVGQSINVAGKWIASKGTQKYELLYNPEANDHNLQVIGDVEDAYPIQKKSQTYQFLRGLPTLRHRTASLASMLRFRSFMETKLMEFFNSQNFTKTTPPLITSSDCEGAGEQFKVEQLHKKEVVVDGAVQEEHFFGKPAFLTVSTQLHLEVLTLSLNRAWTLTPCFRAEDSNTNRHLSEFWMLEAEICYIDHVSQLTDFTEDMIRYVTGALKSEAINEQSSGHSTDLLSSRFKKEELETLKNRWETIMAPQKWPSVTYSEAIDIINKVKNKNKLKNRLTWGDDIQTEHEKWLAGTHFQSPVFITDYPRSQKPFYMPKSHSSVYNPERPTVACYDLILPEIGELVGGSMREHDYENLVQEMTRRNMNLKEMDWYLSTRLNGTVPHGGFGMGFERLLSYIGAMENVKDVIPFPRVPQSCTC

SEQ ID NO: 1637 - protein, 583 aa, Bacillus clausii
MAWADKAFPRPKLVRTHWIDLNGSWDFEFDDQNKGVFEKWQLKSAFSQKIRVPFSYESPESGIGETAFHPVVWYSRNITIPTEQKGKRVLLHFQAVDYRATVWVNGQVAGEHVGGNTAFSFDITPYVKQGETQQIVVRAEDSESTSQPRGKQRWTDENFGCWYVQTTGIWKSVWLEFVADTYLKNVAITPDFDKHAVQFDYELNTANVKGLQIETVVSFRGKEVRRLSFSPESCNLKLTVDLDADIHEWKVAHWTPEHPHLYDVAFTVYQDGVAVDEAFSYFGLRKISTKNGQVLLNNRPIYQKLILDQGYWPHTHLTAPSLEALEQDIDAIIAMGFNGVRKHQKIEDERFYALCDQKGLLVWAEMPSAYTFSREAVGAFTSEWQEVVCQLAHYPSIIAWVPFNESWGIKDVLKSKQQQALTEAIYHLTKSIDETRLVIANDGWEHTISDLITLHDYEEFAEAFLARYEDKDALLSNHYPHNHDKYPFAEGYHYNGQPVLISEYGGIAFKSEDGWGYGNQVATKQAFLQRYEAITDAIKALPYVSGFCYTQITDVQQEINGLLDDNRKPKLDLTDIKAVNDKM

SEQ ID NO: 1638 - protein, 685 aa, Methanopyrus kandleri
  misc_feature (132)..(132): Xaa can be any naturally occurring amino acid
MARMRFVPQVCPFCGCGCGILVGTDGEEIKLLEPWRRHPVNEGRQCVKLWELPEAVQKDRLERPVRMTESGEPRELSWNRALEEVAEVLSTHEPEEVYFVTSAKATNEDNYVAQKLARTLGTNNVDHCARLXHAPTVVALSELLGSGAMTNSIPDLVEADCYLVAGSNTAEQHPIVYRRILQGLEENDADLIVLDPRRTQIAELADIHLQVRPRTDLIVFLYMAKVIVEEGLHDGTFIEERTTGFESFEEYVREAVSEGDVRRIAGVDPEDVRKAAVRYAEAERGCILYCMGLTHHDIATRTVRALCALALLTGNVGRPGTGVNPLRGQNNVQGACDVGALATHFPGYRPINTETANEMSKIWSFEVPDEPGLKLTEAFDADEITVMYVVGENPAVSEPNTRHAVEKLESLEFLVVQDLYLTETGELADLVLPAAGWAERTGTFTATDRRVQLAEKAVEPPGEARPDWWILEAVARRLGLKGFGHRSPREVFEEIRRVVPQYRGITYERLRRRPGGIHWPCPSEDHPGTPILHTEEFATEDGKARFPKPEDVEYREPERDVDEEYPLILTTGRVYAHYHTRTITRRSRLLSEEVPESFVEIHPKDAERYGVRDGELVVVETPYGEWRCRARVTDRVREGTIFTPFHFGENVLTPHDVRDPESGIPEYKYVPARVRPDSRGSASRG

SEQ ID NO: 1639 - protein, 201 aa, Collinsia grandiflora
GVHFGHGTRKWNPKAPYISAKRKGIHITNLTRTARVLSEACBLVFDAASRGKQFLIVGTKNKAADSVAWAAIKARCHCVNKKWLGGMLTNWSTTETRLHKFRDLRMEQKTGRLNRLPKRDAAMVKRQLSRLQTYLGGIKYMTGLPDIVIIVDQHEEYTALRECITLGIPTICLIDTNCDPDLADISIPANDDAISSIRLIL

SEQ ID NO: 1640 - protein, 58 aa, Zea mays
  misc_feature (15)..(15): Xaa can be any naturally occurring amino acid
  misc_feature (46)..(46): Xaa can be any naturally occurring amino acid
CKCEFLTPKAIANRXIKAKVLQKLRRHCQMCHKQCRDENGFKCHCXMSESHQRKMQVI

SEQ ID NO: 1641 - protein, 674 aa, Unknown
  Synechococcus sp. RS9916
MCGIGGVFNADRQQTVDRQLLVNMAAIQAHRGPDGFGVEVLDQAGVGFCHARLSIIDLNESRARQPFLTDDGEVLMAHNGEFYDFQRIRADLTAQGVRFSSKSDSEILLRLYQRQGLEATLPLLRGEFAFALFDRAEDCLYLVRDRFGIKPQYWAMTPEGLVFGSELKVLFAHPAVERRFTSEGLFHQLMQTMVPGTTAFAGVHQVKPGHVLKVQRMNGRLQVSESTYWDVDFPRKDQRDSSRTEADHIAAVRAALLEAVELRMVADVPVGCYLSGGIDSCSILGLASAVSQAPVKAFTIGFDDARYDESPIAREMAEATGAEQDLLRLSGQELYGHMERTIWHAERTIYNTLAVAKFLMSRHVNDVDYKVVMTGEGSDELFGGYPAFRRDMFLHGLDDLPEEERASWESLLQQSNALVKGAMLAENQVDDPDLDAVVGFTPSCLQPWLACAPLVPELLAESHATALEGYSPGKAIAEQLDGDQLDGRHALDKAQYVWIKTMLEGQILTWGGDRVDMANSMEARPAFLDHHLAAVAVQVPPELRIKGKTEKYVLREAMAGLLPEVLYKREKFAFMAPPAHTEPEKWEQMKQLANDYLSDEAIDAAGLLSKAGVRALFARHDDPSTTDAERVQLDAVINHLLGVQMLHRMFVAEDVPALARREADRLGWRVLMPV

SEQ ID NO: 1642 - protein, 370 aa, Unknown
  Cytophaga sp. KUC-1
MDATFATGKELQKMDPVFGQLSFDDHEQIVFCNDKDTGLKAIIGIHNSVMGPALGGTRMWNYNTEWEALNDVLRLSRGMTYKSAITGLNIGGGKAVIIGDAKTQKTPELMRKFGEFVHSLGGRYITAEDVGMETKDMDTVRDVTPYVTGISEGRGGSGNPSPITAYGVYLGMKAAAKSQFGTDVLEGKKVLVQGIGHVGEALVEYLTKEGAIVTITDINEEKLFQVAQKYNATVYTGTDLYTADVDIYAPCAMGAIINDDTVNKIKAKVIAGAANNQLADENVHGQRLQERGILYAPDFLINAGGIINVYAELEHYGKAEIMTKTENIYNTTLEIIDYAVKNGMTTHKAALTIAQNRIDLRKIENAAAKK

SEQ ID NO: 1643 - protein, 202 aa, Globularia cordifolia
GVHFGHGTRKWNPKMAPYISAKRKGIHITNLTRTARFLSEACDLVFDAASRGKQFLIVGTKNKAADSVAWAAIRARCHCVNKKWLGGMLTNWSTTETRLHKFRDLRMEQKMGRLNRLPKRDAAVLKRQLSRLQTYLGGIQYMTGLPDIVIIVDQHEEYTALRECITLGIPTICLIDTNCDPDLADISIPANDDAISSIRLIL

SEQ ID NO: 1644 - protein, 303 aa, Anabaena sp.
TQAKAKHADVPVNLYRPNAPFIGKVISNEPLVKEGGIGIVQHIKFDLTGGNLKYIEGQSIGIIPPGVDKNGKPEKLRLYSIASTRHGDDVDDKTISLCVRQLEYKHPESGATVYGVCSTYLTHIEPGSEVKITGPVGKEMLLPDDPEANVIMLATGTGIAPMRTYLWRMFKDAERAANPEYQFKGFSWLVFGVPTTPNILYKEELEEIQQKYPDNFRLTYAISREQKNPQGGRMYIQDRVAEHADQLWQLIKNQKTHTYICGLRGMEEGIDAALSAAAAKEGVTWSDYQKDLKKAGRWHVETS

SEQ ID NO: 1645 - protein, 202 aa, Plantago major
  misc_feature (31)..(31): Xaa can be any naturally occurring amino acid
  misc_feature (33)..(33): Xaa can be any naturally occurring amino acid
  misc_feature (39)..(39): Xaa can be any naturally occurring amino acid
  misc_feature (120)..(120): Xaa can be any naturally occurring amino acid
  misc_feature (157)..(157): Xaa can be any naturally occurring amino acid
  misc_feature (186)..(186): Xaa can be any naturally occurring amino acid
  misc_feature (194)..(194): Xaa can be any naturally occurring amino acid
  misc_feature (197)..(197): Xaa can be any naturally occurring amino acid
  misc_feature (200)..(201): Xaa can be any naturally occurring amino acid
GVHLGHEPRKWNPKMAPYISAKRKGIHITNXTXTARFLXEACDLVFGAASRGKQFLIVGTKKKAADLVAWAAIRARCHCVTKKWLGGMLTNWSTTETRLHKFRDLRMKQKTGRLNRLPKXDAAMLKRQLFRLQTYLGGIKYMTGLPDIVIIVDQHEXYTALRECITLGIPTICLIBTNCDPDLABXSIPANDDXISXIRXXL

SEQ ID NO: 1646 - protein, 470 aa, Coccidioides immitis
MLPSFNHSLPSGKEKGTYLALDVGGSTFRVALVKLAGKDEGVKILKMATSHIDEDVKALAGKAFFDWMARKIGEMLPPSAEEYSQDSAPLPMGLSWSFPIEQTSIRSGKVISMGKGFHCSDGTVGDDLRELIMEACRKRNLNVTLEAIVNDGSATLLSRAYTDPTTRMSLILGTGTNMAVHFPVHAIGIDKYGERSPEWFAKADHVITNTEISMFGGRVLQMTRWDDDLNRNHIKPDYQPLEYMCTGRYLGEIVRLIAAEAVQTAGLFGGQMPASMQPRYSLDTAILAYIEEDTSPSFQSSLAFLQKQHQFRVPPTPADLAFLKRVTHCVSQRAAAYLATAIHGLWCLRNESETPIFPATPESTNDEEILKIPAKECTKDPIPLQVNIACDGSVINKYPNFRARCQVYLNQLTFDSKTSETSHMILDSAIASKKASSRVEQLRSITLDLAPEGGIIGAAVAVAVAVPDDE

SEQ ID NO: 1647 - protein, 257 aa, Elymus canadensis
CELDNIMRLTGITGIVNGMDVSEWDPTKDKFLAVNYDVTTALEGKALNKEALQAEVGLPVDRKVPLVAFIGRLEEQKGPDVMIAAIPEIVKDEDVQIVLLGTGKKKFERLLKSVEEKFPGKVRAVVRFNAPLAHQMMAGADVLAVTSRFEPCGLIQLQGMRYGTPCACASTGGLVDTIVEGKTGFHMGRLSVNCNVVEPADVKKVATTLKRAIKVVGTPAYHEMVKNCMIQDLSWKGPAKNWEDVLLELGVEGSEPG

SEQ ID NO: 1648 - protein, 517 aa, Escherichia coli
AHIEGRHMKRMLINATQQEELRVALVDGQRLYDLDIESPGHEQKKANIYKGKITRIEPSLEAAFVDYGAERHGFLPLKEIAREYFPANYSAHGRPNIKDVLREGQEVIVQIDKEERGNKGAALTTFISLAGSYLVLMPNNPRAGGISRRIEGDDRTELKEALASLELPEGMGLIVRTAGVGKSAEALQWDLSFRLKHWEAIKKAAESRPAPFLIHQESNVIVRAFRDYLRQDIGEILIDNPKVLELARQHIAALGRPDFSSKIKLYTGEIPLFSHYQIESQIESAFQREVRLPSGGSIVIDSTEALTAIDINSARATRGGDIEETAFNTNLEAADEIARQLRLRDLGGLIVIDFIDMTPVRHQRAVENRLREAVRQDRARIQISHISRFGLLEMSRQRLSPSLGESSHHVCPRCSGTGTVRDNESLSLSILRLIEEEALKENTQEVHAIVPVPIASYLLNEKRSAVNAIETRQDGVRCVIVPNDQMETPHYHVLRVRKGEETPTLSYMLPKLHEEAM

SEQ ID NO: 1649 - protein, 210 aa, Thermosynechococcus elongatus
MNDSLLSNGHAPPLRQATVDRQTKETKVHVELTLDGNGLADNHTGIPFLNHMLDQLCAHGLVDLRVQASGDTHIDDHHTNEDVGITLGMALDQALGDRRGIQRFGHFVAPLDESLVEVALDFSGRPHLNYGLQIPTQRVGTYDTQLVREFFVALVNHSRMTLHIRQLDGMNSHHIIEATFKAFARALRMAIALDPRRAQQIPSSKGVIQA

SEQ ID NO: 1650 - protein, 241 aa, Coccidioides immitis
MPLLSPERFVGLGIDPPKGALLYGPPGTGKTLCARAVANRTDATFIRVIGSELVQKYVGEGARMVRELFEMARTKKACIIFFDEIDAIGGARFDDGAGGDNEVQRTMLELITQLDGFDARGNIKVMFATNRPSTLDPALMRPGRIDRKIEFSLPDLEGRANILRIHAKSMSVERDIRWELISRLCPNSTGAELRSVATEAGMFAIRARRKVATEKDFLAAVDKVIKGNLKFNSTATYMQYN

SEQ ID NO: 1651 - protein, 189 aa, Phelipanche purpurea
FGNHSKKWNPKMAPYISAESKHRHIINLTKTARFLYEACNLVFNAASRGKQFLIVGTETITADLVEEAAIKADCHFVNKKWTGGLLTNWSITEERLKYFNYLRVKEIKGGFDCLPKKDAAVVKRQLSRFQKTLGGIKNMSGLPDIVIILYQNKNEEYKALQECITLGIPTISLIDTDSDPDLADISIPA

SEQ ID NO: 1652 - protein, 473 aa, Oryza sativa
MSAAAEGRPPAAAAAGEMVREATAWCALHGLVVGDRADPRSGTVPGVGLVHAPFSLLPTHLPESHWRQACELAPIFNELVDRVSLDGDFLQDSLSNHTTDIDSKRVPGNEASSQFAKALARAWDEFNVDRDGKTVSVVYFRAGYTPNDYPSEAEWAARLLLEQSSAVKCPSISYHLVGTKKIQQELARPNVLERFLENKEEITKIRKCFAGLWSLDDEEIVKSAIQKPELFVLKPQREGGGNNIYGIDVRETLIRLQKEGGDALAAYILMQRIFPKASLSNLVRGGVCHEALTISELGIYGAYLRAVRVHSAEGAAPGGEQDQRCGGAAPAAEADVEGADTSKATGQEPRALSSSSSSSPLLSSPLLSGIQEPSRVPAMPPPDLELNKRSASASAPEHDQTAGPYGTIEILPQPPVPAAAAAAPGHRRPISPLPHRALLPGTIVTFFHQIGPEDASRDLPSPAFLPGGDSVSF

SEQ ID NO: 1653 - protein, 152 aa, Unknown
  Candidatus Blochmannia noveboracensis
  misc_feature (9)..(10): Xaa can be any naturally occurring amino acid
FIFGVRNKXXIIDLEITSVMFRKALIELNKIAALKGKILFVGTKRAASESVKKTALACNQFFVNHRWLGGMLTNWKTVRQSIKRLKDLEIQSQDGTFKKLTKKEALILNRELINLENSLGGIKNMGGLPDAIFAVGATHEHIAIKEANRLGI

SEQ ID NO: 1654 - protein, 189 aa, Phelipanche purpurea
FGNHSKKWNPKMAPYISAESKHRHIINLTKTARFLYEACNLVFNAASRGKQFLIVGTETITADLVEEAAIKADCHFVNKKWTGGLLTNWSITEERLKYFNYLRVKEIKGGFDCLPKKDAAVVKRQLSRFQKTLGGIKNMSGLPDIVIILYQNKNEECKALQECITLGIPTISLIDTDSDPDLADSSIPA

SEQ ID NO: 1655 - protein, 438 aa, Corynebacterium efficiens [sequence omitted]

SEQ ID NO: 1656 - protein, 245 aa, Oryza sativa
RTFDRHGRGEANELKLLGMWASPFALRAKLALSFKGLSYDYIEEDFKNKSDLLLSSNPVHKKVPVLIHNGKPICESQVIVQYIDEVFPDAGVTLLPADPHDRAVARFWAAYIDEKLFSAWILVFRSKTEEEKAEAVKQTFAVVEKLEGALSECSKGKPFFGGDTVGYVDVVLGGFVAWVHAIEEVYDLNQFDATQTPLLAAWLERFDELDAVKEVMPDIGRLVELAKMRQAQAAGAAAAAAGEAS

SEQ ID NO: 1657 - protein, 147 aa, Unknown
  Candidatus Blochmannia americanus
FGVRNKIHIIDLETTILMFKQALIELNKIASLKGKILFVGTKRAASEAVKKTALACNQFFVNNRWLGGMLTNWKTVRQSIKRLKDLETQSQDGTFQKLTKKEALILNRELINLENSLGGIKNMGGLPDAIFAVGATHEDIAIKEANS

SEQ ID NO: 1658 - protein, 151 aa, Unknown
  Candidatus Blochmannia nearcticus
  misc_feature (7)..(7): Xaa can be any naturally occurring amino acid
KPFIFGXRNKIHIINLETTIIMFKKALTELNKIASLKGKILFVGTKRAASESIKKTAIICNQFFVNHRWLGGMLTNWKTVRQSIKRLKDLEIQSKDGTFKKLTKKEALILNRELINLENSLGGIKNMGGLPDAIFAVGSAHEYIAIKEANS

SEQ ID NO: 1659 - protein, 187 aa, Phelipanche arenaria
FGHRSKEWNPKMAPYISAERKHMHIINLTKTARFLYEACNLVFYAASRGKQFLIVGTKRSTVNLVEQATKKAGCHFVNKKWTGGMLTNWSITKARLQKFKDLIIEQEAGRIDCLSKKDAAVVKRQLSHLQKNLGGIRNMSELPDIVIILCQNEEYKALQECITLGIPTISLIDTNSDPDLADISIPA

SEQ ID NO: 1660 - protein, 828 aa, Zea mays
KTSRAPSHPPRLVTHSTRTHYLIGQSQTNWAPSPPLPLPMAQQLPCVSSPRPLLAVPAGRWRAGVRGRPNVAGLGRGRLSLHAAAARPVAEAVQAEEDDDDDDEEVAEERFALGGACRVLAGMPAPLGATALRGGVNFAVYSSGASAASLCLFAPGDLKADRVTEEVPLDPLLNRTGNVWHVFIHGDQLHGMLYGYRFDGVFAPERGQYYDVSNVVVDPYAKAVVSRGEYGVPAPGGSCWPQMAGMIPLPYNKFDWQGDLPLGYHQKDLVIYEMHLRGFTKHNSSKTKHPGTYIGAVSKLDHLKELGVNCIELMPCHEFNELEYFSSSSKMNFWGYSTINFFSPMARYSSSGIRDSGCGAINEFKAFVREAHKRGIEVIMDVVFNHTAEGNEKGPILSFRGIDNSTYYMLAPKGEFYNYSGCGNTFNCNHPVVREFIVDCLRYWVTEMHVDGFRFDLASILTRGCSLWDPVNVYGSPMEGDMITTGTPLVAPPLIDMISNDPILGNVKLIAEAWDAGGLYQVGQFPHWNVWSEWNGKYRDTVRQFIKGTDGFAGAFAECLCGSPQLYQAGGRKPWHSINFVCAHDGFTLADLVTYNSKYNLSNGEDNRDGENHNLSWNCGEEGEFASLSVRRLRKRQMRNFFVCLMVSQGVPMFYMGDEYGHTKGGNNNTYCHDHYVNYFRWDKKEEQSSDLYRFCRLMTKFRKECESLGLEDFPTSERLKWHGHQPGKPDWSEASRFVAFTMKDETKGEIYVAFNTSHLPVVVGLPERSGFRWEPVVDTGKEAPYDFLTDGLPDRAVTVYQFSHFLNSNLYPMLSYSSIILVLRPDV

SEQ ID NO: 1661 - protein, 187 aa, Phelipanche arenaria
FGHRSKEWNPKMAPYISAERKHMHIINLTKTARFLYEACNLVFYAASRGKQFLIVSTKRSTVNLVEQAAKKAGCHFVNKKWTGGMLTNWSITKARLQKFKDLIIEQEAGRIDCLSKKDAAVVKRQLSHFQKNLGGIRNMSELPDIVIILCQNEEYKALQECITLGIPTISLIDTNSDPDLADISIPA

SEQ ID NO: 1662 - protein, 151 aa, Unknown
  Candidatus Blochmannia floridanus
PFIFGIRNKIHIINLDKTIVMFSNALVELKKIALAKGKILFVGTKRATRESIKSTALICGQFFVNYRWLGGMLTNWKTVRQSIKRLKDLENQSQDGTFDKLTKKEVLILNRELISLENSLGGIKNMGGLPDALFTAGAEQEHIAIKEANSL

SEQ ID NO: 1663 - protein, 532 aa, Burkholderia mallei
MSSTTDWNAARALDERAPQAAAGGHARAKTDFDVLIVGAGLSGIGAAYYLRERCPDATYAILEGRETMGGTWDLFRYPGVRSDSDMFTLGFSFRPWHSDKAISDGQTILDYIRDTARAYGIDKTIRFGHKVTAASWDSTSARWTVRVQRATGDARHDEAVYTCRFLYMCSGYYDYEEGHAPSWPDMDAYQGRIVHPQHWPSDLDYKDKRVVVIGSGATAVTLVPSMAADARHVTMLQRSPTYIVSLPARDAIANALRRWLPSGLAHRLVRLKNVLLTMYFYNLARHRPDATKKFIVRAAGKQLGPQFDVNKHLTPRYKPWDQRVCLVPNGDLFKAIRAGRASIATDEIERFTPGGLRLKSGQRLEADVIVTATGLKLKMLGGAAVTVDGKPVDLSQTVSYKGMMYSGVPNLASSFGYTNASWTLKAELIAQYVCRLLEHMRTHGYDVCVPRLAPGSMELEPVVDLTSGYIQRAAGVLPKQGTKKPWKSYQNYARDFATFRFGPLADGAMQFERRRPALAERDDTRQPAYEGR

SEQ ID NO: 1664 - protein, 370 aa, Pseudoalteromonas tunicata
MIPNQWYAILRTQDVKKKPVGIKRLEKLLVLYRDTAGELVCLDDRCPHKGVKLSLGQQHGDLIACPYHGFQYDQQGDCVHMPVLGQKGNVPKGMCVKSYKVKEELGLIWFWFGDVRQEHEYPDIPMFKQLKEYKGHYSYYGWDAPINYTRYVESVCEIYHIPFVHKGSAINIWDPKGGRVDNFECKVEDTLITSDFILRPDDDRTAEETLVARKPWTRGWRFGIDVQMPNLILIRSDVFDVIFIPTPIDENTCWVCVCYQEPKRDLLLPLIKPLPIPFWGPVRPWYMCRIERFVQQAKDMAVIAHQEPKVSHPKANRLIPLDKVNAHYIRFREKLIREAKEQQQVKELAKSNPEFAAPTLEQIIGIEEVH

SEQ ID NO: 1665 - protein, 890 aa, Unknown
  Candidatus Kuenenia stuttgartiensis
MKIIHLTIDDKSIVAPEGTNIFQAALDNNIYIPGLCYHPKLSQFGGCRLCYVEVTERNQTRRRFACAHPVSEGMSVKVNTAEVNRHRKAVMEYLLAHHELACPTCNKSGECGLQNIAHEQESPLGRFKTARMSAPVIRDNPVLELNRNRCVLCGRCVNACKEIEGVGAIDFQNRGFRTVIGTAFDRPLDCSFCGGCLAVCPTGAWQDRTLKFSGRSWEFEGFQTICPYCSVGCTIVLNTKNGSVRRVLSEDKLGINEGNLCVKGRFGHEFIHSPERITTPLIKKNGEFQAVRWEEAIGFVSETLGRIIEKHGSNTIGGIGSEKCTNEEDYLFQKFCRTVLRTNCIDNIANMRAPFLNSVLYKSVESGFAAAPLKEIENAGTLFFFGVDITEALPVIGCMARKAIKLNNANVVIANPRTIIFKNTAPNEARLNYSLGSQHILLNAIIKVIVEDKLVDIKKLESSASNLSDLRLAVENLSLIDVERLTGVSPEMIRNAAGLLAKPGNCCIVYGKDVIEDPLGADTIKTLLDLCTLIDISNRSEIHPGRVSLFCARYHNNSQGVNDMGVVPESLPGYLDINDASNKERIEELWGVKFSEDLLSKKPLNLIDAAKNGSIKSLYVMGADPVTEYPNGKEIRDSFKNMEFIVVQDSFMTETAKQADVIFPSATFAEKEGTYTSMGLITQRLNKAVSPVGESKADWKIICDVSEKMGHAFPYANVTEIVDEIKKAAPLYSSLSYDRLKRKEFHWPSSFPEKKESNTCTFFAIQGKFLKVNVEKEFPFIVMTGASLNHHGAYSAKSRALVSIAPECCVEINEKDAKDMQIKNGDMVMVESRVGKLKLRARVTKKSPPGIVFVPDAYADSPVNILISQAYTPVKIYTVSDLVLRLSQGE

SEQ ID NO: 1666 - protein, 343 aa, Nicotiana tabacum
MTLCIKNGFLAAALVLVGLLICSIQMIGAQSIGVCYGKHANNLPSDQDVINLYDANGIRKMRIYNPDTNVFNALRGSNIEIILDVPLQDLQSLTDPSRANGWVQDNIINHFPDVKFKYIAVGNEVSPGNNGQYAPFVAPAMQNVYNALAAAGLQDQIKVSTATYSGILANTNPPKDSIFRGEFNSFINPIIQFLVQHNLPLLANVYPYFGHIFNTADVPLSYALFTQQEANPAGYQNLFDALLDSMYFAVEKAGGQNVEIIVSESGWPSEGNSAATIENAQTYYENLINHVKSGAGTPKKPGNAIETYLFAMFDENNKEGDITEKHFGLFSPDQRAKYQLNFN

SEQ ID NO: 1667 - protein, 503 aa, Unknown
  Azoarcus sp. BH72
MRNDSTTAVIAHFPLPPRTMSIEFLINFTPQETRVAIVEQGVVQELHVERTASRGIVGNIYLGKVVRVLPGMQSAFIEIGLERTAFLHVADIWSDRQNGEAAKPIERILAEGQSLVVQVLKDPIGTKGARLSTQISIAGRLLVYLPQEKHIGISQRIENETEREALRERLTRLVPADEPGGFIVRTMAESASDDELAADIAYLRKLWNEIRNNSTGAFPPKLLHEDLGLGQRVLRDLVNEETTRIRVDSRENFQKLAAFAAEYSPKVLPLLEHYTGERPLFDIFNIEEEIQKALARRVDLKSGGYLIIDQTEAMTTVDVNTGGFVGARNFDDTIFKTNLEATQAIARQLRLRNLGGIIIIDFIDMENVEHREMVLEEFRKALARDHTKMSINGFTALGLVEMTRKRTRESLAHLLCEACPTCGGRGEVKTARTVAYEVLRELLREARQFNAREFRVLAAPNVIDLFLDEESQSLAMLSDFIDKKISLHPEASYTQEQFDIVLL

SEQ ID NO: 1668 - protein, 326 aa, Kineococcus radiotolerans
MPRTRPDINVPALVGRHAVVTGASDGVGLALATRLAAAGADLTLPVRNQVKGRAALAAIRRAVPGARVVMADLDLSSLASVAAFGARMQEEGKAIHLLVNNAGVMTPPQRQSTVDGFELQFGTNHLGHVALVAHLLPLLRAGRARVTSQVSVAARSGRVNFEDPNWRDAYHGMKAYSSSMIAFGLFGLELERRSRAQGWGITSNLSHPGIAPTSLLAARPEVGRSADTTQVRRIRTLSRWGLVGTVETALLPALMAATSQESEGGKLYGPRGPGHLSGGPSEQKLYRPLRSTADAAHVWEISEALTGVSFPRSAADVLLAGQEKAS

SEQ ID NO: 1669 - protein, 135 aa, Yersinia pseudotuberculosis
MRLLHTMLRVGDLQRSIDFYTKVLGMRLLRTSENTEYKYSLAFVGYSDESKGSVIELTYNWGVDQYDMGTAFGHLALGVDDVAATCDQIRQAGGKVTREAGPVKGGNTIIAFVEDPDGYKIELIENKSAGDGLGN

SEQ ID NO: 1670 - protein, 202 aa, Tetranema mexicanum
GVHFGHGTRKWNPKMAPYISAKRKGIHITNLTRTARFLSEACDLVFDAASRGKQFLIVGTKNKAADSVAWAAIKARCHCVNKKWLGGMLTNWSTTETRLHKFRDLRMEQKTGRLNRLPKRDAAMLKRQLFRLQTYLGGIKYMTGLPDIVIIVDQHEEYTALRECITLGIPTICLIDTNCDPDLADISIPANDDAISSIRLIL

SEQ ID NO: 1671 - protein, 175 aa, Triticum aestivum
MPPTVMPSSATSVAPFQGFKSTAAFPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVSFIAFKPPACEESGKA

SEQ ID NO: 1672 - protein, 202 aa, Unknown
  Catalpa sp. SS-83
GVHFGHGTKKWNPKMAPYISAKRKGIHITNLTRTARFLSEACDLVFDAASRGKQFLIVGTKNKAADSVARAAIKARCHCVNKKWLGGMLTNWSTTETRLQKFRDLRMEQKTARLNRLQKRDAAVMKRQLSRLQTYLGGIKYMTGLPDIVIIVDQHEEYTALRECITLGIPTICLIDTNCDPDLADISIPANDDAISSIRLIL

SEQ ID NO: 1673 - protein, 522 aa, Unknown
  Synechococcus sp. RS9916
MLGDLWSFQGRYRTLHLTWIAFFLTFVVWFNLAPLATTVRADLDLTIGQIRTVAICNVALTIPARVLIGMLLDKFGPRITYSSILVFSVIPCLLFASAQDFNQLVVARLLLSIVGAGFVIGIRMVAEWFPPKEIGLAEGIYGGWGNFGSAFSALTMVLLAGYLSFSGGATLPTGEVLNWRGAIALTGIISALYGVFYYFSVTDTPPGKVYQKPAKTAGLEVTSMRDFWGLLGMNVPFAAILCVLCWRLTKVGFLTASTYPLALGAVAIWFAFQTWGIIRTNRDLILGNKTYPKEDRYEFRQVAILELTYIVNFGSELAVVSMLPTFFETTFDLPKATAGLLASCFAFVNLVARPAGGLISDKVGSRKNTMGFLTAGLGIGYLVMSMIKPGTFSGTSGIVVAVVITMLASFFVQSGEGATFALVPLVKRRVTGQVAGLVGAYGNVGAVAYLTTFSLLPMWMGGGKDPSPEVIAASNSAFFQILGIAGLVVAFFCFFFLKEPKGSFADLHEGEDASPELAAAGR

SEQ ID NO: 1674 - protein, 202 aa, Unknown
  Jovellana sp. DePamphilis 90-3
GVHFGHGTRKWNPKMAPYISAKRKGIHITNLTRTARFLSEACDLVFDAASRGKQFLIVGTKSKAAGSVASAAIKARCHCVNKKWLGGMLTNWSTTETRLHKFRDLRMEQKMGRLNRLPKRDAAMLKRQLYRLQTYLGGIKYMTGLPDIVIIVDQHEEYTALRECITLGIPTICLIDTNCDPDLADISIPANDDAISSIRLIL

SEQ ID NO: 1675 - protein, 343 aa, Solanum lycopersicoides
MEMDLPVSAIGFEGFEKRLEISFVEPGLFADPNGKGLRSLTKSQLDEILGPAECTIVDNLSNDYVDSYVLSESSLFVYSYKIIIKTCGTTKLLLAIPPILRLAETLSLKVQDVRYTRGSFIFPGAQSFPHRHFSEEVAVLDGYFGKLAAGSKAVIMGNPDKTQKWHVYSASAGTVQSNDPVYTLEMCMTGLNREKASVFYKTEESSAAHMTVRSGIRKILPKSEICDFEFEPCGYSMNSIEGAAVSTIHITPEDGFSYASFESVGYDPKTTELGPLVERVLACFEPSEFSIALHADVATKLLERVCSVDVKGYSVAEWSPEEFGKGGSIVYQKFTRTPYCESP

SEQ ID NO: 1676 - protein, 742 aa, Unknown
  Synechococcus sp. RS9916
MTTPTPSVRSQCPYCGVGCGLELLPPAQPGQAVKKDEEGNPMWTARGDRSHPSSQGQVCIKGATVGETLARGRLHQPLYRASLDQDFEPVSWEQALQTITDQIQTTLANKGADAIAMYGSGQFHTEDYYLAQKLLKGALGTNNFDANSRLCMSSAVAGYTRSLGSDGPPACYDDLDHCSVAVLIGTNTAECHPVLFQRLIKRKKRNPGSVTIVVIDPRRTDTAKAADIHLPIAPGTDLALLHGIAHLVMRENGQDVAFIDDHTENYKPFFDVVARWTPRKVARFCGIPEKRLREVAELFHRKQRVLSLWSMGVNQRREGTAVVQGLINLHLLTGQIGKEGAGPFSLTGQPNAMGGREAGGLAHLLPGYRIVTNDQHRSEVEQAWGFPQGQIAATPGLGAWQQVEAMERGDLDLWWVAATNPLVSMPELDRVKAAMQNCALVVVSEAYADSETSHYAHLLLPASQWSEKAGAMTNSERRVTYCPAYRPRHGQSRPDWEVFAEVGRRLGFEQHFSYDSAAEVYAEFSQLTEGRVCDMSGLSHELLSESGPQQWPFPRGSEPSQGAKRLYSDHQFPTPSGKARFSTDLPQGLAEPPCDTYPLVLTVGRYLGQWHTMTRTGKVKRLQTMHPEPLLEIHPEDASDLQIKDGALTAVSSRRGHLTARAKITNRIRKGSVFLPMHWGFTQDQACEVNALMHDQACPVSKQPELKACAVIAAPAVSAIKPPEQVSNQLVKLRRWFSPAAQ

SEQ ID NO: 1677 - protein, 252 aa, Brassica napus
  misc_feature (31)..(31): Xaa can be any naturally occurring amino acid
  misc_feature (99)..(99): Xaa can be any naturally occurring amino acid
MVAFSAWPWGNFGNLKYLLYAPLAAQVVYSXAYEQDYSRALWCLHILIICGLKGFLHVLWSVYNNMLWASRTLRINPNGVDFKQIDHEWHWDNYILLQXAIIASIICYMSLPLMTMNSIPLWNTKGLVALIALHVTFSEPLYYFLHRSFHRNTYLFTHYHSFHHSSPVPHPMTAGNATLLEGLILCVVAGVPLVGSCLLGVGSSSLIYGYAIMFDFLRCLGHCNVEIFSHKLFETLPILRYLIYTPTYHTLH

SEQ ID NO: 1678 - protein, 171 aa, Bradyrhizobium japonicum
MTTERAVLAGGCFWGMQDLIRRQPGVTSTRVGYTGGEVKNATYRNHEGYAEAIEIIFDPAKTSYRTMLEFFFQIHDPTTLNRQGNDWGTSYRSAIFTTSDEQKRIAEDTIADVEASHLWPGKVVTEVTPAGDFWEAEPEHQDYLERYPDGYTCHFIRPGWKLPRRAAAAGG

SEQ ID NO: 1679 - protein, 738 aa, Arabidopsis thaliana
MEVCNCIEPQWPADELLMKYQYISDFFIAIAYFSIPLELIYFVKKSAVFPYRWVLVQFGAFIVLCGATHLINLWTFTTHSRTVALVMTTAKVLTAVVSCATALMLVHIIPDLLSVKTRELFLKNKAAELDREMGLIRTQEETGRHVRMLTHEIRSTLDRHTILKTTLVELGRTLALEECALWMPTRTGLELQLSYTLRHQHPVEYTVPIQLPVINQVFGTSRAVKISPNSPVARLRPVSGKYMLGEVVAVRVPLLHLSNFQINDWPELSTKRYALMVLMLPSDSARQWHVHELELVEVVADQVAVALSHAAILEESMRARDLLMEQNVALDLARREAETAIRARNDFLAVMNHEMRTPMHAIIALSSLLQETELTPEQRLMVETILKSSNLLATLMNDVLDLSRLEDGSLQLELGTFNLHTLFREVLNLIKPIAVVKKLPITLNLAPDLPEFVVGDEKRLMQIILNIVGNAVKFSKQGSISVTALVTKSDTRAADFFVVPTGSHFYLRVKVKDSGAGINPQDIPKIFTKFAQTQSLATRSSGGSGLGLAISKRFVNLMEGNIWIESDGLGKGCTAIFDVKLGISERSNESKQSGIPKVPAIPRHSNFTGLKVLVMDENGVSRMVTKGLLVHLGCEVTTVSSNEECLRVVSHEHKVVFMDVCMPGVENYQIALRIHEKFTKQRHQRPLLVALSGNTDKSTKEKCMSFGLDGVLLKPVSLDNIRDVLSDLLEPRVLYEGM

SEQ ID NO: 1680 - protein, 323 aa, Gluconobacter oxydans
MTQTAAPAWSTDSLERLDGKTALITGSTGGLGFEVACGLAKQGAAILLSGRNHNKGQAALARLHERVPFVKARFELLDLASLAGIEAFASAMRSRGEPIHLLANNAGVMGPATRLTTKDGFELQFGTNHLGHFALTGRLLPLLAAGNATVMTVASLAALKGEIPFGDLNARHSYNPMVRYRQSKLCNLLFALELNRRALKAPWPIHSRAAHPGWAASDIVANNGSLDQSANKAARFMRGLARRVAGPVFHAMGQTVEEGAWPLLYALASPEARDGGYYGPQGPGERRGVPGIAGLPALAHVPELAERLWTVSEQMTGVKYGLV

SEQ ID NO: 1681 - protein, 202 aa, Lamium purpureum
  misc_feature (8)..(9): Xaa can be any naturally occurring amino acid
  misc_feature (20)..(20): Xaa can be any naturally occurring amino acid
  misc_feature (23)..(23): Xaa can be any naturally occurring amino acid
  misc_feature (31)..(31): Xaa can be any naturally occurring amino acid
  misc_feature (35)..(36): Xaa can be any naturally occurring amino acid
  misc_feature (88)..(88): Xaa can be any naturally occurring amino acid
  misc_feature (96)..(96): Xaa can be any naturally occurring amino acid
  misc_feature (98)..(98): Xaa can be any naturally occurring amino acid
  misc_feature (101)..(101): Xaa can be any naturally occurring amino acid
  misc_feature (106)..(106): Xaa can be any naturally occurring amino acid
  misc_feature (113)..(113): Xaa can be any naturally occurring amino acid
  misc_feature (117)..(117): Xaa can be any naturally occurring amino acid
  misc_feature (120)..(120): Xaa can be any naturally occurring amino acid
  misc_feature (127)..(127): Xaa can be any naturally occurring amino acid
  misc_feature (157)..(157): Xaa can be any naturally occurring amino acid
  misc_feature (162)..(163): Xaa can be any naturally occurring amino acid
  misc_feature (200)..(202): Xaa can be any naturally occurring amino acid
GVHFGHGXXKWNPKMAPYIXAKXKGIHITNXTKTXXFLSEACDLVFDAASRGKQFLIVGTKKKAADSVARAAIKARCHCVNKKWLGGXLTNWSTTXTXLHXFRDLXMQQKAGXLNRXPKXBAAVVKXQLYRLQTYLGGIKYMTGLPDIVIIVDQHEXYTALXXCITLGIPTICLIBTNCNPBLABISIPANDDAISSIRXXX

SEQ ID NO: 1682 - protein, 610 aa, Campylobacter jejuni
MKKNILRLGIVVLVLLIAGVLWLNNDINQKKEDEANKNAIAANADFSLLSDDDPNFEKWGKVFPEQLKMYLTVEKEEPKATEFGGNLAYSKLIRFPQLTILWAGYPFSLDFNEERGHFWVQVDQMKTARNNKDFLNAHGLAAFKGQPAACMNCHSGWTPWLIKNVAKGDFTAFNSTNYWTMIKNIPAVDGIVENSPEHAGPHGGKRMGVTCADCHNPNDMSLRLTRPAAINALVSRGYEKDPVQGVKATREEMRTLVCSQCHVEYYFKPTGEKVKVMGETIVDDSSKKWWNGTQKNYDEYEFWRDGNKAKEIETDGIVLTFPWSEWKKGQPFRIEMLDDYYDKVRGVFGADFTHKLTGAQIIKIQHPESELYSGGVHAANGVSCVDCHMPYVREGAKKVTQHNITSPLRDINSACKSCHKQSEDYLKAQVLDIQNSVAHDQRTAEYAIVSLIMDTKKLRDELGNMEKFQSDGKADAKKISEELKEVLELHRKAQMRADFVNAENSTGFHNPREASRMLLQAVDMARMGQTKLVEIAAANGIKDFKTSNLGFEDIQKFNPGELYYKVDVNNHKAGERYYADEKDVNGNPPKELLEHDKELAPYNYQVIDKK

SEQ ID NO: 1683 - protein, 403 aa, Thermosynechococcus elongatus
MGINLRSPLFIVLLTIVIDRLGESLIFPILPFFVERFNFDAFSLTLLFSAFAAAQLIAAPLLGALSDHWGRRPVLLICIAGTAVSYILFAVATAPWLLFVSRIIDGLTGGVVSTAQAYIADTSAPANRAKNFGLTGAAFGIGFIFGPAIGGSLAAIDLKLPIWFAAVLALVNVVLAYFILPESLPAGQRSPLTLKSFASQQQWLALFNQRTLQALLMAFFIFNFAFAGFTSIFVLFLKRQLSWGPAEAGIIFVMIGVVSTIVQAGLIRSLIPRFGEQCLSLGGLLLVALALLGIAAVPTVGSLSVPLLYACVIGLAFGVGIMLPSLRGVISNRVRDQDQGKILGASQSLQSVAGIAGPAWAGWAFDRWGGVAPAWQSSVMMAIALGFLALGLGKPKDATPSSS

SEQ ID NO: 1684 - protein, 343 aa, Solanum chmielewskii
MEMDLPVSAIGFEGFEKRLEISFVEPGLFADPNGKGLRSLTKAQLDEILGPAECTIVDNLSNDYVDSYVLSESSLFVYSYKIIIKTCGTTKLLLAIPPILRLAETLSLKVQDVRYTRGSFIFPGAQSFPHRHFSEEVAVLDGYFGKLAAGSKAVIMGNPDKTQKWHVYSASAGTVQCNDPVYTLEMCMTGLNREKASVFYKTEESSAAHMTVRSGIRKILPKSEICDFEFEPCGYSMNSIEGAAVSTIHITPEDGFSYASFESVGYDPKTTELGSLVERVLACFEPAEFSIALHADVATKLLERVCSVDVKGYSLAEWSPEEFGKGGSIVYQKFTRTPYCESP

SEQ ID NO: 1685 - protein, 449 aa, Triticum aestivum
MEARPRPSGVRRVTAKKRPRPDASSNSARKLQRREIAAFPERTFAASTTRERFRNIQLQEEFDTYDPKENSSLLPYLRKRSEIIEIVGARDIIFALSQLGVCAAFSRVTNQRICFLNGSPDEVIRSLFYNKNNDSLITVSVYGSENFSALRCRTTRIEYIRRGKPDAGFPLFETESLRWPGFVEFDDVNGKVLTYSAQDSTYKVFDLKNYTLLYTISDKDVQEIKISPGIMLLIYSRKKGYIPLEILSIEDGKRLKSFRHLLHRNKKIDFIEQFNEKLLVKQDGENLQILDVTNSKITEVSSNEFVTPSAFIFLYEMQLFLTFRNRSVSVWNFRGELVTSFEDHLLWHPDCNTNSIYITSNQDLIISYCKAEPDDPSSEDNACSINISDILTGKCMAKIKAGNLCKQKSSKFLCTPLEALGDITSLYYDEEREEIITGNHQGLIHVWSN

SEQ ID NO: 1686 - protein, 949 aa, Oryza sativa
MLSVRCGGGGGGAAAVEEHGAVRHHRPLTPRQQQQLRTVVESLRLDPLEVDEGARLEIARQSYRAGDYKAALEHCNAVYRANPRLLENLLLLGAVYYQLREFDMCIAKNEEAVAIQPNCPECFNSIANAWREKGDVDNAIQFYVHAVQLRPTFADAWTNLANAYTRKGNLSQAAECCHQALALNPHLADAYCNLGDVLKAQGLYREAYSHYLDALNIKPTFANAWNNIAGLLMQWGDFNKAALYYKEAIKCNPAFYDAHLNLGNLYKVTGMRQDAIVCFQNAARAKPENAVAYVFSGNLGNAYHEQGQLDLAILSYRQAIHCNSSYVEAYNNLGNALKDAGRNEEAISCYQTCLALQPSHPQALTNLGNVYMERVSFWSTCRNMMDIAASLYMATLTVTTGLSAPYNNLAMIYKQQGNCNHAITCFNEVLRIDPMAADCLVNRGNTFKEAGRITEAIQDYFHAVTIRPTMAEAHANLAAAYKDTGLLEASIISYKQALQLRQDFPEATCNLLHTLQMSSLPSVQPFHAIAYPIDSTLALEISRTYAAHYSLVASRFGLPTFTHSYPVPISNDGRTSRLRIGYVSSDFGNHPLSHLMGSIFGMHNQDTIEVFCYALSQDDGTEWRQRIRSEAEHFIDVSSMSSDMIAKVINEDKIQILINLNGYTKGARNEIFALQPAPIQVSYMGFPGTTGADYIDYLVTDEFVSPLKFSHIYSEKLVHLPHCYFVNDYKQKNRDVLGPVCPHKRADYGLPEDKFIFACFNQLYKMDPDIFNTCPLCNGHTTGTDILWAGLPMITLPLEKMATRVAGSLCLATGIGEEMVVNRVSFFTSVNKNGRLLVWSVIVISGPEDWWQFRSWMIYADFMRKLERYAWAHLTAGIAVTELLMMSRGSAASALKLGSLFQTSVPALSGVRHSRISWKARGENEPDRVAPCSHLAPASAMTSLPEVPK

SEQ ID NO: 1687 - protein, 441 aa, Corynebacterium efficiens
MNHVTSAQPESEPPTDEPDAVTLRDELPTPHPVSPVTGLPVTPYKQEDSIGASFPAPSPGTEDSAAFGHESNMRERIATAKRVVVKIGSSSLTSDEGGHTVDPNRINTIVNALQARMEAGSDVIVVSSGSVAAGMAPLGLTTRPTDLSMKQAAAAVGQVHLMHQWGRSFARYGRPVGQVLLTAGDAGQRDRARNAQRTIDRLRMLGVIPIVNENDTVATTGVNFGDNDRLAAIVSHLVSADALVLLSDVDGLFDKNPADPTARFISEVRDGNDLKGVLAGDGGKVGTGGMASKVSAARLASRSGVPVLLTSAANIGPALEHAQVGTVFHPKENRLSAWKFWALYAADTAGKIRLDQGATEAVTSGGKSLLAVGITEVIGDFRAGEIVEILGPNGEIIGRGEVNYDSETLMPMLGMKTQELPDDMQRPVVHADYLSNYASRA

SEQ ID NO: 1688 - protein, 255 aa, Thermosynechococcus elongatus
MSSSQLIGKVYLVGAGPGDAGLLTVRAKNLLEWADVVLYDALISPEILNLINPKAEKIHVGKRRGNHTLSQPEICRLLIELAQRHAVIVRLKGGDPFVFGRGGEECLALIEAGITVEVVPGITSGVAAPAYAHIPLTHRDFSSSVVFVTGHEAAGRYQPRVNWPALATAVDTIVIYMGLHHLGEIVPQLLAGGRSPQTPLAFIESGTTPQQRVVVTTLERAIATYDEAQIQTPALIVIGEVIHLRSQLGGSLHQA

SEQ ID NO: 1689 - protein, 187 aa, Phelipanche arenaria
FGHRSKEWNPKMAPYISAERKHMHIINLTKTARFLYEACNLVFYAASRGKQFLIVGTKRSTVNLVEQAAKKAGCHFVNTKWTGGMLTNWSITKARLQKFKDLIIEQEAGRIDCLSKKDAAVVKRQLSHFQKNLGGIRNMSELPDIVIILCQNEEYKALQECITLGIPTISLIDTNSDPDLADISIPA

SEQ ID NO: 1690 - protein, 75 aa, Triticum aestivum
  misc_feature (45)..(45): Xaa can be any naturally occurring amino acid
  misc_feature (51)..(51): Xaa can be any naturally occurring amino acid
  misc_feature (57)..(57): Xaa can be any naturally occurring amino acid
  misc_feature (63)..(63): Xaa can be any naturally occurring amino acid
MGRRPARCYRQIKNKPYPKSRYCRGVPDPKIRIYDVGMKRKGVDXFPYCVXLVSWGXGEFSIXGLQGARIACNNT

SEQ ID NO: 1691 - protein, 187 aa, Phelipanche arenaria
FGHRSKEWNPKMAPYISAERKHMHIINLTKTARFLYEACNLVFYAASRGKQFLIVGTKRSTVNLVEQAAKKAGCHFVNKKWTGGMLTNWSITKARLQKFKDLIIEQEAGRIDCLSKKDAAVVKRQLSHFQKNLGGIRNMSELPDIVIILCQNEEYKALQECITLGIPTISLIDTNSDPDLADISIPA

SEQ ID NO: 1692 - protein, 466 aa, Vibrio fischeri
MTYAPVTDVLSGKLAVDSEVTVRGWIRSRRDSKAGISFLAVYDGSCFDPIQAVVPNDLNNYNDEVLKLTTGCSVEVTGTIVASPAKGQDFELAATEVKVVGWVEDAETYPMAKTRHSIEYLREVAHLRPRTNVIGAVARVRNCLSQAIHRFYHEQGYFWMSAPLITASDAEGAGEMFRVSTLDHANLPLDDKGNVDYDKDFFGKETFLTVSGQLNAETYACALSKVYTFGPTFRAENSHTSRHLAEFWMVEPEVAFATLDDVAKLAEDMLKYVFEAVLAERRDDLEFFASRIDKQAITRLEQFVSSDFAQVDYTDAIQILKDSGRDFEFDVEWGIDMSSEHERYLAEEHFKAPVIVKNYPKDIKAFYMRQNDDGKTVAAMDVLAPGIGEIIGGSQREERLDILDARMIEMGIDPEHMSWYRDLRRYGTVPHAGFGLGFERLVSYVTGMGNVRDVIPFPRTPRSANF

SEQ ID NO: 1693 - protein, 1148 aa, Corynebacterium efficiens
MAKKKASATAHDTDVSPSAVLAADFDRSQLGEKTRVHQLAKQLGLTSKDLVVALDSIGLVKVAQSTLSREEATRLLDLLAKPVEEAPAEVVPDVEPVEKIRRRVEKNVANEIQQIQEKVERELADVVEDTPEDAPEDTPEQAPADTDAADPSEDEEIRRRVEKNVANEIQQIENRVERELAEVVARSQDEQQSDEPVDLMAAAQAEAHAELLEDIIPEITPPPTEAPVYAPIFVAPAIIPTEDLNDTDDPDAQERVARKRRGRRGTGRGKGTGSASGSDVEAVQQKAEDEASTSTVDTPEPEAVDEPVGIKGSTRLEAQRRRRTEMREEGRNKKRHVVSTREFIERRESMERRMIVRERQRTDGTGLVTQVGVLEDDLLVEQFVTSDSQSSMVGNIYLGRVQNVLPSMEAAFIDIGKGRNGVLYAGEVDWKAAGLGGRGRRIEQALKSGQKVLVQVTKDPVGHKGARLTTQISLAGRYLVYVPGGRSAGISRKLPGPERKRLKEILGRVVPPQGGTIIRTAAEGVSEENIAADVNRLHTLWEQIQERTKQEKKSRNTRPVTMYEEPDMLVKVIRDLFNEDFTSLIVDGDRAWNTVRAYIQSVAPDLVSRVEHFDRADYDGKDAFEAFGLNTQLEEAMSRKVNLPSGGSLIIDKTEAMTVIDINTGRYVGKGVGNLEETVTLNNIEAAEEIVRQLRLRDIGGMIVIDFIDMVLPENRDLVLRRLNEALENDRTRHQVSEVTSLGLVQMTRKRIGAGLLETFSSECEHCAGRGLVIHPDPVDNVDERVEAKAEERARRHKNQQEDSRPQQPVRDPARHPMVVAMQDLVEDEDHDLDKEFEDLAASVIITDDAEDTADTAGTVDTADDTEPEITADEVISTVEPEEGPRRRARRRRGRQQETPETPVEPEATGDTTADDIAAIAAAAVDIADAEDPDEPSGANYVSDAAGAATSYEQALAEFEASPRRRRATRGNSRSDHAPKPEDFKSEPARREVEPIPVEEIGEAEEKPRRRSRGRGRSQRPAPVVETTVETAVEDIPEETPRRNRPSEVAASAPSRPGRGRRRAVRRSSGHIETLDDATPTPITPSPADKAGDGEREASPSKGRRRRRRAIRVSGKALSQSTAEKQPEPAAPAGSGRRRRGTRKPQRG

SEQ ID NO: 1694 - protein, 159 aa, Phelipanche arenaria
PKMAPYISAERKHMHIINLTKTARFLYEACNLVFYAASRGKQFLIVGTKRSTVNLVEQAAKKAGCHFVNKKWTGGMLTNWSITKARLQKFKDLIIEQEAGRIDCLPKKDAAVVKRQLSHFQKNFGGIRNMSELPDIVIILCQNEEYKALQECITLGIPT

SEQ ID NO: 1695 - protein, 432 aa, Corynebacterium melassecola
MSSTTLTDDQIRDNERTEVLAKATAAKNIVPDIAVLGTGPKNAILRAAADELVARSAEIIEANASDIEAGRANGMEESMIDRLALDESRIEGIAGGLRQVAGLTDPVGEVLRGHVMENGIQMKQVRVPLGVMGMVYEARPNVTVDAFALALKSGNVAFVRGSSTAVHSNTKLVEILQDVLERFELPRETVQLLPCQTRGSVQDLITARGLVDVVIPRGGAGLINAVVTGATVPTIETGTGNCHFYIDAEAKLGQAIAMVINGKTRRCSVCNATETALLDAALSDSDKLAVVQALQEAGVTIHGRVAELEAFGATDVVEATETDWDSEYLSFDIAVAVVDGVDGALAHIAKYSTKHTEAIATQNIETAQRFADRVDAAAVMINASTAYTDGEQYGMGAEIGISTQKLHARGPMALPELTSTKWILQGTGQIRP

SEQ ID NO: 1696 - protein, 165 aa, Ralstonia solanacearum
MSDIYAFEADSLAGQRVPLSQYRGKVLLIVNTASQCGFTPQYAGLEAVYKRLNEKGLEVLGFPCNQFGKQEPGGAEEIGAFCEKNYGVSFPMFGKIEVNGSNAHPLYKWLTSEKPGVLGTEAIKWNFTKFLLRRDGTVYKRYAPLTKPEEMLGDIETLLAEPDPL

SEQ ID NO: 1697 - protein, 113 aa, Elymus strictus
MTEKKNRREKKNPREAKVTFEGVVTEALPNGMFRVRLENDTIILGYISGKIRSSSIRILMGDRVKIEVSRYDSSKGRIIYRLPHKDSKRIEDSKDSEGLKDSEDLKDTKDSKD

SEQ ID NO: 1698 - protein, 211 aa, Carica papaya
MSYDYLFKYIIIGDTGVGKSCLLLQFTDKRFQPVHDLTIGVEFGARMVAIDGRPIKLQIRDTAGQESFRSITRSYYRGAAGALLVYDITRRETFNHLASWLEDARQHANPNMSIMLIGNKSDLSHRRAVSKEEGEQFAKEHGLLFLEASARTAQNVEEAFIRTAAKILQNIQEGVIDVSNESSGIKFGYGRPQGTAGARDGAVAQRSGCCG

SEQ ID NO: 1699 - protein, 313 aa, Corynebacterium efficiens
MSEEQSKIHDVAIIGSGPAGYTAAIYAARADLKPIMFEGYEYGGSLMTTTDVENFPGFQDGIMGPELMENMRAQAERFGTDLRMELVDRVDLTGDIKKIWVGDDEYQARAVILSMGSAPRYLGIPGEKELLGRGVSACATCDGFFFRDQDIAVIGGGDSAMEEATFLTKFARSVTIVHRREEFRASAIMLERAQKNEKIRFVTNKTVEEVIENDGKVAGLKLKDTVTGELSDLDVTAMFVAIGHDPRSEMLVGQVELDSSNYVVAEHPSTRTNVPGVFAAGDLVDSHYQQAITAAGSGCRAAIDAENYLANQI

SEQ ID NO: 1700 - protein, 306 aa, Unknown
  Vibrio sp. Ex25
MRYFPLFLDLINKPVLVVGGGEVASRKVEALLKAGADVTIVSPTLVDFLSKLAAEHQVRWVQRFYSSDIVTKSFVQVWATTDNPELNHQVYKDAKELGILVNVVDDKPYCDFITPSMINRGRIQIAISSGGASPVLIRNIREKLESILPQNMGLMADFANSKRNSIKEALPSVDLRRKFWEQFFSNPEVENARDNRELETIYQATMATPLDEKGSCTWIQVGKDVEMLPIKAVRYMQQAELALYSTRCEANVLELIRRDAEREAFSSAAELSDMLTKAKSEKLRVCVFIPKGTSEFLLLQGQDLVI

SEQ ID NO: 1701 - protein, 81 aa, Glycine max
  misc_feature (10)..(10): Xaa can be any naturally occurring amino acid
  misc_feature (14)..(14): Xaa can be any naturally occurring amino acid
  misc_feature (17)..(17): Xaa can be any naturally occurring amino acid
  misc_feature (22)..(23): Xaa can be any naturally occurring amino acid
  misc_feature (27)..(27): Xaa can be any naturally occurring amino acid
  misc_feature (31)..(31): Xaa can be any naturally occurring amino acid
  misc_feature (37)..(37): Xaa can be any naturally occurring amino acid
  misc_feature (51)..(51): Xaa can be any naturally occurring amino acid
  misc_feature (63)..(65): Xaa can be any naturally occurring amino acid
  misc_feature (70)..(70): Xaa can be any naturally occurring amino acid
  misc_feature (76)..(76): Xaa can be any naturally occurring amino acid
IPACRGAAIXRRPXRCXRRIKXXPYPXSRFXRGVPDXKIRIHDVCMKKKGXDEFPVCVHLVTXXXENVSXEALEAXRIVLQ

SEQ ID NO: 1702 - protein, 719 aa, Xylella fastidiosa
MQTLSIVDPFIKHHPKETLVAKITKTFQYGKHTVTLETGEVARQASGAVIVKMDDTVLLVTVVAAKTAREGQDFFPLTVDYQEKFYAGGRIPGSFFKREGRATEKETLISRLIDRPIRPLFPEDYKNEVQIIAMVMSLDPEIDGDIPAMIGASAALSLAGIPFKGPIGAAKVGYNDGQYILNPTVSELKKSQLELVVAGTANAVLMVESEAALLSEEVMLGAVIFGHREMQKVIQVIDSLTAEACTQPSDWVPPAKNDALVIALKKVIGGRLSDAFHIRDKLQRRDAIAAVKDDVIQQLAGRLEVEGWNLAELLKEFGELEYRTMRDALLDTKVRIDGRSLEAVRPITVKVGVLPRVHGSGLFTRGETQAIVVTTLGTARDGQVIDAVTGEYKENFLFHYNFPPYSVGECGRFGVPKRREIGHGRLARRGVLAVMPSLDEFPYTIRVVSEITESNGSSSMASVCGSSLALMDAGVPVKAPVAGIAMGLVKEGERFVVLSDILGDEDHLGDMDFKVAGTSEGVSALQMDIKIEGITEEIMRQALQQAKVGRLHILGEMDKALAAPRAELSDYAPRLLTIKIHPDKIRDVIGKGGSTIQAITKETGTQIDIQDDGTIVIASVNNAAAREAKRRIEQITSDVEPGRIYEGKVAKIMDFGAFVTILPGKDGLVHVSQISSERVERVGDKLKEGDVVRVKVLEVDKQGRIRLSIKAVEEEVASI

SEQ ID NO: 1703 - protein, 324 aa, Agrobacterium tumefaciens
MSARHTKVLIIGSGPAGYTAAIYAARAMLKPVLIAGMEQGGQLMITTDVENYPGFADPIQGPWLMDQMLKQATHVGAEIVSDLVTEVETNVRPFVVRTDSGQVWTADTLIIATGAKAKWLGIESEQHFQGFGVSACATCDGFFYRNKDVIVVGGGNSAVEEALYLAHIAKSVTVVHRRDSFRSEKILQERLFAKENVKILWNTEIAEITGAPAKPPMPPSVSGVRLRDTKTGAISDTPIDGVFVAIGHAPAVELFKGKVKLKDNGYMWTAPDSTATDVEGIFAAGDVTDDIYRQAITAAGMGCMAALEAERYLTAQQPLAVAAE

SEQ ID NO: 1704 - protein, 270 aa, Oryza sativa
MAAAGASALRPHLALLPAGGGGGGGGGTRSYALQALSFVSPLLPHCGRRRRCVLRSKASSSPSPPPSPGKEAVAVPTAESCVNLGLELFSKGRVKDALEQFENALELNPNPVEAQAALYNKACCHAFRASPEFKELQEEALRGGEDIGSGFRRDLKLISEVQAPFRGVRRFFYVALTAAAGISTFFTIPRLILAVQGGDGAPDLLETVGNAAINIGGSKASITRAMQRAERYRTELLKRGVLLIPVIFGASQKAQRHAKLERHIAGTSTT

SEQ ID NO: 1705 - protein, 554 aa, Hypocrea jecorina
MAPTNTLPAWSELQAHRDDIAKNFVLKEAFASDADRFNKFSRTFKSDGVSADILFDFSKNFLTNETLDLLVKLADEAGVERKRDAMFRGDKINFTENRAVYHTALRNVGGWEMKVEGQDVMNGPNGVNSVLQHMKEFSEQVRSGEWVGYTGKKLTNIVNVGIGGSDLGPVMVTEALKHYGAPDMTLHFVSNIDGTHMAEALKASDPETTLFLIASKTFTTAETITNANTAKAWFIEKTGGKGDVAKHFVALSTNEEEVTKFGIDKANMFGFESWVGGRYSVWSAIGLSVALYVGYDNFHKFLAGAHAMDKHFRETPLRDNIPVIGGLLGVWYADFFQAQTRLVAPSFDQYLHRFAAYLQQLSMESNGKAITSDGSSAKYTTGSILFGEPCTNAQHSFFQLVHQGTKLIPADFILAAKSHNPIHDNLHQKMLASNYFAQAEALMVGKTDDQLRAEGTPEELIPHKRFLGNRPTTSILVGDVIGPAELGALIAYYEHLTFVEGAVWDINSFDQWGVELGKVLAKKILKELDEPGNGEGHDASTGGLIGAFKSFAKI

SEQ ID NO: 1706 - protein, 299 aa, Campylobacter jejuni
MKVYEKVSELIGNTPIIHLKKFGINVFAKCEFLNPSHSIKDRAAFEMIKDALDSKKINQDTTIVEATSGNTGISLAMICADLGLKFIAVMPESMSLERRKMITLFGARLELTPANLGMKGAVDKANEILLNTPNSFMVSQFENISNKNAHRKNTALEILRDLDNELDIFVAGFGTGGTISGVGEILKEKLEKVHIVGVEPLNSPLLSKGEAGSHKIQGIGANFIPAILNKEVIDEVITVSNEDAINTAKELAKSGLMVGISSGANVFAASMLAKKFPDKRILTMLNDTAERYLSTDLFA

SEQ ID NO: 1707 - protein, 138 aa, Lactobacillus plantarum
TNEMLKANQLSFPGQRVAISGAGNVAIYAIQKVEELGGKVITCSDSNGYVIDENGIDFKIVKQIKEVERGRIKDYADRVASASYYEGSVWDAQVAYDIALPCATQNEISGDQAKNLIANGAKVVAEGANMPSSPEAIA

SEQ ID NO: 1708 - protein, 202 aa, Proboscidea louisianica
GVHFGHGTRKWNPKMAPYISAKRKGIHITNLTRTARFLSEACDLVFDAASRGKQFLIVGTKNKAADSVAWAAIKARCHCVNKKWLGGMLTNWSTTETRLHKFRDLRMEQKTGRLNRLPKRDAAMVKRQLSRLQTYLGGIKYMTGVPDIVIIVDQHEEYTALRECITLGIPTICLIDTNCDPDVADISIPANDDAISSIRLIL

SEQ ID NO: 1709 - protein, 375 aa, Corynebacterium diphtheriae
MARDYYAILGVERDATDNEIKKAYRKLARKYHPDVNDTEEAAEKFSKISIAQEVLLDAEKRRIVDMGGDPMAQGGGDAGYGAGGGLGDIFEAFFGGGGGSRGPRSRVQPGSDALLRTTLTLEEAYLGTKKPITIDTAILCDRCEGTGSKSKSKPNVCSTCNGSGEIQQMQRSFLGNVMTSSPCPTCRGTGEVIPDPCDKCGGDGRVRTQRDLIVNVPAGIADGMRIRMAGQGEVGPGGGPAGDLYIEVMMQQHPVFQREGNDLHMSVHVPMVDAALGATTSVESLSGDAIDFEIPAGVQPAETIVIEGKGMPQLRGEGFGNMIAHVDVSIPTQLDEKSKELLNKLRDHRSDESSVRTADDSDDSLFGRLRNRFRR

SEQ ID NO: 1710 - protein, 202 aa, Sesamum indicum
GVHFGHGTRKWNPKMAPYISAKRKGIHITNLTRTARFLSEACDLVFDAASRGKQFLIVGTKNKVADSVARAAIKARCHCVNKKWLGGMLTNWSTTETRLHKFRDLRMEQKTGRLNRLPKRDAAVVKRQLSRLQTYLGGIKYMTGLPDIVIIVDQHEEYTALRECITLGIPTICLIDTNCDPDLADISIPANDDAISSIRLIL

SEQ ID NO: 1711 - protein, 1034 aa, Flaveria anomala
MERARRLAMLGRLVSQTKHNPSISSPALCSPSRYVSSLSPYVCGGTNVRSDRNLNGFGSQVRTISVEALKPSDTFPRRHNSATPEEQTKMAEFVGFSNLDSLIDATVPKSIRLDSMKYSKFDEGLTESQMIAHMQDLASKNKIFKSFIGMGYYNTSVPTVILRNIMENPGWYTQYTPYQAEIAQGRLESLLNFQTMITDLTGLPMSNASLLDEGTAAAEAMAMCNNIQKGKKKTFIIASNCHPQTIDICKTRADGFDLKVVTSDLKDFDYSSGDVCGVLVQYPGTEGELLDYSEFIKNAHANGVKVVMASDLLALTILKPPGELGADIVVGSAQRFGVPMGYGGPHAAFLATSQEYKRMMPGRIIGVSVDSSGKPALRMAMQTREQHIRRDKATSNICTAQALLANMAAMYGVYHGPEGLKTIAKRVHGLAGTFAAGLKKLGTVQVQDLPFFDTVKVTCADSKAIAEEACKHKMNLRIVDKNTITVAFDETTTIEDVDTLFKVFALGKPVPFTAASIAPEVQDAIPSGLVRETPYLTHPIFNMYHTEHELLRYISKLQSKDLSLCHSMIPLGSCTMKLNATTEMMPVTWPAFADIHPFAPTEQAQGYQEMFKNLGDLLCTITGFDSFSLQPNAGAAGEYAGLMVIRAYHMARGDHHRNVCIIPVSAHGTNPASAAMCGMKIITVGTDSKGNINIEELRKAAEANKENLSALMVTYPSTHGVYEEGIDEICKIIHDNGGQVYMDGANMNAQVGLTSPGWIGADVCHLNLHKTFCIPHGGGGPGMGPIGVKKHLAPYLPSHPVVPTGGIPAPEESQPLGTIAAAPWGSALILPISYTYIAMMGSQGITNASKIAILNANYMAKRLENHYPILFRGVNGTVAHEFIVDLRPLKTTAGIEPEDVAKRLIDYGFHGPTMSWPVPGTLMIEPTESESKAELDRFCDALISIRQEIAEIEKGNVDFNNNVIKGAPHPPQLLMADKWTKPYSREYAAYPAPWLRAAKFWPTTCRVDNVYGDRNLICTLQPPQEYEEKAEATA

SEQ ID NO: 1712 - protein, 394 aa, Oryza sativa
MAAATTSRRGPGAMDDENLTFETSPGVEVISSFDQMGIREDLLRGIYAYGFEKPSAIQQRAVLPIISGRDVIAQAQSGTGKTSMISLSVCQIVNTAVREVQALILSPTRELAAQTERVMLAIGDYINIQVHACIGGKSIGEDIRKLEHGVHVVSGTPGRVCDMIKRRTLRTRAIKLLILDEADEMLGRGFKDQIYDVYRYLPPELQVCLISATLPHEILEMTSKFMTDPVRILVKRDELTLEGIKQFFVAVEKEEWKFDTLCDLYDTLTITQAVIFCNTKRKVDWLTERMRSNNFTVSAMHGDMPQKERDAIMGEFRSGATRVLITTDVSLVINYDLPNNRELYIHRIGRSGRFGRKGVAINFVKKEDIRILRDIEQYYSTQIDEMPMNVADLI

SEQ ID NO: 1713 - protein, 1034 aa, Flaveria trinervia
MERARRLAMLGRLVSQTKHNPSISSSALCSPSRYVSSLSPYVCSGTNVRSDRNLNGFGSQVRTISVEALKPSDTFPRRHNSATPEEQTKMAEFVGFSNLDSLIDATVPKAIRLDSMKYSKFDEGLTESQMIAHMQDLASKNKIFKSFIGMGYYNTSVPTVILRNIMENPGWYTQYTPYQAEIAQGRLESLLNFQTMITDLTGLPMSNASLLDEGTAAAEAMAMCNNIQKGKKKTFIIASNCHPQTIDICKTRADGFDLKVVTSDLKDFDYSSGDVCGVLVQYPGTEGELLDYSEFIKNAHANGVKVVMASDLLALTILKPPGELGADIVVGSAQRFGVPMGYGGPHAAFLATSQEYKRMMPGRIIGVSVDSSGKPALRMAMQTREQHIRRDKATSNICTAQALLANMAAMYGVYHGPEGLKTIAKRVHGLAGTFAAGLKKLGTVQVQDLPFFDTVKVTCADSKAIAEEAYKHKMNLRIVDKNTITVAFDETTTIEDVDTLFKVFALGKPVTFTAASIAPEVQDAIPSGLVRETPYLTHPIFNMYHTEHELLRYISKLQSKDLSLCHSMIPLGSCTMKLNATTEMMPVTWPAFADIHPFAPTEQAQGYQEMFKNLGDLLCTITGFDSFSLQPNAGAAGEYAGLMVIQAYHMARGDHHRKVCIIPVSAHGTNPASAAMCGMKIITVGTDSKGNINIEELRKAAEANKENLSALMVTYPSTHGVYEEGIDEICKIIHDNGGQVYMDGANMNAQVGLTSPGWIGADVCHLNLHKTFCIPHGGGGPGMGPIGVKKHLAPYLPSHPVVPTGGIPAPEQSQPLGTIAAAPWGSALILPISYTYIAMMGSQGITNASKIAILNANYMAKRLENHYPILFRGVNGTVAHEFIVDLRPLKTTAGIEPEDVAKRLIDYGFHGPTMSWPVPGTLMIEPTESESKAELDRFCDALISIRQEIAEIEKGTVDFNNNVIKGAPHPPQLLMADKWTKPYSREYAAYPAPWLRAAKFWPTTCRVDNVYGDRNLICTLQPPQEYEEKAEATA

SEQ ID NO: 1714 - protein, 983 aa, Unknown
  Nostoc sp. PCC 7120
MVSYASIPQSSDEAHSTVGASLQLDERKQDLNNFIQRHIGPSSADIQQMLDVLGFSSLDDLIEKTVPSAIRLHEQLQLPEAQTEYAALAKLKQIASKNQVFRSYIGMGYYDTITPSVIGRNILENPGWYTAYTPYQPEIAQGRLEALLNFQTMIIDLTGLEIANASLLDEATAAAEAMSMSYGVSKNKANAYFVSHDCHPQIIDVLQTRAKPLGIEIIIGDHQTFDFDKPIFGAVLQYPASDGTIYDYRAFIETSHAQGALVTVAADPLSLTLLTPPGEFGADIAVGSTQRFGIPLGFGGPHAAYFATKEEYKRQVPGRIVGVSKDVHGKTALRLALQTREQHIRREKATSNICTAQVLLAVMASMYAVYHGPEGLKQIAERIHHLTLVLGVWLQRLGYTITSQSFFDTLQIKLGEKPLQEILEAAEAYRINLRIVDTSTVGISLDETTTLEDVKDICRIFAGTDELPFVLNVQEFDWIIQQSSLKDEPFSRQSSYLTHPVFNRYHSETELLRYLHRLETKDLSLTTSMIPLGSCTMKLNATSEMIPVTWEEFGRIHPFAPLTQTRGYQILFQQLEAWLGEITGFAGVSLQPNAGSQGEYTGLLVIRQYHQSRGETHRNVCLIPNSAHGTNPASAVMCGMKVVAVACDAGGNIDIDDLKAKAEKHSHELAALMVTYPSTHGVFEAGIQEICAVIHSHGGQVYMDGANMNAQVGICRPGDIGADVCHLNLHKTFCIPHGGGGPGMGPIGVASHLVPFLPGHPVLESGKNPQNIGAVAAAPWGSASILVISWMYIVMMGADGLTQATKVAILNANYIAKKLAAYYPVLYKGQNGLVAHECILDLRALKKSANIEIDDIAKRLIDYGFHAPTVSWPVAGTIMVEPTESESQAELDRFCEALIAIRQEIADIEAGKVDIQDNSLKNAPHTVESLIVGEWPHPYSREQAAYPAPWTREHKFWPSVGRIDAAFGDRNFVCSCLPMDAYN

SEQ ID NO: 1715 - protein, 202 aa, Unknown
  Aptosimum sp. KES PCR3
GVHFGHGTRKWNPKMAPYISAKRKGIHITNLTRTARFLSEACDLVFDAASRGKQFLIVGTKNKAADSVAWAAIKARCHCVNKKWLGGMLTNWSTTETRLHKFRDLRMEQKRGRLNRLPKRDAAMVKRQLFRLQTYLGGIKYMTGLPDIVIIVDQHEEYTALRECITLGIPTICLIDTNCDPDLADISIPANDDAISSIRLIL

SEQ ID NO: 1716 - protein, 374 aa, Thiobacillus denitrificans
MSTSVVRHARRIVVKVGSSLVTADGRGLDHAALSRWAEQIAALAEQGKEVVLVSSGAIAEGIARLGWKKRPKAVNELQAAAAVGQMGLVQAYESIFRTHKLHAAQVLLTHEDLADRTRYLNARSTLRTLLELRVVPIINENDTVATDEIRLGDNDTLGALVTNLIEADCLVILTDQAGLYTADPRKVADASLVMEAHAGDPELERMAGGAGSSVGTGGMLTKILAAKRAARSGAHTVICSGREPRVLLRLAEGEPIGSQLVARQAPLAARRQWLADHLQLRGGLVLDDGAVRALQEDGKSLLPVGVRGVTGEFERGEVVAVVDASGREIARGLTNYSAAEARRIAGKPSTAIEAELGYMDEPELIHRDNLVVLA

SEQ ID NO: 1717 - protein, 86 aa, Triticum aestivum
SANPPLPAEDPNLTAAMGDIPFPGLPQAPPVVAPPEAASSSGAGGWFGGLFGKKEEEKKPSAGGGKSEILESFDTPSSPIPSFEYK

SEQ ID NO: 1718 - protein, 271 aa, Unknown
  Synechococcus sp. RS9916
MTDSSADLVASEGTVAGTVYLVGAGPGDPELLTRKAHRLLGCCDALVYDSLVPKEVLDLVPEGCERHFVGKRRGHHSVPQPSTNAVLVELAQRHACVVRLKGGDPFLFGRGGEEAAHLTARGVAVEVVPGVTSGIAAPAYAGIPVTHRRAGSSVTFVTGHEEIDKRRPSVNWRALATASDGLVIYMGLHNLPRIADELMAGGLAAETPVALIQQGTVEGQRCLTSTLTSVAEEARAQAFASPSIVVVGEVVNQRITACSPQPAPVTMPIPF

SEQ ID NO: 1719 - protein, 369 aa, Anabaena variabilis
MTKTIVVKIGTSSLTQPETGQLALSTIATLAETLSYLRQQGNQVILVSSGAVGVGCARLGLTERPKAIALKQAVAAVGQGRLMRVYDDLFTTLQQPIAQVLLTRSDLVQRSRYLNVYNTFRELLALGVIPVVNENDTVAVDELKFGDNDTLSALVASLVEADWLFLLTDVDRLYSADPRSVPDARPISLVTSIKELADLQVQTGSQGSQWGTGGMMTKISAARIAIAAGVRTVITQGRYPRNIEKIIQGELIGTHFQPQPEPTSARKRWIAYGLVPTGKLYLDSGAIAAIVKAGKSLLPAGVKTVAGEFEPQDAVQLLDPQGNEIARGLVNYSSKDLQQICGRHSKEISTILGYVGAETVIHRDNLVLT

SEQ ID NO: 1720 - protein, 343 aa, Solanum chmielewskii
MEMDLPVSAIGFEGFEKRLEISFVEPGLFADPNGKGLRSLTKAQLDEILGPAECTIVDNLSNDYVDSYVLSESSLFVYSYKIIIKTCGTTKLLLAIPPILRLAETLSLKVQDVRYTRGSFIFPGAQSFPHRHFSEEVAVLDGYFGKLAAGSKAVIMGNPDKTQKWHVYSASAGTVQCNDPVYTLEMCMTGLNREKASVFYKTEESSAAHMTVRSGIRKILPKSEICDFEFEPCGYSMNSIEGAAVSTIHITPEDGFSYASFESVGYDPKTTELGPLVERVLACFEPAEFSIALHADVATKLLERACSVDVKGYSLAEWSPEEFGKGGSIVYQKFTRTPYCESP

SEQ ID NO: 1721 - protein, 228 aa, Medicago sativa
MGTHHIVLVVGLICAVFSSVGAQQAPSTSPNSSPAPPTPPANTPPTTPQASPPPVQSSPPPVQSSPPPVQSSPPPAQSTPPPVQSSPPPVSAPPPVQQSPPPTPLTPPPVQSTPPPASPPPASPPPFSPPPATPPPATPPPATPPPALTPTPLSSPPATTPAPAPAKLKSKAPTLAPVLSPSDAPAPGLSSLSPSISPSGTDDSGAEKLWSHKMVGLVFGCAFLYLLF

SEQ ID NO: 1722 - protein, 217 aa, Pisum sativum
MDKKPCNSSQDPEVRKGPWTMEEDLILINYIANHGEGVWNSLAKAAGLKRTGKSCRLRWLNYLRPDVRRGNITPEEQLLIMELHSKWGNRWSKIAKHLPGRTDNEIKNFWRTRIQKHIKQVDNPNQQNFQQKMSLEINDHHHHHPHQPSSSQVSNLVEPMETYSPTSYQGTLEPFPTQFPTINNDHHQNSNCCANDNNNNNYWSMEDIWSMQLLNGD

SEQ ID NO: 1723 - protein, 839 aa, Zea mays
MLTLSGRTFLDGRHPQQGYVLTASSTQKYFGCPTSVRRGDGICPPQTIDVCHTRSDGFGIRVVVADAKDLDYGGGDVCGVLVQYPGTEGEVLDYAEFVRDAHAHGVKVVMATDLLALTALRPPGEIGADIAVGSAQRFGVPMGYGGPHAAFLATSQEYKRLMPGRIIGVSVDSTGRPALRMAMQTREQHIRRDKATSNICTAQALLANMAAMYAVYHGPAGLKAIADRVHGLAGTFAHGLKKLGTVTVQDLPFFDTVRVTCSDARAIAKEAVKNEMNLRVVDANTITVAFDETSTLEDVDKLFKVFNNGKSASFTAESIAPEVSSSIPSSLARESPYLTHPVFNMYHTEHELLRYLHKLQSKDLSLCHSMIPLGSCTMKLNATVEMIPVTFPNFANLHPFAPTDQAAGYHEMFDDLGNLLCTITGFDSFSLQPNAGAAGEYAGLMVIRAYHNSRGDHHRDVCIIPVSAHGTNPASAAMVGMKIVAVGTDAKGNINIEELRKAAEANKDNLAALMVTYPSTHGVYEEGIDEICKIIHENGGQVYMDGANMNAQVGLTSPGFIGADVCHLNLHKTFCIPHGGGGPGMGPIGVKKHLAPFLPSHPVIPTGGFPLPEKTDPLGTISAAPWGSALILPISYTYIAMMGSQGLTDASKIAILNANYMAKRLEKHYPVLFRGVNGTVAHEFIIDLRAFKTTAGIEPEDVAKRLMDYGFHAPTMSWPVPGTLMIEPTESESKAELDRFCDALISIREEIAEIESGKADVLNNVLKGAPHPPQLLMGDTWSKPYSREYAAFPAAWLRGAKFWPTTGRVDNVYGDRNLICTLQQATQVAEEAAAATATA

SEQ ID NO: 1724 - protein, 411 aa, Prochlorococcus marinus
MKCDPSIAKLINNELSRQETHLELIASENFASKAVMEAQGSVLTNKYAEGLPNKRYYGGCEYIDGIEQLAIDRAKNLFGANWANVQPHSGAQANFAVFLSLLKPGDTIMGMDLSHGGHLTHGSPVNVSGKWFKTCHYEVDKKTEMLDMDAIRKKAIENQPKLIICGFSAYPRKIDFKAFRSIADEVNAYLLADIAHIAGLVASGLHPSPIPYCDVVTTTTHKTLRGPRGGLILSKDEEIGKKLDKAVFPGTQGGPLEHVIAAKAVAFQEASAPEFKIYSQKVISNAQVLSNQLQKRGISIVSKGTDNHIVLLDLRSIGMTGKVADQLVSDIKITANKNTVPFDPESPFVTSGLRLGSAALTTRGFNEQAFEDVGNIIADRLLNPNDEDIKENSINKVSELCNKFPLYSENI

SEQ ID NO: 1725 - protein, 187 aa, Phelipanche coelestis
LGHHSKKWNPKMTPYISAERKHRHIINITKTARFLYEACNLVFYAASRGKQFLIVGTNKIRDDLVEQAAIKAQCHFVNKKWTSGTLTNWSITEARLQKFRNLIIEQKAGRLDCLPKKDAAVVKRQLSRFQKNLGGIKSMRGLPDIVIILHQNEEYKALQECINLGIPTISLIDTNSDPDLADISIPA

SEQ ID NO: 1726 - protein, 332 aa, Beta vulgaris
MAVEPLRVLVTGAAGQIGYALVPMIARGVMLGANQPVILHMLDIPPAAEALNGVKMELVDAAFPLLKGVVATTDVAEACKGVNVAVMVGGFPRKEGMERKDVMPKNVSIYKSQASALEQYAAPNCKVLVVANPANTNALILKEFAPSIPEKNITCLTRLDHNRALGQISERLNAQVSDVKNVIIWGNHSSSQYPDVNPCTVKTGSGEKAVRELVADDAWLNGEFITTVQQRGAAIIKARKLSSALSAASSACDHIRDWVLGTPEGTWVSMGVYSDGSYNVPAGIIYSFPVTCKDGEWKIVQGLPIDEVSRQKMDATGAELVEEKALAYSCLT

SEQ ID NO: 1727 - protein, 187 aa, Phelipanche coelestis
FGHHSKKWNPKMTPYISAERKHRHIINITKTARFLYEACNLVFYAASRGKQFLIVGTNKIRDDLVEQAAIKARCHFVNKKWTGGTLTNWSITEARLQKFRNLIIEQKAGRLDCLPKKDAAVVKRQLSRFQKNLGGIKYMRGLPDIVIILHQNEEYKALQECINLGIPTISLIDTNSDPDLADISIPA

SEQ ID NO: 1728 - protein, 187 aa, Phelipanche coelestis
FGHHSKKWNPKMTPYISAERKHRHIINITKTARFLYEACNLVFYAASRGKQFLIVGTNKIRDDLVEQAAIKAQCHFVNKKWTGGTLTNWSITEARLQKFRNLIIEQKAGRLDCPPKKDAAVVKRQLSRFQKNLGGIKYMRGLPDIVIILHQNEEYKALQECINLGIPTISLIDTNSDPDLADISIPA

SEQ ID NO: 1729 - protein, 96 aa, Raphanus sativus
ATYKVKFVTPEGEQEVECDDDVYVLDAAEEAGIDLPYSCRAGSCSSCAGKVVSGSVDQSDQSFLDDDQIAEGFVLTCAAYPTSDVTIETHREEDVV

SEQ ID NO: 1730 - protein, 178 aa, Mycoplasma hyopneumoniae
MINKHISQILYNRDQIKARIAEIGKWINETYKDSNEIVFIGVLKGSLIFLTELIQSVDVDSMVDFVIAKSYFGGSESTGELKVITDIDIQIQNKDVILIDDILDSGITLSKIRDHLKLKNPKSLRVITLFDKKVKRKYDIQADVSGFVVPDAFLVGYGLDYQDKYRNWPFVAIFDPNK

SEQ ID NO: 1731 - protein, 113 aa, Elymus tsukushiensis
MTEKKNRREKKNPREAKVTFEGLVTEALPNGMFRVRLENDTIILGYISGKIRSSSIRILMGDRVKIEVSRYDSSKGRISYRLPHKDSKRIEDSKDSEDLKDSEDLKDTKDSKD

SEQ ID NO: 1732 - protein, 96 aa, Raphanus sativus
AAYKVKFITPDEDKEVECDESEYVLDAAEESGIDLPYSCRAGACSSCAGKVVSGSVDQSDQSFLDDDQVADGFVLTCIARPTSDVVIRTHQEEEMV

SEQ ID NO: 1733 - protein, 197 aa, Zea mays
LERAVAAQPAHRYETAEEWLRVLEQADRQELSIRPKPLLERAGPGDPELLTLKAVRALREADVVLIDDLVNPAVLEHCIEVRVITVGKRGGCRSTPQDFIHRLMLRYARQGKCVVRLKGGDPCIFGRGGEEAMWLRERGVEVELVNGITAGLAGATNCAVPLTLRGVSRGVTLVTAHTQDDSSLNWRALAEGGTTLV

SEQ ID NO: 1734 - protein, 187 aa, Phelipanche coelestis
FGHHSKKWNPKMTPYISAERKHRHIINITKTARFLYEACNLVFYAASRGKQFLIVGTNKIRDDLVEQAAIKAQCHFVNKKWTGGTLTNWSITEARLQKFRNLIIEQKAGRLDCLPKKDAAVVKRQLSRFQKNLGGIKYMRGLPDIVIILHQNEEYKALQECINLGIPTISLIGTNSDPDLADISIPA

SEQ ID NO: 1735 - protein, 349 aa, Cryptococcus neoformans
MPHSHHSHSGQFCRHAKDNLEDVILEAIRQGFQSFGLSEHAPRWRVEDLFPEEADLCPSDLLSTYEDFLKTALILRSKYDSQISLLVSLETDYITPLDSEKLTSFLVEHTEIDYIVGSVHHVNGVSIDFDRPTWLRAVKLAKEGRIGKTMDPGPPPTLELGDPNDPELMTTYTPDLLSVQPFFEAYFDAQYDLIVKHQPEVLGHIDLCSLWIPNISLMEQEPVWQKVIRNVKAVIAYGGLFEANAAAIRKGWKTSYPCRDILQLIQELGGRVCLSDDSHGISYVGLNYLKMRDYLKGMGLERTWYLISSSRRQTGDYTVGERGRVAARPLDGWYDHPFWAKLSDAQRRK

SEQ ID NO: 1736 - protein, 448 aa, Lactococcus lactis
MSQATEYIKEVRANLAQRDGNQAEFLEAVDNFLATITPVFEAHPEYIEANILGQITEPERAFQFRVPWVDDAGKVQINRGFRVQFNSAIGPYKGGLRFHPSVNLSVVKFLGFEQIFKNSLTGLPIGGGKGGSDFNPKGKSDGEVMRFAQSFMTELQKHIGPDIDVPAGDIGVGGREIGYLFGQYKRLNGFSGGILTGKGLSYGGSLVRPEATGFGLLYYVDAMLKAHRDDLSGKKIKLSGAGNVAIYAIQKATELGAKIVTVSDSDGYIYDERGIDYKVVQQIKEVERGRISEYAKRVSTAEYSKGSVWEAPIDCDVALPCATQNEIDVDGAKLLISSGVQVVAEGANMPSTPEAIKAYRQAGLLYGPAKAANAGGVAVSALEMSQNSQRLAWSFADVDQRLQKIMQDIFQKSADAAKQYNLGDDYVAGANIAGFLKVADAMYAQGIV

SEQ ID NO: 1737 - protein, 113 aa, Thinopyrum intermedium
MTEKKNRREKRNPREAKVTFEGLVTEALPNGMFRVRLENDTIILGYISGKIRSSSIRILMGDRVKIEVSRYDSSKGRIIYRLPHKDSKRIEDSKDSEDLKDSEDLKDTKDSKD

SEQ ID NO: 1738 - protein, 300 aa, Zea mays
  misc_feature (40)..(40): Xaa can be any naturally occurring amino acid
  misc_feature (288)..(288): Xaa can be any naturally occurring amino acid
KLLLTIPRILELLEELSMPPAAVKYSRGTFIFPGAQPAPXRSFSEEVAALNRYFGGLKSGGNAYVIGDPARPGQKWHVFYATEYPEQPMVNLEMCMTGLDKKKASVFFKTNADGNTTCAKEMTKLSGISEIIPEMEICDFDFEPCGYSMNAIHGSAFSTIHVTPEDGFSYASYEVMGLDATALSYGDLVKRVLRCFGPSEFSVAVTIFGGRGHAGTWGKELGAEAYDCNNMVEQELPGGGILIYQSFCAAEDAVASSPKSVLRCFDGENAAPFAKDCKLANLVCLEEXDAIEEKDGVLDE

SEQ ID NO: 1739 - protein, 334 aa, Unknown
  Malus x domestica
MEEQAQHYTSCCSATMSNISSPHVMPCLTEQWGNLPFQVDDSEDMIVYNSLRDAFSLGWSPDHTFPFQVDDWEDMINNNSDALSLGWSPDHTLECIKPEQAYDLDHLFDQYHDQLPPDLFTQSQPHDFDVSINGNKPSQALVLPPDTDIPPLDHDDRDQNQVQVGDAVAEQEELNVNVPKLQKSGVARGRHYRGVRQRPWGKFAAEIRDPAKNGARVWLGTYETSEEAALAYDRAAFRIRGSKALLNFPHRIGLNEPPPVRVTGKRKEPDQEAAASSSTSSSSSATPTAATKRSKLDKSVSSSADHDHQANVCHTRQKNNTSYMLAIGEQLLVS

SEQ ID NO: 1740 - protein, 384 aa, Haloarcula marismortui
MSQDFYEILGVSRDASEDEIQEAYREKAREYHPDVSDDPDAEEKFKQAKKAKEVLTDEEKRQMYDQMGHERFEQAEKRGGAGGGGGRGGMGGDPFGGGAGGFDMQDIFDQFFGGGGRGGRGGSRRRQGQDLQTRLEIDLEEAYNGATKQLNVTRPEACDDCDGAGHPPGADSETCPECNGQGQTTQVQQTPMGRVQQRTTCRRCDGEGTLYDETCSTCRGNGVVQNDASLEVEIPSGIADGQTLRMEREGAPGENGGPNGDLLIEVQVRDHPDFERDGDSLQHQQAISFPQAVFGDTITVPTLDGEVEVDVPSGTQSGEVFRLEGKGMPRLRRRGHGDLYVQVQVVTPDSLNAEQKEALEQFAEAGGEEVDVDEGFFEKLKNSL

SEQ ID NO: 1741 - protein, 138 aa, Lactobacillus plantarum
TNEMLKANQLSFPGQRVAISGAGNVAIYAIQKVEELGGKVITCSDSNGYVIDENGIDFKIVKQIKEVERSRIKDYADRVASASYYEGSVWDAQVAYDIALPCATQNEISGDQAKNLIANGAKVVAEGANMPSSPEAIA

SEQ ID NO: 1742 - protein, 317 aa, Arabidopsis thaliana
MWPFWWKGASGFSARSTAEEVTHGIDGTGLTAIVTGASSGIGEETTRVLALRGVHVVMAVRNTDSGNQVRDKILKEIPQAKIDVMKLDLSSMASVRSFASEYQSLDLPLNLLINNAGIMACPFLLSSDNIELQFATNHLGHFLLTNLLLERMKKTASESNREGRIVIVSSEGHRFAYREGVQFDKINDEARYNTLQAYGQSKLGNILHATELARLFKEQGVNITANSLHPGSIMTNLLRYHSFINTIGNAVGKYVLKSIPQGAATTCYAALHPQAKGVSGEYLMDNNISDPNSQGKDKDLAKKLWEFSLRLTGEEES

SEQ ID NO: 1743 - protein, 463 aa, Unknown
  Acinetobacter sp. ADP1
MLDSAAPLKRAMSTRHLVMLSLGGAIGTGLFLGSGEVITQTGPIGAVIAYMLGGLIAYMVMLCLGELAVHMPVSGSFGAYAKKYIGPGTGYMISWVYWLTWTATLGTEFTAAALLMQEWFPHTSMWIWTIIFALTIFGLNLSSTHIFAESEFWLSLVKVLTVISFIILGLLAIFGIIHFEGHASAPLFSNLTSHGWFPQGLMPIFATMLIVNFAFSGTELIGVAAGETKDPSINVPKAINAAIWRLLIFFVGTIVVISALLPYDQTGLGGHNVSNSPFVTVFQYIGIPYADHIIRFVIITALLSAANSGLYAASRMMWSLSNQRQLPSVFSKLTASGTPIIALVVTMFGAIPGLLSEQFAPETIFKNLLGVAAFTMVIVWMSICLSQFNFRRHWYKQGYHAKDLKFAAPLFPILPILGFLFCLITGLSMAKDPEMLPGFIGCLIFVACCYLSHYIFYREKSKL

SEQ ID NO: 1744 - protein, 345 aa, Francisella tularensis
MKVITAEYIWADGSDPVPHLRSKARVLPFKEFETPDEFPEWSFDGSSTNQATGDNSDCILKPVNFVIDPLRDYGYLVLCEVYNPDGQTPHATNNRAKLRALLASADCQDMWAGFEQEYTMFKDGRPLGWPTTGFPGPQGPYYCSAGNSKAFGRDLVEAHMQACLEAGILFYGINAEVMPGQWEFQIGYRGVDGEDAGILNVADHTHLARWLLERLGEEYGIDISFDNKPIKGDWNGAGLHTNFSTSKTRNPQTGREAIKKICAALEKNHKKDILNYGHNLHERLTGKLETSDMNTFSVGDADRGCSIRIPRPVALKGYGYLEDRRPGANADPYVIAMALANAAIN

SEQ ID NO: 1745 - protein, 101 aa, Nicotiana tabacum
MASSVLSSAAVATRSNVAQANMVAPFTGLKSAASFPVSRKQNLDITSIASNGGRVQCMQVWPPINKKKYETLSYLPDLSQEQLLSEVEYLLKNGWVPCLEF

SEQ ID NO: 1746 - protein, 974 aa, Ralstonia metallidurans
MNAPLPMNAAAQGARPTLAELEARDAFAARHIGPDSAEQQHMLKVLGFESRAALIDAVVPAAIRRRDGMSLGEFTAPLTEEAALGRLRALAGKNRVLKSFIGQGYYNTLTPGVILRNIFENPAWYTAYTPYQPEISQGRLEAMLNFQQMITDLTGLDIANASMLDEGTAAAEAMTLLQRVNKHASNTFYVAEDVLPQTLEVVRTRALPLGIEVKVGPAADAAQAHAFGVLLQYPGVNGDVADYRAIAEAVHASGGRVVAAADLLALTLIAAPGEWGADVTVGNSQRFGVPLGFGGPHAGYMAVKDEFKRSMPGRLVGVTIDAQGNKAYRLALQTREQHIRREKATSNICTAQVLLAVMASMYAVYHGPQGLKRIAQRVHRLTATLAAGLKTLGHTPLNATFFDTLTLETGFNTDAFHASATARGINLRHVDATRIGISFDETASRDDVIALWEIFAHGKAVPDFDTIEASVQDGFPATLARQSAYLTHPVFNTHHAEHEMLRYLRALADKDLALDRTMIPLGSCTMKLNATSEMIPVTWPEFSNIHPFAPLDQTVGYREMIDQLEAMLCAATGYAAVSLQPNAGSQGEYAGLLIIHAYHASRGESHRDICLIPSSAHGTNPASAQMAGMKVVVVACDENGNVDLADLAKKAEQHSKNLAAIMITYPSTHGVFEQGVQQICDIVHKHGGQVYVDGANMNAMVGVAAPGQFGGDVSHLNLHKTFCIPHGGGGPGVGPVAVGAHLADFLPNQDSVGYRRDENGIGGVSAAPFGSASILPISWMYIAMMGSAGLTAATENAILTANYVARRLSPHFPVLYTGQHGLVAHECILDLRPLQKATGISNEDVAKRLMDYGFHAPTMSFPVPGTLMIEPTESEALHELDRFIDAMIAIRGEIARVEDGSFDREDNPLKHAPHTAAVVVSDKWNHKYTREEAAYPVASLRTQKYWPPVGRADNVYGDRNLFCSCVPLSEYAED

SEQ ID NO: 1747 - protein, 202 aa, Nemesia strumosa
GVHFGHGTRKWNPKMAPYISAKRKGIHITNLTRTARFLSEACDLVFDAASRGKQFLIVGTKNKAADSVAWAAIKARCHCVNKKWLGGMLTNWSTTETRLHKFRDLRMEQKTGRLNRLPKRDAAVVKRQLFRLQTYLGGIKYMTGLPDIVIIVDQHEEYTALRECITLGIPTICLIDTNCDPDLADISIPANDDAISSIRLIL

SEQ ID NO: 1748 - protein, 202 aa, Zaluzianskya katharinae
  misc_feature (36)..(36): Xaa can be any naturally occurring amino acid
GVHFGHGTRKWNPKMAPYISAKRKGIHITNLTRTAXFLSEACDLIFDAASRGKQFLIVGTKNKAADSVAWAAIKARCHCVNKKWLGGMLTNWSTTETRLHKFRDLRMEQKTGRLNRLPKRDAAMLKRQLFRLQTYLGGIKYMTGLPDIVIIVDQQEEYTALRECITLGIPTICLIDTNCDPDLADISIPANDDAISSIRLIL

SEQ ID NO: 1749 - protein, 718 aa, Anabaena variabilis
MAEFEKSISFDGRDIRLKVGLLAPQAGGSVLIESGDTAVLVTATRSAGREGIDFLPLTVDYEERLYAAGRIPGGIMRREGRPPEKTILTSRLIDRPLRPLFPSWLRDDLQIVALTMSMDEQVPPDVLAVTGASIATLIAKIPFNGPMAAVRVGLVGDDFIINPTYAEIEAGDLDLVVAGSPHGVIMVEAGANQLPERDIIEAIDFGYEAVRDLIKAQLDLVAELGLEIVQEAPPEVDQTLENYIRDRASDEIKKILAQFELTKPERDAALDVVKDNIATAIAELPEEDPIRLAATANSKALGNTFKDITKYFMRRQIVEDNVRVDGRKLDQVRPVSSQVGVLPKRVHGSGLFNRGLTQVLSACTLGTPGDAQNLNDDLQTDQSKRYLHHYNFPPFSVGETKPLRAPGRREIGHGALAERAILPVLPPKEQFPYVIRVVSEVLSSNGSTSMGSVCGSTLALMDAGVPILKPVSGAAMGLIKEGDEVRVLTDIQGIEDFLGDMDFKVAGTDAGITALQMDMKISGLSLEVIAQAIHQAKDARLHILDKMLQTIDTPRTETSPYAPRLLTIKIDPDMIGLVIGPGGKTIKGITEETGAKIDIEDDGTVTISAVDENKAKRARNIVQGMTRKLNEGDVYAGRVTRIIPIGAFVEFLPGKEGMIHISQLADYRVGKVEDEVAVGDEVIVKVREIDNKGRINLTRLGIHPDQAAAAREAAAVNR

SEQ ID NO: 1750 - protein, 387 aa, Glycine max
  misc_feature (132)..(132): Xaa can be any naturally occurring amino acid
  misc_feature (354)..(354): Xaa can be any naturally occurring amino acid
MPSLFARNQRFSLATLLLLLELLTGNLRMADAQIGVCYGMLGNNLPSANDVIGLYRSNNIKRMRLYDPNQAALEALRNSGIELILGVPNSDLQGLATNPDTSRQWVQKNVLNFWPSVKIKYVAVGNEVSPVXGGSSSVAQYVLPAIQNVYQAIRAQGLHDQIKVSTSIDMTLIGNSFPPSQGSFRGDVRSYLDPIIGYLVYANAPLLVNVYPYFSYTGNPRDISLPYALFTAPNVVVWDGQYGYQNLFDAMLDSVHAAIDNTKIGYVEVVVSESGWPSDGGFAATYDNARVYLDNLVRRANRGSPRRPSKPTETYIFAMFDENQKNPEIEKHFGLFNPNKQKKYPFGFGGKRLXKLLLTTSMQQLPLRVMCKVGILLLKISVIPPIK

SEQ ID NO: 1751 - protein, 202 aa, Halleria lucida
GVHFGHGTRKWNPKMAPYISAKRKGIHITNLTRTARFLSEACDLVFDAASRGKQFLIVGTKNKAADSVAWAAIKARCHCVNKKWLGGMLTNWSTTETRLHKFRDLRMEQKTGRLNRLPKRDAAVVKRQLSRLQTYLGGIKYMTGLPDIVIIVDQHEEYTALRECITLGIPTICLIDTNCDPDLADISIPANDDAISSIRLIL

SEQ ID NO: 1752 - protein, 316 aa, Medicago truncatula
VTQLHRYILTCHGKLLGLDSEKVPANNAVSQNAEALAKAWSEYNNPRAVIMTVVQAEERNMYDQHFLSAVLRDKHGITIVRKTMAEVDQEGEILPDGTLSVNGQAVAVIYFRAGYTPVDYPSESEWRARLLMEQSSAVKCPSISYHLVGTKKIQQELAKPGVLERFLENKDDIAKMRECFAGLWSLDDSDIVKKAIERPELFVMKPQREGGGNNIYGDAVRDTLIKLQKTGSQEDAAYILMQRIFPNISAAVLMRNGGCHKDHAISELGIFGTYLRNKDRVVMNNQSGYLMRTKISSSDEGGVAAGFAVIDSVYLT

SEQ ID NO: 1753 - protein, 202 aa, Stachytarpheta dichotoma
GVHFGHGTRKWNPKMAPYISAKRKGIHITNLTRTARFLSEACDLVFDAASRGKQFLIVGTKNKVADSVARAATKARCHCVNKKWLGGMLTNWSTTETRLHKFRDLRMEQKTGRLNRLPKRDAAVVKRQLSRLQTYLGGIKYMTGLPDIVIIVDQHEEYTALRECITLGIPTICLIDTNCDPDLADISIPANDDAISSIRLIL

SEQ ID NO: 1754 - protein, 339 aa, Oryza sativa
MPNLECRMYEPRFPEVDAAVMIQVKHIADMGAYVSLLEYNNIEGMILFSELSRRRIRSISSLIKVGRQEPAIVLRVDRDKGYIDLSKRRVSEEEAHACEDRYNKSKLVHSIMRHVAETLGIDLEPLYQRIGWPLYRKYGHAFEAFKLIVADPDAILDSLTYEEKETGADGQEVTKVVPAVTPEVKDALVKNIRRRMTPQPLKIRADVEMKCFQFDGVLHIKQAMRKAEAAGNDNCPVKIKLVAPPLYVLTTQTLDKDQGISVLTDAIKACTAEIEKHKGKLIVKEAPRAVSEREDKLFNEHIETLNEQNAEVDGDADSEEEEDTGMGDIDLTNSGVNAD

SEQ ID NO: 1755 - protein, 343 aa, Solanum pimpinellifolium
MEMDLPVSAIGFEGFEKRLEISFVEPGLFADPNGKGLRSLTKAQLDEILGPAECTIVDNLSNDYVDSYVLSESSLFVYSYKIIIKTCGTTKLLLAIPPILRLAETLSLKVQDVRYTRGSFIFPGAQSFPHRHFSEEVAVLDGYFGKLAAGSKAVIMGNPDKTQKWHVYSASAGTVQCNDPVYTLEMCMTGLNREKASVFYKTEESSAAHMTVRSGIRKILPKSEICDFEFEPCGYSMNSIEGTAVSTIHITPEDGFSYASFESVGYDPKTTELGPLVERVLACFEPAEFSIALHADVATKLLEHVCSVDVKGYSLAEWSPEEFGKGGSIVYQKFTRTPYCESP

SEQ ID NO: 1756 - protein, 430 aa, Rhodospirillum rubrum
MTAYTPWTGFFSASVAQADPELDRVLRAELSRQQDQIELIASENIVSRAVLEAAGSVLTNKYAEGYPGKRYYGGCEEVDVAEELAIERAKALFGCSYVNVQPHSGAQANGAVMMALVKPGDTIMGMSLAAGGHLTHGAPPAQSGKWFNAVQYGVRLQDASIDFDEVATLAETHKPKLIIAGGSAYPRIIDFAKFREIADRVGALFMVDMAHFAGLVAAGLHPSPLPYADIVTTTTHKTLRGPRGGMVLSNNPDIGKKINSAVFPGLQGGPLMHIIAAKAVAFGEALRPEFKVYAQAVIDNAKALTDALAAGGLNIVSGGTDTHLALVDLRPKALTGNIVEKSLERANITTNKNGIPFDPEKPAITSGIRVGTPAGTTRGFGTAEFTEIGKLIVEVLDGLAANGEDNSQAEAAVREKVAVLCRRFPIYGGL

SEQ ID NO: 1757 - protein, 181 aa, Paenibacillus polymyxa
MSIYDYSAIAMNGKEIVLSDYKDKVVLIVNTASQCGFTFQYQDLQRLYDQFKDRGLVILGFPCNQFADQEPDSNESVQTFCTLNYGVAFPMFQKVNVRDEQAHPLFTYLASSLPFEGFDETHSVAKILIPLIHERHPEYLPGDSIKWNFTKFLIDRNGKVIKRFEATTDPLDMEEYIEALL

SEQ ID NO: 1758 - protein, 610 aa, Solanum lycopersicum
MMMFEEMGFCGDLDFFPAPLKEVEVSAPQSQTEPDSVVDDDYSDEEEIEVDELERRMWRDKMKLKRLKEMSKSKEGVDPAKQRQSQEQARRKKMSRAQDGILKYMLKMMEVCKAQGFVYGIIPEKGKPVSGASDNLREWWKDKVRFDRNGPAAIAKYQADHAIPGMNEGSNPVGPTPHTLQELQDTTLGSLLSALMQHCDPPQRRFPLEKGVPPPWWPTGKEDWWPQLGLQKDQGSLPYKKPHDLKKAWKVGVLTAVIKHMFPDIAKIRKLVRQSKCLQDKMTAKESATWLAIISQEEALARELYPDRCPPLSSAGVSGNFMLNDSSEYDVEGAQDEPNFDVHEQKPNHLNLLNISAERFKETMPLQQQSHPNKDELVTNLDFSLKRKQANEPTVMMDQKIYTCEFLQCPHNELRHGFQDRSSRDNHQFACLYRSSTCFGVSNFQINEVKPVVFPQQYVQPKSSALPVNQGPPSFDLSGIGVPEDGQRMINELMSIYDSDVQGSKRQNRGNIALTKEQPHQQPRVHQDNYLLSQGIMDGNIFKNTNISTTQSMLPQVDPFDQSKAFNAGSNDNFHFMFGSPFNIQSTNYNGNLPSIGYDTTPKQDAPIWY

SEQ ID NO: 1759 - protein, 199 aa, Triticum aestivum
  misc_feature (96)..(97): Xaa can be any naturally occurring amino acid
  misc_feature (99)..(99): Xaa can be any naturally occurring amino acid
  misc_feature (124)..(124): Xaa can be any naturally occurring amino acid
  misc_feature (127)..(127): Xaa can be any naturally occurring amino acid
  misc_feature (134)..(134): Xaa can be any naturally occurring amino acid
  misc_feature (141)..(141): Xaa can be any naturally occurring amino acid
  misc_feature (153)..(153): Xaa can be any naturally occurring amino acid
  misc_feature (160)..(160): Xaa can be any naturally occurring amino acid
  misc_feature (166)..(166): Xaa can be any naturally occurring amino acid
MAPTVMASSATSVAPFQGLKSTAGLPVSRRSNGASLGSVSNGGRIRCMQVWPIEGIKKFETLSYLPPLSTEALLKQVDYLIRSKWVPCPSSSAKGXXCXSFFVERPTAIAPGVTLRWAPGIGSXCWXKLPLCVXVAPDGHXQVINEVEGARRXPDAYVRXIIGFDXMRQVQCGDVHRLKPPGCEESGKAYNGSLTTRHI

SEQ ID NO: 1760 - protein, 419 aa, Streptococcus suis
MIFDKVNYKEFDKEVWEAIQAEEKRQQNNIELIASENVVSKAVMAAQGSILTNKYAEGYPGRRYYGGTECVDVVESLAIERAKEIFGAKFANVQPHSGSQANCAAYMALIEPGDTVMGMDLAAGGHLTHGASVSFSGQTYNFVAYNVDEETGLLDYDAILKQAKEVQPKLIVAGASAYARTIDFAKFREIADAVGAKLMVDMAHIAGLVAAGLHPNPVPHAHITTTTTHKTLRGPRGGLILTNDEELIKKINSAIFPGIQGGPLEHVIAAKAVSFKEVLDPDFKDYAQKVIENSKAMAEVFLANPNFKVITGGTDNHLFLVDVTKVVENGKVAQHLLDEVNITLNKNSIPYEKLSPFKTSGIRIGSAAITARGFGVEEARKVAQLTIKALENAENEKALEEVRQEVRALTDQFPLYEGL

SEQ ID NO: 1761 - protein, 187 aa, Phelipanche coelestis
FGHHSKKWNPKMTPYISAERKHRHIINITKTARFLYEACNLVFYAASRGKQFLIVGTNKIRDDLVEQAAIKAQCHFVNKKWTGGTLTNWSITEARLQKFRNLIIEQKAGRLDCLPKKDAAVVKRQLSRFQKNLGGIKYMRGLPDIVIILHQNEEYKALQECINLGIPTISLIDTNSDPDLADISIPA

SEQ ID NO: 1762 - protein, 614 aa, Solanum lycopersicum
MMMFEDIGFCADLDFFPAPLKEAETVAAVPPIVPEPMMDDDDSDEEIDVDELEKRMWRDKMKLKRLKEMSKGKEGVDAVKQRQSQEQARRKKMSRAQDGILKYMLKMMEVCKAQGFVYGIIPEKGKPVTGASDNLREWWKDKVRFDRNGPAAIAKYQADNAIPGKNEGANPIGPTPHTLQELQDTTLGSLLSALMQHCDPPQRRFPLEKGVSPPWWPNGQEDWWPQLGLPNDQGPPPYKKPHDLKKAWKVGVLTAVIKHISPDIAKIRKLVRQSKCLQDKMTAKESATWLAIINQEEVLARELYPDRCPPLSSGGSSGTFTMNDSSEYDVEGAIDDPIFDVQEQKPNHLSLLNVNVEMFKEKLPLLQQSQPMKGDIFANLDFTRKRKPADDLTFLMDPKTYTCECLHCPHSELRNGFPDRSSRDNHQLTCLFRNTSQFVVPNFHMEEVKPVVFPQQYAEPKRASLPVNPAPPSFDTSGLGVPADGQRVINELMSFYESNVQGNKSSMAGNSVMSKEQPLQQPSIQQNNYLQSQGNVLEGSIFGDTNISANNSMFVQGDRFDQSKVLTSPFNASSTDDFNFMFGSPFNMQSTDLSECLSGISHDDVTKQDASVWY

SEQ ID NO: 1763 - protein, 187 aa, Phelipanche pulchella
FGHHSRKWNPKMKPYISAERKHMHIINLTKTARFLYEACNLVFYAASRGKQFLIVGTNKMRDDLVEQAAIKAQCHFVNKKWTCGTLTNWSITEARLQRFRNLIIEQKAGRLDCLPKKDAAVVKRQLSRFQKNLGGIKYMRGLPDIVIILDQNEDFTALHECLNLGIPTICLIDTNSDPDLADISIPA

SEQ ID NO: 1764 - protein, 536 aa, Trichophyton rubrum
MKFFTTGLLATAALAAAQEQQVLQAEDGMGRAPLPDSSIFDETLQKFQSSLEDGISHFWSEMKTNFKDYLPLISLPKKHTRRPDSEWDHVVRGADIESVWVQGADGEKRREIDGKLHNYDLRVKAVDPGVKQYSGYLDDNDADKHLFYWFFESRNDPKNDPVVLWLNGGPGCSSLTGLFLELGPATIDKNLKVVSNPYSWNSNASVIFLDQPVNVGFSYSGSSVSDTVAAGKDVYALLTLFFKQFPEYATQDFHISGESYAGHYIPVFAAEILSHKNTNINLKSALIGNGLTDPLTQYPQYRPMACGEGGYPAVLDQGTCRSMDNSLERCLSLIETCYSSESAWVCVPAAMYCNSAILAPYQQTGMNPYDVRTKCEDMASLCYPQLNAITEWLNQKPVMQALGVEVESYESCNSGINRDFLFHGDWMKPYHRLVPSVLEKIPVLIYAGDADFICNWLGNKAWTEALEWPGHKKFAETKLEDLKIVDNKNKGKKIGQVKSSGNFTFMRIFGAGHMVPLNQPEASLEFLNRWLRGEWH

SEQ ID NO: 1765 - protein, 601 aa, Solanum lycopersicum
MGIFEDMGFSGNFEFLSDSMGCGAQEVEHKPVGLEEDDYSDEEMDVEELERRMWRDRMLLRRLKEKNKNKVVGDGAKQRQSQEQARRKKMSRAQDGILKYMLKMMEVCNAQGFVYGIIPEKGKPVTGASDNLRAWWKEKVRFDRNGPAAIAKYQADNQIPGRVEESSVIVSTPHTLQELQDTTLGSLLSALMQHCDPPQRRFPLEKGVSPPWWPSGKEEWWGQLGLPNDQVQPPYKKPHDLKKAWKVGVLTAVIKHISPDIAKIRKLVRQSKCLQDKMTAKESATWLAIINQEEALARKLYPDSYPQGSLAVGNGSFFISDASDYDVEGVDNERNNEVECKPHDINLQTGIMLPKDRVLMPGLAPVKGEIIDLTSDFIQKRKEPCFEESVDQKIYTCEYLHCPYSNYQAGFLDRTSRNNHQMSCPFRFNSAQTLTTPKYQINYEHNTVFPAQTATSKPAVSSVTASSSMSASGLGLPEDDQRIISDLITSYDNNFQQNGSICSGISEILVNQSLPQQQTVELPMDGNINLGHMETSAQETSMPVYRSTEFQYDQCKMSFDAPFGGNINDITDYRFGSPFNLGGSDYAVEQLTKQDISTWYL

SEQ ID NO: 1766 - protein, 179 aa, Unknown
  Rosa hybrid cultivar
MLKMMEVCKAQGFVYGIIPEKGKPVSGASDNLREWWKDKVRFDRNGPAAISKYQADNSIPGLMEDCISVASTPHTLQELQDTTLGSLLSALMQHCDPPQRRFPLEKGVSPPWWPTGNEEWWPQLNLANQGPPPYKKPHDLKKAWKVSVLTAVIKHMSPDINKIRKLVRQSKCLQDKMTA

SEQ ID NO: 1767 - protein, 260 aa, Oryza sativa
MDPDAVKSTLSNLAFGNVMAAAARDYQKVTSLTHSRNWLWRLVSEPGVLLDGSRHQRGGIESRFLIGSGVDGRLIRPRSTRLSCAAGLQPWIVEGRGNGEDDLEIVAKEKAQAANASHDEVDLDELLDDPELEKLHAERIAALKKEVEKREVLKRQGHGEYREITEGDFLGEVTGSEKVICHFYHREFYRCKKGIAVDRLVGFQDLGSKDDFSTRALENILKMKGIIDEKKKDEDDEDDETDMSMNRRIRSSTAQDSDSE

SEQ ID NO: 1768 - protein, 187 aa, Phelipanche pulchella
FGHHSRKWNPKMKPYISAERKHMHIINLTKTARFLYEACNLVFYAASRGKQFLIVGTNKMRDDLVEQAAIKAQCHFVNKKWTCGTLTNWSITEARLQKFRNLIIEQKAGRLDCLPKKDAAVVKRQLSRFQKNLGGIKYMRGLPDIVIILDQNEDFTALHECLNLGIPTICLIDTNSDPDLADISIPA

SEQ ID NO: 1769 - protein, 152 aa, Unknown
  Rosa hybrid cultivar
  misc_feature (38)..(38): Xaa can be any naturally occurring amino acid
LITLIPLLLKVKVREFMLKKKTWDLGREVGIIMRQKEXGMHVRMLTQEIRKSLDRHTILSTTLFELSETLGLQYCAVWMPNEIKTEMILTHELKGRNYSNMYNFSIPIGDPDVVLIKGSDGVNILGPDSILVSGSSGDFGEPGPVAAIRMPM

SEQ ID NO: 1770 - protein, 136 aa, Oryza sativa
MARTKQTARKSTGGKAPRKQLATKAARKSAPATGGVKKPHRFRPGTVALREIRKYQKSTELLIRKLPFQRLVREIAQDFKTDLRFQTSAVRALQEAAERYLVGLFEDTNLCAIHAKRVTIMPKDIQLARRIRGERA

SEQ ID NO: 1771 - protein, 181 aa, Coffea arabica
MASSMISSAAVATTTRASPAQASMVAPFNGLKAASSFPISKKSVDITSLATNGGRVQCMQVWPPRGLKKYETLSYLPDLTDEQLLKEIDYLIRSGWVPCLEFELEKGFVYREYHRSPGYYDGRYWTMWKLPMYGCTDATQVLNEVGECLKEYPNCWVRIIGFDNVRQVQCISFIAAKPKGF

SEQ ID NO: 1772 - protein, 998 aa, Coprinellus disseminatus
MLRLRCVQRFPRLHNKRAAPLARGLASLKQPSSIFSPLDTFQERHIGPDDAEATTMLSNLGYDSMDAFIADTVPPKIRISPSTVSNESIPALSESELQANAKALGAQNKPFKSYIGMGYHNAVVPPVILRNVMENPSWYTQYTPYQPEIAQGRLESLINFQAMVMSLTSMDIANASLLDEATAAAEGMVMAHTSAPKKKTFIVDSGVAPQTLAVIRSRAKGFDVKIVVGDVSALVEDSSLIADVCGVLVQYPDVDGNIKDWAALAEQTHKIGGLVVAATDLLALTKLKAPGEWGADVVVGNSARFGVPAGYGGPHAAFFAVTDKLKRKMPGRLIGLSRDAQGKPAYRLALQTREQHIRREKATSNICTAQALLANMATMYAVYHGPEGLKRISNKVHGFTQVFKSSVESLGFKAINTTFFDTLTLDVTGAVANSWAVHASANAAAINLRRIDDKHVGVTFDESVTPAELVDLINVFATAANKSPFALSDLAESTESAISPHLKRTSKFLPHAVFNKHHSETEMLRYINHLSSKDLSLTHSMIALGSCTMKLNSTSSMVPLTWPEFSNVHPFAPQDQVEGYRTIIKELEEYLCKITGFHSASLQPNSGAAGEYAGLCVIRAFHESRGEGHRDICLIPLSAHGTNPASAHLAGLKVVPVKVHNDGNLDLADLKAKAEKHKDNLAAFMITYPSTFGVFESGVQDACQIIHGKGGQVYLDGANLNAQVGLTSPATCGGDVCHLNLHKTFAIPHGGGGPGVGPICVAEHLAPFLPGHTALPVQGESAINAVAAAPFGSASILLISWAYIKMLGGKGLADSSKLALLNANYMAHKLAPYYTLRYKNENGRVAHELLIDLAEFDKAAGLKVTDFAKRLQDYGFHPPTCSWPISTCMLIEPTESETLEELDRFCEAMIQIRKEADDVIAGKQPKENNLLKNAPHPISVISLSEDRWNRPYSRETAAFPLPWLKEKKFWPTVGRLDDAYGDLNLVCDCPSVEEVASN

SEQ ID NO: 1773 - protein, 140 aa, Aspergillus nidulans
MPPKAAEKKPSTGGKAPAGKAPAEKKEAGKKTAAAASGEKKKRGKTRKETYSSYIYKVLKQVHPDTGISTRAMSILNSFVNDIFERVATEASKLAAYNKKSTISSREIQTSVRLILPGELAKHAVSEGTKAVTKYSSSAK

SEQ ID NO: 1774 - protein, 112 aa, Legionella pneumophila
MKMITAIIKPFKLDDVHEALMEIGVPGITISETRGFGRQKGHTELYRGAEYVVDFLPKIKIELALPDNMVEAAIEAICKSAYTGKIGDGKIFVYALEQVVRVRTGEVGTDAL

SEQ ID NO: 1775 - protein, 443 aa, Unknown
  Burkholderia sp. 383
MTALDLNRGAIAPVADEIDLVDLRVTGAIPHELAGTLLRNGPNPPGGRFEGSDMLSWWPEAAMLHAIAFEGGRATGYRNRWARTQRWAAVHAPEAASQLPDTNPNVNVLQHAGELLALSEGGAPFAITAALDSLGIPARHAGLGGGMTAHPKVDPVTGELIAFRADWRAPWLRYGVADAQGVQRVDLEIDLSAPSMMHDLAITETRSLLLDLNVGYDFSLLKLGHRMPLRWHDDRPARIGVIPRHGGAVRWFGVEPCFILHVVNAYDCDASCIVLDAVRYPSFLRLDAGTGRFADNPVGELWRYVIDTANGLIDEGPLADGGIEMPRINESRTGRRYRYLYAVEQPNNAEMRGVMRFDHASGTTTRYALPPGDQNSEPVFVPRPGGVDEDDGWLLVVVYRAATDTSDVVILDARAIDAGPVATVHLPRRVPAGFHGAWVPREH

SEQ ID NO: 1776 - protein, 138 aa, Lactobacillus plantarum
TNEMLKANQLSFPGQRVAISGAGNVAIYAIQKVEELGGKVITCSDSNGYVIDENGIDFKIVKQIKEVERGRIKDYADRVASASYYEGSVWDAQVAYDIALPCATQNEISGNQAKNLIANGAKVVAEGANMPSSPEAIA

SEQ ID NO: 1777 - protein, 788 aa, Aspergillus oryzae
MSPQGLASRKRPAPGTSPIVHPQLGPVSNYPQNSGAQLSNDQFLQWGQNTSSNVVSPASFSDANPYGATAYSAGQDVPASTATASTQLARRQTPNQLVSRNRGYEQTPSSMSDHGSNTGEPGGWGESLDELYQRALVAKREVQAKRKQIPPFVQKLSSFLDESKNTDLIRWSDDGNSFIVLDEDEFAKTLIPELFKHNNYASFVRQLNMYGFHKKVGLSDNSMRASERKNKSPSEYANPYFKRGHPDLLWLIQKPKNTAGQGSKSGKANVRVKTEEVDEHDNDDYDDVPGARDDRSRNRQLSLIQGGSIMPKDQLAGVYRELQAIRQQQQVISNTITKLRREHEQLYAQAANFQEQHTRHENSINAILTFLATVYNRSLQGQEGPQNLANSFAGAISQDQGNVVDMGDDYSLSTLGAQHMNSPGGPRAMKKQPLLLKAAPSERQSRATTLSPAASAYDGPQPRGHARHPSAPQHGHVEEVFDTSPQPKEAQPPQTEQFPQRDIMSVIQNSNARNGVPPTSFADFPNVLSSLETSNGNVPLTPNQRADMLRLMANETSAGDSNVPVSQNNALVTPTPPPMPLGYSNRLANTRAEIDNLVKMQAEQDRSVQNLTNLLQPLSPTGTIPGMVTGDGSVPPPPLDLDQIFNNDYFTDIGDLEKNKNNLDFGNTTTSVPATAPIEPVTTGADDSVINDGNDLFDFDHIPDNGDLFDGPGQQQQNPGFYNGYDGSGFDNTINPGAGRIIETLTDSEATSPSNTVDEPAQYGVSNGGKDFQGGKGNGGSAKRRKKA

SEQ ID NO: 1778 - protein, 138 aa, Lactobacillus plantarum
TNEMLKANQLSFPDQRVAISGAGNVAIYAIQKVEELGGKVITCSDSNGYVIDENGIDFKIVKQIKEVERGRIKDYADRVASASYYEGSVWDAQVAYDIALPCATQNEISGDQAKNLIANGAKVVAEGANMPSSPEAIA

SEQ ID NO: 1779 - protein, 465 aa, Unknown
  marine gamma proteobacterium HTCC2143
MSATVIKSLLSGSVASESVVTVQGWVRSRRDSKAGISFMAIHDGSCFAAIQAVIPTTLDNYQSEVLQAGAGCSVRVSGMLVTSEGKGQNFEIQATAVEVVGWVDDPETYPVAKKRHSFEYLRTIAHLRPRTNTFGAVTRVRNVLANSIHNYFFDRDFQWVNTPIITASDCEGAGELFRVSSLDLTNLPRGVDGGVDFTKDFFSDESFLTVSGQLNVEAFCMAMSKVYTFGPTFRAENSNTSRHLAEFWMVEPEIAFADLNDDATLAEDFLKYLFNAVLNKCGDDIEFFTQFVDKTCHERLEKVSQQNFERIDYSEAIRILENAPRKFQFPVKWGLDLQSEHERFLCEEHIGAPTIVMNYPKEIKAFYMRMNDDNKTVAAMDVLAPGIGEIIGGSQREERLDVLDARMAEQNIGGDLWWYRDLRRYGTVPHAGFGLGFERLISYVTGLDNIRDVIPYPRTPGNAPF

SEQ ID NO: 1780 - protein, 325 aa, Ashbya gossypii
MPANDLNSAISMFEMNAGTTGAGAVVAPCSAHVAAYHMGVTPAEQHEALQSSSSTSSSDSSILLGELVFEKFACADNLDHEALAKLERSMPMFSESKSSTDLDSAVENFFGSSSDSTPLFEFEGLGKTADPKTWSSLFDDDIPVTLEDVGAVEPISAAAGTESCFLPTPIIEDAVLKPPKRSLTKRDADSVPASKSASPVSISSNISSPALNGCTSASATSRRRSSVMKSEKYDHLGVITYNRKQRATPLTPVVPESDDPVALKRARNTEAARRSRARKLERMNQLEERVEQLLQKNSELEAEVARLRSLVPSSEQPKYTSRAGN

SEQ ID NO: 1781 - protein, 220 aa, Thiobacillus denitrificans
MAQKPKRTKSGSAWMHEHVTDAYVKKAQQDGFRSRAAYKLLEIDSRDHLLHPGMTVVDLGAAPGSWCQVAVQKMKRQGRVLAIDLLPVAPLPGVEALQGDFTAPDTLAWLENTLQAARVDLVLSDMAPNMSGVMLRDQARHYELCELALDFAVNWLKPDGAFLVKVFQGSGFEDFRNAMRRAFDQVVIRKPDASRDRSSEVYLLGRRPVKLESVAATGAS

SEQ ID NO: 1782 - protein, 130 aa, Debaryomyces hansenii
MSLQSSNLKVDYIPLNEIRRPIPPVLDHQKIDAMVSTLQGTPMASATCNIEDMDAGELPPVDVFKVREEGKSYYFAFGGCHRFQAYDRIGSEGNKETLVKCKILPATRRTLKLYLGASVDEMFKDIDEEK

SEQ ID NO: 1783 - protein, 234 aa, Anabaena variabilis
MIFSPLFPYMPSPQSPIPNPQSLVPMQISDYPQLNLSSVPRIASVHRITGETNVQVTVNLDGTGICTAATGIPFLDHMLHQISSHGLIDLDVQAKGDWEIDDHHTNEDVGITLGQALAKALGDRKGIVRFGNFLAPLDEALVQVALDFSGRPHLSYGLQIPTERVGTYDTQLVREFFVALVNHSQMTLHIRQLDGINSHHIIEATFKAFARAARMAIEADPRRAGTIPSSKGVL

SEQ ID NO: 1784 - protein, 357 aa, Unknown
  Vibrio sp. Ex25
MSKQQKILFIDRDGTLIVEPPVDFQVDRLDKLKLEPFVIPSLLSLQDAGYRLVMVTNQDGLGTDSYPQADFDAPHNMMMEIFESQGVKFDDVLICPHFEEDNCSCRKPKLGMVKEYLQGGKVDFQNSVVIGDRQTDLQLAENMAIRGIQYNPETMGWKQILKDLTVKARIAEVIRTTKETDIKVAVNLDEQGGNDISTGLGFFDHMLDQIATHGGFQMVCKVEGDLHIDDHHTVEDTALALGQALKEALGDKRGIGRFGFSLPMDECLAQCALDLSGRPYLKFDAQFSREQVGDLSTEMVVHFFRSLTDTLACTLHLSSAGNNDHHIIESLFKAFGRTLRQAIKVEGTELPSSKGVL

SEQ ID NO: 1785 - protein, 500 aa, Xanthomonas oryzae
MMSEEILVNVTPRETRVAVIENGMLQELHIERGWRRGVVGNIYKGKVQRVMPGMQAAFVEVGLERAAFLHANDVIRLAPAPASVVDTEETPIPPPPPASVPIVELLRDGQDIVVQVVKDPIGTKGARLTTQISIPSRYLVLLPQSKVVGVSARIEDEAERLRLKTIVSEVSAQHGGFGYIIRTNAEGQPAEALAEDIAYLSRVWNVVERRGREAPPCSIIYEDLSLPLRAVRDLIRRDVEKVKVDSNETFVQLQAFVAKYMPVLAERLELYTGDRPIFDLYGVEDEIGRALNKQVPLKSGGYLVIDQTEAMTTIDVNTGSFVGQRNLEETVFRTNLEAAQAVARQLRLRNLGGIIIIDFIDMDDSEHRRQVLRTLEKALARDHAKTTVYEFSPLGLVEMTRKRTVESLERQLSETCGQCGGRGTIKTAETVTYEIFREITRAVRQFDAARLLVIASSKVVARITDEESAAVAELEEFLGKSILFQSDDQYLQEQFDVVLL

SEQ ID NO: 1786 - protein, 474 aa, Vibrio vulnificus
MSIKHWMASSVSVTALVMTALLNITAVSAEEKGLVDPRNDAFEQNHPDQYQSWKKTSESVEIEDALAEDPNMVILWAGYGFAKDYNKARGHFYALDDVRQTLRTGGPQDAKSGPMPMACWSCKSPDVARVIDERGEDGYFEGKWARLGAEIANPIGCADCHDTRSEKFKNGEPELALTRPYVERAFQAINKPFEQQSRLDKQASVCAQCHVEYYFTGPTKAVKFPWDMGTGVQQMEEYYDALGFADWTHAVSKAPMLKAQHPGFETWREGIHGKNKVVCVDCHMPKVKKEDGTVYTDHKVGNPFDRFEDTCAQCHTQSKDQLREIVSTRKAQVLNMKLTAEKQIVAAHFEAGAAWKAGATEEEMKPILQDIRHAQWRWDYAIASHGVHMHAPEVALEVLGTAVDRAADARTKLVRLLATKGITEPVQIPDISTKAAAQKALGMDMEKMNAEKQHFLKTVVPDWDKAAAERESKY

SEQ ID NO: 1787 - protein, 314 aa, Neorickettsia sennetsu
MCDALESDVIIIGSGPAGCTAGIYAARASLSVVIVSGNQSGGQLTTTTEVENYPGFALPVQGPWLMEQMQQQAVNVGCRLVNDHILQIEAPYSSPFVLRGEGGNKYRARSIVVATGAQAKWLGLESEKKYQGYGVSGCATCDGFFFRDQDVIVIGGGNTAVEEALYLTRHAKKVYLLHRRERLRAETVLQERLFANAKVELIWNSVLDEILGRDSPPEVTGVRVRSLMDGTFREILVSGVFVAIGHAPNTALFSGILEMDSAGYIKTSSSDTSTSVSGIFACGDVQDPVYRQAVTAAGTGCMAALDAIRFLDCI

SEQ ID NO: 1788 - protein, 430 aa, Oryza sativa
MGKHEFLTPKAIANRIKAKGLQKLRWYCQMCQKQCRDENGFKCHCMSESHQRQMQVFGQAPDRVVEGFSEEFLDAFLTLLRRAHRHSRIAATVVYNEFIADRHHVHMNSTRWATLTEFVKFLGREGHCKVEDTPKGWFITYIDRDSEQAVKARLKRKRIKSDLAEDERQERMIARQIERAQQSMGKTNGELGDDASPDGSEGESGSADEYSDSENDHEGQEEDAKEANKAAGKIAIALQRAVPGPKVNPLDDKPKVKFGFEEEDEVSARDKEKEELAKKKGKDAINAAEARRSALDELMKEEEKAKERSNRKDYWLCPGIVVKVMSKSLAEKGYCKQKGVVKRVIDKYVGEIEMLESKHVLRVDQDELETVIPQIGGLVRIVNGAYRGSNARLLSVDTERFCAKVQVEKGLYDGKVLKAIEYEDICKIFH

SEQ ID NO: 1789 - protein, 148 aa, Pisum sativum
MGFTDKQEALVNSSSEFKQNLPGYSILFYTIVLEKAPAAKGLFSFLKDTAGVEDSPKLQAHAEQVFGLVRDSAAQLRTKGEVVLGNATLGAIHVQKGVTNPHFVVVKEALLQTIKKASGNNWSEELNTAWEVAYDGLATAIKKAMKTA

SEQ ID NO: 1790 - protein, 1045 aa, Arabidopsis thaliana
  misc_feature (790)..(790): Xaa can be any naturally occurring amino acid
MERARRLAYRGIVKRLVNETKRHRNGESSLLPTTTVTPSRYVSSVSSFLHRRRDVSGSAFTTSGRNQHQTRSISVDALKPSDTFPRRHNSATPDEQAQMANYCGFDNLNTLIDSTVPKSIRLDSMKFSGIFDEGLTESQMIEHMSDLASKNKVFKSFIGMGYYNTHVPPVILRNIMENPAWYTQYTPYQAEISQGRLESLLNYQTVITDLTGLPMSNASLLDEGTAAAEAMAMCNNILKGKKKTFVIASNCHPQTIDVCKTRADGFDLKVVTVDIKDVDYSSGDVCGVLVQYPGTEGEVLDYGEFVKNAHANGVKVVMATDLLALTMLKPPGEFGADIVVGSGQRFGVPMGYGGPHAAFLATSQEYKRMMPGRIIGVSVDSSGKQALRMAMQTREQHIRRDKATSNICTAQALLANMTAMYAVYHGPEGLKSIAQRVHGLAGVFALGLKKLGTAQVQDLPFFDTVKVTCSDATAIFDVAAKKEINLRLVDSNTITVAFDETTTLDDVDKLFEVFASGKPVQFTAESLAPEFNNAIPSSLTRESPYLTHPIFNMYHTEHELLRYIHKLQNKDLSLCHSMIPLGSCTMKLNATTEMMPVTWPSFTNMHPFAPVEQAQGYQEMFTNLGELLCTITGFDSFSLQPNAGAAGEYAGLMVIRAYHMSRGDHHRNVCIIPVSAHGTNPASAAMCGMKIVAVGTDAKGNINIEELRNAAEANKDNLAALMVTYPSTHGVYEEGIDEICNIIHENGGQVYMDGANMNAQVGLTSPGFIGADVCHLNLHKTFCIPHGGGXGPGMGPIGVKQHLAPFLPSHPVIPTGGIPEPEQTSPLGTISAAPWGSALILPISYTYIAMMGSGGLTDASKIAILNANYMAKRLESHYPVLFRGVNGTVAHEFIIDLRGFKNTAGIEPEDVAKRLMDYGFHGPTMSWPVPGTLMIEPTESESKAELDRFCDALISIREEISQIEKGNADPNNNVLKGAPHPPSLLMADTWKKPYSREYAAFPAPWLRSSKFWPTTGRVDNVYGDRNLVCTLQPANEEQAAAAVSA

SEQ ID NO: 1791 - protein, 584 aa, Aspergillus oryzae
MSPHAVHTVPSGENNWWKEATVYQVYPASFKDSNGDGWGDIPGLISKVPYLHSLGVDVVWLSPMYDSPMHDMGYDVSDYENVLPAYGTVEDVERLIDACHERGMKLILDLVINHTSDQHKWFQESRSSKDNDKRDWYFWRPPRYDEQGNRLPPTNYRGYFAGSTWTWDEHTQEYYLHLYAKEQPDLNWDNEATRKAIYDSAVRFWLDKGVDGFRVDTVNKYSKHTDFPDAPVTDPKSYIQPAIQMWCNGPRIHEFLREMYDDALQPYGDVVTIGELANTPDPEHVLKYVGASAKQLSMVFHLDIGHIGMGKSLEDKYIFNPWQLTEMKSIVTKWQSFIEGTDGWTTAFCENHDNGRSVSRFASDAPEHRERSAKMLALMMMAMTGTLFLYQGQEIGMINAPRDWSVEEYKDIEGRGYYQEAERQVAAGVDPTRKDRIMDGLRILARDHARLPMQWDDSSHAGFTTGTPWMRAHDLYPEINVQKQADDPESVLSFWRSVLRLRKEYRELFIHGAFEVVDFDNQQTFCFFKSRDEKKALVALNFTAENQPFTQATTTEGMKLLVSNYAELLPETLRPFEGRIYISQ

SEQ ID NO: 1792 - protein, 159 aa, Unknown
  Oceanobacter sp. RED65
MSVYDFKATDITGQERELSEFKGKPLLIVNTASKCGLTPQFDGLEALYKQYKDQGFAILGFPCNQFAEQDKGSDSEIAGFCMKNYGVSFPMFSKIEVNGDNAHPLYRYLKDQAPGFLGSKKIKWNFTKFLINKEGKVVKRFAPTTKPAAIEKHVKALVE

SEQ ID NO: 1793 - protein, 168 aa, Pinus taeda
MARSTAMTMVLFLLAGFLVSSMAQSPSASPTKSPTTPAPTTTAAPTTTAAPPTITATPPTTTATPPVSTPPPVSSPPPVTSPPPAATPPPVATPVATPPSPVLVPSPAATPPPAAVPTATPPPAVSPTTASPATSPGVSPSSVSGASVTSNLEKAAILTAALAAVFFL

SEQ ID NO: 1794 - protein, 144 aa, Vicia faba
MGFTEKQEALVNSSSQLFKQNPSNYSVLFYTIILQKAPTAKAMFSFLKDSAGVVDSPKLGAHAEKVFGMVRDSAVQLRATGEVVLDGKDGSIHIQKGVLDPHFVVVKEALLKTIKEASGDKWSEELSAAWEVAYDGLATAIKAA

SEQ ID NO: 1795 - protein, 422 aa, Unknown
  Gladiolus hybrid cultivar 'Traveler'
MEGCDCIEPQWPADELLVKYQYISDFFIALAYFSIPLELIYFVKKSSFFPYRWVLIQFGAFIVLCGATHLINLRTFTMHSKTLALVMTVAKVSTAVVSCATALMLVHIIPDLLSVKTRELFLKNKAEELDREMGLIRTQEETGRHVRMLTHEIRSTLDRHTILKTTFVELGRTLDLAECALWMPSRTGLNLQLSHTLHNQIPVGSTVSINLPTVNQVFNSNRAVRISHTSPLARIRPLAGRYVPPEVVAVRVPLLHLSNFQINDWPELSARSYAVMVLILPSDSARKWHVHELELVEVVADQIKDTGCGISPQDIPFLFTKFAHTQNGGNKGYSGSGLGLAICKRFISLMEGHIWLESEGLGKGCTATFIVKLGICGSQNGHQQQMIPTNRVLLGGADFPGPRALLKEDNKAIPSKLRYLSV

SEQ ID NO: 1796 - protein, 154 aa, Lupinus luteus
MGALTESQAALVKSSWEEFNANIPKHTHRFFILVLEIAPAAKDLFSFLKGTSEVPQNNPELQAHAGKVFKLVYEAAIQLQVTGVVVTDATLKNLGSVHVSKGVADAHFPVVKEAILKTIKEVVGAKWSEELNSAWTIAYDELAIVIKKEMNDAA

SEQ ID NO: 1797 - protein, 146 aa, Phaseolus vulgaris
MGAFTEKQEALVNSSWEAFKGNIPQYSVVFYTSILEKAPAAKNLFSFLANGVDPTNPKLTAHAESLFGLVRDSAAQLRANGAVVADAALGSIHSQKGVSNDQFLVVKEALLKTLKQAVGDKWTDQLSTALELAYDELAAAIKKAYA

SEQ ID NO: 1798 - protein, 507 aa, Oryza sativa; identical to SEQ ID NO: 511

SEQ ID NO: 1799 - protein, 473 aa, Unknown
  Candidatus Pelagibacter ubique HTCC1002
MTKKAIVWIREDFRIEYNEALATATQNHEYVSAIYIYNPKNFDKKREAQKWWLSKSLENLSIDLKKLNITLEVQLGDELEVLSILKKKDDVTVYWSKVYEPDVINKGKKIRDLFIKNEIQYKYFKGNILIEFQEMTKDDGTPYKVFTPFWKKTEQHYISKAPSKLIRVKSKIKKINIFKNSISIKEILPKKNWHKKFEKYWDPSEKEAKKYLQELINNKIEDYGDARDIPGVNGTSKLSPFLKFGQIHVETIWKKCQDIKVKKIGYRKYINELGWREFSHSLINYFPQMLKGNLRKDFDNFPWVKNDKFLKAWKAGMTGYPIVDAGMRELYETGWMHNRVRMIVASFLVKHLRIHWMEGEKHFKNCLVDYNEASNVAQWQWVAGCGADAAPYFRIFNPILQGEKFDKAGIYTKKWVPELKNMPNKFLYKPWELETKYQEQIKVIVGINYPKPIVDHVEARNAALDAFKTIKKS

SEQ ID NO: 1800 - protein, 549 aa, Photorhabdus luminescens
MEIFFTILILILVVSVSGVLTKVIPFRIPLPLMQIAMGALLAWPHFGLHVTFNPELFLVLLIPPLLFVDGWKMPTREFFQYGREIFILMLVLVLVTVVGIGYLIYWLMPGIPLIAAFALAAVLSPTDAVALSSIVGKRRMPKRMMNVMEGEALMNDASGLVALKFAVAIAMGTMAFSVTGMTIEFFKVAIGGLLSGIAVTWLYSKSLRLMNRWSGGDPATQIVFMLLLPFASYLIAEHIGVSGILASVAAGMTISKSGVIRNAPLAMRLRADSVWSMLAFVFNGLVFIMLGLQLPGIWQTSVIQAEIDPTVETWMLFAAVAVIYGALLLLRFCWLWLMKNISKVFMRKNPLNFATYTTRELWLASFAGVRGAITLAGALSVPLFLADGTPFPARYQLIFIAAGVILFSLLIGVLSLPFLLRGMQTSDKEADISEVRMARAAMAEVAIVSMNKMEERLSASPEEQLDAEVITEVASRVIGYLRRRTVGQDEIEHNLLVEDLERRFRLTALRAERGELYHLRATRKISNETLQTLLHDLDLLEALLVQKEH

SEQ ID NO: 1801 - protein, 164 aa, Brassica napus
MANSPTAAEQLCYIPCNFCNIVLAVSVPCSSLFDIVTVRCGHCTNLWSVNMAAALQSLSRPNFQVTPYATPEYGSSSRGHTKISSRISARTISEQRIVNRPPEKRQRVPSAYNQFIKEEIQRIKANNPDISHREAFSTAAKNWAHFPHIHFGLMLESNKQAKLA

SEQ ID NO: 1802 - protein, 349 aa, Idiomarina baltica
MEYLREYAHLRPRTNVTGAVMRVRNTLSQAIHRFFHEHGYLWVSTPIITTSDCEGAGEMFRVSTLDLMNVPKTEQGNVDFSQDFFGKEAFLTVSGQLNVESYACSLSKVYTFGPTFRAENSNTSRHLSEFWMVEPEVAFADLDDVAHLAEDMLKYVFKAVLEERPDDMAFFEQRINKDVVERLTRMVDSDFVHMDYTDAIEILKNCGKKFEYPVEWGVDLQSEHERYLAEEHVGAPVILKNYPRDIKAFYMRQNKDGKTVAAMDVLAPGIGEIIGGSAREERLDVLDQRIAEMDLPAEEYEFYRDLRRYGTVPHAGFGLGFERLVSYVTGMQNIRDVIPFPRAPKSAQF

SEQ ID NO: 1803 - protein, 196 aa, Brassica napus
  misc_feature (170)..(170): Xaa can be any naturally occurring amino acid
MDPCPFIRLTISNLALKLPLAAKSSSSAVHPSSSPCFCKIKLKNFPPQTDAIPYIPLETTQFPEIQTLAATFHLSSSDIKRLASRSIFASKPSLKIFIYTGSAGAACGVNSGGLLAEVSVPLDLAGTQSKPCVFHDGWIAVGKGAGTGKASSAAQFHLNVKAEPDPRFVXQFDGEPECSPQVVQSQGSIPQPVITC

SEQ ID NO: 1804 - protein, 338 aa, Glycine max
MAAENVVEFTDLPVKRPREEEEGTNGVSNDAVSALPNDPQYPGISAVIPGWFSEISPMWPGEAHSLKMEKILFQGKSDYQNVMVFQSSTYGKVLVLDGVIQLTERDECAYQEMITHLPLCSIPNPKKVLVIGGGDGGVLREVARHASVEKIDICEIDKMVVDVSKQFFPDIAVGFEDPRVTLTVGDGVAFLKDVPEGTYDAVIVDSSDPIGPAQELFEKPFFASVAKALRPGGVVCTQAESIWLHMHIIEDIVANCRQIFKGSVNYAWTTVPTYPSGMIGFMLCSTEGPLVDFKHPVNPLSENDSQQSRPLKFYNSEIHTAAFCLPSFAKRKIGSKTN

SEQ ID NO: 1805 - protein, 207 aa, Oryza sativa
SPGTTRTLSYLIRTPGRGRTYWGDEMTTLSGIYDIIPEMERCEFDFEPCGYSMNAIHGSAVSTIHVTPEDGFSYASYEVVGFDASTLAYGDLVKRVLRCFGPSEFSVAVTIFGGHGHAGTWAKELNADAYKCNNMVEQELPCGGLLIYQSFDATEDVPVAVGSPKSVLHCFEAENMVNPAPVKEGKLANLLPWGEDALEENDGVFDE

SEQ ID NO: 1806 - protein, 461 aa, Shigella flexneri
MADNKPELQRGLEARHIELIALGGTIGVGLFMGAASTLKWAGPSVLLAYIIAGLFVFFIMRSMGEMLFLEPVTGSFAVYAHRYMSPFFGYLTAWSYWFMWMAVGISEITAIGVYVQFWSPEMAQWIPALIAVALVALANLAAVRLYGEIEFWFAMIKVTTIIVMIVIGLGVIFFGFGNGGQSIGFSNLTEHGGFFAGGWKGFLTALCIVVASYQGVELIGITAGEAKNPQVTLRSAVGKVLWRILIFYVGAIFVIVTIFPWNEIGSNGSPFVLTFAKIGITAAAGIINFVVLTAALSGCNSGMYSCGRMLYALAKNRQLPAAMAKVSRHGVPVAGVAVSIAILLIGSCLNYIIPNPQRVFVYVYSASVLPGMVPWFVILISQLRFRRAHKAAIASHPFRSILFPWANYVTMAFLICVLIGMYFNEDTRMSLFVGIIFMLAVTAIYKVFGLNRHGKAHKLEE

SEQ ID NO: 1807 - protein, 222 aa, Brassica napus
  misc_feature (22)..(22): Xaa can be any naturally occurring amino acid
MDATKEASVPDQKRPREEDDQXTAAGAAMETDNSAPASNGEQTKKPACISSVIPGWFSEMSPMWPGEAHSLKVEKVLFQGKSDYQDIIVFQSATYGKVLVLDGVIQLTERDECAYQEMITHLPLCSIPNPKKVLVIGGGDGGVLREVARHSSVEQIDMCEIDKMVVDVSKQFFPNVAIGFEDPRVNLVIGDGVAYLKNAAEGSYDAVIGDSSDPIGPAKELV

SEQ ID NO: 1808 - protein, 90 aa, Zea mays
  misc_feature (21)..(21): Xaa can be any naturally occurring amino acid
LRVRPRVRNRSTGPARCYRAXMNMPYAKSRYCRGVPDPKIRIYDVGMKRKGVAEFPDGVHLVCWEKEKDPSEALEAARIARNKYMTKCAG

SEQ ID NO: 1809 - protein, 242 aa, Pseudoalteromonas tunicata
MANVSMRDMLQAGVHFGHQARYWNPKMKPFIFGARNRVHIINLEHTVPMFNEALSFLRNVASNKGKILFVGTKRAASEAVKEAAQRSDQYYVNHRWLGGMLTNWKTVRQSIKRLKELEIQSQDGTFEKLTKKEALMLSREMDKLEKSLGGIKDMGGLPDALFVIDADHEHIAIREANNLGIPVVSIVDTNSNPDGVDFIVPGNDDAIRAVQLYTGAVAQNIIEGRESNLVVQAEKDDFVEAE

SEQ ID NO: 1810 - protein, 576 aa, Oryza sativa
MQFNLFLPANACSFPRGEYLCVFIFVFGSHCSIVASMTTVASLSLLPHLLIKPSFRCCSRKGVGRYGGIKVYAVLGDDGADYAKNNAWEALFHVDDPGPRVPIAKGKFLDVNQALEVVRFDIQYCDWRARQDLLTIMVLHNKVVEVLNPLAREFKSIGTLRKELAELQEELAKAHNQVHLSETRVSSALDKLAQMETLVNDRLLQDGGSSASTAECTSLAPSTSSASRVVNKKPPRRSLNVSGPVQPYNPSLKNFWYPVAFSSDLKDDTMVPIDCFEEQWVIFRGKDGRPGCVMNTCAHRACPLHLGSVNEGRIQCPYHGWEYSTDGKCEKMPSTKMLNVRIRSLPCFEQEGMVWIWPGNDPPKSTIPSLLPPSGFTIHAEIVMELPVEHGLLLDNLLDLAHAPFTHTSTFAKGWSVPSLVKFLTPSSGLQGYWDPYPIDMEFRPPCMVLSTIGISKPGKLEGKSTKQCSTHLHQLHICLPSSRNKTRLLYRMSLDFAPWIKHVPFMHILWSHFAEKVLNEDLRLVLGQQDGCQWRKCLELASIICKLGIRYRLWRDAIERGVDRLPFSNQSESGS

SEQ ID NO: 1811 - protein, 159 aa, Corynebacterium glutamicum
MTSIHDISVTLNDGTETTMADWAGHLLLIVNVASKCGLTPQYEGLQKLYEEYQDRGFFVIGVPCNQFNGQEPGTDAEVCAFAQNQYDVTFPLLSKTEVNGEGTHPLYKVLKEATDGSEIEWNFEKFLVDAEGNTIKRFAPRTEPSAAEVVEAIEENLPI

SEQ ID NO: 1812 - protein, 83 aa, Glycine max
MAAEPKESPSNNPGLHTTPDEATKGYIMQQTMFRIKYPKVSLDFYSRVLGMSLLKRLDFPEMKFSLYFMGYENTGLKSLIGKQ

SEQ ID NO: 1813 - protein, 556 aa, Francisella tularensis
MSENFKELFEQSLKQTEMRIGKIIEATVVSIDKEFAMIDAGLKSESFIPVSSLKNSNGELEVAAGDRINVVLEALDNSCGETRLSRDKAKKIELWDRIEKAFENNETVLGKITNHVRGGYTMDVEGLRAFLPGSLVDTRPIKDVAHLEYKDIELKVVKIDTKRNNIVVSRKAVIEENNSGDRDAMLEKISEGSVLKGIVKNITDFGAFIDLGGVDGLLHITDISWSRISHPTDVLSIGQEIDVKVIKFDKEKQRISLGIKQLGEDPWLNIANELPVCAKLMGTVTNITDYGCFVKLKEGIEGLVHTSEMDWTNKNVNPHKAVSIGQEVEVIVLELDADNHRISLGIKQCRPNPWSEFEKNYKPGDKVTGKIRSITEFGVFIGLEGGIDGLVHISDVAWDNPAKAIKELKKGDEVEAVLVSVNTDLERIALSMKQLSEDPFKNFINIHPKGSLVTGKVTKVQDNGAVVMLDEDNNIDGFIRISEISAEHTKDVRDELSEGQEVEARIINIDAKKRSITLSIKAVDEDNTAAGKSNYKVEQMTPTTLGDLIKEQLNKK

SEQ ID NO: 1814 - protein, 636 aa, Oryza sativa
MDGCDCIEPLWPTDELLIKYQYISDFFIALAYFSIPLELIYFVKKSSFFPYRWVLIQFGAFIVLCGATHLINLWTFTTHTKTVAMVMTVAKVSTAVVSCATALMLVHIIPDLLSVKTRELFLKNKAEQLDREMGLIRTQEETGRHVRMLTHEIRSTLDRHTILKTTLVELGGTLGLEECALWMPSRSGSSLQLSHTLRHQITVGSTVSINLPVVNQVFSSNRAIIIPHTSPLARIRPLAGRYVPPEVAAVRVPLLHLSNFQINDWPELSAKSYAIMVLMLPSDSARKWHVHELELVEVVADQVAVALSHAAILEESMRARDLLMEQNVALDLARREAEMAIRARNDFLAVMNHEMRTPMNAIIALSSLLLETELTPEQRLMVETVLKSSNLLATLINDVLDLSKLEDGSLELEIKAFNLHAVFKEVMSFIKPIAAIKRLSVSVMLAPDLPLCAIGDEKRLMQTILNISGNAVKFTKEGHITLVASVVKADSLREFRTPDFHPTASDDNFYLKVQIKDTGCGISPQDLPQVFTKFAQSQPGGNRGYSGSGLGLAICKRFVTLMGGHIWLDSEGTGRGCTVTFVIQLGICDNTNAYQQKLIPLVWPSSGDADFVGPVPNAPNEEKGQASLKSRYQRSI

SEQ ID NO: 1815 - protein, 110 aa, Oryza sativa
MRRGQQWRRPTRCEEELPVGAVRSTAHEGWPAGGAGVVVPHVGRGWTVWSIGAPAMDSQVVPSSRVLQETCNYIRSLHQEVDDLSERLSELLATSDMSSAQAAIIRSLLM

SEQ ID NO: 1816 - protein, 135 aa, Unknown
  Vibrio sp. Ex25
MSELTKTLLNIRSLRAFSRELTLEQLEEALDKLTTVVEERREAEEAERAAQAEQEAKLAEIAEKIAQDGIDVEALITALSGETKTKGKAKRAPRPAKYKYTDSNGNEKTWTGQGRTPSAIQEQLDAGKSLDDFLI

SEQ ID NO: 1817 - protein, 471 aa, Chlamydia muridarum
MDKQKRFLSLVFLTFTLFGIWFCPHSDFVDPKAWHLFAIFTTTILGIILQPAPMGAIVIMGISLLLVTKTLTLDQALSGFHSPIAWLVFLSFSIAKGVIKTGLGERIAYFFIKVLGKSPLGLSYGLVLTDFLLAPAIPSLTARAGGILFPVVMGLSESFGSSVEKGTEKLLGSFLIKVAYQSSVITSAMFLTAMAGNPIVSALASHSGVALTWAIWAKAAILPGIVSLACMPFVLFKLFPPQITSCEEAVETAKIRLKEMGPLKQGERIILLIFSLLISLWTFGDSIGVSATTTALIGLSLLVLTDILDWQQDVLSNTIAWETFLWFGALIMMASFLSSFGFVNFVGDSVIGMVQGLSWKIGFPVLFLIYFYSHYLFASNTAHIAAMYPIFLTVSISLGVNPMFAALALAFASNLFGGLTHYGSGPAPLYFGSQLVSVQEWWRSGFILSIVNLIIWLGLGSWWWYCLGLIR

SEQ ID NO: 1818 - protein, 517 aa, Candida albicans
MKNFNALSRLSILSKQLSFNNTNSSIARGDIGLIGLAVMGQNLILNMADHGYTVVAYNRTTAKVDRFLENEAKGKSILGAHSIKELVDQLKRPRRIMLLVKAGAPVDEFINQLLPYLEEGDIIIDGGNSHFPDSNRRYEELAKKGILFVGSGVSGGEEGARTGPSLMPGGNEKAWPHIKDIFQDVAAKSDGEPCCDWVGDAGAGHYVKMVHNGIEYGDMQLICEAYDLMKRVGKFEDKEIGDVFATWNKGVLDSFLIEITRDILYYNDPTDGKPLVEKILDTAGQKGTGKWTAVNALDLGIPVTLIGEAVFSRCLSAMKAERVEASKALKGPQVTGESPITDKKQFIDDLEQALYASKIISYTQGFMLMNQAAKDYGWKLNNAGIALMWRGGCIIRSVFLAEITAAYRKKPDLENLLLYPFFNDAITKAQSGWRASVGKAIQYGIPTPAFSTALAFYDGLRSERLPANLLQAQRDYFGAHTFKVLPGQENELLKKDEWIHINWTGRGGDVSSTTYDA

SEQ ID NO: 1819 - protein, 351 aa, Unknown
  Acinetobacter sp. ADP1
MNAIPVVNLVNKPCYSQFEDQDWEILSQHWYPVARIEEVSMQPQQVTLLDVKMALYKTASGDIHLVRDICPHRGVPLTKGWVEGEEIVCPYHGLRYNAEGKCTKIPAQPELTKISDRFSLTKFPVIQKYGLIWTSIQNRNVASANLPELDTWDMPEHQAILPPFVDIAGSSGRQLEGFIDVAHFAWVHHEAFASRENPVVPKYSTVKTDYGLRTEYMSDVSNYPHELQHLAPKDFLWKRTFDVYPPFSAVLTVDFPNDGVLKILNACCPISPNKTRLFVPLTRNFDTTGDLQAVYDFNAQIFAEDQEMVEAQKPEELPLDLTMEAHFEADRSSTMYRRILADLGLSKRYIV

SEQ ID NO: 1820 - protein, 246 aa, Triticum aestivum
  misc_feature (181)..(181): Xaa can be any naturally occurring amino acid
  misc_feature (204)..(204): Xaa can be any naturally occurring amino acid
MQLNTMSHLPHEPEFEQAYGELASALENSSLFNEHPEYRTALAVAAIPERVIQFRIVWEDDKGNLQVNRGYRVQFNSALGPYKGGLRFHPSVNLSILKFLGFEQIFKNALTGLSMGGGKGGADFDPKGKSDAEIRRFCQSFMTELSKHIGAETDVPAGDIGVGGREIGYLFGAYRKLRNRXWEGVLTGKGLFWGGSLIRPEATXGYGLVYYVDYMLKHANRGSFEGKRVALSGSGHVAQYAALRSS

SEQ ID NO: 1821 - protein, 290 aa, Campylobacter jejuni
MKIALIQQKFHLNKEQTIKKTCEFIEEASKQGAELVCLGELHQSEYFCQSENVDFFDYANDYEKDVKFWANIARKNQIVLIASLFEKRSAGLYHNTAVVFEKDGSIAGKYRKMHIPDDPCFYEKFYFTPGDLGFEPINTSLGKLGVLICWDQWYPEAARIMALKGAEILIYPTAIGWFDKDKDEEKQRQLNAWLGVQKGHAIANGLYVVAINRVGFEKDVSGVEEGIRFWGNSFVFGPQGEELCLLDSQNECVKIIEIDKKRSENVRRWWPFLRDRRIEYFADLTKRFID

SEQ ID NO: 1822 - protein, 182 aa, Idiomarina baltica
MSNTTQFQKATLGGGCFWCIESAFNQLKGIESAQSGYTGGTTENPTYKQVCNGDTGHAEVVQLTFDPSIISYRQILEIFFTLHDPTQVNRQGNDVGTQYRTSIFYHDDEQQQIALELIDELENDVVFEDPIVTEVAPLDTFYSAEDYHDDYFNRNPENPYCQAVISPKLAKFRKTFAELLRS

SEQ ID NO: 1823 - protein, 458 aa, Prochlorococcus marinus
METKVKEDNVENLVIIGSGPAGYTAAIYAARANLQPLLVTGFNSGGIPGGQLMTTTFVENYPGFPDGVLGPELMDLMKAQAERWGTNLYESDVISIDTSKSPFELKTLEGSIKSNSIIIATGASANRLGVINEDKFWSKGISACAICDGATPQFRNEELAVIGGGDSACEEAAYLTKYGSKVHLLVRSEKLRASAAMIDRVKANSKIEIHWNTKVEKANGTDWLENVETINSHKGNVEIKVKGLFYAIGHTPNTKFLNNKIELDKKGYIACNSGRPETSIEGIFAAGDVVDSEWRQGVTAAGTGCMAALAAERWLAEKNLSKIIVRETSEPEKTLSSSSFNEEVTNEDTFNLNSEWQKGSYALRKLYHESNKPILVIFSSPSCGPCHVLKPQLKRVIKEFDGAVQGIEIDIDKDQEIAKQAGINGTPTIQLFKDKLLKKQWQGVKQRSEFKEAIQNII

SEQ ID NO: 1824 - protein, 245 aa, Triticum aestivum
  misc_feature (38)..(38): Xaa can be any naturally occurring amino acid
  misc_feature (72)..(72): Xaa can be any naturally occurring amino acid
  misc_feature (95)..(95): Xaa can be any naturally occurring amino acid
  misc_feature (131)..(131): Xaa can be any naturally occurring amino acid
  misc_feature (138)..(138): Xaa can be any naturally occurring amino acid
HAFRHNLSSPESMDPTPSRTSPPPPGRGAPVGYPPGAXAPPPGAPAAAYPPQIYAPPGADVAQQAAAQQQQXLQVFWAEQYREIEATTDFKNGGXGVAFIKKIMKADEDVRMIAAEVPVVFVRTCKMFILXELTHRGXWAHAEDNKHRTLQKSDIAAAIARTEVFEFLVDILPRDEAKDAEADVVAGIVTGVAAIPSPALRVATTYPIMAYYYVHQQERINTLIKRISMTKMYCPTEIDIDDKMA

SEQ ID NO: 1825 - protein, 502 aa, Haemophilus ducreyi
MKYLTKSRVIATIAMLGCLSVSAWAETPTNQPESLTDKALKHEKLGVVVESANHKFAEKYRLQYDSWKATAESTDRSSALEADPRLVVLWAGYAFAKEYNKPRGHYYAVTDVREILRTGAPKDENDGPQPMACWTCKGPDVPRLIEEKGERGYFDPKWAKYGAEIVNSIGCADCHDTTSKAFEEGKPALRVARPHVLRALESVGWRFEDLDKHGKRVAVCSNCHVEYYFKDKKDVTFPWAKGVDVDSIEKYYDESQFTDWTHALSKAPMLKTQHPDFEVWSQGVHGKNGVTCIDCHMPKVKDKDGKVYTEHKIGNPFDRFDATCKTCHEQSKQTLQDRVKEHKAQVKEAMIRLEDQIVKAHFEAKVAWDAGATAEEMQDILMAIRHAQWRWDYSAAGHGNHFHAPDVMLHTIATGLDRVADARAKLGVVLTKHGVETPIVMPDISTREKAQKAVGIDIAKDQAAKDEFLRTVVPQWERQARERGLLPEVTPKSVTTPKVDAK

SEQ ID NO: 1826 - protein, 500 aa, Mannheimia haemolytica
MKFLIKSLAVATISILGCLQTALAEEAKTESLTDKAVKHEKLGVKIESANHLFAEKYPLQYDSWKSTAKSTDRGSALEADPRYVILWAGYAFAKDYNKPRGHFYAVTDVRDILRTGAPKDENDGPQPMACWTCKGPDVPRLIEEKGERGYFDPKWAKYGAEIVNSIGCADCHDTTSEEFKQGKPALRVARPHVLRALNTVGWKFEDLDKHGKRPAVCANCHVEYYFKNKTDVTFPWDKGVDVDSIEKYYDEINFTDWTHALSKAPMLKTQHPDFEVWSQGTHGKNGVTCIDCHMPKVKDKDGKVYTDHKIGNPFDQFEATCKTCHEQSKETLEKRVKEYKHEVKEAMIRLEDQLVKAHFEAKAAWEAGATQEEMKEILMAIRHAQWRWDYSAAGHGNHFHAPDVMLRTIATGIDRAADARAKLGVVLAKHGVTTPVAIPDISTKEKAQLAIGLDIPKEQAAKDEFLKTVVPQWEKEARAKGLLPAEEADKPVAAPKAEAK

SEQ ID NO: 1827 - protein, 483 aa, Thermococcus kodakarensis
MCLIAGGMGGNLREKLIKMAIAGKHRGPESFGVWTDGGVLKSDDFSKLTEIPDGRIGLLQCRLAITGSKSFTQPFINDLALVHNGEIYNHAALREYLERRGVSFESDVDSEVVLRLIEFLREEHLSYPEIVKKLFWMLEGDYAVAFSDGERIYLFRDPLGIRPLYFSRNGLFASEKKVLWAVGEREVEPVQPGELVVLEKNGVRRARLFSLENLKSKAKCERKDPVGGVGKLLRYAVKNRVSKKTGVLFSGGLDSTLVAYLASQYSDVILYTAGTEDSPDIEWARKVADHFGWALRERTFEVEDVRDAVKRVMYAIEEPNPMNLAIGLPLYFASGLASSDGTRVLLSGQGADELFGGYAKYLERPELMEEDIALISERNLARDDKITMLNGVEGRYPFLALPVVSFALKLPLEAKIVDGTRKVILRKLALRLGIPEWIAEREKRAAQYGSRAQKLLEKIAREEGLTLREFAEKLFRETFPNAF

SEQ ID NO: 1828 - protein, 467 aa, Unknown
  Shewanella sp. MR-4
MMKKMTGKSFALSALVAASFMAAGAMASDKTEPRNEVYKDKFANQYNSWHDTAKSEEITDALAGDPSLVILWAGYGFAKDYNAPRGHMYAVTDVRNTLRTGAPTNAEDGPMPMACWSCKSPDVPRLIEEQGEDGYFKGKWAKGGPEVVNTIGCSDCHEKGTPKLRISRPFAERGMEALGTPFDKASKKDKQSMVCGQCHVEYYFEKKDDRKGFVKFPWDSGTTVEQMEAYYDAIEFSDWTHSLSKTPMLKAQHPGYETWKMGVHGKNDVSCVDCHMPKVTNDKGRKYTDHKVGNPFDRFDETCATCHSQSKEFLEGITKERYAKVKELKARAEGQLVKAHFEAAKAWEVGATEAEMKPILTDIRHAQWRWDFAIASHGVAAHAPEEALRILGTAVDKAADARVKLAQLLAKKGVTDAVAIPDISTKAKAQAALGMDMDKMNAEKEAFKKDMLPKWDAEAKKREATYK

SEQ ID NO: 1829 - protein, 225 aa, Arabidopsis thaliana
MVMETESKFHVLAVDDSLFDRKMIERLLQKSSCQVTTVDSGSKALEFLGLRVDDNDPNALSTSPQIHQEVEINLIITDYCMPGMTGYDLLKKVKESAAFRSIPVVIMSSENVPARISRCLEEGAEEFFLKPVKLADLTKLKPHMMKTKLKKESEKPVAIEEIVVSKPEIEEEEEESSVIEILPLHQEIESEQLEPMLSSNKRKAMEEVVSTDRSRPKYNDITTSV

SEQ ID NO: 1830 - protein, 382 aa, Schizosaccharomyces pombe
MQIFVKTLTGKTITLEVESSDTIDNVKSKIQDKEGIPPDQQRLIFAGKQLEDGRTLSDYNIQKESTLHLVLRLRGGMQIFVKTLTGKTITLEVESSDTIDNVKSKIQDKEGIPPDQQRLIFAGKQLEDGRTLSDYNIQKESTLHLVLRLRGGMQIFVKTLTGKTITLEVESSDTIDNVKSKIQDKEGIPPDQQRLIFAGKQLEDGRTLSDYNIQKESTLHLVLRLRGGMQIFVKTLTGKTITLEVESSDTIDNVKSKIQDKEGIPPDQQRLIFAGKQLEDGRTLSDYNIQKESTLHLVLRLRGGMQIFVKTLTGKTITLEVESSDTIDNVKSKIQDKEGIPPDQQRLIFAGKQLEDGRTLSDYNIQKESTLHLVLRLRGGLF

SEQ ID NO: 1831 - protein, 497 aa, Prochlorococcus marinus
MAVSYLKRETSPKQTIFNKEDWSSAYCNVEKELDHVQLKLVKGSIPEQISGTFYRNGPGRLERGGRWVHHPFDGDGMIAAFKFDNGKINLTNRFVRTKEWTEEEKSQKFLYRGVFGTQKEGGVLANAFDVRLKNIANTHVIKLGDDLLALWEASSPYSLNPNTLETKGLSNLKGVLKKGEAFSAHPRFDPGHHQSQRMVTFGVSTGPKSTIRLMEFSTKGENIGSLLSDRKDSFNGFAFLHDFAITPNWAIFLQNAISFNPLPFLLGQKGAAQCLASKSDGTPKFLLIPRDSGKFAGQPPKSVDAPKGFVFHHLNAWEDNEKINIESIFYDDFPSIGPEDNFREIDFDLLPEGILKRSEINPIENTFTCSTISNQCCEFAMVNPHFEGLKARFSWMATAEEKEGNGPLQAIKKIDLSNNKEISWSAAPRGFVSEPIFIPSQESKSEEDNGWVVALVWNSIRSGTDLIILDSKDLTEKAILEVPISIPHGLHGSWVEN

SEQ ID NO: 1832 - protein, 374 aa, Prochlorococcus marinus
MADFYQILGVSRDADANTLKSAYRKLARQYHPDVNKDPGAEDKFKEIGKAYEALADPETRARYDQFGEAGIGGAAGMPDMGDMGGFGDLFETFFNGFGGQSSQGGRSQRRGPQQGDDLRYDLNIDFKDAIFGQQREIKIPHLETCDICRGSGAKKGTGPINCTTCGGSGQVRRATRTPFGNFTQVAECPTCNGVGQVISDPCASCGGNGVKQVRKKLRINIPAGVDSGTKLRVSGEGNVGLKGGPPGDLYVFIKVKSDPNLKRDGINIYSEISVSYLQAILGDTLDIMTVDGKVNLKIPSGTQPNSTLSLENKGVPRLGNPVARGNHQVLVKVKLPTRITDEERNLLENLASKYSEHNSNSNSGLFSKLFGKES

SEQ ID NO: 1833 - protein, 434 aa, Corynebacterium glutamicum
MGVTEQPYTLIIGGGQGGIALGARLKRLGVPALIIDKASRPGDQWRSRYHSLCLHDPVWYDHLPYIPFPDHWPVFTPKDKMGDWLEHYVGIMDLDYWTNTECLRASYNEDTKQWDVTVNRDGAESTLHPTQLVMATGMSGSPNKPTLPGQDKFQGEIRHSSEHPGGDVDRDKNVVVLGANNSAHDICADLYSNGAKPVMIQRSSTHIVRSDSLMREVFGPLYSEDAVEAGIDTDTADLLFASWPYKVLPGVQKQAFDKIREDDKEFYDKLENAGFLLDFGDDDSGLFLKYLRRGSGYYIDVGASELVADGKIPVRSNVSIEDVKENSVVLTDGTELPADVIVLATGYGNMNNWVAQLVDQETADKVGPCWGLGSETTKDPGPWEGELRNMWKPTNVDSLWFHGGNLHQSRHYSRYLSMQLKARYEGMNTPVYSK

SEQ ID NO: 1834 - protein, 504 aa, Prochlorococcus marinus
MVQSMPTLEYKMTKFQSIFWHRRDLRFGDNIGLFEASKNSKSLIGVYVLDPNLLDLNRTTSEAKNWFLGESLLELQKNWEIRGSLLLILNGDPIELISKLAELVHAECIYWNENIEPYEINRDKQIAEKLSKEKRKVYTFLDQLIVNPSDIKTNNDEPYKVYGPFYRKWIDIINRTKSSDNNLIQTSETAKKLTGLNERELSSIKNSDLNYCITKKSKSIYELLSSNRFSNTSLCPCKPGESESIKQLNSFIHSGVINSYNQARDIPSLENTSNLSAALSLGTISCRAVWNGAQVSKSSTHDEYKINSIDTWIKELAWREFYQNALINFPELEKGPYREKWLNFPWQNRPDWFEAWGDGLTGIPIIDAAMRQLKCSGWMHNRCRMIVASFLVKDLLIDWRLGELFFMKSLVDGDLAANNGGWQWSASSGMDPKPMRIFNPFRQASKFDEDGEYIRKWIPELSHISTPNLLSGEISSAERNSYPNPIINHKNQTSIFKELYSNIK

SEQ ID NO: 1835 - protein, 389 aa, Mycoplasma genitalium
MAAGKRDYYEVLGISKNASSQDIKRAFRKLAMQYHPDRHKAENETTQKQNEEKFKEVNEAYEVLSDEEKRKLYDQFGHEGLNASGFHEAGFNPFDIFNSVFGEGFSFGMDGDSPFDFIFNRSKKRQQQIVVPYNLDIALVIEINFFEMTNGCNKTIKYERKVSCHSCNGFGAEGGESGLDLCKDCNGNGFVIKNQRSIFGTIQSQVLCSTCNGQGKQIKVKCKTCRSNKYTVTNQIKEINIPAGMYSGEALVDESGGNEFKGHYGKLIIQVNVLASKIFKRSDNNVIANVLVDPMVAIVGGVIELPTLEGIKEFNIRPGTKSGEQIVIPNGGIKFSKSFKRKAGDLIIIISYARPCEYTNLELKKLREFIKPNQEVKQYLNTLKNEYKT

SEQ ID NO: 1836 - protein, 356 aa, Datisca glomerata
MSLLSDLVNLNLSDSTEKVIAEYIWIGGSGLDIRSKARTLPGPVSDPSKLPKWNYDGSSTGQAPGKDSEVILYPQAIFRDPFRRGNNILVMCDAYTPAGEPIPTNKRCAAAKIFSHPNVVAEVPWYGIEQEYTLLQKDVKWPIGWPVGGFPGPQGPYYCGVGADKAFARDVVDAHYKACLYAGVNISGINGEVMPGQWEFQVGPSVGISAGDELWVARYILERITEIAGVVLSFDPKPIQGDWNGAGAHTNYSTKSMREKGGYEVIKKAIEKLGLRHKEHIAAYGEGNERRLTGRHETADINTSLWGVANRGASIRVGRDTEKEGKGYFEDRRPASNMDPYVVTSMIAETTLLWKP

SEQ ID NO: 1837 - protein, 398 aa, Aspergillus niger
MASNDKGLEEIPEGQIETNYDEVTDSFDSMDLKPELLRGVYAYGFERPSAIQQRAIKPIIAGHDVIAQAQSGTGKTATFSISALQKIDQELKACQALIVAPTRELAQQIQKVVVAIGDFMNIECHACIGGTNVRDDMNALRAGPQVVVGTPGRIHDMIERRVLKTDQMKLFILDEADEMLSRGFTEQIYDIFQLLPQSTQVTLLSATMPQDVLEVTTKFMRDPIRILVKKQELTLEGIKQFYIAVEKEEWKLDTLSDLYETVTITQAVIFCNTRRKVDWLTDKLTARDFTVSAMHGDMEQGQRDVIMKEFRSGSSRVLIATDLLARGIDVQQVSLVINYDLPANRENYIHRIGRGGRFGRKGVAINFVTADDVRMMREIEQFYSTQIEEMPMNVADLI

SEQ ID NO: 1838 - protein, 150 aa, Arabidopsis thaliana
MAPKAEKKPAEKKPASEKPVEEKSKAEKAPAEKKPKAGKKLPKEAGAGGDKKKKMKKKSVETYKIYIFKVLKQVHPDIGISSKAMGIMNSFINDIFEKLAQEASKLARYNKKPTITSREIQTAVRLVLPGELAKHAVSEGTKAVTKFTSS

SEQ ID NO: 1839 - protein, 652 aa, Ipomoea trifida
MAPAGKVTSFYRQGNDWFCNASLPSDISLIVDGVNFHLHKFYSGVIYDTLNSNLTTKKMLTVQFPLISKCGRIFKALEEAEGTNGQTSTTRLEDFPGGADIFLVTVKYCYGCRVEFTPRNIVMVYCAADYLEMTDEYGENNLLSKSDDYFHKNVLTNWKDCILALQSCNSMIPRAIKLQIIGKCLNALSVMVCTDPSLFGWPMLMYGSLQSPGGSILWNGINTGARIQSTASDWWFEDISYLSVPLFERLIQTMETKGIKPESLAGAIMHYCRKYLPGLGRWQSGQIVTSRTVASFSMTPATVDQKDLLESIVKLLPTKKGKSFCRFLLGLLRVALILGINHSCQETLERRIGMQLHLATLDSLLIPSYSDSDTLYNTDCVERMIHHFISEPAVTTVSPSSFDLGTSPSSEPLCRVAKLMDSYIAEIASDVNLKPERIRALAEALPDSSRSLHDGLYRAVDIYFKAHPWLPDRDKEQLCNIIDFQKLSIDACAHASQNERLPLRIILQVLFFEQLQLRTALAGCLHVLDTESANAAPAAGPSDMAGHIVQRDGWVTVVRENQVLRVDLERMRSRVRELEEEFSKIKQEMRKVSKSHSHLSSPRFLARRMGCKLLPRSSDAQPDVIGSTGPTPRASVEHPRTSGGHRKSFSLF

SEQ ID NO: 1840 - protein, 396 aa, Aspergillus terreus
MADKGLEDLPEGMIESNYEDVTDSFDSMELKAELLRGVYAYGFERPSAIQQRAIMPIIKGNDVIAQAQSGTGKTATFSISALQKIDPNLKACQALIVAPTRELAQQIQKVVVAIGDFMNINCHACIGGTAIRDDMKALQEGPPIVVGTPGRIQDMIQRRVLKTDQMKLFILDEADEMLSRGFTEQIYDIFQLLPQATQVVLLSATMPQDVLEVTTKFMRDPVRILVKKQELTLEGIKQFYIAVEKEEWKLDTLSDLYETVTITQAVIFCNTRRKVDWLTDKLTARDFTVSAMHGDMEQSQRDIIMKEFRSGSSRVLIATDLLARGIDVQQVSLVINYDLPANRENYIHRIGRGGRFGRKGVAINFVTADDVRMMREIEQFYSTQIEEMPMNVADLI

SEQ ID NO: 1841 - protein, 986 aa, Lotus japonicus
MRIRVSYLLVLCFTLIWFRWTVVYSSFSDLDALLKLKESMKGAKAKHHALEDWKFSTSLSAHCSFSGVTCDQNLRVVALNVTLVPLFGHLPPEIGLLEKLENLTISMNNLTDQLPSDLASLTSLKVLNISHNLFSGQFPGNITVGMTELEALDAYDNSFSGPLPEEIVKLEKLKYLHLAGNYFSGTIPESYSEFQSLEFLGLNANSLTGRVPESLAKLKTLKELHLGYSNAYEGGIPPAFGSMENLRLLEMANCNLTGEIPPSLGNLTKLHSLFVQMNNLTGTIPPELSSMMSLMSLDLSINDLTGEIPESFSKLKNLTLMNFFQNKFRGSLPSFIGDLPNLETLQVWENNFSFVLPHNLGGNGRFLYFDVTKNHLTGLIPPDLCKSGRLKTFIITDNFFRGPIPKGIGECRSLTKIRVANNFLDGPVPPGVFQLPSVTITELSNNRLNGELPSVISGESLGTLTLSNNLFTGKIPAAMKNLRALQSLSLDANEFIGEIPGGVFEIPMLTKVNISGNNLTGPIPTTITHRASLTAVDLSRNNLAGEVPKGMKNLMDLSILNLSRNEISGPVPDEIRFMTSLTTLDLSSNNFTGTVPTGGQFLVFNYDKTFAGNPNLCFPHRASCPSVLYDSLRKTRAKTARVRAIVIGIALATAVLLVAVTVHVVRKRRLHRAQAWKLTAFQRLEIKAEDVVECLKEENIIGKGGAGIVYRGSMPNGTDVAIKRLVGQGSGRNDYGFRAEIETLGKIRHRNIMRLLGYVSNKDTNLLLYEYMPNGSLGEWLHGAKGGHLRWEMRYKIAVEAARGLCYMHHDCSPLIIHRDVKSNNILLDADFEAHVADFGLAKFLYDPGASQSMSSIAGSYGYIAPEYAYTLKVDEKSDVYSFGVVLLELIIGRKPVGEFGDGVDIVGWVNKTMSELSQPSDTALVLAVVDPRLSGYPLTSVIHMFNIAMMCVKEMGPARPTMREVVHMLTNPPQSNTSTQDLINL

SEQ ID NO: 1842 - protein, 860 aa, Marchantia polymorpha
MAVTKRESRSVMDASGKYVRYTNEQVEALERVYNECPKPSSIRRQQLIKDCPILANIEPKQIKVWFQNRRCREKQRKEATRLLSVNAKPTALNKLLMEENERLSKHTSQLAIENQYLRQHTSSERNLKPSRRLHEQAGMATPDTSSESVVTGGLQRHPTPQHPPRDASPAGLLAIAEETLTEFLAKATGTAIDWIQMPGMKPGPDSIGIVAISHGCAGVAARACGLVGLEPTKVADVLKDRPAWLRDCRRLDVLGAFPTGNGGTVELIYTQMYAPTTLAPARDFCALRYTSFLEDGNLVICERSLSGAHGAPTMPPVQFFVRAEMLPSGYLIRPCEGGGCIIHIVDHMDLEPWSVPEVLRPLYESSAVLAQKMTMGALRHLRRLAQEIPGEVVLGSDQQPAVLRALSQRLARGFNEAVNGFADDGWTTLPSDGMDDVSVVVNPNPNSKQFGGGPNATDRLCSIGGGILCAKASMLLQNVPPALLIRFLREHRSEWADCEIDADAAAALRSTNYVGSESRGSLCGGQLPLPLAHAVEQEEFLEVVKLEGHSPTQDGGVLNRSDSFLLQLCSGVDENAVGACAQLVFAPVDVAVTDDVPLLASGFRVIPLDSGIVDGYGLSRTLDLTSTLEGGSEARLVGDSGASACHLRSVLTIAFQFAFEVYTGDSVAAMARQYVRTVVASVQRVAMALAPSRLGSHLGGTRHPPPATPEALVLARRVLQSYRSYMGMELTRELERTDYSNSEALFKIFWNHSDAILCCACKSLPEFTFGNRAGLEMLETSSGALQELTWEKTLDENGRKTAYSDFTQVMTQGYACLPAGVRISSMGRPATYQQAIAWKVVDEDDHTHCIAFMFTNWSFL

SEQ ID NO: 1843 - protein, 737 aa, Physcomitrella patens
MDSSGKYVRYTNEQVEALERVYHECPKPSSIRRHQLIKECPILANIEPKQIKVWFQNRRCREKQRKEATRLVSVNAKLTALNKLLMEENERLAKHASQLTLDNHALRQQLPNLPVPDGKCRLSGQAGVASTDTSCDSAVTGGLPQHLTSQHSSPDASPAGLLSMAEETLTDFLAKATGTAVDWIQLPGMKPGPDAIGIIAISHGCVGIAARACGLAALDFSKVAEILKDRPGWSQDCRRMEVLGTLPTGNGGTIELLYTQMYAPTTLAPARDFCTLRYTTLLEDGNLVICERSLTGKHNGPTMPPVQSFIRAEMFPSGYLIRPCEGGGCIIHIVDHVEYEPWSVPEVLRPLYESPAVLAHKSTIAALRYLRRIAAEESGEIIIRNGQHPAVIRTLSQRLTKGFNDAVNGFGDDGWVPMESDGMDDVSVMLNATPKSMEGQIATDKLLFSLGGGILCAKASMLLQNVPPALLIRFLREHRSEWADHEIDANAATAFRGASNGHVSRGRMSHVQLPLPLAQFGEQGEFLEVVKLEGHSAVQHSVLSRDSFLLQLCSGIEEGAVGAGAQLVFAPIDAAVSEDIPLLPSGFRVIPVDSSVVDGIGLNRTLDLASTLEDHEAGLNGESKSNGSSSQVRSVLTIAFQFAYEVHTRETCAVMARQYVRTVVASVQRVAMALAPSRGQPRPALGNSDAISLARHILSSYRVQLGMDLVRPEVGGTEALFKVFWHHSDAIVCCAWK

SEQ ID NO: 1844 - protein, 612 aa, Oryza longistaminata
MISLPLLLFVLLFSALLLCPSSSDDDGDAAGDELALLSFKSSLLYQGGQSLASWNTSGHGQHCTWVGVVCGRRRRRHPHRVVKLLLRSSNLSGIISPSLGNLSFLRELDLGDNYFSGEIPPELCRLSRLQLLELSDNSIQGSIPAAIGACTKLTSLDLSHNQLRGMIPREIGASLKHLSNLYLHKNGLSGEIPSALGNLTSLQEFDLSFNRLSGAIPSSLGQLSSLLNMNLGQNNLSGMIPNSIWNLSSLRAFCVSENKLGGMIPTNAFKTLHLLEVIYMGTNRFHGKIPASVANASHLTRLQIDGNLFSGIITSGFGRLRNLTELYLWRNLFQTREQEDWGFISDLTNCSKLQTLNLGENNLGGVLPNSFSNLSTSLSFLALHLNKITGSIPQDIGNLIGLQHLYLCNNNFRGSLPSSLGRLKNLGILLAYENNLSGSIPLAIGNLTELNILLLGTNKFSGWIPYTLSNLTNLLSLGLSTNNLSGPIPSELFNIQTLSIMINVSKNNLEGSIPQEIGHLKNLVEFHAESNRLSGKIPNTLGDCQLLRHLYLQNNLLSGSIPSALGQLKGLETLDLSSNNLSGQIPTSLADITMLHSLNLSFNSFVGEVPTM

SEQ ID NO: 1845 - protein, 308 aa, Propionibacterium freudenreichii
MIYHDVTEVVGRTPLVRLNHVNDTDAVVLAKLEFYNPANSVKDRIGVSIVDAAEKSGALGAGGTIVEATSGNTGIALAMVGAARGYHVVITMPASMSRERRAVLHALGAELVLTPAVEGMRGAVTAAERIAAERGGVLASQFANAANPAAHHATTGPEIWNDTDGEVAALVSGVGTGGTVSGAGRYLKEQDPRVDVYAVEPDESPLLSRGRAAAHGIQGIGANFVPDTYDAAVVDEVLSVTTDQALAMARRLAAEEGILAGISSGAAVAAALEVGARPQYRGRTIVAIIPDFGERYLSTPLFAGLMDS

SEQ ID NO: 1846 - protein, 371 aa, Francisella tularensis
MQQKCYYEILNISKTASGVEIKRAYRKLAMKYHPDRNPGDKEAEIKFKEISEAYEILSDDSKRSRYDQFGHAGVNQQSGFGGTGGFEDIFDTFFGGGTSRGSNRSRASRGSDLEYTLEITLEEAFFGVEKEITIPRMESCDSCDGTGSKSRSKTTCHACHGQGTIRRQQGFFAFEQTCPVCNGTGYSITDPCDACYGNGKVKKQKTLKVKIPEGVDNGDRIRLQGEGDSGSNGAMNGDLYVQIIIKEHKIFERRDINLYCEMPISFTKACLGGDIKVPTLDGEVVLKVVPETQTGKVFRLREKGMKSLRGHRRGDLLCKVVVETPVNLSAEQKELLEKFADSLGEDYQSKHAPKSKTWFDNVKDYAKKFFE

SEQ ID NO: 1847 - protein, 996 aa, Oryza longistaminata
MISLPLLLFVLLFSALLLCPSSSDDDGDAAGDELALLSFKSSLLYQGGQSLASWNTSGHGQHCTWVGVVCGRRHPHRVVKLRLRSSNLTGIISPSLGNLSFLRTLQLSNNHLSGKIPQELSRLSRLQQLVLNFNSLSGEIPAALGNLTSLSVLELTNNTLSGSIPSSLGKLTGLYNLALAENMLSGSIPTSFGQLRRLSFLSLAFNHLSGAIPDPIWNISSLTIFEVVSNNLTGTLPANAFSNLPNLQQVFMYYNHFHGPIPASIGNASSISIFTIGLNSFSGVVPPEIGRMRNLQRLELPETLLEAEETNDWKFMTALTNCSNLQEVELAGCKFGGVLPDSVSNLSSSLVSLSIRDNKISGSLPRDIGNLVNLQYLSLANNSLTGSLPSSFSKLKNLRRLTVDNNRLIGSLPLTIGNLTQLTNMEVQFNAFGGTIPSTLGNLTKLFQINLGHNNFIGQIPIEIFSIPALSEILDVSHNNLEGSIPKEIGKLKNIVEFHADSNKLSGEIPSTIGECQLLQHLFLQNNFLNGSIPIALTQLKGLDTLDLSGNNLSGQIPMSLGDMTLLHSLNLSFNSFHGEVPTNGVFANASEIYIQGNAHICGGIPELHLPTCSLKSRKKRKHQILLLVVVICLVSTLAVFSLLYMLLTCHKRRKKEVPATTSMQGHPMITYKQLVKATDGFSSSHLLGSGSFGSVYKGEFDSQDGEITSLVAVKVLKLETPKALKSFTAECETLRNTRHRNLVKIVTICSSIDNRGNDFKAIVYDFMPNGSLEDWLHPETNDQAEQRHLTLHQRVTILLDVACALEHLHFHGPEPIVHCDIKSSNVLLDADMVAHVGDFGLARILVEGSSLMQQSTSSMGIRGTIGYAAPEYGVGNTASTHGDIYSYGILVLETVTGMRPADSTFRTGLSLRQYVEPGLHGRLMDVVDRKLGLDSEKWLQARDVSPRSSITECLVSLLRLGLSCSQELPSSRTQAGDVINELRAIKESLSMSSDM

SEQ ID NO: 1848 - protein, 322 aa, Propionibacterium freudenreichii
MSAIHDSITELIFNTPLVRAPHYLKAAGAPDADIVLKLEYFNPAGSVKDRIALAMITDAEKRGVLKPGGTIIEPSSGNTGIGLAAVGTARGYKVKVVLPASLSVERRALIQAYGGEVILTPGPLAIKGSIAYAKQLHDADPSSVILGQFDNPANPEIHYKTTGPEIWKDTDGTVDVFIAGIGTGGTLSGAGKYLEEQKPDLKVIGIEPAKSPILEGGKPGPHGIQGIGTGFVPNTLDRSVYDEVVGITDEDSIAQARLLGTAEGIFVGISSGAALTAALQIAARDEYKGKRIVALLPDSGDRYLSTALGQFPELTVHEDVEL

SEQ ID NO: 1849 - protein, 112 aa, Pseudoalteromonas tunicata
MKKIEAIIKPFKLDDVREALSEIDITGMTVCEVKGFGRQKGHTELYRGAEYMVDFLPKVKLDIVLADEDVDRAIDVIIKTAQTGKIGDGKIFVTDIERVVRIRTGEEDEAAI

SEQ ID NO: 1850 - protein, 234 aa, Geobacillus stearothermophilus
SVISMKQLLEAGVHFGWQTRRWNPKMKKYIFTERNGIYLIDIQKTVKKVEEAYNFVRELAANGGKILFVGTKRQAQESVKEEAERCGMFYVNQRRIGGTLTNFATLQKRIKRLREIEKMEEDGVFDVLPKKEVIGLKKEKERLEKFIGGIKDMKELPDALFVIDPRKERIAVAEARKLNIPIIGIVDTNNDPCEGGYVIPANDDAIRAVKLLTSKIADAVLEAKQGEEAAVAAE

SEQ ID NO: 1851 - protein, 391 aa, Herminiimonas arsenicoxydans
MKAMILAAGKGTRVQPLTYELPKPMIPILGKPVMEYLVEHLVKYGITEIMVNVSYLHQKIEDYFGEGQRFGAQIGYSFEGYMTDDGEVMPKPIGSAGGLKKIQEFGGFFDETTLVICGDALIDLDIKSALFEHRQKGALVSIITKEVAPEKTVDYGMVVTDEEGRVLSFQEKPKPEEALSNLASTGIYIFEPEVLELIPSGEEFDIGSQLFPLLVEKGVPFFAQKRFFNWIDIGNVKDYWAVSQSVMLGEMAHMTMPGTQIAEGLWVGLNTSIDWEGTTIEGPVYLGSGSTIEAGSTIIGPTWIGHGSQICSGSKVERSILFAYTRVSPHSSMSELVVCTEYCVSREGKMRHVSDCVQDSWRDARDRRGQTRPAASSATPDTPVRKLEDAA

SEQ ID NO: 1852 - protein, 553 aa, Neorickettsia sennetsu
MNKQQFYITTNKASERRFYSEVPDYNEEDFTTILEERFSDSLIREGDMVEGVIKSISPHFVLVNLGLKSEGKIPVQQFHDLGTLEVGSKIIVYVEKTETGSGNLVLSYTKALKQKVWNRLYEMYLNGSDEDVMGVILYTIKSGCIVEVEGLNAFLPNSHLDVRPVSDPATLVGVKLKFRILKMDPKTGKIFVSRRKALGAVHEAARSEYISTIKEGDIIDGRVKSIASYGVFVQIHESDKVGVVDGLLYVNDISWARVTHPSSIYSVGQEVRVKVIAVDPEKGRISLGVKQLTENPWKDVSKKYTPGNVYPGVVTSVEDYGIFVRLEEGVEGLVHSGEISWTREKPLFLPNSKVNVMLLSVDEEGHKIALSVKQCSDNPWKKFLDAYGLGVVVKCKVVEITDSGIVLTLLDPGYSYVRGYVRLANISWSQNPRKELKRFTIGDEVEAKLVHVNPDRGRVMFNIKYVEYDPFEEFISRVNEKDIINAKVIRVEDDGIYIEVREGLEFFTAQSDVSRLTVGQHLSFVVCSKDHYSVKLEIITDEKAGGAPAGEEK

SEQ ID NO: 1853 - protein, 477 aa, Unknown
  Acinetobacter sp. ADP1
MNQLIWFRNDLRLNDHAALWHATQAGSTIAFVALSPLQWQQHDDAIIKIDFYMRQLTQLKQELNTINIPLIVQIIPLWKDIATEIISISDRYHIQDVYANIETGINEIERDHAVQEALSKIGKNLILFHDKTLFPLGSIRNKSQAPYQVFTPFKKTCYERLNIDIPKCFPYPHKQKQQPEIAKKEAAIPSLKQLGYSQIDQHIQNEWPIGETFALNLLEDFTQDKINRYHESRDYPAQDGTSHISAYLTIGILSIRQCIQAIFQKQHGQFFLNNKGQEIWLNELLWREFYQQLLFDFPKLSRHQPFQDHTKNIPWNENDEHFEAWIQGKTGIPIVDAGMRQLKATGWMHNRVRMICAMFLSKNLLIDWRKGEKWFMQHLIDGDLAANDGGWQWSASTGTDASPYFRIFNPVTQSQKFDPEGVFLKKWIPELKHLDSKHIHDPYAYQHKTELNYPKPIIDLKATRKNAIEVFKKSSSL

SEQ ID NO: 1854 - protein, 73 aa, Unknown
  Acinetobacter sp. ADP1
MANKEELIEFEGVVTETLPNTMFRVRLENGHEVIAHISGKMRKHYIRILTGDNVKVEMTPYDLSKGRITYRAR

SEQ ID NO: 1855 - protein, 197 aa, Blastopirellula marina
MSRTAKISRQTAETQIELELNLDGEGKSEIATGVGFFDHMLELFTRHGCFDLKVKANGDLHVDQHHTVEDVGICLGQAIRQAIGDKKGIRRYGHFTLPMEETLCTTAIDLSGRYFLVFNAQFHSSKIGEFDSELVEDFWQSTAANALCNLHVNVFYSRNSHHVAEAIFKSAARALRMAVERDPRMPGVPSTKGTLSE

SEQ ID NO: 1856 - protein, 348 aa, Arabidopsis thaliana
MAASKLLVSDIASVVDHVPSNYVRPVSDRPKMSEVQTSGDSIPLIDLHDLHGPNRADIINQFAHACSSCGFFQIKNHGVPEETIKKMMNAAREFFRQSESERVKHYSADTKKTTRLSTSFNVSKEKVSNWRDFLRLHCYPIEDFINEWPSTPISFREVTAEYATSVRALVLTLLEAISESLGLAKDRVSNTIGKHGQHMAINYYPRCPQPELTYGLPGHKDANLITVLLQDEVSGLQVFKDGKWIAVNPVPNTFIVNLGDQMQVISNEKYKSVLHRAVVNSDMERISIPTFYCPSEDAVISPAQELINEEEDSPAIYRNFTYAEYFEKFWDTAFDTESCIDSFKASTA

SEQ ID NO: 1857 - protein, 431 aa, Blastopirellula marina
MPNTLARPPKKQHNFRRVAILFAGGPAPAANAVISTAAVSFLRNDVEVLGIKHGYSNLMQFGPDRPMELGRDYIMLDHQALSRSRAQQGIMIGTARANPGKQVSHPDHLKDPERSAPLQTTYDALCSLGVDALISIGGDDTLKTANKFKLFQETLPEGSQKIPVVHLPKTIDNDYMGIDFTFGYFTAVDFLAGEVRNLLYDAEAGQAYFLVECMGRSAGWLPYGTAIAGEASLVISVEDIIGDYVGKEEEVDGRTKKVMNVDKVVDRIVKTMLAREAEGKKFGVIILAEGLAEMLPPEYLEGIKRDDHGHISITEVSLGRQFAKWISKRYEEQTGRSRKVTGLQLGYEARCSKPHAFDVMLGSQLGVGAYRALVEEGLNGVMVSVSGQLNLHYVAFENLVDPETLVTVVRYINPMSDFHRLARFLETYIND

SEQ ID NO: 1858 - protein, 520 aa, Staphylococcus aureus
MAYFNQHQSMISKRYLTFFSKSKKKKPFSAGQLIGLILGPLLFLLTLLFFHPQDLPWKGVYVLAITLWIATWWITEAIPIAATSLLPIVLLPLGHILTPEQVSSEYGNDIIFLFLGGFILAIAMERWNLHTRVALTIINLIGASTSKILLGFMVATGFLSMFVSNTAAVMIMIPIGLAIIKEAHDLQEANTNQTSIQKFEKSLVLAIGYAGTIGGLGTLIGTPPLIILKGQYMQHFGHEISFAKWMIVGIPTVIVLLGITWLYLRYVAFRHDLKYLPGGQTLIKQKLDELGKMKYEEKVVQTIFVLASLLWITREFLLKKWEVTSSVADGTIAIFISILLFVIPAKNTEKHRRIIDWEVAKELPWGVLILFGGGLALAKGISESGLAKWLGEQLKSLNGVSPILIVIVITIFVLFLTEVTSNTATATMILPILATLSVAVGVHPLLLMAPAAMAANCAYMLPVGTPPNAIIFGSGKISIKQMASVGFWVNLISAIIIILVVYYVMPIVLGIDINQPLPLK

SEQ ID NO: 1859 - protein, 388 aa, Yarrowia lipolytica
MQGWRVTMEDAHATVLELKDAKGQPEKKKVAFFGVYDGHGGDKVAIYTGDNLHHIVARQEAFAKGDYGQALKDGFLSTDRAILEDAALKHDSSGCTATTAIVSDGKVICANAGDSRTVLGVKGIAKPMSFDHKPQHEGERTRICAAGGFVEAGRVNGNLALSRAIGDFDFKRSPYFPPEEQIVTAYPDVIEHQLTADDEFLILACDGIWDCFLSQEVVEFVRRGIAEKQTLVDICENLIDNCLAPTSDLSGVGCDNMTVMVVALLQGKTEEEWYNMVAERVKNGEGPAASREAVERVAGEEREVTAQQLQQNAQAQQANSASLALQQLLSSGATITDENGMVVLKAENAAELLAKVGFAPEDVGQLVESGDLVEEDVEVGGDRITEEQ

SEQ ID NO: 1860 - protein, 432 aa, Saccharomyces cerevisiae
MTVNDKKRLAIIGGGPGGLAAARVFSQSLPNFEIEIFVKDYDIGGVWHYPEQKSDGRVMYDHLETNISKKLMQFSGFPFEENVPLYPSRRNIWEYLKAYYKTFIANKDAISIHFSTEVTYLKKKNSQWEITSKDELRTTKSDFDFVIVASGHYSVPKLPTNIAGLDLWFDNKGAFHSKDFKNCEFAREKVVIVVGNGSSGQDIANQLTTVAKKVYNSIKEPASNQLKAKLIETVQTIDSADWKNRSVTLSDGRVLQNIDYIIFATGYYYSFPFIEPSVRLEVLGEGVTGDKHSSVNLHNLWEHMIYVKDPTLSFILTPQLVIPFPLSELQAAIMVEVFCKSLPITTTFDSNACGTHNFPKGKDLEYYAELQELLNSIPRRVGHFEPVVWDDRLIDLRNSSYTDKEERNVLLAEHAQALKKKKAPYFLPAPHT

SEQ ID NO: 1861 - protein, 868 aa, Physcomitrella patens
MDSSGKYVRYTNEQVEALERVYHECPKPSSIRRHQLIKESPILANIEPKQIKVWFQNRRCREKQRKEATRLVSVNAKLTALNKLLMEENERLAKHASQLTLENHSLRQQLPSLPLTNGTHRLSSQNLLKKERAVNGGDESSTQGGICVKLHGQAGVASTDTSCDSAVTGGLPHHLTPRHSPRYTSPAGLLATAEETLTEFLAKATGTAVDWIQLPGMKPGPDAIGIIAISHGCVGIAARACGLVALDAGKVTEVLKDRPAWLEDCRRMEVLGALPTGNRGTIELLYTQMYASTTLAPARDYCTLRYTTILEDGNLVICERSLTGGQNGPSMPPVQSFVRGEMFPSGYLIRPCDGGGCIIHVVDHYDNGPWSVPEVLRPLYESPAVLAQRSTIAALRHLRRLAAEESGEGNPRNGQHPAVLRTLGQRLAKGFKNAVNGFADDGWVSTVSDGLDDVSVILNATSQSMEGQIASDKLLYSLGGGILCAKASMLLQNVPPSILIKFLREHRSEWADYDMDANLATSFRSNGNGYAPQGGGVSHVQLPLPLPNSGEHGEILEVVKLEDHSSVQHMVISRDSFLLQLCSGIDENAVGASAQLIFAPVDVALTEDIPLLPSGFCISPVDANVLDEFDLDHTLDLASTLEGGSDLRLNGDSKSNGTSSHMRSVLTIAFQFAYEVHSHEACAVMARQYLRTVVSSVQRVAMALAPSRGSAPPRQMSANPDALSLARHVLRSYRLHLGLDLTRSENGGDETLFKAFWHHTDAILCCAWKGKPEFVFANRSGLEMFETTTSSLQELDWDKTLNESDCKLSYATFTQVLQQGYCSLPAGVRMSSSGRTATYERALVWKVVDDNETVECIAFLFINWSFVV

SEQ ID NO: 1862 - protein, 443 aa, Unknown
  Candidatus Pelagibacter ubique HTCC1002
MTKVAIIGAGPCGLSALRSFEQAEKNGEKIPEIVCFDKQEDWGGLWNYSWRTGSDQYGDPVPNSMYRYLWSNGPKECLEFADYSFDEHFGKPIPSFPPREVLYNYILGRVKKGNLKSKIKFNTTVTNVSYDNENFEVTYRDKKNDKISKDIFDYVIVSTGHFSVPFIPEYPGMKAFPGRIMHSHDFRDAEEFRGKNVVVLGSSYSAEDVALQCHKYGAKSVTIGYRHNPMGFKWPEGMKEVFHLDRLEGNKAIFKDGHVQETDAVILCTGYLHHFPFMSEDLKLKTGNRLYPPMLYKGVVWQNNHKLMYLGMQDQFHTFNMFDCQAWFARDVIMGKIKTPNDSEIEKDINKWVSMEEKLENADQMIDFQTEYTKELHELSDYPKIDFELIRKTFKEWEHHKVENIMTYRNKSFASPVTGSVGPIHHTPWEEAMDDSLKTFLNK

SEQ ID NO: 1863 - protein, 871 aa, Physcomitrella patens
MDASGKYVRYTQEQVEALERVYHECPKPSSIRRHQLIKESPILANIEPKQIKVWFQNRRCREKQRKEATRLVSVNAKLTALNKLLMEENERLAKHTSQLTLENHALRQQIPNLPFPDGRHRLPSQILQSPLKKEGAVNGGDESSTQGGICVKVHGQAGIASTDTSCDSAVTGGLPHRLTPQHSPRDSSPAGLLATAEETLTEFLAKATGTAVDWIQLPGMKPGPDAIGIIAISHGCVGIAARACGLVALDISKVTEVLKDRPRWLQDCRRMEILGALPTGNGGTIELLYTQMYAPTTLAPARDYCTLRYTTILEDGNVVICERSLSGVQGGPTMPPVQSFVRGEMYPSGYLIRPCDGGGCIIHVVDHYNNEPWSVPEVLRPLYESPAVLSQKSTLAALRHLRRLAAEESGEGVPRNGQHPAVLRTLCQRLTKGFNNAVNGFPDDGWEATISDGLDDVSVMLNATPKSMEGQIASDKLLYSLGGGILCAKASMLLQNVPSSLLIRFLREHRSEWADYDIDANVASFRSNGNGYVPRCGGVSHVQLPLPLAYSGESGEILEVVKVEGHSSVQHMVLSRDTFLLQLCSGVDESAVGACAQLVFAPVDVALADDIPLLPSGFCVSPIDTNVVDGFGLDRTLDLASTLEGGNDLRLNGDAKSSNSPGQMRSVLTIAFQFAYEVHTRETVAAMARQYVRNVVASVQQVAMALAPSRGAPPPRQVPSNPDALSLVRHVLSSYRFHMGIDLIRPENGSDEALFKAFWHHTDAIVCCALKGIPEFVFANRSGLEMFETATASSLKDLDWEKTLNENDRKLSYATFTHVLQQGYCSLPAGVRMSSTGRTATYEQALAWKVLNDSEAVECIAFLFINWSLAT

SEQ ID NO: 1864 - protein, 195 aa, Rhodospirillum rubrum
MEQASKGSGGGDWLIRGVFSLGLALASFGGPASAQAAGAHDYSFPAIDGGTLPLAAWAGHPVLVVNTASECGFTAQYEGLEALWKAYRAKGLIVLGVPSNDFGGQEPGSAAEIKDFCESTFAVDFPLTDKTAVSGARAHPFYAWAKASRPDLSAPRWNFHKYLIAPDGSLAASFSALTDPKDRDLTDAIDKLLEK

SEQ ID NO: 1865 - protein, 635 aa, Solanum lycopersicum
MESCDCIEALLPTGDLLVKYQYLSDFFIAVAYFSIPLELIYFVHKSACFPYRWVLMQFGAFIVLCGATHFISLWTFFMHSKTVAVVMTISKMLTAAVSCITALMLVHIIPDLLSVKTRELFLKTRAEELDKEMGLIIRQEETGRHVRMLTHEIRSTLDRHTILKTTLVELGRTLDLAECALWMPCQGGLTLQLSHNLNNLIPLGSTVPINLPIINEIFSSPEAIQIPHTNPLARMRNTVGRYIPPEVVAVRVPLLHLSNFTNDWAELSTRSYAVMVLVLPMNGLRKWREHELELVQVVADQVAVALSHAAILEDSMRAHDQLMEQNIALDVARQEAEMAIRARNDFLAVMNHEMRTPMHAVIALCSLLLETDLTPEQRVMIETILKSSNLLATLINDVLDLSRLEDGILELENGTFNLHGILREAVNLIKPIASLKKLSITLALALDLPILAVGDAKRLIQTLLNVAGNAVKFTKEGHISIEASVAKPEYARDCHPPEMFPMPSDGQFYLRVQVRDTGCGISPQDIPLVFTKFAESRPTSNRSTGGEGLGLAICRRFIQLMKGNIWIESEGPGKGTTVTFVVKLGICHHPNALPLLPMPPRGRLNKGSDDLFRYRQFRGDDGGMSVNAQRYQRSL

SEQ ID NO: 1866 - protein, 820 aa, Selaginella kraussiana
MRMTKDKGGDLDSGKYIRYTPEQVEALERVYHECPKPSSIRRQQIVRDYPVLANIEPRQIKVWFQNRRCREKQRKETSRLQSVNSSLTAMNKIIMEENERLTKHSSQLSLDNQLLRQQLQQLRNNQDPDRKSSDRLNDQALALADRSPDSEVTGGVPHHHLTMAPQSPRDSSPAGLLSIAEETLNSFLAKATGTLVDWIQIPGMKPGPDSISAAAISHGSAGVAARAVGLVDLEPIRVAEILKDRPSWLWDCRRLEVVGTFPTPNGGTLELIYSRMYAPTTLAPARDFWTLRYTIFLEDRSLVVCEKSLTGAHGKHKGGPDFERAEMLPSGFLIRPYEGGVSSIHIVDHYDLESWRVLEVLRPLYESSVFLAQRVTIAALQHLKRISQESSGEILLRGGQQPAALRAFSHRIARGFNDAVNGFAEDGWVSLVADGIDTVSITINTSVASKALPGNQVWPDRFSNNISGILCAKSSMLLQNVPPATLIRFLREHRSEWVGCNSATSDSVSALRISGYGTSKGDEEPELLEVIKMEGYGSQSVPKDTVLLQLCTGYTDNVSGTCAQLIFAPVDPAVTNDMPLLPSGFRVIPLDSGSALPTKLAPTLDLASTLDTAKFPDDSSSAHCRSVLTMAFQFVFEAHNREEIISSARQYVRNVMVSVQSIAMALASFRMSPQQGPKQPEARIIAEQIVRGFRSSFGVELSDGSTDAFWNEKDAILCCTWKAIPEFIFANRSGLEMMETTWRDLHSLPYERTFDSAGRETAYSDFAQVLHQGYAQLPGGVRISSKGHTVAYDSATAWKVYDEEGNVTCIAFMFTNWTIL

SEQ ID NO: 1867 - protein, 214 aa, Agrobacterium tumefaciens
MSRADKERQHFHGAAKMAERKGEIIRKTNETSVSVRVDIDGTGKSKISTGVGFFDHMLDQLSRHSLIDMDIEVQGDLHIDDHHTVEDTGIAIGQAIAKALGDRRGITRYASLDLAMDETMTKAAVDISGRPFLVWNVNFSAPKIGTFDTELVREFFQALAQNAGITLHILNHYGANNHHIAETCFKAVARVLRTATEIDPRQAGRVPSTKGMLA

SEQ ID NO: 1868 - protein, 829 aa, Psilotum nudum
MSLMGIKDCKGVMDSGKYVRYSNEQVEALERLYNECPKPSALRRQQLIRECPILSNIEPKQIKVWFQNRRCREKQRKEAARLQTVNGKLTAMNKLLMEENDRLQKQVAQLLRENGYLRQQLPQGGLTTTDTSCDSVVTSGLQHLPTPQHPPHDAATHSGILSLAEEALAEFLQKATGTAIDWIQMPGMKPGPDSTGMINISHGCTGVAARACSLVGLEPAKVVEILKGRPSWHWDCRQLTKLYSSNVGNNGTIEVLYMQMYAPTTLAPARDFCTLRYTSPLEDGSYVICERSLNNTHGPPTAPHMQSFVRAEMLPCGYLIRPCEGSGSILIIVDHMDLESWTVPEVLRPLYESSAALAHKITIPALRYLRHLAQAAGVEIPGVRRPAAVRSLSQRLARGFNDAVNGFGDDGWTTVPSDGTDDVTVAIKSNYNARELGDQFTSGTAGVLCAKASMLLQNVPPALLVRFLREHRSEWADYGAAANSTSALQINNFGILDTHGDVCISQVLQQPIHAVEDDEFLELIKLEGREEGSTLPRDIFLLQLCSGLEENTAGASAQMVFAPIDISIPDDVPLLPSGFRAIPLDNCLLDAGSPSRTLDLASTLDVGSTNGKYANNAVFHLRSVLTLAFQFSFHSHMQESATTMSRQYVRNVVSTVQRLAMALAPSRLSPHMGSSRQMPGTPEGVNYARWICRSYKCKLGIDLVSVDGERSDEYLKAVWQCYDAIMCCSCKSMPVFTFANQAGLEMLETSSVTLQELSWDKTLDENAKKSLCSVFSQVMQQGYACLSAGVRLSSMGRVVSYERAVAWKVLDDDDNMRGVAFIYVNWSFI

SEQ ID NO: 1869 - protein, 717 aa, Ralstonia solanacearum
MFNKIVKEFQWGNHKVRMETGEIARQASGAVLLDMDDTVVLATVVGAKNAKPGQDFFPLTVDYIEKTYAAGKIPGGFFKREGRPSENETLTSRLIDRPLRPLFPEGFYNEVQVVIHVLSINPEVPADIPALVAASAALAVSGLPFNGPVGAARVGYKDGQYLLNPNRAQLAHSDLDLVVAGTERAVLMVESEANQLSEEVMLGAVVYGHEQMQIAINAIHDLVRDGGKPEWDWQAAPKNEALVAKVSELGLADLQAAYQLRQKSARSQKLKEVYASVAAKLAEAGVEADGVEVDNILFELESKIVRGQILNGEPRIDGRDTRTVRPIEIRSSVLPRAHGSALFTRGETQALVVATLGTKSDEQIIDALQGEYRDRFMLHYNMPPFATGETGRVGSPKRREIGHGRLAKRALIPVLPKEDEFAYTIRLVSEITESNGSSSMASVCGGCLALMDAGVPVKAHVAGVAMGLILEGNKFAVLTDILGDEDHLGDMDFKVAGTDNGITALQMDIKVQGITKEIMQVALAQAKEGRLHILGKMQAAMGHARTELSEHAPRMITVKINPEKIRDVIGKGGSTIQALTKETGCTIDIQEDGTITIASTSSEGMAEAKRRIEGITAEAEVGKIYSGTVLKLLDFGAIVNILPGKDGLLHISEIANERVNQVSDYVKEGQMVRVKLLSTDEKGRMRLSIKAAKAEEGDVPATAPQAPGAGDATSQQQ

SEQ ID NO: 1870 - protein, 384 aa, Roseovarius nubinhibens
MAKRDYYEVLGVARGASADEIKKAYRRKAKELHPDRNKDNPEAETQFKEAGEAYDVLKDADKKAAYDRFGHAAFEGGMGGGPRPGGGGHGQGDFASAFSDVFDDLFGDFMGGRGAPGGGRQRASRGSDLRYNLRVTLEEAFSGLQKNITVPTSVQCGSCNGSGAEGGGEPTTCPTCSGMGKVRAQQGFFTVERTCPTCSGMGQTIKNPCKNCGGAGRVEKDRALNVNIPAGVETGTRIRLSGEGEAGLRGGPSGDLYIFIEVSKHKLFERDDMHLFCHVPVSMSVAALGGDIEVPTIDGGRSRVKIPAGSQSGRQMRLRGKGMPALRSNTRGDMFIELAVETPVNLTARQKELLKEFDSLSEDNNPESKSFFSSVKTFWDSMKS

SEQ ID NO: 1871 - protein, 458 aa, Unknown
  marine gamma proteobacterium HTCC2143
MKKWECIVCGWVYDEAKGDPESGLAPGTRWEDVPDDWICPDCGVGKDDFEMIEMTEAETDVPHHQAEDSADHITAPVIILGTGLAGYGLAKEFRKHDKETPLILISSDDARAYSKPMLSTGYTKNTEASTLTQADGGTMARQLNASVWTMTEVVAIDTDKQFIKVGDAATSIHYSKLVLALGAEPIAPPIKGDGLDHVYTINDLLDFDDFRKSVKKTGAKKICVIGGGLIGCEYTNDLLNGGFAVETVDPLDYCLPTLLPEVAGKAVQRALEEKGAKFHFGPLVTEVNKAEDGVAVKLNNGKIIDADLVVCAVGVRPRTALAAASGIAVNRGIVANKLLETSAKNVYTLGDCAEVAGHVLVYVAPLMAGAKALGKTLAGEETSVSYGVMPITIKTPACPVVVNPAPRNTEGVWSIEQDGNNVVGEFRDSQGKLLGFALTGDGTKEKMRLQKELPPVMP

SEQ ID NO: 1872 - protein, 729 aa, Legionella pneumophila
MAKITKEIVFGNHKLILETGEVARQADGAVMASMNGTQVLVTVVWKKDGGESNDFFPLTVNYQEKFYAIGKIPGGFNKREGRPSDNETLISRLIDRPIRPLFPDNFFNEVQIIATVLSLNPEVSPDIIAMIGASAALSISGVPFNGPIGAARVGYKDGVYLLNPSRKEQEESKLDLVIAGTKDAILMVESEAQELSEDIMRGAMLYGHEMMKNVIKSIEELARDVGKSKPEWKAPEIDTVLKARINDVARNEVEAAYLIKDKQQRYQRLDELREQTISALLAENDELNADVIANMFGELERSIVRNRILDGEPRIDGRDHRTVRPISIRTKFLERTHGSCLFTRGETQAIVVATLGNERDAQILDGISGESRDRFMLHYNFPPYSVGETGQVGSPKRREIGHGRLAKRALMAVLPDANEFPYVLRIVSEITESNGSSSMATVCGTSLALMDAGVPLKAPVAGVAMGLIKEGDRYAVLTDILGDEDHLGDMDFKVAGTEKGITALQMDIKISGITNEIMEQALEQALEGRTHILGVMNNALAEHRTELSQHAPRITTMKVAEDKIRTIIGKGGATIKGLIESTGVSIDIDDSGVVQLFSPDKMALEEAQKQIKALIAEIEVGQTYQGKVSKIVDFGAFINLLPGKDGLLHISQICADRTQKVEEVLQEGQEIEVFVAGIDKQGRVKLEWKDKPQAEAKEVEDAPVSATFLTMEEQSEEINSGNKISEEEE

SEQ ID NO: 1873 - protein, 472 aa, Clostridium acetobutylicum
MNILLVNPVIPNKHRILEFCNDEARKAVDKRVLVGPPLGLNMLAGVVPNDNVIIIDQKAETDMNPNYDAADDLEKNIREFKPDIVSFTCLTAQYNGVLKLLELVKRINSKIITTVGGIHPTSAPQDFVGSKADIISIGLGKHSYYSIVKELKLNRDNPNFSRIPGIALNRGNSLYYTRSLGEFTYKEFKENYLLDEVLPNRDLTDKYNYTIPKVNKTIHYLSTSEGCTNKCNFCYLWKMTNGHFYHRSVDAIIQEIKKMDKYNVIRFCDANTFGDVNKAKVLFNRIIEEGLNRNHIYMGDVRTDTVVKYPEIIELASKAGLRITICGLEATSDEELKEYGKDNSIENTKKALKILNEANIYVNGNYIIKPSYDERDFERVGKFIDENPIYNSAFTILTPFPGTEQWEKLQSEIVIKDYDYYNLTNSVLRTKLSEKEFYLKISELYNFSGKSAQKYFAKYGNMTLDRLICGNN

SEQ ID NO: 1874 - protein, 292 aa, Pseudomonas syringae
MSRIVSVAATQMACSWDLEANIETAEKLVREAAAKGAQIILIQELFETPYFCQKPNPDYLQLATTIESNVAIKHFQKLAKELQVVLPISFFELAGRARFNTIAIIDADGTNLGIYRKSHIPDGPGYHEKYYFNPGDTGFKVWQTRYAKIGVGICWDQWFPECARSMALQGAEILFYPTAIGSEPHDKTISSRDHWQRVQQGHAGANLMPLIASNRIGNEEQDGYDITFYGSSFIANQFGEKVAELNETEEGVLVHSFDLDELEHIRSAWGTFRDRRPNLYGAVKTLDGSLES

SEQ ID NO: 1875 - protein, 357 aa, Arabidopsis thaliana
MLRSTCCTPLCPFTAKQPSFLRKQQRITSDRFTFRGGGGGDAAAVVSSSGLRDLVFVVNPQGANGRTAKEWKKLLPHLRSRLGKDCNVSELLTSGPSHAIDITREAIRDGADAVIAVGGDGTLHEVVNGFFWEGKPVGYLSGEASRSTALGLIPLGTGSDFARTFGWNNDPCEAVERIARGMRSRIDVGVIDKEGKDLHYFINVADVHLSAKAGFYASKYKKFGNLCYVIGALQAFMGHHNQDMRIRVNGGEWEIYPQVTALCVGNAKYFGGGMKITPNAIPGNGNLEVVVLQNFKWYDFVLKLHKLYNGTHLSVNNVTSRSVQSIEVEEITDSGSIYVQSDGEHLGFLPRKFQVQN

SEQ ID NO: 1876 - protein, 145 aa, Casuarina glauca
EALLKQSWEVLKQNIPGHSLCLFALIIEAAPESKYVFSFLKDSNEIPENNPKLKAHAAVIFKTICESATELRQKGQAVWDNNTLKRLGSIHLKNKITDPHFEVMKGALLGTIKEAVKENWSDEMCCAWTEAYNQLVATIKAEMKE

SEQ ID NO: 1877 - protein, 87 aa, Guaduella marantifolia
KPSMVVHQPRVEVGGTDMRTFYTLVMVDPDAPSPSDPNLREYLHWLVTDIPGTTGAAFGQEVMCYESPRPTMGIHRFVFVLFQQLGR

SEQ ID NO: 1878 - protein, 186 aa, Zea mays
  misc_feature (73)..(73): Xaa can be any naturally occurring amino acid
  misc_feature (91)..(91): Xaa can be any naturally occurring amino acid
  misc_feature (104)..(104): Xaa can be any naturally occurring amino acid
  misc_feature (120)..(121): Xaa can be any naturally occurring amino acid
  misc_feature (123)..(123): Xaa can be any naturally occurring amino acid
  misc_feature (125)..(125): Xaa can be any naturally occurring amino acid
  misc_feature (127)..(128): Xaa can be any naturally occurring amino acid
  misc_feature (131)..(131): Xaa can be any naturally occurring amino acid
  misc_feature (138)..(138): Xaa can be any naturally occurring amino acid
  misc_feature (141)..(142): Xaa can be any naturally occurring amino acid
  misc_feature (144)..(146): Xaa can be any naturally occurring amino acid
  misc_feature (148)..(148): Xaa can be any naturally occurring amino acid
  misc_feature (151)..(151): Xaa can be any naturally occurring amino acid
  misc_feature (158)..(158): Xaa can be any naturally occurring amino acid
  misc_feature (163)..(165): Xaa can be any naturally occurring amino acid
  misc_feature (171)..(172): Xaa can be any naturally occurring amino acid
  misc_feature (175)..(175): Xaa can be any naturally occurring amino acid
  misc_feature (180)..(180): Xaa can be any naturally occurring amino acid
GTRQMVEDAAVWCAVHGLVVGDRANQRSGTVPGVGLVHAPFSLLPARFPASFFNQACELAPIFNELVDRVSLXMGEFLQAALSRTKQVDEXTSRLLEIHDKMMXINKKEGIRLGLHRSGXXSXDXEXXSPXQIEPKTXGTXXSXXXGXLVXELHRGFXSKQYXXXIKGQNXXRVXQNWGXPNCRSI

SEQ ID NO: 1879 - protein, 421 aa, Unknown
  Nostoc sp. PCC 7120
MTVAALDDCPEPMKSAKRAFQASLKLGTTKGIDRSRAVLAMAQALENAFDDILEANTLDLEASREMAVPELILDWLKLTPTRLEITVEILQRLGEISDPLRRVRNADYQPEDSQSYSQLMPLGVIGFIYEAFPDLGAIAAGLCIKTGNSIILKGSTEASHSNAAIVEALQHAIVEVGLPSGCIELVTTEHGGSLRDLITQDQYINLVIPYGRSSLVQQVMRQATCPVLKSAMGNCYLYWSLNSSLDMVRWMILDSHESEPDPVNAIEKVLIHRQAMPSSLAVLWNSLKEKGFEIKGDGELVEAFPQLQLAKDNEWGNAYLTKTVAFKLVDSLDGAIAWINQYSSGHADSIATESYQESRQFALGVNSAATYINTSPRFSRNPSRGDSVFLGMSNQKGHRRGFISLETLTTLKHIIQGNGRF

SEQ ID NO: 1880 - protein, 342 aa, Corynebacterium diphtheriae
MRIATLTSGGDCPGLNAVIRGIVRTCSEYGSTVVGYQDGWVGLMEDKRIQLYDDENIDRILLRGGTILGTGRLHPDKFKSGLDQIKANLEDAGIDALIPIGGEGTLKGAKWLSDNGIPVVGVPKTIDNDVNGTDYTFGFDTAVSVATDAIDRLHTTAESHNRVMIVEVMGRHVGWIALHAGMAGGAHYTVIPEQPFDIAEICKAMERRFQMGEKYGIIVVAEGALPKEGTMDFVEGGVDQFGHQTFNGIGQVIGEEIKKRLGHDVRTTVLGHIQRGGTPTSYDRVLATRYGVHAARACHNGDYGKMVALHGEHIDLIPLEDAVDTLKTVPEGRYRTARALFG

SEQ ID NO: 1881 - protein, 299 aa, Zea mays
MAEHLASIFGTEKDRVNCPFYFKIGACRHGDRCSRLHNRPTISPTLVLANMYQRPDMITPGVDAQGQPIDPEKMQEHFEDFYEDIYEELGKFGEIENLNVCDNLADHMIGNVYVQFREEEQAAAAYNALQGRFYSGRPIIVEYSPVTDFREATCRQFEENSCNRGGYCNFMHVKQIGRDLRRKLYGRSASRRYHGRSRSRSPPPQRRGHRDRDDYRGGGGGGRGRGSRYDRYDDGAGRGGRHDRYDDGAGRGGRHDRFDDGGRRRHGSPSRRARSPVRESSEERRAKIEQWNREREGKQ

SEQ ID NO: 1882 - protein, 206 aa, Francisella tularensis
MSKGSSTKKWLHEHTSDYYVIQANKLGYRSRASFKILEIQDKYQLFKPNMFVVDLGAAPGGWSEQVIKYIGKNGKLIALDLLEMAPIAGVEFIQGDFSSDETYQKLNTLVNNQKIDCVISDMAPNLSGNKTSDQAKSIYLLELALDFANTNLNKNGSFVAKVFQGQGSDEYLKLVRESFNKVIQFKPKSSRAKSREFYVIATEFKG

SEQ ID NO: 1883 - protein, 364 aa, Magnaporthe grisea
MQMASASRQILRAASRASTRTAFAPAASRGLAARTIAGRRFYSSSSEPAKASSSNLGWIAGALAAAAAGAGYWYTQNGGAATLTKPEFKDYQTVYNDIASRLEENPDYDDGSYGPVLVRLAWHASGTYDKETGTGGSNGATMRFSPEGGHGANAGLKAARDFLEPIKAKYPWITYSDLWILGGVCAIQEMLGPKIPYRPGRSDKDAAACTPDGRLPDAAQRQDHVRNIFYRMGFNDQEIVALAGAHALGRCHTDRSGFDGPWTFSPTVLTNDYFKLLLNEKWEYKKWDGPKQYVDSKTKSLMMLPADMCLIEDKKFKEWTKKYADDNDLFFKDFSAAVLKLFELGVPFAEGTENQRWIFKPTSE

SEQ ID NO: 1884 - protein, 475 aa, Bacillus cereus
MQQPTNEKLHRTMKSRHLFMIALGGVIGTGFFLGSGYTINQAGPGGAILSYLVGGFIMYLTMLCLGELTVAMPVSGSFQKYATKFIGPGTGFMIGWLYWLGWAVTVGLELTSIGLMMKRWFPNVDVWVWCLVFGVILYASNAISAKSYAELEFWFSSIKVVTILAFVVLGGSALLGFISYDGKEAAPLFSNFVSDGGLFPNGLAAVLLTMITVNFSFQGTELIGIAAGESENPEKTIPRAIRNTVWRIMLFFILTMTILVGLISWKEAGVIESPFVVVFDKIGIPYAADIMNFVIITALLSVANSGLYAATRILWSLANEGMAPKSFQKVNKRGIPITALVVTIAVAALSLLTSFLAEDTVYMYLLSIAGLSAVSSWIIIALSQLRFRSQYIKGGGKLEDLKYRTPLYPIVPILALITNSIVVISLAFIPEQRMALYCGIPFIIFCYIYYYISKKRQKPMKVEMEKTNETNNQTR

SEQ ID NO: 1885 - protein, 376 aa, Zea mays
  misc_feature (253)..(253): Xaa can be any naturally occurring amino acid
MAAVAIHQFAECITCHAWSPDQSMIAFCPNNHEVHIYKFFTDKWEKLHVLSKHDQMVSGIDWSKSSNKIVTVSHDRNSYVWTQEGSDWVPTLVILKLNRAALCVQWSPKENKFAVGSGAKSVCICYYEQENNWWISKVIRKKHESSVTSLAWHPNNIYLATSSTDGKCRVFSTFIKGVDTRGSKSSTSTDSKFGEQIAQLDLSSTWVFGVRWSPSGKTLAYAGHNSMIYFIDEVESSPVAQNLALRDLPLRDXVLFVSERTLIGVGFDCNPMIFAADDTGLWTFIRFLDERKAAPSASKASQLSEALGKLYGQSKQGTSSDTVEPSKPRGGAHENCITCIVPLRKGSDGSIKRFSTSGLDGKIVVWDLENHVSIAK

SEQ ID NO: 1886 - protein, 209 aa, Escherichia coli
MTGKKRSASSSRWLQEHFSDKYVQQAQKKGLRSRAWFKLDEIQQSDKLFKPGMTVVDLGAAPGGWSQYVVTQIGGKGRIIACDLLPMDPIVGVDFLQGDFRDELVMKALLERVGDSKVQVVMSDMAPNMSGTPAVDIPRAMYLVELALEMCRDVLAPGGSFVVKVFQGEGFDEYLREIRSLFTKVKVRKPDSSRARSREVYIVATGRKP

SEQ ID NO: 1887 - protein, 590 aa, Asparagus officinalis
MCGILAVLGCSDDSQAKRVRVLELSRRLKHRGPDWSGLCQHGDCFLSHQRLAIIDPASGDQPLYNEDKSIVVTVNGEIYNHEELRRRLPDHKYRTGSDCEVIAHLYEEHGEDFVDMLDGMFSFVLLDTRNNCFVAARDAVGITPLYIGWGLDGSVWLSSEMKGLNDDCEHFEVFPPGNLYSSRSGSFRRWYNPQWYNETIPSAPYDPLVLRKAFEDAVIKRLMTDVPFGVLLSGGLDSSLVAAVTARHLAGSKAAEQWGTQLHSFCVGLEGSPDLKAAKEVAEYLGTVHHEFHFTVQDGIDAIEDVIFHIETYDVTTIRASTPMFLMARKIKSLGVKMVISGEGSDEIFGGYLYFHKAPNKEEFHHETCRKIKALHQYDCLRANKATSAWGLEARVPFLDKEFMDVAMSIDPESKMIKPDLGRIEKWVLRKAFDDEENPYLPKHILYRQKEQFSDGVGYSWIDGLKAHAAKHVTDRMMLNAARIYPHNTPTTKEAYYYRMIFERFFPQNSARFTVPGGPSIACSTAKAIEWDARWSNNLDPSGRAALGVHDSAYDPPLPSSISAGKGAAMITNKKPRIVDVATPGVVIST

SEQ ID NO: 1888 - protein, 218 aa, Xanthobacter autotrophicus
MFWLKKSLDLPTKADALPGRSTPVPTAETHFVNGHALKGPYPAGFETAVFALGCFWGAERKFWQTPGVWATAVGYVAGITENPTYEEVCSGRTGHTEAVLVVYDPKAVSYDELVRLFFESHDPTQGMRQGNDVGTQYRSGIYVTNAGQRVAAEAAKAAYEPALKAKGFGPITTEIAELGPFYFAEGYHQQYLAKNPAGYCGLGGTGVSCPIGTGVAAQ

SEQ ID NO: 1889 - protein, 286 aa, Ipomoea trifida
FYVAEVLLALEYLHMLGVVYRDLKPENILVREDGHIMLSDFDLSLRCAVNPKLLKSSSPVGQPPKKMSSPCSDSSCIEPFCLHPSWQVSCFTPRFLSAAAKTRKLKADIAAQVTPLPQLVVEPTSARSNSFVGTHEYLAPEIIKGEGHGSAVDWWTFGIFMYELLYGRTPFKGTTNEDTLGNVVSQCLKFPETPMISSHARDLIRRLLQKEPENRLGSSKGATEIKNHSFFEGLNWALIRCATPPEMPRIFDLGNLISDTNSQKKQGGKCQKEGTSGEENIEFEMF

SEQ ID NO: 1890 - protein, 470 aa, Chlamydophila caviae
MNKQKRFLSLLFLTLVLLGIWFCPHPEAITPEAWHLFAVFTTTILGIILQPVPMGAIVIIGISILLLTRTLTLEQGLSGFHEPIAWLVFLSFSIAKGIIKTGLGERVAYFFVSVLGQNPLGLSYGLVITDFLLAPAIPSVTARSGGILYPVVMGLSESFGSSSEKGTESLIGSFLIKVAYQSSVITSAMFLTAMAGNPLLAALASNAGISLTWALWAKAAIIPGLLSLVLMPIVLYKFYPPTITSCEEAIRSAKLRLKEMGPLKKGEKIILMIFILLVVLWTFGDLLRISATTAALIGLSLLILTNILDWHKDVMANTTAWETFIWFGALIMMASFLNQFGFIPLIGNSVAAGVAGLSWKVGFPILFLIYFYSHYLFASNTAHIGAMFPVFLAVSISLGTNPIFACLVFAFSSNLFGGLTHYGSGPAPLYFGSQLVSIKDWWRSGFILSIVNIAIWIGIGTLWWKLLGLF

SEQ ID NO: 1891 - protein, 554 aa, Aspergillus nidulans
MGSFQKDKTFHCDVIIVGAGFSGVYGLHRFRQLGLNVKVFEAGADLGGVWYWNRYPGLRVDSEWPYYQLGIPEVWKDFYFTERFPKGEEIRSYFDHADKVLNLKKDIQFNARVNSATWDETRLQWTVTTEAGHTATAQYLCLFTGVLHRQYIPGFPDLGEYEGQVFHSAAWPEGVDVTGKRVAVIGAGATGVQLVQELSKRASHLTLFLRRPPICFPMRNRPIMPAEEECWKPYYELLFDASRKSPIGFPVSRPTKGIYDVSESERNEYYEKLWKTGGFHFGAGNYPQIRVDKNASRMAYAFWAKKTRVRIKDPIKRDLMVPLDPPFWILTRRSPLEIDYYESLDQDHVEIVSLAQAPIQKFTERGIQTADGKHREFDNIVCATGFESFTGSVATMNIQSKDGVYIKDIWAKGIRTYLGILVHGFPNCFLSYSPQAPTVIANGPTVLQCQIDFIVDAIAKMRAENLERIEATAEAEEGWRQMILEVGSKTLAAETDSWWTAANVPGQPRQFLTYVKGIGNYETECRATLDGWKGFDVRERPNCGKDGVDSKATD

SEQ ID NO: 1892 - protein, 267 aa, Mesembryanthemum crystallinum
MASSTMALSSPSFAGKAVKLSPTASETLGEGRITMRKAAGKSKVATIDSPWYGPDRVKYLGPFSGESPSYLTGEFPGDYGWDTAGLSADPETFAKNRELEVIHCRWAMLGALGCVFPELLARNGVKFGEAVWFKAGAQIFSEGGLDYLGNPSLVHAQSILAIWACQVVLMGAIEGYRVAGGPLGEVTDPLYPGGSFDPLGLAEDPEAFAELKVKEIKNGRLAMFSMFGFFVQAIVTGKGPLENLADHLADPVNNNAWAFATNFVPGK

SEQ ID NO: 1893 - protein, 313 aa, Amelanchier bartramiana
GGLGDVLGGLPPAMAANGHRVMTVSPRYDQYKDAWDTGVPVEIEVGGRVETVRFFHCYKRGVDRVFVDHPSFLERVWGKTGSKIYGPSAGQDYKDNQFRFSLLCQAALEAPRVLNLNSNKYFSGPYGDDVVFIANDWHTALLPCYLKAIYKPKGIYENAKVVFCIHNIAYQGRFPISDFSVLNLPENLKGSFDFIDGYNKPVKGRKINRMKAGILESDRVVTVSPFYAQELVSGEDKGVELDNIIRKTGITGIVNGMDVQEWNPATDKYLDTKYDNTTVLDAKPLVKEALQAEVGLPVDRNIPVIGFIGRLEE

SEQ ID NO: 1894 - protein, 267 aa, Mesembryanthemum crystallinum
MASSTMALSSPSLAGKMVKLAPTASEILGEGRITMRKTAGKTKSVSSDSPWYGPDRVKYLGPFSGESPSYLTGEFPGDYGWDTAGLSADPETFTKNRELEVIHCRWAMLGALGCVFPELLARNGVKFGEAVWFKAGAQIFSEGGLDYLGNPSLVHAQSILAIWACQVILMGAIEGYRVAGGPLGEVTDPLYPGGSFDPLGLAEDPEAFAELKVKEIKNGRLAMFSMFGFFVQAIVTGKGPLENLADHLADPVNNNAWAFATNFAPGK

SEQ ID NO: 1895 - protein, 257 aa, Desulfotalea psychrophila
MREEKQTVYFVGAGPGDPELITVKGQRLLQEADLIIYTGSLVPRALVENLAGESINSAPLNLDEVFTLIKTAHAEGKRIVRLHTGDSAIFGAINEQLALLRAHSIPFQVIPGVSSALATAAALETQLTLPEVAQTVIFTRRAGRTPVPAGEDLISLARHGSTMMIFLSISMISEVVAELLEGGYPVHTPAAVVEKASWPEERILRGTLTNIAQQVKDAGITKTALIAVGPAISLEAPEILSKLYDRGFSHEYRQAKP

SEQ ID NO: 1896 - protein, 313 aa, Amelanchier bartramiana
GGLGDVLGGLPPAMAANGHRVMTVSPRYDQYKDAWDTNVLVEIEVGGRVETVRFFHCYKRGVDRVFVDHPLSLEKVWGKTESKIYGPRTGVDYMDNQFRFSLMCQAALEAPRVLNLNSNEYFSGPYGDDVVFIANDWHTALLPCYLKTIYKPKGIYKNAKVVYCIHNIAYQADFLFRDFSLLDLPENLKGSFDFFDGHDKPVKGRKINWMKGGILESDRVVTASPYYAQELVSGEDKGVELDNIIRKTGITGIVNGMDVQEWNPATDKYLDIKYDNTTVLDAKPLLKEALQAEVGLPVDRNIPVFGFIGRLEE

SEQ ID NO: 1897 - protein, 267 aa, Mesembryanthemum crystallinum
MASSAMALSSPSLAGKAVKLNPTTSQILGEGRITMRKTAGKTKNVSSDSPWYGPDRVKYLGPFSGEAPSYLTGEFPGDYGWDTAGLSADPETFAKNRELEVIHCRWAMLGALGCVFPELLARNGVKFGEAVWFKAGAQIFSEGGLDYLGNPSLVHAQSILAIWACQVILMGAIEGYRVAGGPLGEVIDPLYPGGSFDPLGLAEDPEAFAELKVKEIKNGRLAMFSMFGFFVQAIVTGKGPLENLADHLADPVNNNAWAFATNFAPGK

SEQ ID NO: 1898 - protein, 313 aa, Amelanchier bartramiana
GGLGDVLGGLPPAMAANGHRVMTISPRYDQYKDAWDTEVTVELKVGDKTETVRFFHCYKRGVDRVFVDHPLFLEKVWGKTASKVYGPVTGVDFKDNQLRFSLLCQAALEAPRVLNLDSSKDFSGPYGEEVVFIANDWHTALLPCYLKAVYKPRGIYSTAKVAFCIHNIAYQGRFAFADFALLNLPDEFKSSFDFIDGNEKPVKGRKINWMKAGILESDKLLTVSPYYAEELVSAVEKGVELDNIIRKTGIFGIVNGMDVQEWNPSTDKYTTIKYNASTVADAKPLLKETLQEEVGLPVDRDIPVIGFIGRLEE

SEQ ID NO: 1899 - protein, 1093 aa, Rhizobium leguminosarum
MDTMNADSAPQPLWYKDAIIYQLHIKSFYDANGDGVGDFAGLHQKLDHIAALGVNAIWLLPFFPSPRRDDGYDIADYGSVSPDYGTVEDFQAFVDAAHQRNIRVIIELVINHTSDQHPWFQRARQAPAGSPERGFYVWSDTDQKFPETRIIFIDTEKSNWTWDAVAGAYYWHRFYSHQPDLNFDSPLVMEELLRVMRFWLETGIDGFRLDAIPYLVEREGTINENLPETHAILKRIRAALDATHPGVMLLAEANQWPEDTREYFGEGDECHMAFHFPLMPRMYMAIAKEDRFPITDILRQTPEIPDNCQWAIFLRNHDELTLEMVTDAERDYLWETYASDKRARINLGIRRRLAPLMERDRRRIELMNALLLSMPGTPVIYYGDEIGMGDNIYLGDRDGVRTPMQWSPDRNGGFSRADPARLVLPPVADPLYGFEAVNVEAQSTDAHSLLNWTRRMLALRGRHPAFGRGTLRFLSPENRKILAYLREYEGEVLLCVASLSRLPQAVELDLSSFEGRVPIELTGMSPFPPIGQLTYLLTLPPYGFFWFQLTADADPPAWRTAPPEQLPDLLTMVLRRSLLDLVDEPGHARILSGEILPAYLSRRRWFGAKDQPLQAARLISVTPIPFADGVVLGELEVVLPNHSESYQLPLAVAWDDAHPSALAQQLALGRIRQGRRVGFLTDGFAVEAMARGILHGLRDRSRTTGRTGTLEFLGTEQLDSLDISGELPVHWLSAEQSNSSLLVGDVAMIKLIRHIFPGIHPEVEMTRYLTRAGYDHTAPLLGEVAHTDSSGRRSTLIIVQGAIRNQGDAWNWMLNNLRRGADELVLNDPAVQPDDDVFRSLISFVAMVGLRLGELHVVLAAKTGDEAFSPVVAGDSEVEAMRKAVVGELAYAMSKLDERDENADPAIDLLAAPLLERRSELAELAGTLAESSRYTLMTRTHGDFHLGQILVSEGDAVIIDFEGEPAKNLTERRAKTNPLRDVAGLLRSLSYLVATAQLDNDAVIEHDNEVRREAIARFGRNAEEAFLDAYSQAVSVSKELDMPPDQRRRILDAFLLEKAAYEIAYEARNRPKWLPIPLSGLTEIVSRLAGVTA

SEQ ID NO: 1900 - protein, 313 aa, Amelanchier bartramiana
GGLGDVLGGLPPAMAANGHRVMTISPRYDQYKDAWDTEVTVELEVGDKTETVRFFHCYKRGVDRVFVDHPLFLEKVWGKTASKIYGPTAGVDFKDNQLRFSLLCQAALVAPRVLNLNSSKYFSGPYGEEVVFVANDWHTALLPCYLKAIYKPKGIYKTAKVAFCIHNIAYQGRFVFADFALLNLPDESKSSFDFIDGYDKPVKGRKINWMKAGILESDKVLTVSPYYAEELVSSVEKGVELDNIIRKTGIQGIVNGMDVQEWNPLTDKYTTVKYDASTVADAKPLLKEALQAEVGLPVDRDIPVIGFIGRLEE

SEQ ID NO: 1901 - protein, 334 aa, Aspergillus oryzae
MSRYAEAHANPQGPGDARPTALQIVKDTEMEGKLAGKSAVITGVSSGIGLETVRAIAATGAFLYLTARDLNKAKTALDDIFKPEQMELIHMDQSSLESVRNAAKTILSKTDKVSLLINNAGIMALPELRLSMDGYELQFATNHLSHFLLFNLLKPAMLAASTPEFQSRVVNVSSDSHRHHGINASDNYNFQKGGYEPWTAYSQSKTAVIYMANELDRRYGSRGLHATSVHPGMIATNLGQYLTPEQIEQLLQNTRWNSLWKSFEQGAATTVWAAVGREWEGNGGKFLAGCAEAVRGPEGTEDYVGTFVNHTYKPEDEARLWKDSLEMVGLSDDK

SEQ ID NO: 1902 - protein, 229 aa, Francisella tularensis
MIKKIIYSLSILSCSLGFSANSDTKYEKAIFAGGCFWCLESDFEYMQKHQDLSHNGIIKVISGYDGGLQKDPTYKTVSAGITNYKESVEVIYDPTKISYQELVEYFYRRIDPTDFKGQFCDKGKQYQSAIYYNNDKQKQVAEEVTKKLKEEFKKHNQSVYTQILPSTHFYKAESYHQDYHHKNPKRYCYYRTGCGRDLTINKVWQNIDCKYSNVVPFDIPSSYAECLIR

SEQ ID NO: 1903 - protein, 292 aa, Oryza sativa
MTTARFVSPSLSRVSPSPAGRVSGSSWLSRAGVALPARPHGLSLHLRPPAMASAAAAGNGSPSAPEDSTALSRIGEVKRVTKETNVHVKINLDGTGVADCSTGIPFLDHMLDQLASHGLFDVCVKAKGDTHIDDHHSNEDIALAIGTALLEALGDRKGINRFGHFTAPLDEAAVEVILDLSGRPHLSCGLSIPTERVGTYDTQLVEHFFQSLVNTSGMTLHIRQLAGKNSHHIIEATFKAFARALRQATEYDLRRRGTVPRLQYSKETNGMASTAPRFLLTLGISVGCDNRT

SEQ ID NO: 1904 - protein, 1095 aa, Thiobacillus denitrificans
MEENDPLWYKDAIVYELHVKAFFDANGDGAGDFRGLISKLDYLQELGVNALWLLPFYPSPGRDDGYDISDYHNLHPSFGDMADFRRFIREAHQRGLRVITELVVNHTSDQHPWFQAARRAPPGSVKRNYYVWSDTDTRFSETRIIFSDTEKSNWAWDEVAQAYYWHRFFSHQPDLNFNNPHVFKAIMRTMRFWFDAGVDGMRLDAVPYLCERDGTSNENLPETHAVIRRMRAELDARYSNRMFLAEANQWPEDVREYFGNGDECHMAYHFPLMPRMYMAIAQEDRHPIVEIMEQTPDIPDLCQWAVFLRNHDELTLEMVTDRERDYLYQAYASDPQARLNLGIRRRLAPLLDNDRHRIELMNLLLMTMPGSPIVYYGDEIGMGDNLLLGDRNGVRTPMQWDGGPNGGFSSAPTERLFLPPITDPVYGYGAVNVEAQQRNPSSLLNWTRRLIAMRKAHRALGRGTLRFLRPGNRKVLAYLREYEGETILCVANVARAPQAVELDLSPFKGHVPVELMGRSSFPPIGELPYLLTLGGYGCFVFRLATDVEAPAWHEERPVPPDLPVLVLVDAGWRTLFARTDEGVNQLMVRRAREQLERQIIPRYFRTQPWFVYSEAALEKFEFGTLREWGTDSGTWLLATVTVTLLDGSIYHYALPLGLAWEDEDEGRVAALLHVTLAKVRRLARVGILFDAFWDDGFCCAIVSAMERGETLAYGDGHLTFRTASAYPGFFCPLVTSSITRTVSEHGRLRVNLNDQLVLKSYPRQMQGTHPELEMSRFLTETAKFAHIPQLGGTVEYVASSGRHSTLAILERYAPNQGDAWAYTLNYLERFLDLSRTTGEQAPDGRHGRYMGLMKTLGERTAEFHRALATPDRSGDFGSEPIAPPDILEWVNKVRHEMGVMYELLERALPALPEPVAVAAQQLFLVRPKLYRRVIRASRVRVDASKTRCHGNYHLGQVWLVQNDFLIANYGGIPGRSWEERRAKHAPLRDVASMLLSLSQAGAAALARVAGDSVDVMAALQPHVDAWELAARKAFYRGYRKGMDGHAAYPTDATAAEALLTLFLAEKAIAELTEALERRAVGSAAAMRRLVQVTRR

SEQ ID NO: 1905 - protein, 87 aa, Sasa kurilensis
KPSMVLHQPRVEVGGNDMRTFYTLVMVDPDAPSPSEPNLREYLHWLVTDIPGTTGAAFGQEVMCYESPRPTMGIHRFVFVLFQQLAG

SEQ ID NO: 1906 - protein, 178 aa, Clostridium perfringens
MLYDFKVKDIEGNEVSLGEYKGKVLLIVNTATGCGFTPQYEGLEVLYKKYHDKGFEILDFPCNQFFEQAPGSNEEIVGFCKLNYGTTFKTFAKVEVNGENACELYKFLKKEAPMAKEDETSLGFYDKLKGLGFTTEGEEIKWNFTKFLIDKNGEVVARFAPTFEPEKLDELIEELLEE

SEQ ID NO: 1907 - protein, 246 aa, Burkholderia xenovorans
MRTINTGIASLRKRFSVTRLTGLVVVALGVAAAQHLAHSAEAATKIPAPMQDEKAAATHSETAVFAGGCFWGVQGVFEHVRGVKEVASGYSGGAASTAQYETVSEGDTGHAESVRITYDPTQITYGRLLQIFFSVAHNPTELNYQGPDHGTQYRSAIFPVNAMQRGIAQSYIAQLDNAHVFSAPVVTRVENFKGFYPAENYHQNFLALHPDYPYIAINDLPKVADLKRMFPDLYRNDPVLLATSAQ

SEQ ID NO: 1908 - protein, 1135 aa, Candida glabrata
MNKNDDDIESILGTKDPVVVEFVLRIAQESQDLNEFEKKFEALGVVLETDKIQRLYATLTSTVKDDPISSISKVLDSELGISDNVVAEFILQIVKDSPNISTLLKKLTEMNTGVPPIVAKKLFDSYNASQGQLTVKTKVRIKNEVDGLELPNETIKWEDIYDSKDLLSMNFITEDEQPVLGKIYKGIIKKIMPFGCFVQILHLKKECGEGLVHISELCKNKVRHPSDVVKQGQTVYVKISKIMTNGKISLSMINIDQVSGKEKESTDVDVESLKVRGRPGEKQSNPIRKRKLTSPERWELRQLIASGMASIKDYPELLKYDQKEVVDHEGNNDKTEDQSDNINEIEEIDIERNPNDRPKFLRKEGKKVSKKYELPKLSNNPMGSLNRAGSQGSKLMLQHREEKLQKKKDIEEQIKQKRKIEDPTKDPLQIKKEIDDLRQQLTVTSWEKKKSREKVSYGKKSAKPISAQRKSLPVYSMREKLMSEIKNNQFLVIVGETGSGKTTQITQYLDDEGFSKNGIIGCTQPRRVAAESVARRVAEEVGCKIGREVGYTIRFENVTSDVTRIKYMTDGMLQQEALLDPILSKYSVIMLDEAHERTIATDVLFALLKKAAMKRDDLKVIVTSATLDSNKFAEYFNNCPIINIPGKTFPVEVLYSKTPTMDYIASSLDCVMDIHTSEGPGDILVFLTGQEEIDTCCEVLFERAKEMGDKIDPLIILPVYSALPSEIQSKIFEPTPRGSRKVIFATNIAETSITIDGIFYVVDPGFSKVNTYSPRAGMEQLVVAPISQAQANQRKGRAGRTGPGKCYRLYTESSYQNEMLPNAIPEIQRQNLLHTILMLKAMGINDLLHFDFMDPPPKSLMVHALEELYHLQALDADGHLTKLGQRMSLFPMEPTLARALLSSVSNNCSDEMITIIAMLSVQNVFYRPKNKQQEADGKKARFHHPYGDHLTLLNVYNRWERSNCSEDFCNTNFLHFRHLRRAKDVKRQISMIFERLNLPITSCNENPEIIRKTLVSGFFLNAAKRETKSGYKTINGGTEVGIHPSSALYGREYEYVIYHSLILTTREFMSQISGIEPQWLLEVAPHFYKVADENSQSRKKTKIEPLFNRHSKDQNSWRLSSKKQNREKALGMKKK

SEQ ID NO: 1909 - protein, 408 aa, Thiobacillus denitrificans
MAGGEGSRLQPLTADRCKPAVPFGSRYRIVDFVLSNLTNSDIRSIYVLVQYRPQSLIEHVRKAWTVTSLFADQFLTVVPPQMTKTSTVFGGTADAVYQSLDLMNMHRPDLVAIFGADHIYRMDVRQMVRFHCEHDAEATVAALPVSLNQASSFGIIETDAQNRIIGFDEKPKAAKPMPDDPDHAYASMGNYLFNADVLREALEEAHRRGETDFGRHVLPRLAQSHGVYAYNFATNEVPGTKRYEEQAYWRDVGTLDTYFDAHLDVLGLEPRFDAFNPQWPIYSSHYQGPTARVLRAELDNVLLGAATIVTGAKIRNSILRREVVVEPGAEIEDSVIMDYVCIGAGAKLRRVIIDRHNVVPPGARIGYDHDADRAAGYHVTEGGVVVAPLGDVRFYAREASRHSGGYSE

SEQ ID NO: 1910 - protein, 356 aa, Alnus glutinosa
MSLLSDLINLNLSDATDKVIAEYIWIGGSGTDLRSKARTLTGPVNHPSKLPKWNYDGSSTGQAPGEDSEVIYILRQFFKDPFRRGNNILVICDTYTPAGEPIPTNKRHGAAKIFSHPEVVAEVPWYGIEQEYTLLQKDVKWPLGWPVGGYPGPQGPYYCGIGADKAWGRDIVDAHYKACLYAGINISGINGEVMPGQWEFQVGPSVGISAGDEVWAARYILERITEIAGVVLSLDPKPIQGDWNGAGAHTNYSTKSMRNNGGYEIIKKAIEKLGLRHKEHIAAYGEGNERRLTGRHETADINTFKWGVANRGASIRVGRDTEKEGKGYFEDRRPASNMDPYVVTSMIAETTLLWKP

SEQ ID NO: 1911 - protein, 161 aa, Glycine max
MTTTLERGFSEEQEALVVKSWNVMKKNSGELGLKFFLKIFEIAPSAQKLFSFLRDSTVPLEQNPKLKPHAVSVFVMTCDSAVQLRKAGKVTVRESNLKKLGATHFRTGVANEHFEVTKFALLETIKEAVPEMWSPAMKNAWGEAYDQLVDAIKSEMKPPSS

SEQ ID NO: 1912 - protein, 72 aa, Lactococcus lactis
LAKDDVIEVDGKVVDTMPNAMFTVELENGHQVLATISGKIRKNYIRILPGDKVQVELSPYDLTRGRITYRFK

SEQ ID NO: 1913 - protein, 485 aa, Sphingomonas paucimobilis
MAHFPQTPGFSGTLRPLRIEGDILDIEIEGEVPPQLNGTFHRVHPDAQFPPRFEDDQFFNGDGMVSLFRFHDGKIDFRQRYAQTDKWKVERKAGKSLFGAYRNPLTDDASVQGMIRGTANTNVMVHAGKLYAMKEDSPCLIMDPLTLETEGYTNFDGKLQSQTFCAHPKIDPVTGNLCAFAYGAKGLMTLDMAYIEISPTGKLLKEIPFQNPYYCMMHDFGVTEDYAVFAVMPLLSSWDRLEQRLPFFGFDTTLPCYLGILPRNGDARDLRWFKTGNCFVGHVMNAFNDGTKVHIDMPVSRNNSFPFFDVHGAPFDPVAGQGFLTRWTVDMASNGDSFEKTERLFDRPDEFPRIDERYATRAYRHGWMLILDTEKPYEAPGGAFYALTNTLGHIDLATGKSSSWWAGPRCAIQEPCFIPRSPDAPEGDGYVIALVDNHVANYSDLAIFDAQHVDQGPIARAKLPVRIRQGLHGNWADASRLAVAA

SEQ ID NO: 1914 - protein, 438 aa, Glycine max
MDTTHTNSEYEDWKSIDIADSILSYGSELGDMEENEWQMVQTKGNQFVVNDQPFYVNGFNTYWLMVFAADESTRGKVTEVFKHASSVGMSVCRTWAFNDGQWRALQKSPSVYDEDVFKALDFVVSEARKYKIRLILSLVNNWEAYGGKPQYVKWGNAAGLNLTSDDDFFSHPTLRSYYKAHVKTVLNRVNTFTNITYKEDPTIFAWELMNEPRCTSDSSGDVLQDWIKEMAFYVKSIDPKHLVEIGLEGFYGPSTPQKYQFNPNSYAHEVGTDFIRNHQVLGVDFASVHIYPDSWISQSVADSHLPFIKTWMEAHIEDAEKYLGMPVVFAEFGVSAKAPGYNSTYRDNLINTVYKTILNSTKKGGSGAGSLVWQLFPDGTDYMDDGYAIVLSKSPSTSSIISLQSTRLALFNSLCSKKCRWGCKKRNVLEKVLYHDEL

SEQ ID NO: 1915 - protein, 734 aa, Oryza sativa
MDFGDEPEGSDSQRRRKRYHRHTPRQIQQLEAMFKECPHPDENQRAQLSRELGLEPRQIKFWFQNRRTQMKAQHERADNCFLRAENDKIRCENIAIREALKNVICPTCGGPPVGEDYFDEQKLRMENARLKEELDRVSNLTSKYLGRPFTQLPPATPPMTVSSLDLSVGGMGGPSLDLDLLSGGSSGIPFQLPAPVSDMERPMMAEMATRAMDELIRLAQAGDHIWSKSPGGGVSGGDARETLNVDTYDSIFSKPGGSYRAPSINVEGSRESGLVLMSAVALADVFMDTNKWMEFFPSIVSKAHTIDVLVNGMGGRSESLILMYEELHIMTPAVPTREVNFVRYCRQIEQGLWAIADVSVDLQRDAHFGAPPPRSRRLPSGCLIADMANGYSKVTWVEHMEVEEKSPINVLYRDLVLSGAAFGAHRWLAALQRACERYASLVALGVPHHIAGVTPEGKRSMMKLSQRMVNSFCSSLGASQMHQWTTLSGSNEVSVRVTMHRSTDPGQPNGVVLSAATSIWLPVPCDHVFAFVRDENTRSQVSHPLSPPLISLTHSLCPPLLLLQWDVLSHGNQVQEVSRIPNGSNPGNCISLLRGLNASQNSMLILQESCTDASGSLVVYSPIDIPAANVVMSGEDPSSIPLLPSGFTILPDGRPGSAAGASTSSAGPLAAARGGGGGGAGGGSVVTVAFQILVSSLPSSKLNAESVATVNGLITTTVEQIKAALNCSAHGHHP

SEQ ID NO: 1916 - protein, 892 aa, Xanthobacter autotrophicus
MNAPLASPPSVKTTCPYCGVGCGVKATPDGLGGALVEGDAAHPANLGRLCSKGAALGETVGLDTRLLHPLVRGTDGALARASWDTALDRIADGLKTVRDAHGPGAIAFYLSGQLLTEDYYAANKLAKGFLGTAHVDTNSRLCMSSSVAGHKRGFGSDTVPGSYEDLEAADLIVLVGSNTAWCHPVLFRRMEAARKARGTKFVVIDPRRTETAAEADLHLPLAHGADALLFSGLLAHLAQSPAFDADYVRDHTTGFDAALAHARAMAPDAEATARACGLAVEDVARFFALFTDTARTVTCYSQGVNQSVAGTDKVNAILNCHFATGRMGREGMGPFSLTGQPNAMGGREVGGLANQLAAHMGFSPEEVDRVRRFWDAPHMATREGHKAVDLFAAIGRGEIKALWVMGTNPAVSLPEADGVRAALKGLDLFVLSENVVHNDTAACHPHVMLPAAAWGEKDGTVTNSERRISRQRPFLALPGAVKPNWWALAQVASRLGFGAAFAWRGPADIFREHAALSGFENAGSRDFDISAFADLSDTAYQDFTPVQWPAPRGRPQGTPRLFADGGYFTADRRARFVSPAPVAAARASEAYPFLLNTGRIRDQWHTMTRTGLSPRLGSHILAPFVAVHPDDAAPLGLADGGLARVSSAHGAAVLEVKIDAGQKRGTLFAPIHWSGATSSHGRVGPLVHAVTDPFSGQPDSKATPATLAPFTAPFEGFVLSRRPLAMPQGLWWARAALEGGFGWRTAGSLGPDEWAQWVKAEGPADVAELVDGPSGLYRAAAFDADGRLDFAVFEGTAGRRVAWDALKGLLKEDTVSTADRRTLLAGRRAGAAAACGPLVCACFGVPRDAIVGAIRAGAHDAAMVGEKLKAGTNCGSCLPEIRRLLAETTVPA

SEQ ID NO: 1917 - protein, 161 aa, Prochlorococcus marinus
MSMAINISQIVVRTPEGAEKSLSEYSGTVLLIVNVASRCGFTKQYKGLQALQNTYGPQGLKVLGFPCNDFGAQEPGTLEEIKSFCSTTYGASFELFDKVHAMGKTTEPYTTLNQTEPAGDVAWNFEKFLVGKDGTVLKRFKSGVEPESTELKAAIDQALMA

SEQ ID NO: 1918 - protein, 378 aa, Clostridium perfringens
MSENLTMSELMDSFELKHFHKGEIVKGKVISVKNDEIIVNIGHFADGVVPRNEISNDKNFDINSINVDDDIFVMVLSGDDGEGNVLLSKKRADAIKVCDDLKEAFEEEKSIKVSLKEVVKGGIVGDFNGLRVFMPASQCAGRRIENLEELVGKTLEVRVIEFNKENRKVVVSRRVIDEEIRNNEKKALWSSIKEGEKRKGKVTRLAKFGAFVDIGGVEGLVHLSDMSWSRVHKPEEVVSVGDEVEVFVSEVDMDRERIALSLKDVIKNPWETLEGLKVGNVVLGKVTNFIKVGAFVEVLPGIEGLVHISEITDENIAKPSDILELGQEVKVKILNIDDENKKMSLSIKDAVETSNEYMQYNDEEEGYSLADLFKGLNL

SEQ ID NO: 1919 - protein, 406 aa, Xanthobacter autotrophicus
MSEPLLIIGNGMAAAKLCEELSQRALGRYAVAVIGAEPHLAYNRVLLSEVLAGHMTAADAQMKPASWWRDRGVTLQYGTPAVAIDRTERAVVLADGRRLSYARLVLATGSHPIRLPLPGMDLNGVHTFRDLKDVEALLAAAAVPGTRAVVIGGGLLGLEAAVGLAGAGVKTSLVHLMDRLMERQLDPAAAGFLRRAVEGKDVEVLLQAASDAIEGDEQGRVTGLRLKDGRVVEADLVVVACGVIPNADLARAAGLEVKRGIVVDDTLATSDPAICAIGECAEHRGIAYGLVAPAYEQARVLAHRLAGEEARYDGSVMATNLKVSGVPVFSAGDVTGGEGTEDIVLTDRGLGVYRRLIVKDGLLVGAVLFGDTADGLFYLDLITQRTPITAMRADLAFGRDAIAAAA

SEQ ID NO: 1920 - protein, 377 aa, Unknown
  Synechococcus sp. RS9916
MADFYDLLGVSRDADADTLKRAYRRLARQYHPDINKEPGAEDRFKEIGRAYEVLSDPQSKARYDQFGEAGLGGAAGMPDMGDMGGFADLFETFFSGFGGAGGGAAGRQRRNGPQQGDDLRYDLTIDFDQAVFGQEREIRIPHLETCTTCNGSGAKSGSGPTTCSTCGGVGQVRRATRTPFGNFTQVAECPTCNGTGQVIADPCNACGGQGVTQVRKKLRINIPAGVDSGTRLRVAGEGNAGLRGGPAGDLYVFLTVKPHPHLRRDGLTVLSDVKVSYLQAILGDTIEVETVDGPTSLEIPPGTQPNAVLTLENKGIPKLGNPVARGNQRVTVAVQLPTRLNDDERTLLEQLAGHHSARGVQHHHHKSGLFARLFGQG

SEQ ID NO: 1921 - protein, 461 aa, Escherichia coli
MADNKPELQRGLEARHIELIALGGTIGVGLFMGAASTLKWAGPSVLLAYIIAGLFVFFIMRSMGEMLFLEPVTGSFAVYAHRYMSPFFGYLTAWSYWFMWMAVGISEITAIGVYVQFWFPEMAQWIPALIAVALVALANLAAVRLYGEIEFWFAMIKVTTIIVMIVIGLGVIFFGFGNGGQSIGFSNLTEHGGFFAGGWKGFLTALCIVVASYQGVELIGITAGEAKNPQVTLRSAVGKVLWRILIFYVGAIFVIVTIFPWNEIGSNGSPFVLTFAKIGITAAAGIINFVVLTAALSGCNSGMYSCGRMLYALAKNRQLPAAMAKVSRHGVPVAGVAVSIAILLIGSCLNYIIPNPQRVFVYVYSASVLPGMVPWFVILISQLRFRRAHKAAIASHPFRSILFPWANYVTMAFLICVLIGMYFNEDTRMSLFVGIIFMLAVTAIYKVFGLNRHGKAHKLEE

SEQ ID NO: 1922 - protein, 110 aa, Triticum aestivum
MDSQFGALERGGSRQRRSPVLARPNTTKRHIQQQRANAADKKVVMPNYFSIEAFFVLACLTVSLLILPLVLPPLPPPPSLLLFVPVCLLILLMVLAFMPTDMRSMATSYL

SEQ ID NO: 1923 - protein, 245 aa, Unknown
  Malus x domestica
  misc_feature (227)..(227): Xaa can be any naturally occurring amino acid
RGSNIELTVTILNSELPALNDAAAATAWVQKNVQPYSADVRFKYIAVGYEIRHYSAEVGSLLPAIQNIHSAIVAANLQGQIKVSTAIDTTLVANPFPPSDGVYDAANQFIQPVIDFLVNSGAPLLVNVYPYFSYIDNPSIDLAYALFTSQGVVVPDGTRYPSLFDALLDAQYAALEKAGAPNMEIVVSESGWPSEGGDQATPQNAATFCQNLINHVTSTTGTPKRPXKATETYLFAMFDESNSRG

SEQ ID NO: 1924 - protein, 345 aa, Bacillus halodurans
MKNVAVIGAGSWGTALSLVLADNGHHVTLVARREEIAREINERHTNETYLPSIEIPSSIVATCSMEEIIDVEIIVLVVPTKAIRQAVRSLNDVLKWPVTIVHASKGIEPGSHLRISEMIEEELEPTLLKEVVVLSGPSHAEEVSLRQPTTVTVSSKSLSTTKQIQDLFMNQQFRVYTNEDLIGVEIGGALKNIIALACGLTNGLGYGDNTKAAIMTRGLAEIGRLGVKLGASPLTFAGLSGLGDLIVTCTSIHSRNWRAGQMLGKGKSPAEVEESMGMVVEGIRTTQAAHELAQKLQIEMPITSALYSVLFEGKKPEHAADELMGRVKKHEMENLHDVVSDQKND

SEQ ID NO: 1925 - protein, 648 aa, Musa acuminata
MSSPPPSPSATPPSTSPPPPTSLSPPPASNSPPPAPNAPPPTPPSPPPASPPPPTPPPPADVPPPPVVTSPPPPAPPPPSVSPPPPALSPPPASTPPRPPSASPPPAAAPPPPPPSATPPPTNSPPPPPSATPPPTISPPPPGSQSPPAPAPSNSTGGTPPAPPKPPSPPSPSPSASHRAPAYPISPSSNGSGIPTSDVGQKSGQSSGDGGMKAGPAVAVALVTAVVLLGLLGAITWIVRRKRRKPPANYESGFAMSSPYQSSVMSESSHQRSPSAPLVHHHNHHKSGSLASESMVASTIGSATSWFSYEELYEITNGFSPQNILGEGGFGCVYKGCLSDGREVAVKQLKVGSGQGEREFKAEVEIISRVHHRHLVSLVGYCISDIQRLLVYDYVPNGTLESHLHGKGGPAMDWATRVKVAAGAARGIAYLHEDCHPRIIHRDIKTSNILLDNKFEAQVSDFGLARLAMDACTHVTTRVMGTFGYLAPEYASSGKLTERSDVFSFGVVLLELITGRKPVDGTRPLGDESLVEWARPLLAHAIETGEFGELPDSRLEDAYDDTEMFRMIEAAAACTRHSAAMRPRMGKVVRVLDSLSDVDLHNGVKPGQSEVFNVGQTADIRLLQRLAFGSQEFSSEYSQSNWSRQSDL

SEQ ID NO: 1926 - protein, 600 aa, Prochlorococcus marinus
MSGINKGLLLQNKNLSTFEITDNITCIRFLDHNKERFELEFNLEKGTSFNTFLIRSNDELFIIHPPEKNYSKTIIKIISTIFDNFNLDKVHIITGHINPKIIETIKAISTKFNKLSITCSNPGFKLISELWNQKNPNSTKFIEVQLPIFNVIKKELHLELESTGLELIPVPTARWPGGLIIYETDQEILISEKIFSAHIATTDWSETNRISTEIERKHFYDCLMAPMSNQIVTIAEKISELEIKTIAPLHGPTIEYSLKSFLNDYIRWGENLSTNNPKISLIYASAYGNTASIGDALAKGINRTAVEVDSINCEFTSNDELIQSIQNADGYLIGSPTLGGHAPTPIVSALGTLLSEGNRDKPVGIFGSFGWSGEAIDLLETKLKDGGFKFSFDPIRIKFSPNKPKIKELEEIGTHFGRKILKKAKQKIRKSDTGMISSKTDPTFQALGRVLGSLCVLTASKGTKENNIKGAMLASWVSQASFSPPGLSISVAKDRSVESLLQIGDSFALNILSDKDFREPLKRFTKPFSPGEDRFEGLDIELTPNNQIIIPDSLAWLEASIKERMECGDHWVIYAEVLHGNILKSDCLTAVHHRKSGANY

SEQ ID NO: 1927 - protein, 591 aa, Prochlorococcus marinus
MITSAKTSTSDMIKVEQKLSVQYKTFAADSSAIRSLDWERSRFDIEFGLRNGTTYNSFIIQGQKLAIIDTSHSKFKKLWFEQLLKEVNPEKIDYLITSHTEPDHSGLIGNLLSLNPHITVVGSKLALKFIEDQIHVPFKSLEVKSGQYLDLGDNPTSGVNHNIEFISAPNLHWPDTIFSYDHGTNVLYTCDAFGLHYCSDEFFDSNQKEIYDDFRFYYDCLMGPNARSVLQAIKRINKLPELKTIAVGHGPLLHNQVNFWKDKYLEWSANKSKGNEFVSVCYISDYGYCDRLSQAISHGISKADAQVQLIDLRSSDSQELTGLITESKAVVIPTWPVNSDNDLKESLGTLFAALKPKQFTAVYDAFGGDDEPIDSLSNKLRELGQKEAFSPLRVRNIPDPIIYQQFEEAGTDLGQLINKKKNIASMKSLDSNLDKALGRLSGGLYVVTASQGENSTFRQSAMVASWVSQASFSPPGITVAVAKDRAIESFMQVGKGFVVNILREDNYQKMFRHFLKRFAPGADRFADVDVISNIANGGPVLSDSLAFLDCKVSSRLETPDHWIIYGIVENGSVSDLSCKTAVHHRKVANHY

SEQ ID NO: 1928 - protein, 215 aa, Aspergillus nidulans
MAKETRFYPYTSNGGATLGVSGPDFAILAGDTRSTAGYNINTRYEPKVFTIQDARDRSIVISVIGFAADGRALKERLDAIVAMYKYQHGKNIGLRACAQRVSTMLYEKRFFPYQLQTMVAGIDADGQGAIYYYDPAGCIEKRSHCAAGEASSLMLPFLDSQAPRLQPLSLQTAQQLVRDAYTGATERHIEVGDHLQMLVVTREGVSEQLVDLKKD

SEQ ID NO: 1929 - protein, 365 aa, Dechloromonas aromatica
MSALRFHELTIKRVSPEAAGSVAITFNIPDAEREAFSFQPGQFLTLRAKVDGQDVRRSYSISSPRSRLAKAGELEIGIRPVEGGVFSNWAAQTLKAGAKLDVMPPDGRFVVKKQRAIHRVGFAAGSGITPILSIAATTLEEQPEAKFTLVYGNRRMSSVMFNESLQDLKDRYPDRLTLIHILSRQAQEVDLLQGRIDGAKVQAVIDALLPVKSMDEVFICGPEAMIEATEKALIEAGVPESRVYTERFTSGPAQAAKIQADTDAAPTRVAAAKDIALTVVLDGKEHELQIGPDEHVLDAAMNAGLDLPFSCKAGVCCTCRAKVLCGEVVMDKNYTLEGDEMAQGFVLSCQARATTKRLVVSFDER

SEQ ID NO: 1930 - protein, 455 aa, Francisella tularensis
MDNNQDKLKRDILSRHIVMISLGGTISASFFLGIGSILNTVGAFGTVIGFFIGGIIMMLVMISLAEMAIEMPISGSFQSYATKFISPYSGFLTGWLYLLNWLTAAAGGLVAAGIICNNFYPAISVWQFCLAIILIVSLLNLCAVRVFAEIEFWLSAIKIITIIIFIIIGIGIIGGFLHSNKPIAGLVNFYVDGLFPNGFKAFLFGLVIIVCTFQGAEVVGIAAGETKEPEKNIRKAIRSVAVRILLFFVFSSFIIAYVIPYKDSGITNTPFVTVLQLVNIKYVDTIMQLVILSASLSAVNSCFYTCARLMWSMAEANQAPKIFAKISKKQIPIYGVVFVALLSCICLITKFIGAEKIFILVISSSGMVGCMIWIIISMCHIYFRKSLTASQIESLRFKAWGFPLIPYTSILFNSCVILAMFWDPEQRMVVYSGVILILLFSFLYKFYYKKIIVKT

SEQ ID NO: 1931 - protein, 378 aa, Mycobacterium leprae
MARDYYGLLGVSRNASDADIKRAYRKLARELHPDINPDEAAQAKFKEISMAYEVLSDPEKRRIVDLGGDPMENAAASPSGFGGFGGLGDVFEAFFGGSSASRGPIGRVRPGSDSLLPMWLDLEECATGVTKQVTVDTAVLCDRCQGKGTNGDSAPIPCDTCGGRGEVQTVQRSLLGQMVTARPCPTCRGVGVVIPDPCCQCVGDGRVRARREITVKIPSGVGDGMRVRLAAQGEVGPGGGPAGDLYVEVHEQAHDIFVRDGDDLHCTVSVPMVDAALGTTITVDAILDGMSEIDISPGTQPGSVIELRGQGMPHLRSNTRGNLHVHVEVMVPTRLDQHDTELLRELKRRRSRDVAEVRSTHAAGGGLFSRLRETFTNR

SEQ ID NO: 1932 - protein, 332 aa, Zea mays
MGADGGLNRPAEKPSDGEGGEARVFRCTDYSLPRTTLALALWLGGIHFNVLLVLASLFLLSGRAAAIVVAFQLLFMFAPVNDRDKWGRSVARFICRHAMGYFPITLHVEDYKSLDPSRAYVFGYEPHSVLPIGLSALADLVGFLPLTKIKVLASSAVFYTPFLRQIWTWLGLVPATRKNFYCYLGAGYSCIVVPGGVREMLHMNNDSEVAFLKSRKGFVKIAIQSGCPLVPVFCFGQSYAYKWWRPGGKLFIKIARAVKFTPIIFWGRFGTPFPFPKPMHVVVGKPIEVNKIPHPTIDEINEVHEQFIIAMRDLFEKYKAKAGYPGLHLRVL

SEQ ID NO: 1933 - protein, 268 aa, Zea mays
MTEQLNREYDIGDEIGRGRFGVVRRCVSRATGDAFAVKSVDRSLLGDDLDRALAELEPKLARLAGGEGDGNPGVLQVRAVYEDDAWTHTVMDLCTGPDLLDWIRLRRGAPVPEPDAARVVAQLAEALAGCHRRGVVHRDVKPDNVLLDVDPAGEAPPRVRLADFGSAAWLGEGARGRAEGLVGTPHYVAPEVVAGGEYGEKVDVWSAGVVMYALLSGGALPFGGETAADVFAAVLRGSLRFPPALFAGVSPAAKDLMRRMMCRISNET

SEQ ID NO: 1934 - protein, 439 aa, Brassica rapa
MLLESDGEMSLETTNSPISSGTESCSSFSRLSFDAPPSTTAIIPEEESCLSLKPHRSSDFAYAEILRRRKHSLTFRDFRLMRRIGAGDIGTVYLCRLAGDQEESRSSYFAMKVVDNEALAMKKKMHRAEMEKKILKMLDHPFLPSLYAEFEASHFSCIVMEYCSGGDLHSLRHRQPQHRFSLSSARFYAAEVLVALEYLHMLGIIYRDLKPENILVRSDGHIMLSDFDLSLCSDSIAAVESSSSTPENYPHSSPRRLTRLAKLFNRVLRSKKVQTLEPNRLFVAEPVTARSGSFVGTHEYVAPEVASGGSHGNAVDWWAFGVFLYEIIYGRTPFAAPTNDVILRNIVKRPLSFPTDSPATMFELHARSLISGLLNKDPSTRLGSRRGAAEVKVHPFFKGLNFALIRTMTPPEVPSDVRRPKKSATFGGRSSKPAAFDFF

SEQ ID NO: 1935 - protein, 766 aa, Ostreococcus tauri
MLREEGRLPTSTSSETRASRRATRASFGTERAGDVKSVLIVDDVALVRRIHAGHVGKLGYRTIDARDGAEALRLYGENHAGLQGILLDVMMPGMDGFQTAGGIRELEQKQALRRMPIIAVTSLTEKEMQWDDKLASFDGHVDKPTSMSTLASIFKSMSMTPDLRISENEATGAAHASLLDPHGVKRTRGANMPSSSESDADGNLDGSNEGSSEQNGRKGSNSDRDAEGQRSSGGSGNEEGQNAYVSPRSERRVRSPGPDNRSRRPANATMAGSGKNTSGGNASDEGSGDASRQGSADEDGEMKSTMDTKAETAPESNAKVKDLATGKVPSADNGDAEIKTATKTTRASAGKAVENEESPNAKAMEENTPIPCARCGSDRTRFCYYNNGLPTQPRYYCRSCQRYWTDGGILRNLPEGSGKRKDRAPLINTNLPQTSVPLAPETAPQKPTVPVTTMVSGEANANAPTEMQRAVLMLMTQVAGFDVNHAAKHAGVVASRAGEQVAQAVLQNLGHTSEAIDMAISMAKITGWRIGLSVSAVATASVSQGLNPAEISNLISTQLPFLADTLVREISEQAKTMKLMRKSPSGGSDSGGSGGTGEENGGKSATSAKSASTTATATAMGTLPSTQEALMQRWMSDLRNFGFGASQGTGMPPANETEIPVARKPFESNVQATANLRTIEKSSSSAFEVPKSASTGAFTVPMPVPRTANAPAPMNFPMNPTAWLAKMNRQASLRSQQNNSGTPPTQQHFVKTEVPRVDDKTRPERK

SEQ ID NO: 1936 - protein, 246 aa, Solanum lycopersicum
MASNTLMSCGIPAVCPSFLSSTKSKFAAAMPVSVGATNSMSRFSMSADWMPGQPRPSYLDGSAPGDFGFDPLGLGEVPANLERYKESELIHCRWAMLAVPGIIVPEALGLGNWVKAQEWAAIPGGQATYLGQPVPWGTLPTILAIEFLAIAFVEHQRSMEKDSEKKKYPGGAFDPLGYSKDPAKFEELKVKEIKNGRLALLAFVGFCVQQSAYPGTGPLENLATHLADPWHNNIGDVIIPKGIFPN

SEQ ID NO: 1937 - protein, 498 aa, Acidobacteria bacterium
MAILLFISVLLISACGLIYELIAGTLASYLIGDSVFQFSTIIGSYLFAMGIGSALSRYIRSGLVHRFIWIELMVGLIGGFSSALLFLAFAYTQAFGLLMYTLVIVIGVLLGLEIPLLMRIVREKYDFRDTVAHVLTFDYIGALGASLLFPVLLVPKLGLVRSAMLFGIVNALVALWSTFLFGSELAKRTMLRAMSAIVLIALCAGMVNARKITAAAEDNIYADEIVFARDTRYQHIVLTRFKDDLRLFLNSHLQFSSRDEYRYHEALIHPGLSAVPVPRHVLVLGGGDGLAVREILKYPQVESITLVDLDPEMTKLFSTNPMLTALNKKSFLDPKVKVINADAFPWIDQSTESFDFIVIDFPDPTSYSLGKLYTTTFYRAVARHLSEQGFMVVQSTSPMFARDSFWCIAETLKQTGLKTYPYHVYVPSFGEWGFVLAGTHEYEAPTSLPQGLRFVSTATLPTLFQFPPDMAPMNVPANHLNDQVLVRMYDNDWKDISH

SEQ ID NO: 1938 - protein, 177 aa, Unknown
  Acinetobacter sp. ADP1
MRTIMQQALFGGGCFWCTEAVFQQIRGVEKIVSGYAGGVNENPTYEAVCTGETNHAEVILIDFDESQVSYDDLLHVFFAIHDPTTLNRQGNDIGTQYRSVIYYFDEHQKQDAEKLIAELKAEGMSVVTELSPMPTFYPAEDYHQDFYTKNPSQGFCNFAIPPKIAKLRSKFQSLLKA

SEQ ID NO: 1939 - protein, 721 aa, Prochlorococcus marinus
MEGKNTSITFDGREIRLTTGLYAPQAGGAVMIECGDTSLLVTATKTTKKQAADFLPLICDYEEKLYAAGRIPGGFMRREGRPPERATLIARLIDRPMRPLFPSWMRDEIQIVASCLSLDERVPADVLGVTGASIATLLAEIPFYGPMAAVRVGLIGDDFILNPSYREIEKGDLDIVVAGSPEGIVMIEAGANQLSEQDTIEAIDFGYEAVSELIKAQENLLKDLGIKQVKPLEPEEDKALATYLEKNCTKPIDLILKKFDQSKEERDLELDKIELEVQTKIDSLKDDNQLKVLTSENEKLIHSDFKKLTKKLMRSQIINEGKRVDGRDLDEVRKISASAGILPKRVHGSALFQRGLTQVLSTTTLGTPSDAQEMDDLNPSTEKTYLHHYNFPPYSVGETRPMRTPGRREIGHGALAERAITPVLPGKETFPYVLRVVSEVLSSNGSTSMGSVCGSTLSLLDAGVPLKAPVSGTAMGLIKEGKEVRILTDIQGIEDFLGDMDFKVAGTEKGITALQMDMKITGLPVSVISDAIKKARPARLHILEKMQEAIDKPQESLSPHAPRLLSFRIDPELIGTVIGPGGRTIKGITERTNTKIDIEDGGIVTIASHDGAAAEEAQKIIEGLTRKVHEGEIFPGVVTRIIPIGAFVEILPGKEGMVHISQLSEARVERVEDVVRQGDEVTVRVREIDSRGRINLTLRGVAQNGGMSYPEPTPTPVAPLN

SEQ ID NO: 1940 - protein, 426 aa, Zea mays
  misc_feature (179)..(179): Xaa can be any naturally occurring amino acid
MAAAAAVFFPSTPNPRHRLAAAARRPPPSFTGATDAVPLPEDEDSSDDDADDDGAPRRSGRRDRRRAVRVAWKKLVRWSRSWRRRNRSDVLETTRKVVVLGGGSFGTAMAAHVAAKKADLEVAMLLRDDHICRSINNAHVNCKYLSEHRLPENIVATTSAADALAGADFCFHAVPVQFXSFLESISTHVDPKLPFISLSKGLELNTLRTMSTIIARALGNRRQPFVVLSGPSFAVELMNKLPTAMVVASKDNKLASSVQQLLASPNLRISTSSDVTGVEIAGALKNVLAIAAGIVEGMSLGNNCMAALVAQGCSEIRWLATKMGAKPTTLSGLSGSGDIMLTCFVNLSRNRTVGLRLGSGEKLDRIMGSMNQVAEGVSTAGAVIALAQKYKVKMPVLTAVARIIDNELTPTKAVLELMNFPQVEEV

SEQ ID NO: 1941 - protein, 100 aa, Triticum aestivum
  misc_feature (59)..(59): Xaa can be any naturally occurring amino acid
  misc_feature (86)..(86): Xaa can be any naturally occurring amino acid
  misc_feature (89)..(89): Xaa can be any naturally occurring amino acid
STLPLMDGDQDQGHFQAFHLPKDPPILFPFMIDNPVEHQGQGYGDQHSRQQFLGESNQXFNDHMMMSGGSADSLPHAPRSGPTIQXSIXSDMIQNSHTFL

SEQ ID NO: 1942 - protein, 341 aa, Lolium temulentum
MVVLAKPAALEQISLLRTPEPWETFSGVPAVDLSGPDAAGDVVRACEQFGFFSVVNHGVPAGVVDRLEAEAVRFFGSSPAVKDASAPAGADPFGYGSKRIGRNGDMGWLEYLLLAIDRDALSEKASRAATSTALRDAINEYVVAMRGLARTVLEMVADGLGVSPRGALADMVTGDASDQVFRLNHYPPCPLLQGLPPSCSVTGFGEHTDPQLVSILHSNGTAGLQVALHDGRWVSVPPNRDAFFVNVGDSLQVLTNGRLKSVRHRVVAGSGLKSRVSMIYFGGPPLAQRIAPLPQLLAGLPLYREFTWGEYKKAAYRSRLGDNRLAPFEEPPVAAGHHHWS

SEQ ID NO: 1943 - protein, 473 aa, Lactobacillus plantarum
MNQPAVHPNKPIADVSSKPKTSTIANSLPNLPLKTIFAITFGFCGVNMAFSLQSSQMSRIFQTIGADPTKLGLFFILPPLAGLFVQPLVGKYSDRTWTRFGRRMPYLLFSAPLAALVMVLLPNAGSFGFGYASTAALLFGAIAILFMDLSSNVCMQPFRMIIGDMVNENQKDKAWSWQQAFSNLGGVLATILPFVLTYFGVANTAQKGVVPLSVRIAFYIGAIILLGISAYTIHTVKEYDPDTYALYHHINPEQHKHTKPIWQLVKEAPKAFWEVALVQLFAWIGIQYMWTYTTGAIAENVWHTTNAASAGYQAAGNWYGILTFIQSMAAVLYGFLVLSRTNPYKRKFWYRFGLASFAVGLVWVFFIHNQYLLIAPFCLIGIGFFTVHVEPFNIFTSSLDGANEGSYIGIFNGTICLPQILASVASFMVFKFVGNSMPGMMLIAGISMFIAVLAISIIKQDNPQEDLSENPTK

SEQ ID NO: 1944 - protein, 506 aa, Petunia axillaris
MMLLTELAAATLITLIAHIIISTLISKTTSRRLPPGPRGWPVIGALPLLGAMPHVSLAKMAKKYGAIMYLKVGTCGMAVASTPDAAKAFLKTLDINFSNRPPNAGATHLAYNAQDMVFAHYGPRWKLLRKLSNLHMLGGKALENWANVRANELGHMLKSMSDMSREGQRVVVAEMLTFAMANMIGQVMLSKRVFVDKGVEVNEFKDMVVELMTIAGYFNIGDFIPCLAWMDLQGIEKRMKRLHKKFDALLTKMFDEHKATTFERKGKQDFLDVVMENGDNSEGERLSTTNIKALLLNLFTAGTDTSSSAIEWALAEMMKKPTILKKAQAEMDQVIGRNRRLLESDIPNLPYLRAICKETFRKHPSTPLNLPRISNEPCIVDGYYIPKNTRLSVNIWAIGRDPQVWENPLEFNPERFLSGRNSKIDPRGNDFELIPFGAGRRICAGTRMGIVMVEYILGTLIHSFDWKLPSEVIELNMEEAFGLALQKAVPLEAMVTPRLQMDVYVP

SEQ ID NO: 1945 - protein, 113 aa, Hordeum vulgare
MTEKKNRREKKNPREAKVTFEGLVTEALPNGMFRVRLENDTIILGYISGKIRPSSIRILMGDRVKIEVSRYDSSKGRIIYRLPHKDSKRIEDSKDSEDLKDSEDLKDTKDSKD

SEQ ID NO: 1946 - protein, 424 aa, Thermus thermophilus
MKSEPLSYLGKDGGPWEIFTEQVDRVVPYLGRLAPLAESLKRPKRVLIVDVPVRLDDGSVAYFEGYRVHHNTARGPAKGGVRYHPEVTLSEVMALAGWMTIKNAAVGLPYGGGKGGIRVDPRKLSPGELERLTRRYTSEIGILLGPDRDIPAPDVNTGEREMAWMMDTYSMNVGRTVPGVVTGKPIALGGSLGRRDATGRGVFITAAAAAEKIGLQVEGARVAIQGFGNVGNAAARAFHDHGARVVAVQDHTGTVYNEAGIDPYDLLRYVQEFGGVRGYPKAEPLPAADFWGLPVEFLVPAALEKQITEQNAWRIRARIVAEGANGPTTPAADDILLEKGVLVVPDVIANAGGVTVSYFEWVQDFNSYFWTEEEINARLERVLRNAFGAVWQVAQEKKIPLRTAAYVVAATRVLEAQALRGLYP

SEQ ID NO: 1947 - protein, 419 aa, Thermus thermophilus
MPLKAYRPPEDPGLWDTYLEWLERALKVAEAHPTTLEYLAHPKRLVTLSLPVVMDDGKVRIFQGYRVVHDIARGPAKGGVRLDPGVTLGQTAGLAAWMTLKAAVYDLPFGGAAGGIAVDPKGLSPQELERLVRRYTAELVGLIGPDSDILGPDLGADQQVMAWIMDTYSMTVGSTVPGVVTGKPHALGGSEGRDDAAGLGALLVLEALAKRRGLDLRGARVVVQGLGQVGAAVALHAERLGMRVVAVATSMGGMYAPEGLDVAEVLSTYEATGFLPRLDLAPEEVFGLEAEVLVLAAREGALDGDRARQVQAQAVVEVANFGLTPEAEAYLLGKGALVVPDLLSGGGGLLASYLEWVQDLNMFFWSPEEVRERFETRVARVVDAVCRRAERGGLDLRMGALALALERLDEATRLRGVYP

SEQ ID NO: 1948 - protein, 113 aa, Hordeum vulgare
MTEKKNRREKKNPREAKVTFEGLVTEALPNGMLRVRLENDTIILGYISGKIRSSSIRILMGDRVKIEVSRYDSSKGRIIYRLPHKDSKRIEDSKDSEDLKDSEDLKDTKDSKD

SEQ ID NO: 1949 - protein, 175 aa, Musa acuminata
MFNLRFLVYRLQFAQKISRSMNINLAYNCRYRAITSAYYRGAVGALLVYDVTRHTTFENVSRWLRELRDHTDPNIIIMLIGNKSDLRHLVAVPTEDGKAYAEKESLYFMETSALEATNVDNAFAEVLTQIYHIVSRKAVEAGDDAASSAPPSTGERINVKDDASTTMRKLSCCST

SEQ ID NO: 1950 - protein, 823 aa, Pneumocystis carinii
MDYLKKVRLWSEEEVGEWLESNNFGDYMDIFKENNINGDILLECNAAVLKELGVKKLGDRIRLSVCIKGLREKCIESARKSKMSFLMIDNQIQGFSFTLQSPTDPLIPVKSSELASPTSNFQLDNSYSDACCFDSLNNFHSVLSNISCSTKSISRNSSISTQKVFEKSPIFLETNVMQSDSIKKNCLKFIGEKGQTRIVNISLCYTADAILSKALKKFNITENPSEWRVFITNEDGSFECISNDTLLTISRQLSRPERERLILKRKSDPLTQEEFKKSQTIAREQRDAIYHTAVMAKTSGNLRKLETFFGEKLAPTLTSSFTTPLPSPLPKDNKYGNITHIRNFFGQRPPSELINSNLAEYFPGHEKKVLEQTIKNSIKSNHLNSFKGSNFDTPSSTLTYDLSSIPAVGEERIQYEGRRLSGVSHTLSLSRFISTRFPTLLESSILRENSSHHTLSSSSKLNSEGNTQDSKPSFRKKLEEKASSDETFKSESPNMLMEPSILSDFYDASLETDRDLLDDNIFENNEAKDFNTEKEIENNNSGPTRWIKGALIGSGSFGSVFLGMNALSGELMAVKQVEIPSIDIQGCKRKRAMLDALQREISLLKELHHENIVQYLGSSMDETHLTFFLEYVPGGSVTALLNNYGAFEEPLIRNFVRQILKGLNYLHNKKIIHRDIKGANILVDNKGGIKISDFGISKKVEANLLSMTRNQRPSLQGSVYWMAPEVVKQTLYTRKADIWSLGCLIVEMFTGKHPFPKMNQLQAIFKIGQYVSPDIPEHCTSEARHFLEKIFEPDYHARPTAADLLKYSFLGPMVSSPLTDAKK

SEQ ID NO: 1951 - protein, 410 aa, Unknown
  delta proteobacterium MLMS-1
MSGFAELFEQEGVGGQQLEPGRKIKARVVEVGREWIFIDLGGKSEGSVAKAEFTDPEGNCTVAAGDELEVFFLADKKNEKIFTTKVGGAAAQAHLEEAFHGKVPVEGTVESETKGGFLIRIGGSSRAFCPYSQMDLRRAANPEEYLGQSFSFLIMEFREGGKNILLSRRQLLEQERQELKEQLRQSLKVGDLVTGTVTSVRDFGAFVDIGGIEGLIPISEIGWGRVEDIHSHLEPGRQVEVAVKSLDWEKDRYSLSLKDTLPDPWEQAAVSFPEGSTQRGRVARLTDFGAFVTLAPGVDGLVHISKLGAGRRLNHPREVVQVGDELEVRVEAVDVEQKRISLAVAPPTGSAEPETPYAIPADAPLAAATDKRPAAGDQGGQRPAAAKSQPAMGTLGELLQAKMQDKEGKK

SEQ ID NO: 1952 - protein, 281 aa, Legionella pneumophila
MKENKLTVALVQEQWYENPKEHQDKLASGIFSATQQGAKLVCLQELTLSPYFCTRSDVDPAPYMEDIATGPTAQFVSQMAKSNQIHITASLFEKAGYNTAVAFNPQGELIAVTRKQHIPSGEKYHENFYFKPGDSNYPVHTIAGHHLGLPTCYDQWFPELSRIYGLKGAEILVYPTAIGGEPTAPGFDSQPMWQKVMVAQGIMSNTFIIAVNRIGCEDDLSFYGSSFISTPMGEILVQAPRNEPAVLVAELDFSQRELWGRLFPFPQQREPETYHELVKSR

SEQ ID NO: 1953 - protein, 247 aa, Legionella pneumophila
MFKRRIHCDIPDNKMVNYCTFCWEKVVKFCIIGKIVLSLFVMNRTKSSKRWLQEHFDDVYVKKAQAEGYRSRAVYKLKEIDDKESLIKPGMTVVDLGAAPGGWTQYASEKMRGSGRLVALDILPMDALPNVEFILGDFREDNVLQELINLIPQRTLDLLLSDMAPNMSGSSAIDIPRAMYLVELAFDFAEKMLKPGGNMLVKIFHGSGFDELVKQARASFEKVVIRKPSASRSRSKETYLLAKGYNL

SEQ ID NO: 1954 - protein, 198 aa, Sinorhizobium meliloti
MLRLLFGFLVTCFLLLPARAAEPQYAIFAGGCFWCVESDFDAVPGVLETISGYAGGKSANPTYEDYAKGGHREVVRVKFDPDRVSYAELVGVLFRTTDPTDGDGQFCDRGFAYTTAIHALNERQAMDAKAEKIKAEAELGRPIVTPVEGAAKFWPAEDYHQDFGKRNPIRYWYYRNGCGRNRTVEKLWGDRAYAGVSH

SEQ ID NO: 1955 - protein, 367 aa, Ipomoea batatas
MTTVSTLTALAGETALQSSFVRDEDERPKVGYNEFSDEIPVISLKGIDDVNGRRVQIRNDIVKACEDWGIFQVVDHGVDAGLIGEMTRLSKDFFALPPEEKLLFDMSGGKKGGFIVSSHLQGEAVKDWREIVTYFSYPVRARDYSRWPDKPEGWRAVTEKYSEKLMDLACKLLEVLSEAMGLEKEALTKACVDMDQKVVVNFYPKCPQPDLTLGLKRHTDPGTITLLLQDQVGGLQATKDGGKTWITVQPVDSAFVVNLGDHGHFLSNGRFKNADHQAVVNSERSRVSIATFQNPAPEAKVYPLKVREGEKPTLEEPITFAEMYRRKMSKDLELARLKKFAKEQQQIIKAAAADKNLETKPIDQILA

SEQ ID NO: 1956 - protein, 507 aa, Staphylococcus epidermidis
MLNADLKQQLQQLLELMEGDVEFVASLGSDDKSNELKELLNEIAEMSAHITITEKSLKRTPSFSVNRPGEETGITFAGIPLGHEFNSLVLAILQVSGRAPKEKQSIIDQIKGLEGPFHFETFVSLTCQKCPDVVQALNLMSVINPNITHTMIDGAVFREESENIMAVPAVFLDGQEFGNGRMTVQDILTKLGSTQDASEFNDKDPYDVLIVGGGPASGSAAIYTARKGLRTGIVADRIGGQVNDTAGIENFITVKETTGSEFSSNLAEHIAQYDIDTMTGIRATNIEKTDSAIRVTLENDAVLESKTVIISTGASWRKLNIPGEDRLINKGVAFCPHCDGPLFENKDVAVIGGGNSGVEAAIDLAGIVKHVTLFEYASELKADSVLQERLRSLPNVDIKTSAKTTEVIGDDYVTGISYEDMTTGESQVVNLDGIFVQIGLVPNTSWLQNAVELNERGEVMINRDNATNVPGIFAAGDVTDQKNKQIIISMGAGANAALNAFDYIIRN

SEQ ID NO: 1957 - protein, 377 aa, Glycine max
MAHLALSQMAVTVPVGNDLSLRRSAVKAPNLNFWDKSWAPVFTLDLKPNNPSLRSRHVVCMSVQQASVSKVNVSPLELEDAKEPPLNLYKPKEPYTATIVSVDRLVGPKAPGETCHIVIDHGGNVPYWEGQSYGVIPPGENPKKPGAPHNVRLYSIASTRYGDFFDGKTASLCVRRAVYYDPETGKEDPSKNGICSNFLCNSKPGDKIQITGPSGKIMLLPEDDPNATHIMIATGTGVAPFRGYLRRMFMESVPAYKFGGLAWLFLGVANTDSLLYDDEFSKYLKDYPDNFRYNRALSREQKNKSGGKMYVQDKIEEYSDEIFKLLDNGAHIYFCGLKGMMPGIQDTLKKVAEQRGESWEEKLSQLKKNKQWHVEVY

SEQ ID NO: 1958 - protein, 713 aa, Agrobacterium tumefaciens
MFNKHSVEIEWAGRPLKLETGKVARQADGAVIATYGETMVLATVVSAKSPKPGQDFFPLTVNYQEKTYAAGKIPGGYFKREGRPSEKETLVSRLIDRPIRPLFPEGYKNDTQVVVTVIQHDLENDPDVLSMVAASAALTLSGIPFMGPVGGARVGYINGEYVLNPHLDEMDESVLDLVVAGTQDAVLMVESEAKELNEEIMLGAVMFGHKGFQPVIDAIIKLAEVAAKEPREFEPEDFSALENEMLGLAETELRTAYKITEKAARYAAVDAVKTKVKAHFLPEEGEAKYSPEEIGAVFKHLQAKIVRWNVLDTKSRIDGRDLSTVRPIVSEVGILPRTHGSALFTRGETQAIVVATLGTGEDEQYVDSLTGMYKERFLLHYNFPPYSVGETGRMGSPGRREIGHGKLAWRAIRPMLPTAEQFPYTLRVVSEITESNGSSSMATVCGTSLALMDAGVPLAKPVAGIAMGLILEGERFAVLSDILGDEDHLGDMDFKVAGTADGITSLQMDIKIAGITEEIMKIALEQAQGGRKHILGEMANAITESRGQLGEFAPRIEVMNIPVDKIREVIGSGGKVIREIVEKTGAKINIEDDGTVKIASASGKEIEAARKWIHSIVAEPEVGQIYEGTVVKTADFGAFVNFFGARDGLVHISQLASERVAKTSDVVKEGDKVWVKLMGFDERGKVRLSMKVVDQATGKEVAADKKDGEAAAE

SEQ ID NO: 1959 - protein, 231 aa, Brassica napus
TSNNASVNRTLDLASALEGSTRQGGEADPNGCHFRSVLTIAFQFTFDNHTRDNVASMARQYVRNIVGSIQRVALAIAPRPDSSISPISAPTSPEALTLVRWISRSYRVHTGVDLFGSDSQISGDTLLHQVWSHTDAILCCSMKTNASPVFTFANQTGLDMLETTLVSLQDITLDKTLDEPGRKALCSEFPKIMQQGYAHLPAGVCASSMGRLVSYEQATVWKSLEDHESNH

SEQ ID NO: 1960 - protein, 541 aa, Glycine max
MQRSREALLHRRRAKTGSGYKLSLSLLFLLWPLIFRAHGYPAPTESNWKQNKQGQCKTSNFANKCLLKETHDYILPDPEDAESVPNDSDTPTREDVQKSDHLPWAVPLGLDEFKSRAISSKINSGTAGSSGSVMHRVEPGGAEYNYASASKGAKVLCSNQEAKGASNILSGDKDKYLRNPCSAEEKFVIIEISEEILVDTIQVANFEHHSSNLKAFELLGSLSFPTDVWVFFGNFTASNVRHAQRFVLQEPKWVRYLKLNLQSHYGSEFYCTLSAVEVYGVDAVERMLEDLIHTQDNLYAPGDGDADKRTVSPHPNPPESEDVHQNNFGDPASDISSANHEKVNSNVPDPVEETHQQVGRMPGDTVLKILMQKVRTLDLNLFALERYMEDLNSRYVNIFKEYSKDMGGKDILIQNIKDGIRNLVDRQDAITKGASDLKSWKSHISMQLDHLLRDNAVLRSEVNEVRRKQTSLENKGVLVFLVCCIFSLLVILRLSLDMATSVYRVVLSVNRTDCSRKFCAVSSSWFLLLLNCIIVIFILTL

SEQ ID NO: 1961 - protein, 259 aa, Bordetella parapertussis
MISLPYLQRFALSGQVALVTGSARGLGLRIAQALAGSGAHVLLNGRDAHAVEAAVSDLCQQGLRASALPFDVSDEQATEQAFARIDAEHGRLDILVNNVGARNRKPLAETSPAEIRAMMDTNLVAGILLARLAAQHMVRQRYGRLIAITSVAGELARANDAVYPAAKQGLTGMMRALAVEFGRHGITSNAIAPGAFATETNAAMANDPQAGAAMAARNPTGRWGDPEEIAGAAVFLASPAASYVNGHVLVVDGGLSVQF

SEQ ID NO: 1962 - protein, 417 aa, Cryptococcus neoformans
MPLKRPSPGPHPLDLNPYERLQFEEKENRRSHNDTDHHATLTSRQEGLRRRAALGENVDISADGESKEDEGYSAEKRNDRLSSPEDTKTGEGKGKKSPLMSNLKLDDFRDTLEAGIERKFAPLHIPPHRRLQTAAVALWALLLPICMIVLLLLLSLPPMWLILIPYFIWISFDRAPIHGGRPKEWARKGFIWKYFADYYPCSIVKEAELPPNRPYLFGYHPHGIIGMGAFATFATEGTNFSEYFPGIKPHLLTLGSNFKIPFYRELLMIHGCGSVSKRSCANVLSQGPGSAIAIVIGGASESLSAHPGTADLTLKKRFGFVKMAIREGADLVPVFSFGENDIYAQLANAKGSMVYKLQKKFEKVFGFTLPLFYGRGQLWTNAVSSSYRFCRWKAHSCRTGSTSKRRKGARATEQIHC

SEQ ID NO: 1963 - protein, 370 aa, Synechococcus elongatus
MAPMSETLVVKIGTSSLTNPHHPGLALSTIAGLVEVICQLRRQGYNVVLVSSGAVGVGCTRLGLRDRPSRIAQRQAIAAVGQGRLMRTYDDLFTTLGQPIAQVLLTRGDLAQRQRYINAYQTFQELFELGVVPIVNENDTVAVEELKFGDNDTLSALVASLVEAQWLFLLTDVDRLYTADPRQDPNAKPITIVHDLSELESIQAGGQGSRWGTGGMATKLTAAKIATQASVRTVITQGRSPENLLKILAGEAIGTWFEPQPETVNARKRWIAHGLVPTGKLLLDAGAVQAIQAGGKSLLAAGIQAIEGDFEAQDAVQLCDLNGTEIARGLVNYDSHELQQIRGCQSDQIVQILGYEGAETIVHRDNLVLS

SEQ ID NO: 1964 - protein, 295 aa, Unknown
  Vibrio sp. Ex25
MSKHMATNDSVTSFPKPKPRLVSDNPVAGVTRFAKQSLQPGEVALVGAGPGDPELLTVKALNCLQQADVVLYDYLVSEEIMALIPSDTILVCVGKRAGHHSVPQEKTNQLLVDFAKQGYKVVRIKGGDPFVFGRGGEELEVLADAGVRFQVVPGITAAAGATAYAGIPLTHRDYAQSAIFVTGHLKEESDEMDWSTLARGNQTLVIYMGLMKSHYIQNQLIKHGRSASTPIAIIERGTQIQQKVFTGELSQLSDLSKEAQSPSLIVVGEVVRLSQKLDWFLSSTEFNKSAIANSI

SEQ ID NO: 1965 - protein, 191 aa, Sorghum bicolor
GDYGWDTAGLSADPETFARNRELEVIHSRWAMLGALGCVFPEILAKNGVKFGEAVWFKAGAQIFSEGGLDYLGNPNLVHAQSILAIWACQVVLMGFVEGYRVGGGPLGEGLDKVYPGGAFDPLGLADDPDTAAELKVKELKNGRLAMFSMFGFFVQAIVTGKGPIENLFDHVADPVANNAWAYATNFVPGN

SEQ ID NO: 1966 - protein, 446 aa, Cryptococcus neoformans
MPLKRPSPGPHPLDLNPYERLQFEEKENRRSHNDTDHHATLTSRQEGLRRRAALGENVDISADGESKEDEGYSAEKRNDRLSSPEDTKTGEGKGKKSPLMSNLKLDDFRDTLEAGIERKFAPLHIPPHRRLQTAAVALWALLLPICMIVLLLLLSLPPMWLILIPYFIWISFDRAPIHGGRPKEWARKGFIWKYFADYYPCSIVKEAELPPNRPYLFGYHPHGIIGMGAFATFATEGTNFSEYFPGIKPHLLTLGSNFKIPFYRELLMIHGCGSVSKRSCANVLSQGPGSAIAIVIGGASESLSAHPGTADLTLKKRFGFVKMAIREGADLVPVFSFGENDIYAQLANAKGSMVYKLQKKFEKVFGFTLPLFYGRGLFNYNYGLMPFRHPIVSVVGKPIHVERDPHPSDEKVQELQSKYIAELTRIWDKYKDLYARGRTKELTLVE

SEQ ID NO: 1967 - protein, 94 aa, Ostreococcus tauri
MSQAKTKTALEIARKAAEIFGHHLGNGLPSGRKILRKPLIGERLVNWYPSSMAKMDPLFADPGDARRKVKLERMKRRGKGPPKKGEGKRASKGK

SEQ ID NO: 1968 - protein, 79 aa, Phyllostachys aurea
  misc_feature (2)..(3): Xaa can be any naturally occurring amino acid
PXXKFGANDMRTFYTLVMVDPDAPSPSEPNFREYLHWLVTDIPGTTGAAFGQEVVCYESPRPTMGIHRFVFVLFQQLGR

SEQ ID NO: 1969 - protein, 87 aa, Olyra latifolia
KPSMVVHQPRVDIGGNDMRTFYTLVMVDPDAPSPSDPTLREYLHWLVTDIPGTTGAAFGQEVMCYEPPRPSMGIHRFVLVLFQQLGR

SEQ ID NO: 1970 - protein, 316 aa, Tulipa gesneriana
MASFPVINLEQLEGGERSTVMEALHDACANWGFFELLNHGISHELLDKVERLTKDHYKKCMEERFREFASKTLRDGSMVDVDNLDWESTFYLRHLPTSNMSEIPDLSDEYRETMKEFALRLEELAEQLLDLLCENLGLEKGYLKKAFSGSKGPTFGTKVSNYPPCPKPKLIKGLRAHTDAGGLILLFQDDKVSGLQLLKDGEWVDVPPMHHSIVINLGDQIEVITNGKYKSVMHRVLAQPDGTRMSIASFYNPGSDAVIYPAATLLEEAEKQSEVYPKFVFEDYMKLYAVQKFQAKEPRFETMKTMKIADAQSIAT

SEQ ID NO: 1971 - protein, 560 aa, Treponema denticola
MNESTMQRLRYNYEPKIPKVFAEPLSLIKPEIGEATHAQSNQAELKEIFPHTYGMPIIRFVKGKSEVEHKPLKFGVILSGGQAPGGHNVISGLFDALKKGNANSKLYGFLRGPEGLVKGRYVEIKKALIDKYRNTGGFDIIGSGRTKIETEEQIESSIQNVKKLKLDALIIIGGDDSNTNAAFLAKYFIQAKLDTKVIGVPKTIDGDLKNQYIETSFGFDTATKLYSELIGNICRDVNSARKYWHFIKLMGRSASHIALECALKTQPNVCLIGEELAEKKVTLQQVTDYIVDIIVKRSQKGENFGVVLVPEGIIEFIPEMDELIEEINDIMAEKTSAFSKLKTFAGKKSWLQKHLSKKAFALFDNLPENISLQLLMDRDPHGNVQVSRIETEKLLIDLVTRKITEMKKEGTYNGKFSTYAHFFGYEGRSAFPSNFDSDYCYTLGFTAFLLALNGFSGYIASVKNLTDEVEHWLPCGVPLSMMMNMERRKGKMTPVIKKSVVDLNGKPFKTYEKNRDKWAVETLYRFPGAIQYFGDLEVCDIPTKTLLLEKGNLKEKRKKK

SEQ ID NO: 1972 - protein, 133 aa, Prochlorococcus marinus
MRMLHTMLRVGDLDRSLRFYTEVLGMQLLRRKDYPSGRFTLAFVGYGEESDTTVLELTHNWDQDHYELGEGYGHIALGVEDIQSTCLAISKRGGRVVREPGPMQHGSTVIAFVEDPDGYKVELIQLASREAAS

SEQ ID NO: 1973 - protein, 358 aa, Triticum aestivum
  misc_feature (342)..(342): Xaa can be any naturally occurring amino acid
AYLGDSLEQVCTKKQAGTGPEFPGYRRPTRPITFSEASIFADPHGRGLRALSRAQIDSVLDLARCTIVSELSNKDFDSYVLSESSLFIYSQKIVIKTCGTTMLLLTIPRILELAEELCMSLAAVKYSRGMFIFPGAQPAPHRSFSEEVDVLNRYFGHLKSGGNAYVIGDPAKPGQKWHIYYATEQPEQPMVTLEMCMTGLDKKKASVFFKTSADGHVSCAKEMTKLSGISDIIPEMEVCDFDFEPCGYSMNAINGSAFSPIFGGRGHAATWGKKLDAEAYDCNNVVEQELPCGGVLIYQSFAANEEVAVSAGSPRSVFHCFEAETVESHPLVKEGKLANLLXAWRAEDSLEEGVVLCE

SEQ ID NO: 1974 - protein, 129 aa, Vibrio vulnificus
MLRVGNLDKSIQFYTEVMGMQLLRTNENKEYEYTLAFLGYGDESQGAVIELTYNWGKTEYDLGSAFGHIAIGVDDIYVTCDAIKAAGGNVTREPGPVKGGTTHIAFVKDPDGYMIELIQNKQASAGLEG

SEQ ID NO: 1975 - protein, 323 aa, Rhodospirillum rubrum
MRVLPFAPANPAPAPAQRRVMIIANPAAGSLKQRRLNRTLLGLEKLGCTVGLRETAKPGDATLMAREAALAGNVDVVVAAGGDGTINEVANGLAGSGVALGVIPLGTANVLAIEAGIPRDPGKAAQVIATGVLRKLYLGEVRASAETPLAGPRRFVMMAGAGFDAHVVDTVDLALKRKTGKLAYVWCTVQRAFSYDFPLCAVDIDTPDGRTIHADVATAVVCNGKYYGGPFIAAPLADISHPTFQVILLKSPGLRHVARYALALAMGRLPRLPDVEIIEATRVRIALQGAQPLQADGDTVAHMPVDIVMAAEPVSLIVPAPAA

SEQ ID NO: 1976 - protein, 151 aa, Nicotiana alata
MAVNSVKALVLLQLSILVISSFSELTNGDHGTESLPDATLQRFKFKWPFFGKSPKNSPKSSPSRSPPPKREQPSPPPPVKSPPPPSPSPPPPSPPPPSPSPPPPSPSPPPPSPPADDMAPSPSPAAAPTPPDMLLRPSARLAGNMVISGLH

SEQ ID NO: 1977 - protein, 344 aa, Xanthobacter autotrophicus
MPKFKLEYIWLDGYTPTPNLRGKTQIKEYDVFPTLEQLPLWGFDGSSTQQAEGRSSDCVLKPVAVYPDPARTDGALVMCEVMMPDGVTPHPTNKRATILDDAGAWFGFEQEYFFYKDGRPLGFPEHGYPAPQGPYYTGVGFKNVGNIARQIVEEHLDLCLAAGINHEGINAEVAKGQWEFQIFGKGSKKAADEVWMARYLLLRLTEKYGVDIEFHCKPLGDTDWNGSGMHANFSTTYLREVGGKAYFEALMAAFEANLEDHIAVYGPDNHMRLTGKHETAPWNKFSYGVADRGASIRVPHSFVKNDYKGYLEDRRPNSMGDPYQIASQILKTIASVPTDVSAAA

SEQ ID NO: 1978 - protein, 311 aa, Tulipa gesneriana
MASFPVINLEKLEGGERSKVMEVLHDACANWGFFELLNHGISHELLDKVEKLTKGHYKKCMEERFREFASKTLQDVSKVDVDNLDWESTFYLRHIPTSNMSEIPDLSDEYRETMKEFVLSLEELAEQLLDLLCENLGLEKGYLKKAFSGSKGPTFGTKVSNYPPCPKPELIKGLRAHTDAGGLILLFQDDMVSGLQLLKDGEWVDVPPIHHSIVINLGDQIEVITNGKYKSVLHRVVAQPEGTRMSIASFYNPGSDAVIYPATTLLEEAKKKSEVYPKFVFEDYMKLYAIQKFQAKEPRFETMKNMESAVI

SEQ ID NO: 1979 - protein, 427 aa, Rhodospirillum rubrum
MNDAARLTTDDIPGLMIDIGRRARAAGRILALAPAAARNAALLAGAAALRAEAGAIALENAKDMSAGRAKGLTDALLDRLELTPARIEAMAKGLEDIAALPDPVGTVLAGWQRPNGLRIERVRVPIGVIGVIYESRPNVTADAGALCLKAGNAAILRGGSESFNSSRAIHRCLAAGLRAAGLPEDAIQSVPTPDRAAVGMLLTMTDFIDVIVPRGGKSLIERVSAESKVPLFKHLEGLCHTYIHAKADPQKALSVTVNAKMRRTGVCGSTETILVDRAIAATILPPLLDALAKAGCALRGDEETRAFSERVGPATAEDWDTEYLDAIVSIRVVADLDEALAHIAAHSSDHTDCILTEDAAAAERFLTEVDSAIVMHNASTQFADGGEFGMGAEIGISTGRLHARGPVGVEQLTIFKYKVRGTGQTRP

SEQ ID NO: 1980 - protein, 372 aa, Bacillus subtilis
MSKRDYYEVLGVSKSASKDEIKKAYRKLSKKYHPDINKEAGSDEKFKEVKEAYETLSDDQKRAHYDQFGHTDPNQGFGGGGFGGGDFGGFGFDDIFSSIFGGGTRRRDPKLRARGADLQYTMTLSFEDAAFGKETTIEIPREETCETCKGSGAKPGTNPETCSHCGGSGQLNVEQNTPFGKVVNRRVCHHCEGTGKIIKNKCADCGGKGKIKKRKKINVTIPAGVDDGQQLRLSGQGEPGINGGLPDLFVVFHVRAHEFFERDGDDIYCEMPLTFAQAALGDEVEVPTLHGKVKIPAGTQTGTKFRLRGKGVQNVRGYGQGDQHIVVRVVTPTNLTDKQKDIIREFAEVSGNLPDEQEMSFFDKVKRAFKGD

SEQ ID NO: 1981 - protein, 258 aa, Arabidopsis thaliana
MAMAVSGAVLSGLGSSFLTGGKRGATALASGVGTGAQRVGRKTLIVAAAAAQPKKSWIPAVKGGGNFLDPEWLDGSLPGDFGFDPLGLGKDPAFLKWYREAELIHGRWAMAAVLGIFVGQAWSGVAWFEAGAQPDAIAPFSFGSLLGTQLLLMGWVESKRWVDFFNPDSQSVEWATPWSKTAENFANYTGDQGYPGGRFFDPLGLAGKNRDGVYEPDFEKLERLKLAEIKHSRLAMVAMLIFYFEAGQGKTPLGALGL

SEQ ID NO: 1982 - protein, 483 aa, Nicotiana tabacum
MDFIIYLFLSFSISLITFLLLRAAAAAHFRRRKTRLPPGTLGLPFIGETLQLISAYKTENPEPFIDDRVSKYGNIFTTHIFGEPTVFSTDAETNRFILQNEGRPFESSYPSSLQNLLGKHSLLLMRGSLHKRMHSLTMSFANSSILKDHLLADIDRLVRLNLDSWTGRVFLMEEAKKITFNLTVKQLMSLDPCEWTEKLMKEYMLVIEGFFTIPLPFFSSTYRKAIQARRKVAEALGLVVKERRKERGGGERLKNDMLEALFEGDGVEGFSDEVIVDFMLALLVAGYETTSTIMTLAVKFLTETPHALSLLKEEHEEIRLRKGDVESLLWEDYKSMPFTQCVVNETLRVGNIISGVFRRTMTDINIKGYTIPKGWKVFACFRAVHLDHEHFKDARTFDPWRWQSNAGSTSSPNVFTPFGGGPRRCPGYELARVELSVFLHHLVTRHSWVPAEPDKLVFFPTTRMQKRYPIIVQRRSLFDPCKE

SEQ ID NO: 1983 - protein, 914 aa, Ricinus communis
MAASVDNRQFHLEPTLNGVVRPFKSGPTHRSDSPIRNGFNFTNQDFTRSSSNKKPTPIMDDDFSSDDDEADYGDLIRKGNSELQPSILDPRDEGTADNWVERHPSMIRLTGKHPFNSEAPLTQLMHHGFITPVPLHYVRNHGPVPKASWKDWTVEICGLVKKPTRFTMDQLVNDFPSRELPVTLVCAGNRRKEQNMVKQTIGFNWGAAGVSNSVWRGVPLHFVLKRCGIYSRKKGALNVCFEGAEDLPGGGGSKYGTSIKKEYAMVPSRDIILAYMQNGELLAADHGFPVRMIIPGFIGGRMVKWLKRIIVTTKESDNYYHYKDNRVLPSHVDAELANAEAWWYKPEYIINELNINSVITTPSHEEVLPINSWTTQRPYTLKGYAYSGGGKKVTRVEVTMDGGDTWQVCSLDHPEKPNKYGKYWCWCFWSLEVEVLDLLGAKEIAVRAWDETLNTQPEKLNWNVMGMMNNCWFRIKTNVCKRHKGEIGIVFEHPTVPANQSGGWMAKERHLEISSENHPILKKSVSTPFMNTSSKTVSMAEVKKHNSADSCWIIVHGHVYDCTRFLKDHPGGTDSILINAGTDCTEEFDAIHSDKAKKMLEDYRIGELVDSTAYTTDSNASSPNNSVHGASNMSQTPLAPIKEITPTPARNVALVPREKIACKLVKKESLSHDVRLFRFALPSDDQVLGLPVGKHIFLCATIDEKLCMRAYTPTSTIDVVGYFDLVIKVYFKGVHPKFPNGGLMSQHLDSLQLGSVIDVKGPLGHIEYAGRGNFMVHGKPKFAKKLTMLAGGTGITPIYQVIQAILKDPEDDTEMYVVYANRTEDDILLREELDSWAKEHHERLKVWYVVQESIKEGWQYSVGFITENILREHVPEGSDDTLALACGPPPMIQFAVQPNLEKMNYDIKNSLLVF

SEQ ID NO: 1984 - protein, 419 aa, Sulfolobus solfataricus
MEEVLSSSLYTQQVKKLYKVGELLGLDNETLETLSQPERIIQVKIQIRGSDGKLKTFMGWRSQHNSALGPYKGGVRYHPNVTQDEVEALSMIMTWKNSLLLLPYGGGKGGVRVDPKKLTREELEQLSRKYIQAIYKYLGSELDIPAPDVNTDSQTMAWFLDEYIKITGKVDFAVFTGKPVELGGIGVRLYSTGLGVATIAKEAANKFIGGVEEARVIIQGFGNVGYYAGKFLSEMGAKIVGVSDSKGGVINEKGIDVGKAIEIKEKTGSVINYPEGRKVTNEELLISDCDILIPAALENVINKFNAPKVKAKLIVEGANGPLTADADEIMRQRGIAVVPDILANAGGVVGSYVEWANNKMGEIISDEEAKKLIVDRMNNAFNTLYDYHQKKLEDHDLRTAAMALAVDRVVRAMKARGIL

SEQ ID NO: 1985 - protein, 65 aa, Glycine max
AELNSAVVIILSTGLSVFLGRLVFFDCQMDNIANRVPDRSDLTHFEGGDTHAKEYVILVRFSEPV

SEQ ID NO: 1986 - protein, 219 aa, Unknown
  delta proteobacterium MLMS-1
DLIIPRGGEGLIRFVAENSRIPVLKHYKGVCHVFVDESADLEMAAAIVSNGKIQRPGVCNALETLLVHRQVAAEFIPAVAGQLTAAGVELRGCPQTVALAPAAKPAAADDWGREFLDLILAVRVVDDLDAALAHIVEYGSQHTEAIVTSNHPRAQRFIREVDASSVMVNASTRFSDGGQYGLGAEIGISTTKLHAYGPMGLRELTTRKFIVYGEGEIRQ

SEQ ID NO: 1987 - protein, 461 aa, Ralstonia eutropha
MVESNNDGTLKRGLKNRHIQLIALGGAIGTGLFLGIAQTIKMAGPSVLLGYAVAGIVAFFIMRQLGEMVVDEPVAGSFSYFANKYCGHFAGFMSGWNYWVLYILVSMAELSAVGIYVQYWWPGIPTWISALAFFLIINAINLSSVKSFGEMEFWFSIIKVAAIIGMIGFGGYLLMSGNAGPQASITNLWQHGGFFPNGLGGLVMAMAVIMFSFGGLELVGITAAEADQPEKSIPKATNQVIYRILIFYVGALAVLLSLYPWENVVTGGSPFVLIFHALNSNWVANVLNVVVLTAALSVYNSGVYCNSRMLFGLAQQGNAPKSLLKVSKRGIPLTALGVSAAATGLCVLINYFMPGKAFELLMGLVVSALIINWAMISIIHLKFRADKRKAGQETRFKSFGYPLTNYLCLAFLGGILVVMYLTDGLRISVYLIPVWLAVLGISYRLRQKNAVPALQGSVSAQ

SEQ ID NO: 1988 - protein, 186 aa, Triticum aestivum
  misc_feature (85)..(85): Xaa can be any naturally occurring amino acid
  misc_feature (94)..(94): Xaa can be any naturally occurring amino acid
  misc_feature (117)..(117): Xaa can be any naturally occurring amino acid
  misc_feature (128)..(128): Xaa can be any naturally occurring amino acid
  misc_feature (142)..(142): Xaa can be any naturally occurring amino acid
IACNKYMTKSAGKDAFHLRVRVHPFHVLRINKMLSCAGADRLQTGMRGAFGKPQGTCARGDIGSRSSFLFRCKDNNAAHASGALXRRAKFKFPXRQKILEEQKVGLQQSSTRADYLXKYKSEGRIVPXGVNANCSGNHGKLXKRVPGEVPPGAGPVPIPPWDAITFGLAYLFALGNMNLSVWVYMP

SEQ ID NO: 1989 - protein, 188 aa, Brassica rapa
AGGVQFGWALQLSLLTPYVQELGIPHAWASVIWLCGPLSGLFVQPLVGHSSDRCTSKYGRRRPFIVAGAVAISISVMVIGHAADIGWAFGDREGKIKPRAIVAFVLGFWILDVANNMTQGPCRALLADLTGKVPDFSVDWVKGSKFGILVIIHSHAKHGNAQICDFGYNLGYWSIAIKRSLLCFWSVA

SEQ ID NO: 1990 - protein, 283 aa, Clostridium perfringens
MELWYTEEHTDKVRFSIKVDEQLYSGKSDFQRIDVFKSQEFGTFFTLDGLMMVTEKDEFIYHDMIVHVPMATNPNIKNVLVIGAGDGGTVRELTRYETIEKIDMVEIDKLVVDVCREYLPQTANKLDDPRVSLFFEDGLKFVRSVENKYDLIIVDSTDPFGPGEGLFTREFYGNCFKALKEDGILVNQHESPYYEEYARGMKRAHKRIKECFPVCRVYQAHIPTYPSGHWLFGFASKKYDPLNANIEKWNDLGLKTKYYNTDLHKGCFALPNYVKEMLENVDE

SEQ ID NO: 1991 - protein, 402 aa, Roseovarius nubinhibens
MSKIVVIGAGQAGSSLVAKLRTLGHDGSITLIGAESAPPYQRPPLSKKYLLGEMELERLYLRPESFYADQGIDLRLGATVTGIDRDAREVILGDERLPYDQLALTTGSAPRRLPAAIGGDLAGVFTVRDLADVDAMEPMVRAGAHVLIVGGGYIGLEAAAVAASRGLKVTLVEMSDRILQRVAAPETSDFFRKLHGNHGVDIREGVGLDRLLGDGKVSGARLSDGSELAVDFVIVGVGITPETALAEAAGLALDNGIAADAQGRTSDPAIWTAGDCASFPHGAGRLRLESVPNAIDMAECVAENMLGAGKDYVPQPWFWSDQYDVKLQIAGLSTGFDRIVTRHDDGDAVSFWYFKGDQLLAVDAMNAPRAYMVGKRLIDNGKTADPAAIADPATELKTLLKP

SEQ ID NO: 1992 - protein, 412 aa, Staphylococcus epidermidis
MSYIEKKDKVVYDAIQKEFQRQNSNIELIASENFVSQAVMEAQGSVLTNKYAEGYPGRRYYGGCEHVDVTESIAIERAKALFGAEHVNVQPHSGSQANMAVYLVALEMGDTVLGMNLSHGGHLTHGATVNFSGKFYHFVEYGVDQENELINYDEVRRLAIEHQPKLIVAGASAYSRTIDFKKFKEIADEVGAKLMVDMAHIAGLVAAGLHPNPVEYADFVTTTTHKTLRGPRGGMILCKEEYKKDIDKTIFPGIQGGPLEHVIAAKAVAFGEALNDDFKDYQNQVIKNAQALAQTLIEEGFRVVSGGTDNHLVAVDVKGSINMTGKLAEETLDKVGITCNKNTIPFDKEKPFVTSGVRLGTPAATTRGFDESAFVEVAKIISLALNNYDNDTKLNEAKERVHALTSKYPLYN

SEQ ID NO: 1993 - protein, 333 aa, Sinorhizobium meliloti
MSGKSKSAPKIVVVGAGAFGTALSAVAAAKDKANVTLLARREEAAAECRRTGRNDAVLPGIPLPPGLVYSSQAAALEDADIVLFAMPSQAHRDAARSYGPAIGARAIVVTCAKGMEQSTGQLLTDVLEEELPGRRIGVLSGPGFAADIASGLPTAMVIAAPDTAIATELAEALSGRTFRLYPSADRTGVQLGGALKNVLAIACGIVEGAGLGDSARAALISRGLAEMSRFIVARGGEADTVRGLSGLGDLVLTATSHQSRNLRFGIALGKDGRAAAGSSELVEGAFAASVAARVAGALGIEMPVTEAVAAIVDGKLDVRSALEQLMSRPITHE

SEQ ID NO: 1994 - protein, 532 aa, Hordeum brevisubulatum
MGQCCSRATSPDSVQGGANGYGYSHQPKQAQAPPSYNNAQPPPRAEVRYTPPAMNPPVVPPVVAPSKPMPDTILGKQYEDVRSVYSLGKELGRGQFGVTYLCTEISTGRQYACKSISKRKLVSKADKEDIRREIQIMQHLSGQPNIVEFCGAYEDKGSVHVVMELCAGGELFDRIIAKGHYSERAAATICRGVVNVVNVCHFMGVMHRDLKPENFLLATKDENAVLKATDFGLSVFIEEGKMYRDIVGSGLLCCSEVLRRNYGKEIDVWSAGVILYILLSGVPPFWAETEKGIFDAILQGEIDFESQPWPSISESAKDLVRKMLAQDPKKRISSAQVLRHPWLREGEASDKPIDSAVLSRMKQFRAMNKLKKMALKVIASNLNEEEIKGLKQMFMNMDTDNSGTFTYEELKAGLAKLGSKLSEAEVKQLMDAADVDGNGSIDYVEFITATMHRHKLERDEHLFKAFQYFDKDNSGFITRDELETALIEHEMGDADTIKDIISEVDTDNDGRINYEEFCAMMRGGIQQPIKLK

SEQ ID NO: 1995 - protein, 259 aa, Bacillus anthracis
MKVACIQMDIFFGDVEKNIENAKNKISEAMKERPDVIVLPELWTTGYDLTRLSEIADRDGLETKEKLIEWSKQYGVHIVGGSIAKQTEQGVTNTMYVVTNKGELVNEYSKVHLFQLMDEHKYLIAGNSTGEFKLDDVECAGTICYDIRFPEWMRVHTAKGAKVLFVVAEWPLVRLAHWRLLLQARAVENQCYVVACNRAGKDPNNEFAGHSLIVDPWGEVVVEANEEESILFGELTFEKIEEVRKGIPVFADRRPELYK

SEQ ID NO: 1996 - protein, 139 aa, Burkholderia xenovorans
MNPSAIPSSQQLPRATHFDRLGGEPAVIRLVDAFYRRMDTRPDAQRIRAMHHPDLSSTKAVLVLYLCEWLGGDKQYSAQRGHPRLRMRHAAFAIGLAERDAWLTCMRGALDETGVDPALRDELMQAFFKTADWMRNTPT

SEQ ID NO: 1997 - protein, 287 aa, Glycine max
SDRDCQLRPAMNAIATAAVLSLPFSFSKSSKLDTKKGLKGRFRVFAVYGEEIDKKNAWSALFDVEDPRSKVPQYKGKFLDVYQALEVARYDIQYCDWRARQDLLTIMLLHEKVVEVLNPLARDYKSIGTMKKELAELQEELAQAHQQVHISEARVSSALDKLAYMEELVNDKLLQERSTTEVSQTSSSPSTSFKPVDIEKRRSPRKSLDISGPVQSYHPHLKNFWYPVAFSTDLKDDTMVSQYVYNSLYHTLNMFVASASMQNFKSIFGLNPLVSNLLEAYYDMSVE

SEQ ID NO: 1998 - protein, 289 aa, Francisella tularensis
MIANINNKKIFHETLYHSYHQSIAISEILYEHKTDYQHLVIFNNPIFGNVMVLDGIVQTTEKDEFIYHEMLVHVPVIAHGNVKNILIIGGGDGGMLREALSHKAVEFVTLVEIDQAVIDMCQEYFPGHSKGAFDHPKAKIVIQDGCEFVKNPPRKYDLIICDSTDPIGPGEVLFTSKFYKDCKEALNPGGIMVTQNGVIYFQIDELKKTLERFEPLYKDVSFYTAAVPTYVGGSMAFGWGTDELSYRNHDIQVIAQRFLKSGIKTKYYNPAIHIAAFALPQYVIDTLKK

SEQ ID NO: 1999 - protein, 641 aa, Rhodococcus erythropolis
MCGLLGLLTSGGTSEDAVSRVDQAMHCLRHRGPDEHGTWNDDHLVFGFNRLAIIDIAHSHQPLRWGPPENPERYALTFNGEIYNYLEIRAELVKDHDAKFFTEGDSEAIVAAFHYWGEDAVRRLRGMFAFAIWDTDTRELFIARDPFGIKPLFIATGAGGTAFGSEKKSLLELTDLIGIGTELDPRAIEHYTVLQYVPEPETLHKEIRRLESGSFARVRPGEEPTFTRYFTPKFPAKPFAPGTEKARYQEIAEALEDSVAKHMRADVTVGSFLSGGIDSTAIAALAMRHNPNLITFTTGFEREGYSEVDVAAESAAAIGAKHVVKVVSPAEFAAAIPEIVWYLDDPVADPALIPLWFIAKEARKHVKVVLSGEGADELFGGYTIYREPLSLKPFEYLPKGLRRAAGKLSERIPDGTRGKSLLNRGSLTLEERYYGNARSFNDAQLRAVLRDFRPEWTHQDVTAPIYAQSRDWDPVARMQHLDLFTWLRGDILVKADKMTMANSLELRVPFLDPEVFDVASRVPLDQKITKDTTKYALRQALEGIVPHHVLHRAKLGFPVPLRHWLRGTELFDWAHLQIEESGTDHIFDKQAVVKMLNDHREGVSDHSRRLWTVLTFMVWHGIFVEKRIVPQIQEPVYPVNI

SEQ ID NO: 2000 - protein, 410 aa, Pediococcus pentosaceus
MNYTKQDPELWSAIEREEKRQQHNIELIASENIVSDSVRKAQGSVLTNKYAEGYPGKRYYGGCEFIDQVEQLAIDRAKAIFNAEYVNVQPHSGSQANAAAYAAFIKPGDKILGMDLNAGGHLTHGAKVSFSGTFYQSVSYGVDPQTEKLDYDEIRRIALKEQPQIIVAGASAYSRFIDWNKFREIADEVGAYLMVDMAHIAGLVAAGLHPSPVGIADVVTTTTHKTLRGPRGGMILSQEKYAKQLNFAVFPQNQGGPLEHVIAAKAVAFGEALQPEFKTYQKQVLKNAKAMAEVFENDTILHVVTGGTDNHLMTVDLTGTQLNGKEVQNLLDGVFITTNKEAIPEEKLSPFKTSGIRIGTPAITTRGFKEDDCREVANLIIRAIKNADNETVLEEIKRDVFKLTEKYPID

SEQ ID NO: 2001 - protein, 125 aa, Ostreococcus tauri
MDHDSIVTTTFKMAGKKPAQKKPSGAKKGGRKSKTETYKIYIYKVLKQVHPDTGISSKAMSIMNSFINDIFEKIATEAAKLARYNKKPTVTSREIQTAVRLILPGELAKHAVSEGTKAVTKFTSA

SEQ ID NO: 2002 - protein, 563 aa, Cryptococcus neoformans
MVCVISDPDWWRQAVVYQIYPRSFADANGDGIGDLKGITARVPYLKALGVDAIWLSPFYPSALRDGGYDVADYRDVDPKIGTLEEFDEMTAAFQKVGIRVIVDIVPNHSSDDHEWFQAALKAGKGSPERERYIFRDGLGPNKDQPPTDWICSFGGSAWSPSGMNDGQWYFHWFDSSQPDWNWENPDVKADFLKTLKFWGDRGVSGFRIDVAHGLAKDMSEPLPNWEQLTKLTHQKLTNGNSELDHPLLDRKEVHDIYRSWREVFNQFNPPLMAVAEAWVAPDQKPLYASSEGLGQTFSFDILLCNFDAEEYRQCIKSSLAGSKKSDSTTTWVLSNHDVMRHPTRFGLPNVPNANHAMTTDTYNKFLKTKLTDPKVDIEQGLRRAKAATLMILALPGSTYLYQGEELGLQEVVEIPDEERQDPIFIRTKGEEVGRDGCRVPIPWVADEKNFGYGPGKRAHLPQPAWFKDYAVDVEEKDANSVLSLYRRALGLRKGLQSAEELEWVENPNKEVLHFRRPGGWEVVVNIGKDSVDLPKGSVLISSSNNALKGGSIPGETTVWLKSA

SEQ ID NO: 2003 - protein, 1092 aa, Ustilago maydis
MTGTSNLPAASSQDSAVITTLSSPSEAHLSTASHPSAAASSTASAQHPPTIDTHPTRLSSNDPLKKHPNTAIAKGTAAEVGSKQKEFQRRAQHLSLTSKPIPYARQGDSPRLLVVLKDFDRLLRSLPIPLHHIVPTIVARFICRVFRSQNIMASNIAFDIALFFWRIIINLFFREIRPRSSWRIPREGPVIFVAAPHHNQFLDPLLLASEVRRASGRRVAFLIAEKSIKRRFVGAAARIMQSIPVARAADSAKAGKGYISLHPSGDPLLIQGHGTAFKSQLQLKGQIMLPKACGHATVEVVEVISDTELKIKKEFKDPRALDMLRGKVPQPEPTKSDKKPSKSSSSKALEKVAADLFENQGCRYSCLPFVDQTQMYAKVYDKLAEGGCLGIFPEGGSHDRTDLLPLKAGVVIMALGAMSANRDLNVRIVPVGLSYFHPHKFRSRAVVEFGAPIDVPRQLVGQFDEGGEGKRKAVGQMMDIVYDGLKGVTLRAPDYETLMVVQAGRRLYRAPGQSLSLGQTVALNRKFIMGYLQFKDEPRVVKLRDEVLRYNKKLRYAGLRDHQVERATRAGWRSLGLLAYRLGLLGLWGGLALPGAVLNSPIIILAKIISHKKAKEALAASQVKVAGRDVLATWKVLVSLGVAPILYSFYAALATYLAHRLELSPRTRALMPLYTLIVLPTMSYSALKFAEVGIDIYKSLPPLFISLIPGNHKVILDLQQTRTKISADMHALIDELAPQVWEDFAENRMLPSASAPPTPSREALVWKDKKQSSSAASDALSHPLQWMDERLFGWGRRRHSSTRRSLTAEEIKHLRSPSLTRGSAKDENSVLDDEDGARFEGEGDGSLDDVSEGSSSFIESGEEDEGDYEAVFSMLNPQNLLNGLRNGGLSPGTPGSGGRRSRTHSRSRSGSRGSIGGVASGETFAEKRNRSSQDLRALMREGGAMSPTTTRSSGILEGAGSKQSSRTSALPASLITTNISGNDGENGASKASNTSRRNRTHSLSEDVHVSELKNAGPAAKKLPFSAASQAFEMQHEASGGQAGYRPKLENMQSAENTPPATPKHEDKKVLTSASSVPTDSNDLDGKDDGKAQ

SEQ ID NO: 2004 - protein, 107 aa, Agrostis stolonifera
MTEKKNRREKKNPREAKVTFEGLVTEALPNGMFRVRLENDTIILGYISGKIRSSSIRILMGDRVKIEVSRYDSSKGRIIYRLPHKDSKRMEDSKDIEDLKDSEDSKD

SEQ ID NO: 2005 - protein, 212 aa, Unknown
  Vibrio sp. Ex25
MLNKQTLISIEDALPGRDQPMQVEDHHFVNKSNLKAPLEPHQQQILLGMGCFWGAERVFWQLDGVISTSVGYAGGYTPNPTYEEVCTGKTGHTEVVRVVFDERVISLEKLLAVFWEKHDPTQGMRQGNDLGTQYRSAIYTYSAKQQESAEKSKLLYQQALQEELRANITTEIQPAGPYYFAETYHQQYLAKNPDGYCGIGGTGVCFPPSLQS

SEQ ID NO: 2006 - protein, 356 aa, Cryptococcus neoformans
MLLSLRSSLSRNIIGQSRHLPTISYSVTSSRIRNMSSQAATSSATVAVCQLRSTSDPVHNLKISEKVIRNAVAAGAKACFLPEASDFINPSKTESRKFSRPLPKHEYTTGLQRLAKELGIVISVGVHEGPEDENEERVYNTHVLIGKDGGILASYRKIHLFDVELSKPPAPDGTPRPPQRTGESERILAGQAVTPPVEVEGIGNIGLEICYDIRFPELSIILTRLGAEVLLFPSAFTVKTGRDHWGTLCRATAIQYQSYLIASAQYGAHNSKRTSWGETLAFDPWGRQLGRLRSVDDTPPPKEGEEGDKGVEKLYEDSGEFFLCEIDGTKVKETRGQIPLAIQKRSDIYGVVGEGA

SEQ ID NO: 2007 - protein, 715 aa, Burkholderia vietnamiensis
MSMFNKVVKEFQWGQHKVRLETGEVARQASGAVIVDVEDTVVLATVVGAKSAKPGQDFFPLTVDYLEKTYSAGKIPGGFFRREGRPSEHETLTSRLIDRPLRPLFPEGFYNEVQVVIHVLSVNPDIPADIPALIGASAALAVSGLPFNGPVGAARVAYIDNAYVLNPTRDQIKASSLDLVVAGTERAVLMVESEADQLPEDVMLGAVVFGHEQMQIAIDAIHELVREGGKPEWDWQPAPKNEALIARVTELAHGDLLAAYQLRDKQARSTKLKEVYAATSAKLEEDALAAGTVAADKATVGNILFDIEAKIVRSQILNGEPRIDGRDTRTVRPIEIRTGVLPRTHGSALFTRGETQALVVATLGTKGDEQIIDALEGEYRERFMLHYNMPPFATGETGRVGSPKRREIGHGRLAKRALVKCLPSADEFGYSIRVVSEITESNGSSSMASVCGGCLALMDAGVPMKAHVAGIAMGLILEGNKFAVLTDILGDEDHLGDMDFKVAGTEHGVTALQMDIKIQGITKEIMQVALAQAKEGRMHILGKMTSAVSGANTQLSEFAPRMITIKINPEKIRDVIGKGGSVIRALTEETGTTIDISDDGVVTIASTSSEGMAEAKKRIENITAEIEVGQVYEGTVLKLLDFGAIVNLLPGKDGLLHISEIVNERVKDINDYLKEGQQVKVKVIQTDEKGRVRLSAKALLNEAAAASQSDTPPQQ

SEQ ID NO: 2008 - protein, 387 aa, Geobacillus stearothermophilus
MKKKCIAMLLAGGQGSRLRSLTTNIAKPAVPFGGKYRIIDFTLSNCTNSGIDTVGVLTQYQPLLLHSYIGIGSAWDLDRRNGGVTVLPPYSVSSGVKWYEGTANAVYQNINYIEQYNPDYVLVLSGDHIYKMDYQHMLDYHIAKQADVTISVIEVPWEEASRFGIMNTNEEMEIVEFAEKPAEPKSNLASMGIYIFNWPLLKQYLQIDNANPHSSHDFGKDVIPMLLREKKRPFAYPFEGYWKDVGTVKSLWEANMDLLDENNELDLFDRSWRIYSVNPNQPPQYISPEAEVSDSLVNEGCVVEGTVERSVLFQGVRIGKGAVVKESVIMPGAAVSEGAYVERAIVTPDSIIPPHSSVCPEDADDVVLVTAEWLKQSNEETARKDEA

SEQ ID NO: 2009 - protein, 386 aa, Unknown
  Helicosporidium sp. ex Simulium jonesii
MSPPTGEKYSLPPVFGTQGQITQLLDPIMAERFKDLSQHGKVMAEYVWIGGTGSDLRCKTRVLDSVPNSVEDLPVWNYDGSSTGQAPGDDSEVFLIPRAIYRDPFRGGDNILVLADTYEPPRVLPNGKVSPPVPLPTNSRHACAEAMDKAAAHEPWFGIEQEYTVLDARTKWPLGWPSNGFPGPQGPYYCAAGAGCAIGRDLIEAHLKACLFAGINVSGVNAEVMPSQWEYQVGPCTGIESGDQMWMSRYILIRCAELYNVEVSFDPKPVPGDWNGAGGHVNYSNKATRTAETGWAAIQQQVEKLGKRHAVHIAAYGEGNERRLTGKHETSSMNDFSWGVANRGASVRVGRLVPVEKCGYYEDRRPASNLDPYVVTRLLVETTLLM

SEQ ID NO: 2010 - protein, 448 aa, Clostridium perfringens
MEVKKYVDNLMEDLKKNNPGESEFLAAAEEVLYSLVPVLEKNPKYMEEGILERIVEPERVIMFRVPWVDDAGNVRVNRGYRVQFNSAIGPYKGGLRFHPSVNLSIIKFLGFEQIFKNSLTTLPIGGGKGGSNFDPKGKSDREIMRFCQSFMSELYRHIGPNTDVPAGDIGVGGREIGYMFGQYKKLKNSVDAGVLTGKGLTYGGSLARKEATGYGLVYFVDEMLRDNGQTIEGKTVVISGSGNVAIYATEKVQELGGKVVALSDSSGYVYDENGIDLEVVKEIKEVKRGRISEYVNYVKTAKFTEGFRGIWNVKCDIALPCATQNEIDKSSAKTLIDNGVIAVGEGANMPSTLEAQKLFVDNKILFAPAKAANAGGVATSALEMSQNSLRMSWTFEEVDAKLKDIMKNIYYNSRNAASEYGHDGNLIVGANIAGFKKVADAMLDHGII

SEQ ID NO: 2011 - protein, 328 aa, Prochlorococcus marinus
MSRIYEDNSQAIGNTPLVKLHAVSKNAKATVLAKIEGRNPAYSVKCRIGANMIWDAEKRGLLSKERTIIEPTSGNTGIALAFTAAARGYKLILTMPESMSLERRRVMAVLGAELILTEAAKGMPGAIAKAKEIAESDPQKYFMPGQFENPANPDIHSKTTGPEIWNDCDGAIDVLVAGVGTGGTITGVSRYIKQEKGKSIVSVAVEPTHSPVISQTLNGEDVKPGPHKIQGIGAGFIPKNLDLALVDRVEQVSNDESIAMALRLANEEGLLVGISSGAAVAAAIRLAEQPEFAGKTIVVVLPDMAERYLSSVMFESVPTGIIQDPVAA

SEQ ID NO: 2012 - protein, 339 aa, Zea mays
  misc_feature (218)..(218): Xaa can be any naturally occurring amino acid
INARPTRPAFLLPLWPLPRHRVLPLDLRAAMAKPVLFHSGWVAVGSRRGKAAAAASSSSARAQLSITVRAEPDPRFVFQFDGEPECSPQVLQVKGSMKQPMFTCRFSCRSSSDLRSRSVQSDPGARNWLAKLGSERERAGKERKGWSVTVHDLSGSPVALASMVTPFVASPGTDHVSRSSPGAWLILRPADGTWAPWGRLECWRGRGDTLGYRFELVXATPRGGAGVCVAEASVPASRGGRFAIDLTAAAQPFWCSSSGDMGHGIWPFGGFVMSAAVQGEGRCSRPPVEVGVAHVGCAEDAAAFVALAAAVDLSMDACRLFSCKLRRELSTASRAEFLR

SEQ ID NO: 2013 - protein, 603 aa, Escherichia coli
MLRPVETPTREIKKLDGLWAFSLDRENCGIDQRWWESALQESRAIAVPGSFNDQFADADIRNYAGNVWYQREVFIPKGWAGQRIVLRFDAVTHYGKVWVNNQEVMEHQGGYTPFEADVTPYVIAGKSVRITVCVNNELNWQTIPPGMVITDENGKKKQSYFHDFFNYAGIHRSVMLYTTPNTWVDDITVVTHVAQDCNHASVDWQVVANGDVSVELRDADQQVVATGQGTSGTLQVVNPHLWQPGEGYLYELCVTAKSQTECDIYPLRVGIRSVAVKGEQFLINHKPFYFTGFGRHEDADLRGKGFDNVLMVHDHALMDWIGANSYRTSHYPYAEEMLDWADEHGIVVIDETAAVGFNLSLGIGFEAGNKPKELYSEEAVNGETQQAHLQAIKELIARDKNHPSVVMWSIANEPDTRPQGAREYFAPLAEATRKLDPTRPITCVNVMFCDAHTDTISDLFDVLCLNRYYGWYVQSGDLETAEKVLEKELLAWQEKLHQPIIITEYGVDTLAGLHSMYTDMWSEEYQCAWLDMYHRVFDRVSAVVGEQVWNFADFATSQGILRVGGNKKGIFTRDRKPKSAAFLLQKRWTGMNFGEKPQQGGKQ

SEQ ID NO: 2014 - protein, 957 aa, Candida glabrata
MVKNSMVHGVTRVDLTAYSAESFENAIQFYLAFLVLDELDQNEDGGVVLANSHVYIKISYKEDGEMERKVNDRLMNLIEKTTSGDWRAVSSNVLVYTVDDIGLVKETLKRIGLPHQAYPTELTPAQIYTLDPLGNVVGFTGNKLAIATEIPFVLPTEEDDESELSSKESSYTNLTSLMRTTSGYPSLPFGHSRTHRNIAILTSGGDAPGMNSVIRAVVRTALFKGCRVYIVREGLEGLVKGYIEEFFWEDVGGWNSQGGTNIGTAKSNAFLQRRGRLLAARNLIIHDIDSLIVCGGDGSLAAADIFKHEWHSLISELLSSHLIKIEQLHSHKHLTICGISASIDNDIPVTDASIGAYSALDRICKALDYIQVTAESTSRAYVVEIMGGNCGWLTLLAGIATAADYIFLPECPQQKEDWRTHLQRIVKRNRRNGRRNTLVLLCEGAVAADSTPITSRDVHQVLSEELDIDTRITVLGHVQRGGAPVAYDRILATLQGVEAVSVILESTPDTPSYLIAVKENKILRKDLQDAVRQTFKISTSLKDREFEKAFRAKEAEFIEHYHNFLAINAADQDKKLVKSASLLNIAIINIGAPAGGMNSAVYAMASYCMWKGHRPIAIYNGWSGLARHESIRSLKWSEIVGWQSRGGSEIGTNRETPNEADVGMIAYYFQKYKIDGLIIVGGFEGFESLRQLEKARELFPAFRIPMVLIPATLSNNVPGTEYSLGSDTALNSLTEFCDNIGISSAATKDKAYVVEVQGGNSGYLATLTSIAIGACATYVPEEGISLVQLSEDIETISKSFDCVQTGDHAGKIILKSQNASKAMSAEKLANIITEEAAGKFEAKSVIPGHLQQGGTPSPIDRTRATKLAIRAVDFILEKSKVLKSQDDVIYEHTKELTESAVVLGVKGSNILFTSVKQLYLFETNVRDRMPKVIHWDGIRTLSDHMAGRRRIYEDEDN

SEQ ID NO: 2015 - protein, 195 aa, Silicibacter pomeroyi
MRRASISRQTAETEISVDINLDGTGAYDNQTGVGFFDHMLDQLARHSLIDMTISAKGDYHIDDHHTVEDTGIALGQALSAALGDKRGIRRYGECHLPMDDAQVRCALDLSGRPFLVWNVDLPTAKIGTFDTELVREFFQAFSTHGGITLHVDQLHGLNSHHIAEAAFKAVARALRQAVESDPRKGDAIPSTKGTL

SEQ ID NO: 2016 - protein, 1806 aa, Streptomyces avermitilis
MDLIPRGSAPRTRRTHRHSRTAAAVAAAALAVSLAQPLEARAATPPAPPSDAKLAAEPARHDATREQFYFVMPDRFANGDTSNDKGGLTGSRLSTGYDPTDKGFYQGGDLKGLTRKLDYIKGLGTTSIWLAPIFKNQPVQGTGKDASAGYHGYWITDFTKVDPHFGTNKDLETLISKAHAKGMKVFFDVITNHTADVVDYEEKSYGYLSKGAFPYLTKDGRPFDDAGYTDGPRKFPAVDGDSFPRTPAVAARKKNAKVPSWLNDPTMYHNRGDSTFAGESSTHGDFSGLDDLWTERPEVVRGMEKIYEKWVRDFGIDGFRIDTVKHVNTEFWTQWATALDAYAKKRGKDDFFMFGEVYSADTSVTSPYVTQGRLDSTLDFPFQDAARSYASQGGSAKKLASVFGDDYKYTTDKANAYEQVTFLGNHDMGRIGYFLNQDNPKATDAELLRKDRLANELMFLSRGNPVVYYGDEQGFTGSGGDKDARQTMFASKVADYLDDDEIGTDRGHASDAYDTSAPLYKEIAALSKLRKDNPALADGIQTERYAADGAGVYAFSRTDARTGTEYVVAVNNADKASAATFATGSADTAFKGIHGTDDVLKSDADKKITVTVPAGAAVVLKAAGRPGTPAAKPSLTLKAPDAGATGTVELSADVDGGRLNRVVFAAQVGNAKWRTLGSADHAPYRVTQTIGKDVPAGTALRYKAVVIDAAGRTASATAASTTGTPPAAETPTASSRDYAIVHYKRPDGDYTDWRLYAWGDLADGESTTWPAGHDFVGRDAYGAFAYVKLKPGASTVNFLVIDKDGDKDVSADRTIDVTKAGEVWVEQGKETVRTERPDYPAQDKTKAVIHYHRADGDLTGWGLHVWTGAATPTDWSKPLEPVRTDAYGAVFEVPLTDGATSLSYIIHKGDEKDLSADRSLDLTADGHEVWLLNGQENHLLPQPAGSAAALDLTTSKAVWIDRNTVAWNGSDAAASTQLLSSRDGSIAVKDGSLTSDDERWLRLSKTSLTDAQKAAFPHLKSYTAWSVDPRDRDRVREALAGQVVASQRAANGAVLAATGVQLAGVLDDLYDATKADLGPTFRGGHPTLAVWAPTAQSVSLELDGAHVRMKRNNATGVWSVTGPASWKGKPYRYVVKVWAPTVRKVVTNKVTDPYSVALTTDSERSLVVDLDDRSLAPSGWSSLKKPKAVPLRDAEIQELHIRDFSVADRTVPAKDRGTYLAFTDKNSDGSRHLRQLAESGTSYVHLLPAFDIATIAEKKSGQQATDCDLASYAADSEKQQECLTAVAAKDAYNWGYDPYHYTVPEGSYATDANGTRRTVEFRRMVKSLNQDGLRVVMDVVYNHTAAAGQAGTSVLDRIVPGYYQRLLADGSVATSTCCANTATENAMMGKLVVDSLVTWAKEYKVDGFRFDLMGHQPKANILAVRKALDALTVAKDGVDGKKIILYGEGWNFGEVADDARFVQATQKNMAGTGIATFSDRARDAVRGGGPFDADPGVQGFGSGLYTDPNSSDANGTPAEQKARLLHYQDLIKVGLSGNLAKYRFTDSSGKEVTGSEVDYNGTGAGYADAPGDALAYADAHDNESLYDALTYKLPKGTPAGDRARMQVLAMATAALAQGPSLSQAGSDLLRSKSLDRNSYDSGDWFNAIHWNCQDGNGFGRGLPMAADNKSKWPYATPLLTSVKVGCDQIEGTSAGYQDLLRIRTTEPDFSLSTAGQVQSKLTFPLSGKDETPGVITMKLGDLVVVFNATPDQQEQTVAALAGKDYALHPVQAAGADPIVKSASYTAKSGMFAVPGRTVAIFSQVAR

SEQ ID NO: 2017 - protein, 236 aa, Silene latifolia
MTRRYWNINLEEMMEAGVHFGHGTRKWNPRMSPYISAKCKGIHIINLTRTARFLSEACDLVFDAASRGKKFLIVGTKNKAADSVAWAAIRARCHYVNKKWLGGMLTNWSTTETRLHKFRDLRMEQKAGRLARLPKRDAAVVKRQLSHLQTYLGGIKYMTELPDIVIIVDQQKEYTALRECITLGIPTICLIDTNCDPDLADISIPANDDAISSIQLILTKLVFAICEGRSSYVRNT

SEQ ID NO: 2018 - protein, 396 aa, Phaeosphaeria nodorum
MADKGLEDVPEGQIESNYDETTDSFDAMNLKAELLRGVYAYGFERPSAIQQRAIMPVIKGHDVIAQAQSGTGKTATFSISTLQKIDSNVKACQALILAPTRELAQQIQKVVVAIGDFMDVACHACIGGTSVRDDMKALQDGPQVVVGTPGRVHDMIQRRVLKTDHMKMFVLDEADEMLSRGFTEQIYDIFQLLPQSTQVVLLSATMPQDVLEVTTKFMRDPVRILVKKDELTLEGIKQFYIAVEKEDWKLDTLSDLYETVTITQAVIFCNTRRKVDWLTDKLTARDFTVSAMHGDMDQAQRDVIMKEFRSGSSRVLIATDLLARGIDVQQVSLVINYDLPANRENYIHRIGRGGRFGRKGVAINFVTADDVRMMREIEQFYSTQIEEMPMNVADLI

SEQ ID NO: 2019 - protein, 445 aa, Citrobacter amalonaticus
AVMGRNLALNIESRGYTVSVFNRSREKTEEVIAENPGKKLVPYYTVQEFVESLETPRRILLMVKAGAGTDSAIDSLKPYLDKGDIIIDGGNTFFQDTIRRNRELSEEGFNFIGTGVSGGEEGALKGPSIMPGGQKEAYELVAPILKQIAAVAEDGEPCVTYIGADGAGHYVKMVHNGIEYGDMQLIAEAYSLLKGGLNLSNEELATTFSEWNKGELSSYLIDITKDIFTKKDEEGKYLVDVILDEAANKGTGKWTSQSSLDLGEPLSLITESVFARYISSLKTQRVAASKVLTGPQAQPAGDKAEFIEKVRRALYLGKIVSYAQGFSQLRAASDEYNWDLNYGEIAKIFRAGCIIRAQFLQKITDAYAENPAIANLLLAPYFKQIADDYQQALRDVVSYAVQNGIPVPTFSAAVAYYDSYRAAVLPANLIQAQRDYFGAHTYKRT

SEQ ID NO: 2020 - protein, 235 aa, Zygnema circumcarinatum
MKEENWNNNLEQMMEAGVHFGHQARKWNPKIAPYLLKDTKKIRIIHITHTARLLADACDFATNAAREGKQFMLVGTRYQTAGLVATTAKKARCHYVNTKWLGGMLTNWSTIKTRLQKFEQLEAQEIAGAFNHLPKKEVAVMKRQLSQLRKYFHGIKYMKKVPDIVIFINQHQDYTAIQECIKLGIPTIGLVDTDCDPNLVDMPIPANDDNRTSIRWILSQLTTAIKEGRSTSLKQ

SEQ ID NO: 2021 - protein, 484 aa, Musa acuminata
MRLFSISSASFLLVLLFSCSLVRGGRSRELDREALRQQEADRVVGLPGQPPVSFRQYAGYVTVNESHGRALFYWFFEATHDVEKKPLLLWLNGGPGCSSIGYGAAEELGPFLMQKGVPELRFNQHSWNKGKKPIPKANLLFLESPVGVGFSYTNTSSDLQSLGDKITAEDSYIFLVNWLKRFPQYKSHDFYIAGESYAGHYVPQLSEKIFDENKKASKETYINFKGFMIGNALMDDDTDQTGMIDYAWDHAVISDRVYHDVKSNCNFGIEPATEACNNALREYFAVYRIIDMYSLYAPVCTSITSTRKSFQIEGAAPKLFSRYSGWHQKPAGYDPCVSDYSEVYFNRPDVQEALHANTTKIGYNWTHCSEVVTKWNDSPATMLPVIRKLINGGLRVWVFSGDTDGRIPVTSTRYTLNKLGMKTIQEWKPWYDRKQVGGWTIVFEGLTFVTVRGAGHQVPTFAPRQAQQLIHHFLANQQLPPSAF

SEQ ID NO: 2022 - protein, 112 aa, Roseovarius nubinhibens
MKKIEAIIKPFKLDEVKEALQDVGVQGLSVIEVKGFGRQKGHTELYRGAEYVVDFLPKVKIDVVLDDDQVDAAIEAIVDAAKTDKIGDGKIFVSPVEQAIRIRTGETGSDAL

SEQ ID NO: 2023 - protein, 324 aa, Pseudomonas putida
MSRIFADNAHSIGNTPLVQINRIAPRGVTILAKIEGRNPGYSVKCRIGANMVWDAESSGKLKPGMTIVEPTSGNTGIGLAFVAAARGYKLMLTMPASMSLERRKVLKALGAELVLTDPAKGMKGAIEKANEIVASDPEQYFLPGQFENPANPAIHEKTTGPEIWNDTDGAIDVLVAGVGTGGTITGVSRYIKHTQGKAILSVAVEPVASPLISQTLAGEELKPSPHKIQGIGAGFVPKNLDLSIVDQVETVTDEESKAMAIRLMQEEGILCGISCGAAMAAAVRLAEKPEMQGKTIVVILPDSGERYLSSMLFSDMFSEQETQQ

SEQ ID NO: 2024 - protein, 56 aa, Francisella tularensis
MPASFFERDGNACYNSIAMIDADGSIMGIYRKAHIPDGIGYQEKYYFSPGSVGFKV

SEQ ID NO: 2025 - protein, 157 aa, Brassica rapa
SNADKLLTEFIEKQLIDYAKNSKKVVGNSTSLLSPYLHFGEISVRRVFQCARMKQIIWARDKNGQGEESAVLFLRGIGLRDYSRYICFNFPFTHEQSLLSHLRFFPWDADVEKFKAWRQGRTGYPLVDAGMRELWATGWMHNRIRVIVSSFAVKFLL

SEQ ID NO: 2026 - protein, 122 aa, Francisella tularensis
MALKGAEILLYPTAIGSELHLPDYDSKDHWQRVMQGHAAVNMLPVLASNRYATEANDNITATYYGSSFITDHTGDKIAEADRSDDDILYATFDFAELQQQRFYWGLFRDRRPELYDEIVRKY

SEQ ID NO: 2027 - protein, 461 aa, Desulfitobacterium hafniense
MIAFVDRKSGDIMPTLLMITPENSEINKFRAHQLNNFTQLTMPYLAGFVPEEYSIRLLDEYTEPILFEKVDLVAITVNTPNAPHVYSISKRFRELGTWVALGGPHVTLNPEEAACHGDTIFVGEAEETWPEFLKDFLSGSMQKAYTSLHVPSLDGLPIPRRDLIVGHRLTSGAVFASRGCPHNCSYCSLKKIYHNEFRTRPVDEVIKDIGSMPNKYFVFWDDNFFADPVYTKALLKDLARLNKRWAAQVTACSCEDEELLSLAKAAGCLYLFLGLESFSEQGLRDANKNFNKIEEYGKVVNKLHRHGISIQAGIVFGFDSDTLEVFETTLKACNNIGVDGVTASILTPFPGTSIYEQYKKEGRLLDVDWDHYNGKTKVAYVPKRMSHKELLNGYNEFRGKFHSWSSIVKRISKSRVNIFYTLAMNYGYKRAYRNFTRLGFGERSDESLGHRIAQHSRNWPR

SEQ ID NO: 2028 - protein, 1592 aa, Aspergillus oryzae
MDGQRQQQYIPVQPPPSAPASQSHILLPPPPPRYQPTQTQGVVPPPPPGPPPGTGYGAAKITNPQVQAQNTIGWQQKWAARQALSQGYLPPPPPPPLVPANQQLYNRTHLSIPSGEGRTSATYVPQPGTFGPGVGIPAFDSHTLSAYENQATLMDSDRQRPQVNQLYEYPSPDTAYKRDGTIPPTPSARTIPSALAANDGAHEQLPNHGQTTELTKSSSHRHNSSNTLPGGMSPSEAAAQWPLERVLLWLAKNGFSKDWQETFKALELQGADFIELGHGLNGRPNLGKLHNVVYPQLAKECESSGTGWDQTREREEGKRMRKLIRQIQEDGGYDAGIPIPKQRDSQTLPGSAPEGVLEASPMLTHEPLSAGPAANSPNLKTLQPAYPQRQSVQTRSFTTPIPASHDHLSSEPNSNDGTNWTRSDISRAALSSIAGDHRRQSPSVSSDGGHFFPPARPYEGSPKSGSPATQHATLAHQGASSSTSDLGVRFEHSRGNSSDSTTGRRYYESIRQDNTRPSPYDPYNRQLSGDNPSSYSKDHSNRLLHFFKKRSRTGDSNHPSPEEQFLESPTSPVNMRQNASHLPYTKPNFSSSDMSLGERPSSSSVSDHDRLALRAKSGHKGRKWAFATLDGWNYRLVDITETESVEVLRATICQNLGLSDWTGAQIFLTEPGQTEHDEPLNDPSLTLCRKTKSDSLGSLKFFVRGSHTYAGASSSPHVAGLGVSFPDKHTASPTSGQHQLHRKPLDDEALNRIAKPTSPQVASRQQLRTPAVKLPARDISHTPLSASPVDGGQDAGHLDPDKADLLARHEEHQREVERKQKAYRISKVSSVPQPRKDAYGETGYRREGVIDFDSPRISPYEDKKAEPLVPLRKPPTAPHESHTLTKVNSLRKKDADRPRVHQPVQTHGLGAVLASVGRMTSAIGTPTPSVSTSQAGTNNHANIEAPSESNIPDETKSTSQSPAGQDSQETPTSHTNQSPAKTAVPEEPRPTVQSRKSFGPEFDFEETNVSFQRSPMPQEDSDDDDSDDGLFAIPLANSKSPTKEKDSATGFSASQKLSAKPSLTVNTENRLRKGLSVSFRSPSATRETFASSSGDPDPRTGSLSDLTASPEEEKPPRRDSFARGDIWASRPPVEGVIEYLDDFFPNIDLDAPYLDGQGASPPSSPASRVAAESELSQKERPQPPPNPSESTLGSSEPTIKPQEANIVARRNVNRSGGLTRMKSIREVARGANQTSRNRSVTSSTGNQKSGDILRRKSTKMFGARIMQISPKPGSRLSQLDPIPQNNAPTTSVPQRQPTFRIIRGQLIGKGTYGRVYLGMNADNGEVLAVKQVEINPRIAGQDKDKMKDMVAAMDQEIDTMQHLEHPNIVQYLGCERGELSISIYLEYISGGSIGSCLRKHGKFEESVVKSLTQQTLSGLAYLHNQGILHRDLKADNILLDLDGTCKISDFGISKKSDNIYGNDSTNSMQGSVFWMAPEVIQSQGQGYSAKVDIWSLGCVVLEMFAGRRPWSREEAIGAIFKLGSLSQAPPIPEDVSMNISPAALAFMYDCFTIDSLDRPTAETLLTRHPFCEPDPKYNFLDTELYAKIRHVL

SEQ ID NO: 2029 - protein, 304 aa, Synechococcus elongatus
MLRSNVLKQRALLLVNRRSRRGRKLLKPAIAQLEAAGFELVQPYLDRHSDYSELITAHRDRVDLVIIGGGDGSLNAAARGLVETQLPLGVLPLGTANDLARTLALPTDLSQACQVIARGQTQAVDLGWVNGYYFFNVASLGLSVKITQGLTSGVKRRWGVLAYALVALRSLWRFRPFRAEIQIGDRRLQTKTVQIAVGNGRYYGGGLSVAHDAAIDDQRLDLYSLSINHWWQIVPLLPSLYHGRYPSPLTEQCGPGETIEIRTRRHRHINTDGEIHTTTPAQFRVIPQALRIFVPVTAASPPTL

SEQ ID NO: 2030 - protein, 314 aa, Spinacia oleracea
QIASDVEAPPPAPAKVEKHSKKMEEGITVNKFKPKTPYVGRCLLNTKITGDDAPGETWHMVFSHEGEIPYREGQSVGVIPDGEDKNGKPHKLRLYVIASSALGDFGDAKSVSLCVKRLIYTNDAGETIKGVCSNFLCDLKPGAEVKLTGPVGKEMLMPKDPNATIIMLGTGTGIAPFRSFLWKMFFEKHDDYKFNGLAWLFLGVPTSSSLLYKEEFEKMKEKAPDNFRLDFAVSREQTNEKGEKMYIQTRMAQYAVELWEMLKKDNTYFYMCGLKGMEKGIDDIMVSLAAAEGIDWIEYKRQLKKAEQWNVEVY

SEQ ID NO: 2031 - protein, 585 aa, Mycobacterium avium
MLSGRPNGEQGRRVATVRSGTMRSMGAQTALTLLLAAIAVIVLVDWISERTRLPSATLLVLVGIGQALLPGPTIGLEPDVVMTCILPPLLYHAALESSLVGIRRNLRTVVSLSVVLVLLTAASVGVAFSLLVGGATLAVGMVLGAAVAPTDPVAALAVARKEGLPLNIVTLIEGEGLLNDATALTTLAVAVTVARGAAFSAPSAIREFVLAAVGGLVVGQVFAYARRLLRRWRHDVLTANAISLATPFLTYLVAEKLSASGVLAVVVCGLIVGHDSPRVESGASRLQTRAVWRLVNFLLEGVVFLLIGHQVPVILDELGGYALSTILVAVGVTVAVVLLVRPLWLLLTQALPRSLHTRLGNVDDSATDSAEPRPERTRERLSGREIVVLSWAGTRGVVSLAAIFAVPVLTEGNAPFPDRDLLLFCTLVVVLVTLIGQGVTFGPLVRALGLRAKTTDELRLRNRARAAALRAALDRLDSLDPEDGADVDPRVIDGVRQQLSAQLERYEHRLTLLSDVDELPAAPAYEAAVGLRRVAIDAQRDELVRWRDAGMLPDQSLRAIERELDHEESMLPMGLPRSPRRSQKR

SEQ ID NO: 2032 - protein, 626 aa, Pediococcus pentosaceus
MCGFAGYINQANVNKDTIKSMADRIKHRGPDDEAFFQDENASMGFRRLSIIDLAHGRQPMMNSAETKVLTFNGEIYNYKQVREELKELGYEFRTDVDSEVLIHGYDAWGPELLKKLRGMFAFVIYDKEKQEVFGARDHFGIKPLYYYDDDKTFLWGSEIKSFLEHPNFVKEFNEELLPIHLSFEFIPSKETMFKNVYKLLPGTYFIHKNGKTETHTYFKFNYDHIDESQTIEEDSKKIRKIVSDSVDAHMIADVEVGSFLSSGIDSSYVLAEAAKLKPIQSFSLGFRNSKYSELSYSTEFAKEINQKNTPLYMDGDDYFDILPTIMYYMDEPLSNPSAMQLFYLSKGTRKNVKVALSGEGADEFFGGYNTYLEAFTFERYQKMVPSFIRKGLAKAVSGLPRFHGRRFLMRGAQPLSERYYRVNYVFNQQERDQILRNPALNVDSGAYTQHIFDEVKGKDEMTQMQYFDINTWLPFDILHKADRMSMANSLEVRTPLVDREVAKFAATMPIKTRIHKEETKVSLRRAAEAELPERVAKKEKLGFPSPIANWIKEDKYRKRIEAAFNSDIAKKFFKPEALMHILDEHVNGKSSMQKIFTIYTFILWYGVFFPEDTNTNTIDLVKRTQV

SEQ ID NO: 2033 - protein, 226 aa, Brassica napus
ESGETYTDMLGYLMKKEDNRYLLTDKEIRDQVLTILYSGYETVSVTSMMALKYLHDHPKALEELRREHLVIRDRKRPDEPLNLDDIKSMKFTRAVIFETSRLATVVNGVLRKTTHDLELNGYLIPKGWRIYVYTREINYDTSLYEDPMIFNPWRWMEKKMESMSYFLLFGGGARHCPGKELGISEVSSFIHYFVTRYKWEEKGGEKLVVFPRVSAPKGYHLRVSPY

SEQ ID NO: 2034 - protein, 485 aa, Arabidopsis thaliana
MSGVVRSSPGSSQPPPPPPHHPPSSPVPVTSTPVIPPIRRHLAFASTKPPFHPSDDYHRFNPSSLSNNNDRSFVHGCGVVDREEDAVVVRSPSRKRKATMDMVVAPSNNGFTSSGFTNIPSSPCQTPRKGGRVNIKSKAKGNKSTPQTPISTNAGSPITLTPSGSCRYDSSLGLLTKKFVNLIKQAKDGMLDLNKAAETLEVQKRRIYDITNVLEGIDLIEKPFKNRILWKGVDACPGDEDADVSVLQLQAEIENLALEEQALDNQIRQTEERLRDLSENEKNQKWLFVTEEDIKSLPGFQNQTLIAVKAPHGTTLEVPDPDEAADHPQRRYRIILRSTMGPIDVYLVSEFEGKFEDTNGSGAAPPACLPIASSSGSTGHHDIEALTVDNPETAIVSHDHPHPQPGDTSDLNYLQEQVGGMLKITPSDVENDESDYWLLSNAEISMTDIWKTDSGIDWDYGIADVSTPPPGMGEIAPTAVDSTPR

SEQ ID NO: 2035 - protein, 419 aa, Oryza sativa
MVLQHSDRMDSLFSPQTSWVSGPIIVGAGPSGLAVAASLREQGVPFTMLERADCIASLWQKRTYDRLKLHLPKQFCELPRMAFPAHYPEYPTRRQFIDYLEDYAAAFDINPLFGHTVLSARYDETSGLWRVRASSSAGAEMEYIGSWLVVATGENAESVVPDIPGIDGFGGEVVHVADYKSGEAYRGKRVLVVGCGNSGMEVSLDLCDHGARPAMVVRDAVHVLPREVLGKSTFELAVLLMAWLPLWLVDKILVLLAWLVLGNLAKLGIRRPATGPLELKNTTGRTPVLDYGALARIRSGEITVVPGVARFGRGFAELADGRVIALDAVVLATGYRSNVPQWLQGNDFFNKDGYPKTAFPNGWKGESGLYAVGFTRRGLSGASADAMRAAKDLARVWKEATKPTKKSTACHRRCISVIF

SEQ ID NO: 2036 - protein, 72 aa, Francisella tularensis
MAKEDCIEMEGVVLEALPNTMFRVELENGRIVTAHISGKMRKNYIRILTGDKVVVEITPYDLTKGRIKFRSK

SEQ ID NO: 2037 - protein, 135 aa, Vibrio parahaemolyticus
MSDLTKTLLNIRSLRAFSRELTLEQLEEALDKLTTVVEERREAEEAEREALAQQEAKLAEIAEKIAQDGIDVEALISALSGETKTKAKSKRAPRPAKYKYIDTNGQEKTWTGQGRTPSAIQEQLDAGKSLDDFLI

SEQ ID NO: 2038 - protein, 445 aa, Citrobacter koseri
AVMGRNLALNIESRGYTVSVFNRSREKTEEVIAENPGKKLVPYYTVKEFVESLETPRRILLMVKAGAGTDAAIDSLKPYLDKGDIIIDGGNTFFQDTIRRNRELSAEGFNFIGTGVSGGEEGALKGPSIMPGGQKEAYELVAPILTKIAAVAEDGEPCVTYIGADGAGHYVKMVHNGIEYGDMQLIAEAYSLLKGGLNLSNEELAETFTEWNKGELNSYLIDITKDIFTKKDEEGKYLVDVILDEAANKGTGKWTSQSSLDLGEPLSLITESVFARYISSLKEQRVAASKVLSGPKAQLAGDKAEFIEKVRRALYLGKIVSYAQGFSQLRAASDEYNWDLNYGEIAKIFRAGCIIRAQFLQKITDAYAENAGIANLLLAPYFKKIADDYQQALRDVVAYAVQNGIPVPTFSAAVAYYDSYRAAVLPANLIQAQRDYFGAHTYKRT

SEQ ID NO: 2039 - protein, 445 aa, Citrobacter freundii
AVMGRNLALNIESRGYTVSIFNRSREKTEEVVAENPGKKLVPYYTVKEFVESLETPRRILLMVKAGAGTDAAIDSLKPYLDKGDIIIDGGNTFFQDTIRRNRELSAEGFNFIGTGVSGGEEGALKGPSIMPGGQKEAYELVAPILTKIAAVAEDGEPCVIYIGADGAGHYVKMVHNGIEYGDMQLIAEAYSLLKGGLNLSNEELATTFTEWNEGELSSYLIDITKDIFTKKDEEGKYLVDVILDEAANKGTGKWTSQSSLDLGEPLSLITESVFARYISSLKDQRVAASKVLSGPQAKLAGDKAEFVEKVRRALYLGKIVSYAQGFSQLRAASDEYNWDLNYGEIAKIFRAGCIIRAQFLQKITDAYAENKGIANLLLAPYFKNIADEYQQALRDVVAYAVQNGIPVPTFSAAVAYYDSYRSAVLPANLIQAQRDYFGAHTYKRT

SEQ ID NO: 2040 - protein, 368 aa, Brassica napus
MTRKYFQREVLPVTALVIMECANVGLNTLFKAATLQGMGFHVFIVYSYGLAALLLLPSLFFSYRSRTLPPMNFSILYKVVLLGLIGCCSNIMGYTGINYSSPTLASAISNLTPAFTFLLAILFRMESVSFKRTSSVAKMLGTIVSIGGAFIVTLYNGPVVINMSPPSISLRSQSPNHDWIIGAAFLAVEYFMVPLWYIVQTQIMREYPSEFTVVCYYSFGVSFWTGLATLFTEGSDLSAWKIKPNIALVSIVCSGLFGSCINNTIHTWALRIKGPLFVAMFKPLSIAIAVAMGVIFLHDSLYIGSLIGATVITTGFYTVMWGKAKEAAMVEDDNKANNEDATNEADHDSPLASQKAPLLESYKNDEHV

SEQ ID NO: 2041 - protein, 520 aa, Unknown
  Synechococcus sp. CC9311
MLGELWSFQGRYRTLHLTWFAFFLTFVVWFNLAPLATTVKADLGLTLGQIRTVAICNVALTIPARVLIGMLLDKYGPRLTYSSLLVFSVIPCLMFASAQDFNQLVVARLLLSIVGAGFVIGIRMVAEWFPPKEIGLAEGIYGGWGNFGSAFSALTLVGLAGWLSFSGGFELPSGAVLNWRGAIALTGIISAVYGFIYYFNVSDTPPGKTYQKPERTAGLEVTSMRDFWGLLGMNVPFAAILCVLCWRLQKVGFLNAGTYPLALGAVLIWFIFQTWGIIRTNRELIMGTKTYPKEDRYEFKQVAILELTYIVNFGSELAVVSMLPTFFETTFDLPKATAGILASCFAFVNLVARPAGGLISDKLGSRKNTMAFLTGGLGIGYLVMSMIKPGTFSGTTGIIIAVLITMLASFFVQSGEGATFALVPLVKRRVTGQVAGLVGAYGNVGAVTYLTIFSLLPMWMGGGKDPSPEIIAASNSAFFQVLGVAGLIVAFFCFFFLKEPKGSFDDLHEGETASPEFANN

SEQ ID NO: 2042 - protein, 445 aa, Escherichia vulneris
AVMGRNLALNIESRGYTVSVFNRSREKTEEVVAENPGKKLVPYYTVQEFVESLETPRRILLMVQAGAGTDAAINSLKPYLDKGDIIIDGGNTFFHDTIRRNRELSAEGFNFIGTGVSGGEEGALKGPSIMPGGQKEAYELVAPILTKIAAVAEDGEPCVTYIGADGAGHYVKMVHNGIEYGDMQLIAEAYSLLKGGLNLSNEELAQTFTEWNKGELSSYLIDITKDIFTKKDEEGKYLVDVILDEAANKGTGKWTSQSSLDLGEPLSLITESVFARYISSLKEQRVAASKVLSGPQSQPAGDKAEFIEKVRRALYLGKIVSYAQGFSQLRAASEEYNWDLNYGEIAKIFRAGCIIRAQFLQKITDAYAETPAIANLLLAPYFKQIADDYQQALRDVVAYAVQNGIPVPTFGAAVAYYDSYRAAVLPANLIQAQRDYFGAHTYKRT

SEQ ID NO: 2043 - protein, 329 aa, Schizosaccharomyces pombe
MEETAHELTVKQYVEQQRELEREAREVLPYSFDTCTYSMGYLKQPLYACLTCQKASGSLNAVCYSCSISCHADHDLVDLFNKRHFRCDCGTTRTHSIPCNLRKSVDECGSENDYNHNFEGRFCICDTVYNPETEEGTMFQCILCEDWFHEKCLQKTNKGIAIPDAETFEWLVCSECSEKYRDHLLNQKHESIAGTERAPLFLSENFRENLCPCESCISLRNLEMPMLVAEEPIYEPPEDSEDGISEMNEDPSESGEMIEQVISSTMNDVLRILDRLPRVQANESVYAYNRLKSELTDFLTPFARENRVVTKEDISNFFLERSRISKNLR

SEQ ID NO: 2044 - protein, 135 aa, Zea mays
  misc_feature (15)..(15): Xaa can be any naturally occurring amino acid
  misc_feature (38)..(38): Xaa can be any naturally occurring amino acid
  misc_feature (78)..(78): Xaa can be any naturally occurring amino acid
  misc_feature (103)..(103): Xaa can be any naturally occurring amino acid
  misc_feature (110)..(110): Xaa can be any naturally occurring amino acid
  misc_feature (123)..(123): Xaa can be any naturally occurring amino acid
VGGAVCTYVSWEKEXNVYSEAFEAARIACIMFMTNSAXKDAFHLWVRVHPFHVLRVNKMLSCAGAAWLQTGMMGAFGXPQGTCARVDIGQVLLFVRCMDNFAXHASESLXLAMFKFPGLQKIXESLKWGFTCFSR

SEQ ID NO: 2045 - protein, 445 aa, Raoultella planticola
AVMGRNLALNIESRGYTVSVFNRSREKTEEVIAENPGKKLVPHYTVKEFVESLETPRRILLMVKAGAGTDSAIDSLKPYLNKGDIIIDGGNTFFQDTIRRNRELSAEGFNFIGTGVSGGEEGALKGPSIMPGGQKEAYELVAPILEQIAARAEDGEPCVAYIGADGAGHYVKMVHNGIEYGDMQLIAEAYALLKGGLALSNEELATTFTKWNEGELSSYLIDITKDIFTKKDEEGKYLVDVILDEAANKGTGKWTSQSSLDLGEPLSLITESVFARYISSLKDQRVAASKVLTGPKAQPAGDKAEFVEKVRRALYLGKIVSYAQGFSQLRAASNEYNWDLNYGEIAKIFRAGCIIRAQFLQKITDAYEQNAGIANLLLAPYFKQIADEYQQALRDVVAYAVQNGIPVPTFSAAIAYYDSYRSAVLPANLIQAQRDYFGAHTYKRT

SEQ ID NO: 2046 - protein, 414 aa, Campylobacter jejuni
MSLEMFDKEIFDLTNKELERQCEGLEMIASENFTLPEVMEVMGSILTNKYAEGYPGKRYYGGCEFVDEIETLAIERCKKLFNCKFANVQPNSGSQANQGVYAALINPGDKILGMDLSHGGHLTHGAKVSSSGKMYESCFYGVELDGRIDYEKVREIAKKEKPKLIVCGASAYARVIDFAKFREIADEIGAYLFADIAHIAGLVVAGEHPSPFPYAHVVSSTTHKTLRGPRGGIIMTNDEELAKKINSAIFPGIQGGPLMHVIAAKAVGFKFNLSDEWKVYAKQVRTNAQVLANVLMDRKFKLVSDGTDNHLVLMSFLDREFSGKDADLALGNAGITANKNTVPGEIRSPFITSGLRLGTPALTARGFKEKEMEIVSNYIADILDDVNNEKLQENIKQELKKLASNFIIYERAMF

SEQ ID NO: 2047 - protein, 445 aa, Raoultella terrigena
AVMGRNLALNIESRGYTVSVFNRSREKTEEVIAENPGKKLVPHYTVKEFVESLETPRRILLMVKAGAGTDSAIDSLKPYLDKGDIIIDGGNTFFQDTIRRNRELSADGFNFIGTGVSGGEEGALKGPSIMPGGQKEAYELVAPILEQIAARAEDGEPCVAYIGADGAGHYVKMVHNGIEYGDMQLIAEAYALLKGGLALSNEELATTFTEWNQGELSSYLIDITKDIFTKKDEEGKYLVDVILDEAANKGTGKWTSQSSLDLGEPLSLITESVFARYISSLKDQRVAASKVLTGPQAQPASDKAEFIEKVRRALYLGKIVSYAQGFSQLRAASNEYSWDLNYGEIAKIFRAGCIIRAQFLQKITDAYEENAGIANLLLAPYFKQIADEYQQALRDVVAYAVQNGIPVPTFSAAIAYYDSYRSAVLPANLIQAQRDYFGAHTYKRT

SEQ ID NO: 2048 - protein, 445 aa, Shigella boydii
AVMGRNLALNIESRGYTVSIFNRSREKTEEVIAENPGKKLVPYYTVKEFVESLETPRRILLMVKAGAGTDAAIDSLKPYLDKGDIIIDGGNTFFQDTIRRNRELSAEGFNFIGTGVSGGEEGALKGPSIMPGGQKEAYELVAPILTKIAAVAEDGEPCVTYIGADGAGHYVKMVHNGIEYGDMQLIAEAYSLLKGGLNLSNEELAQTFTEWNNGELSSYLIDITKDIFTKKDEDGNYLVDVILDEAANKGTGKWTSQSALDLGEPLSLITESVFARYISSLKDQRVAASKVLSGPQAQPAGNKAEFIEKVRRALYLGKIVSYAQGFSQLRAASEEYNWDLNYGEIAKIFRAGCIIRAQFLQKITDAYAENPQIANLLLAPYFKQIADDYQQALRDVVAYAVQNGIPVPTFAAAVAYYDSYRAAVLPANLIQAQRDYFGAHTYKRI

SEQ ID NO: 2049 - protein, 717 aa, Arabidopsis thaliana [sequence omitted]

SEQ ID NO: 2050 - protein, 338 aa, Streptococcus pyogenes
MTKQKVAILGPGSWGTALSQVLNDNGHDVRLWGNIPDQIEEINTKHTNRHYFKDIVLDKNITATLDLGQALSDVDAVLFVVPTKVTRLVARQVAAILDHKVVVMHASKGLEPETHERLSTILEEEIPAHFRSEVVVVSGPSHAEETIVRDITLITAASKDIEAAKYVQSLFSNHYFRLYTNTDVIGVETAGALKNIIAVGAGALHGLGYGDNAKAAVITRGLAEITRLGVKLGADPLTYSGLSGVGDLIVTGTSVHSRNWRAGAALGRGEKLEDIERNMGMVIEGIATTKVAYEIAQDLGVYMPITTAIYKSIYEGADIKESILGMMSNEFRSENEWH

SEQ ID NO: 2051 - protein, 297 aa, Bacillus subtilis
MKIGLIGLGKMGINIGKQFIDRNHQVVGYDVNQAAVDELKAYGAEGTTNLKEFISLLHPPRILWVMVPHGIVDAVLRDVSPLLSKGDMIIEAGNSHYKESIRRYNQMKEAGIHYLDAGTSGGMEGARHGACFMVGGDHEAWEIVEPLFRDTAVENGYLYAGEAGSGHFLKMIHNGIEYGMMAAIGEGFEVLENSQFDFDYEKVARVWNHGSVIRSWLMGLTERAFAKDAKLDQIKGIMHSSGEGKWTVETALDLQTATPVIAMSLMMRYRSLTDDTFTGKVVAALRNEFGGHATEKK

SEQ ID NO: 2052 - protein, 28178 aa, Unknown
  Synechococcus sp. RS9917
MGKRRRRRNRSTSKAQPQATPRRAPGQRVRDLASTATVAAAAMVMFGGGRAALALPQGMTVRGGQLTIQRPDGKTAVIRQGSKRGAADFKRFDIDAGEQVRIEQPDAKSVFLGRVTGGKLTEIHGRLDANGRVLLINPAGVLIGPGGVVNTASFTASTLQVDPDQFMAGGVVELKALPGDDPNAAVINQGTINVADGGFAALVAPHVVNDGVITARLGQVQMASGTAATLDVSGDGLVAVVLDPAVAGSITNRGTVQASHVRLGGGDAAALTAATVNLGGVIEARSAADVLGLDPAVASDAEQQASIEAVSSGVITVDGRVDASASAAGLKGGEVKLLGRAITLKPTAAVEASGPAGGGEVLVGGNDLGQGPEPNAQQVSIEAGAAIRADATQAGDGGRVIVWSDERTDFHGEISAKGGPEGGDGGFVETSSKQTLVVTGKVSTAAAKGKAGQWLLDPEDVEIGDEAAAQEEEAAAQEEEETSAETEETAAEVEAEAEAESEADTNTESKSESESEKEEKVEKGEKDEDEDDEEEETTSAASSESDESSDKPEAETASDSTSDSSGSFISKDSIETARGEGTEVTVVSSGEVSGAESEEASAEKGGLTVISNAEDPAAAVAAAQASEDAESSESSISGSSIETARDAGTEVTVVSSGEVSGAESEEATAEKGGLTVISNAEDPTAAVAAAQASEDAESSESSISGSSIETARDEATEVTVVSSGEVSGAKSEEATAESEASSDRQASPEDPISTPELYTLYLNGDDLNLSAQQEQLSGRNVVIASCEGSCTTDRAGNIFIDSLSGLASLQVLALADVTLEKEISVSGGLSFAGALTFSGTEISIRANELVLSGPVQVAEPVKAAGGPALTISSASSDRAIQLGGAGQASVNLDAPAAELQLGSSTLNKLNQAGLAELKIGGTDHTGGINLDASASLKASNAVSLESQQVNVAGAITASDGNRGGQVTITGDQLTVQGTARIDASGAAGGGEILIGGSWQNENPAVRQAETTTIEAGAVVDASATGNGKGGTIVAWSDITNPTGHTTVAGTLLAKGGAQGGDGGRIETSGYDLKVDGINVSTEAPLGKTGQWLLDPRDITISSSGDTVSGNYTAAADSAFIDVATLQTALNSTNVTVFTGSTGTQAGTISVSSAISSGSTYDLELKAASDIVINADITRSGTGGITLRAGSGSVSGTGDLILGGGTTLSLAHGTTLANDIQLTSGGATIGFAGLAVEYLIVGGGGNGEGIYSGYAQGGGGGDVKTGSLQLSGSSSTITVGAGGTTGTGTTGKGGDSSGFDITAAGGLGSISASGGTSGSGFTGGAGLYDGGGGGGAAGTGTAGTNGSGTRRAGAGGIGIYSDITGSQVGYGGGGAGGYLSNWTVGTGGQSYGGGGPGQSGTANTGGGAGGGKDGGSGVVIVRYQGAQAATGGTTTSGTGTAADYTIHQFTAVGSSTFEINNLAATLTGSISGSDQLTLAADRGTLTLSGANTYTGTTSISGGSVKATSSDALGKGSAVSLSNTAGATLELANTSADPVATPLTVSIGALSGGGISGGNVVLGANTTLSTDGAATPFAGVISGSGTLTKSGAGTLTLTSSNTYSGGTSVSAGTLQLGSGGASGSAGTGTIDIATGATLATNRSNTLILSQAISGDGSVEQAGSGSLTLTSSNTYTGGTTVSAGTLITRSDAALGTGMVSLGGGVSLLIGHGVTLANAIDITGNATIGFADLEVEYLVVGGGGGGAGRDVGGGGGAGGLLTGLTTLGSTTSVTVGDGGAGGTDANGSRHGERGDDSSLGTITAFGGGGAAGYGTVLANSQQDGGSGGGGAGLTNYEAGSGKAGQGFAGGGGAGGSDYGGGGGGGAGGPGASSADGGDGGVGVYVAWADAAELGESGYFAGGGGGAGHRTADPGHSGAGGLGGGGDVPGTDGQSTPAGNGGAGQANTGGGGAASRNAGTSGGAGGSGIVAVRYAGPVTATGGTAKSFTGDGTNGVNGVEYQVHAFTSSGTFTVTDNMVAAITGSISGNGDLTLTTQRGTLTLSGTNNYTGATSITGGTVKATSSSALGSGSAVSLSNTAGANLELANTDLDPTNNNLTVSIGSLSGGGTSGGNVVLGADTTLQIGSAGTSTSYAGTISGSGAITKTGAGTLTLTGNNIYSGGTNVSAGTLQLGSGGSSGSAGTSEIQIASGATLAANRSDTLILSQAISGAGTLSQIGSGRLSIAGDNYDDGNNTGFTGAVSISSGTLGVYNNQALGTAAVSIGAARLEFGRAVTSFANDITLTDAATIGLDTTVEYLIVGGGGGGRTRHGGGGGGGGLLEGSIDLAGWSGDVVVGSGGAAGQKGGDSGALGLTAIGGGSSNSITGGSGAGGSGPQVGGAGTDDQGFAGGSGVGGGAESTYGGGGGGGAAAKGGDASGNGAIGGTGGDGVYVDWVAELGLGDNGYFAGGGGGGVASTSNSAGAGGLGGGGAGSKGTAAATSGDSNTGGGGGGGGFAGDTNATPGSGGSGIVVLRYLGAAAATSGSTADSGAAQTGSGLSDGYTVHTFKSGSQSFTLAASSVTLGGTISGTGTHSVQLDTNGGGLILAGANTYSGDTTITSGRVEVSGSLGQGNYAGAISNAGTLVLNSANNQTLAGNITGKGSLEQAGSGTTTLTGSGNAYTGATTISDGTLRIGDGTANGSLGGNGTVAIGANGQLIFDIISNSTFVSSKNISGAGTFEKTGAGQLTLTGTNSYNLTKISEGTLQIGDGGTTGSAGTGEIQIANGAVLATNRSNGFSITGAITGAGKVVKNGSDLLNLAGANTFSGGMDVTAGTLALSTTNAGGFSGGLRMGLDGNANTELVLAPGVDLQSDLTLNGTVAITLGLPVDYLVVGGGGGGGGDNGGGGGGGGFVEGTAILTSSSAAVVVGGGGSGGTVNQPGAKGGDSKFGSITAVGGGGGAGGDANSGRNATTGGSGGGGDGETNTVNRLGADGTTGQGNPGGDGFSGGGGGGGGAGAQGENATGPGQPGSGGAGLPSTITGTETFYAGGGGGGPDNTTAVTTGYGLGGVGGGGDGKLGTGEAGATNTGGGGGGGGYNSSGTGIGGAGGSGVVVVRYLGDTDIANGGTETAPNTGSAAGYRIHTFNSSGSFDLSGVDFTATISGNVTVNAGAALNVESAGDLTISGNISSADAANAGTVTLTGTPVASHAPFLTTTATTVATGMTVQEALDSITGAKLGGGAVNSGTALTGTITRRSFDSSTGKGYFQVQAQNGLNKVAVVELSQSGSDVQAKVIRAAYGSGDLFGEDFSTGFTNFTIASNSSTNGYGVLNLSFTGSLTLAGDNSGFSGAFNLNSGNLRAESANALTAAAVTLSSSANTQLILANTAADPSTNPLTVAVGSLAGGGGAKGNVGLGAHTTLKVGDASTTSFDGTITGAGGLRKDGSGTLTLTRSNVYSGTTTIANGALQLGNGGALGMIALSNITNDGELIFNRSDEIVLTGSISGTGAIEQAGPGTLRLTAASTYSGGTTVSAGTLITGVTGAAGTGAITLGSATTLLLGHGTTLSNAIDLAGDATIGFAPLEIDVLLVGGGGGGGGSPHGGGGGAGGLIYQSGLLVWDAGAVSVGAGGAGKQGALVSPWPSAGTNKGDTGENTVAFGLTALGGGGGGGYSGGSTSDTAGQAGGSGGGGGRDSNSGTALQPTSASGGFGNDGGPLGSTGGITAGGGGAGQAGQEGFGGDGLDFSTQFGTTFGESGWFAGGGGGSYYAATRPASTGGQGGGGDAGLNNSTGRPGNGLANTGGGGGGAERDGTGKGGDGGSGVVLVRYATSQVATGGSISNFTDAQGTSYTIHAFTDPNAAYTFQPDLAASLTGVISGSGDVTFDTDLGTLTVSGANTFSGATTITGGTVKVTDSGALGSQAAVRIDNTAGATLTLDGTDLSIGSLAGGGSAGGTLNLGNNTLTVGGNNSDSGFAGVISDAGTGTRGSVVKTGTGTLTLSGNSTYGGTTRVEGGLISVSTLGDSVGAIGASQLVFDGGGLRYTGATGSINRAISIEGGKEGRIDVFNPNSTLTLTGAITASDVAGTKLVKQGGGTLILDADNSATLAADTNVAAGTLTLRASAGLGTGALSLAGSSSLLLGHGVDIANNITLNGDATIGLTIQPIDVEYLIVGGGGGGGSSAGVGASGGGGGAGGFVLGQTTISSIDANIITVGAGGGGGSAGGDNPGTSGLSSSAFGITAYGGGGGGGRTYNSATVGVGKNGASGGGSGSQGQTPGDAVHGDQGNTGGSTNNSDGNSTYDNASGGGGGAGGVGGDGVDDSAGGAGGVGKYVAWADAADLGESGWFAGGGGGGISDGRGTRTAAAGGQGGGGDGGVGTDANNNTAVATAGTSATGGGGGGAGGTGHAGGAGGSGIVVIRYRGETFATGGSISTITENNETYTIHAFTSVGSNNSFALDYSNLAAKISGNITGAGKLTTAAGDGTLTLAGDNSYGSTAIAGGTLKITGGSSANPLGSGAISNQGQLVIDRSDNLTIGAAISGSGTLVQAGSGTTTLTATNTYSGQTRIDDGVLQVGAGGTSGSLGSGRLVNNATLAVNRSDDLTFAQVLDGTGNLLKQGAGTLTLTGNNVYSGTTQVAQGVLQLGNGGASGTAGSGAIILDSDVNTANSGGGSLVVNRSGSITLSQVISGEGSLTKQGSGTLSLVANNTYSGGTTVQAGTLALSSDGTNTTPVGAGDLTLEDGSSLLLSSGTSIGNAITLNGLATIAMGIQVDYLVVGGGGGGGAWVGGGGGGGGVLTGTQVIAGGSYGVVVGNKGFGANNYNKMNAATIRATSGGSSSIFGITALGGGHGGSWTAQRAATGASGGGQGYSYAAIPGTEGQGFAGGTGRGNRSNGYPTGGGGGAGGPGGNWSSSKAGDGGVGLYVDWAGAAGLGDDGYFGGGGGGGVHGYGSSPNAAAGSGGKGGGATGAVATTSRPTAAQANTGGGGGGSGNAGGSDSRGGDGATGIVVVRYAGATPAASGGTTVRTVNIGGIDYTFHEFKTTGSASFSVDAMSAALTGTISGSGSLDINAAGGELTLGNSANTYTGSTRVSAGTLSVSNLADGGANSSIGASSNAAANLQLAGGALKYTGTSASSDRNITIAGSGATTIDVVNQGTTLSLSGTSSAGSGGIRKAGAGTLTLSGNHGYSGSTLVAGGTLNVEGTIDGTDLVNVYGNSTLNIATGGSLTTGSGGTFAIGSGKGSHGTVNVSGDLNIGGGKGAVYIGGKLHNTGTAGTGTLNINDGGVVSISGGGQSSISGAQAWRAWLNPWGKGGASGDPGATINVNSGGTLETARVLSEGYNGLAEINFDGGTLKALRSGTLIHQDNDANLSVNIKDTTNGGGLIVDTNGFNVLIAKPMDGSGGLTLDGTGGGTLRLNKANTYTGGTTVDNGTLLLQYASGGTGTIRGDLTVNADGVVDYSTHHTFGWRPNSTGGTIESVTSLTINGGRVGGNNFANHFWGKTTADGTPSGFQLTMDGGELILGGTYNEFYNPTFNLSGNAVIRRATGNTSANLHLRDGGDLTINAADGTNALISAPIRQRNGTADFSFNGPGTVTLSGVNNWTGTSTIDGGRVIVTNDEALGSQYSAKTVNIFGGGVLEAAFTGRPNDHMRIVNLNLGKDGELGGTLAGTGTGHPNYGEFYLHGNVTVAGTSASEISADLRIGGGATRTFTVADVTGDSADDLIISGKLGHYNGISWGYLTKAGAGTLAITGANQIGGATVNEGMLRLIGADANNAFWSRGIRLNKDAGLELNLSSGSTTGSYRITGAGSGGVTKTGAGRIILTNNHAYTGATTISQGTLQLGNGGSRGALGNTTVTIDNGATLAYFRNNGMTLANTVSSSGTGTGPAGGTIEFLGTGNQNQSDYRIGGNSTGFTGNVIIRSGARLGIDSTDAIGQGTVTVDAGGGVFVRIGETGGVANTISNDFIIAGDGWLQSAGRLGALRLISGNITGGVTLAGDARITAWTGQGGIITGIISDGGNGYGLEKTGSGGITLNGLNTYSGATKLSGGTLYVGTLADGGVASSIGQSSNDAANLVFAGGTLAYSGGSVTTDRNFQFANGSNNTIAVTNAATTLTLSGTSPSSTGSLIKRGAGTLELTGAHNYTGLTNVAQGTLLLSGNSTLTSTPTSGVYDGRILIGTGATLKLNTSTNQTFAGVISGGGQLIKDGTSELTLNATNTYTGGTTVDGGTLWLGKGGSSGTIRGSVTVNSGATLDYRDANTFGWVRGASVNKLTINGGTVGGADFGNHFWNNFQLTMNGGELKLGGTVNEFYYPTINVSDDALISQVSSAAMFGLRDGSRITTDVAAGKTLTIDAPLTQRYGSSSLRVRGAGTTELTNTNNKFDGITQIWDTSTLLLSGTGRLAGTTSNIYRGRIHIASGGKLDVDSTATQQWDGVITGTGALNIKAGIVDLGGKSTYSGQTTISDGARLQIARGGSNAEIRGNIQIDSGGTLRYFRGDTNAAIKLHNTISGSGTLQFAGQPTRNSSSYLAYKASAFSGNTEVLSGARLWLSHHEGVGTNGIIKVMDGATLSIAVGDGNNVVNDVEVQGTGWLENVGRIGALRMASGDLTGTITMTGDTRFGAWRGERGVINSVIDDGGNGYDFQKWGNGRLTLTGANTYSGDTIVSGGQLMLANPNGPALYNDPTNTDPANLGRMANPGRVIIRHDEGAGWRYPDVAANLEFGADNQLGPQVDIVFDAVKPYSYMSLRDTTQEVGNLSTGRNPGWAVLQNYEDSSQDTNPGTGQGHLIINQDQNLTFSGYLRNSWTRGTNNSDPLKITKKGTGTLIIARGTKNTGGIDVQEGVLQIGDGNFNGSLLNSNAVTIGADGTLKYYRTDRQNVEGVVRIGHDISGDGTLIFASNNWNSSDVGEKGAGDYRYTGTNTLSSNATFIIDNARLVVFDQADLGANLPTVKVINDGQLYLGKGGTYSNPLEIEGQGWSQPEGTRWGALFAYTYTGGGNATYDGDILLTDNARISALNFGNLTLEGVVSSGNNTYGLNFTGNREITLAGENTYLGNTHVREQLVTLASTGSLYRDAALYNALDAADRGRIILGGSGGQRGNARLRLNADNQIGEFGANGVLNPIDVEFQSGSNRWNFLELRSTDQEIGNIIAGSGHARTVIQSWDGGYDANQSNGLSKTSAATLTINQTVDAGYAGQVRNAWRGQGLLAITKQGDAALTLSGPTNYSGDTTVKGGTLIFTGATRSGNYQIDSGAVLDFNVARGTRDMPVDMTFTGGGTLRKSGDGLLVWGRKAATFDLDAGGWINIAGGTLVAGSWGNENWDSNLASLNIASGATFRSVEAEIRIDALTGGGTWAGGWRSSNFRSTPIIGVADGVGAANAVFSGRIVDYNRAAGDKIQNLIKVGTGTQIFTGTNTYSGITQVQGGTLQIGDGGSTGSLGGHTVIVTGGTFAINRSDTVAFNQKITSAGASDATDITGALDPLPSYDLASLSGSVVQRGSGQTYFTNSANDYTVQTVAEQGTLTLSTTTTNTKGIDVWAGATVELPAKLDGFTNPGGITYTGAGTIVRSAPRGSGVYRTLVGNAGGTIDLSAGGRLVIAGGETRLVNSAKTDWTSNEGSLTVSNSAVLNLWDSGIAPTAGQANTNLYIDALDGDGRIWRTLLDNNAASPASTLIMGVANTNGRFTGTISDSSNASIGNISVEKVGIGTQILANNNGYYGTTLITDGTLQIGAGGLAGRPGFGDITNNANLVFNLANTAPELTLAQNISGTGDLTIVRSGGIRFANDPGKTFSQANVTIQDSGNNRTVQFTGNTTISNGLIVQAGSADYNVSFLGATNSIGGTVTTFANRGTLTLGNEATDSITFAGSLIATAPSRRTISGTVAVQNAGAIDFGSTGATAVNHNATLGGSGTGAIRIGTALLAPNVAFTIGTGNASSISAGFLSGSLADSSSLTLNSAGDISVGGGAVADAITISGGDQVTFANQVVANTLSIGGISTGITFEGRTQVLADGTATNTGLTVNSGAYDIAFLASGNVIRGQSVTFNNTGSLSFGDEITDSTTFFNAVDASSVSAVNLFGTLTVREGRTNQVFTPVNGRQRLQSYDLTSRGGLNLGSAALNITGDAYLYAGAEATGITPGTTGLTDNGSFSAGDVTIADGAFLRLTYASDASAGGSPSLTLGNVSGTADGDASRLLVSAAGPVSLGAVGTDISTLAIGTAGTDGDITFTGALGSSSDRISSIQLSSVNGLVDVQGDLYAGSLQINGNSNVNLYGAVSDVSGASSFATTGTLNLGNASTDQLRFTGGITHVAGSTSLSADLTTNGAVNFAGLGVLNNATIDSGAAATSTVRIGQINLAADTSLSIGTANTTAAISLGGVSAAAPSSAINSDLTLTTSGTVAVTNALSGNLDAVTINRAGDISIGGDLVANTITIADFAGDSLSFGGNVRGNTGVNGGIAALSLGATSNAYDLSFSGATNEFGGANGGDLSFTNTGALALGNASGATFNFGGALTATSASSLSLGGTLTAAGAVSLANASTPIALLGTTTIDTWGANGAITLANGVDLAPGASGSFTLHSGSGAISVQGAIGQASSLSAVAINDQAGNTGLATIGTDSTAGSIRAGSITLGATDLAGSATLQADTISLLGALGSTASGRSDSLTLLSRTANAARSLGSAAGATDLSQIQGEFSRVVIGSANPNERGTLTIDASSGEATSANNLELYGAAITINNGTLASSNAAGSGAILLDATGSISSAGSGGSAVSAAGDLTLRFRGGNGTVLDFTRAFEGDNVRLEQRNAADFTIGTATGSETTLTGTSLANLSVTGASGTLSIGGPGTYAATPGASPALTLNAAANTSSNLALDFNRIVLGADLSLASGKTLSLSSAAGGNIEQTGGVITAANLVLAGAGDVDLATAGSLNAIGSLSSSARGAISLSNAAQSLTINGVSNAASFSATGATAYTVAGVLSAAGDVLLDTSASTITIGASGRVVSLAGDVTLDAGMSGTFINERGADAVSAGGRWTIWSKGWENGTTLNQFGPGSDVNAVLASGNGAVWGASWSGTDASRSTALTGNGYEYGNRYVFASALPAPQSGLLTIRTADATKTYGTALSATDLLGEQYVRLTASLGNLTLADVRGSNNMVGSAFTDEAPNTSGITLSQAFGSAAVTSTGSAGNANVGSYALNLSLGGSLTIDAGVVKSGAVDYTINNAGTDYTFKVVDGGQLRVTPKLLDVAVAGTTREYDGTTNLGGTLSVSTGVGSETLTVTSSSSGFAGADAGQQAWSVSGLSLANGTGTASNYVLRSTELSGIGTIEQRAISASVSGSKVYDGTPSLDTPAITLSNRVAGDDLNLSLTAAFASANAGSGIALNFSNKALSGAAAMNYTLTGATLSGSGTIEQRAIRIGNATTASKVYDGSRDLTISDLAFNLTGVVGSDDVSVTSADLAASLASANAGATSFAGTGSFSLSGNDAGNYSLSNGGSSLTLSGDATVSQRSIDLVVGGTRSYDGTDELASELTSLTVSNAVSGDDLAVRFNTAVGANADAPVASFSSANAGSRDLTVNVAELQLSGAAAGNYALSNNATYTTAGGGTISAAELTLTGVAVADKTYDAGLTTTSFTNSGSLSGLIGTETLSLNATGATATFADKNVGIAKAVTLSGWTLGDGSNGGLASNYTLVLPTDITATVTQADLTVTGLSVADRDYDGTTTASFSGGAITALGNDSVTLDLSGASASFDSRNVGSRTVSFDGALISGTDARNYNLVLPSNLTGEITAKQLQVLGITADGKEYDGTTDVTIDAAGAVFSGVVGGDDVSLDANATISASFASANAGEGVAVTISGYALDSSGNDVGNYSLAQPSDVTADIDRRLITVSGLTADDRTYDGTVDATFDTTSASFGRPTELGGTAVIAADSANLSIATATGEFADKNAGTNKPVTLTEVTLDGSAAANYEVVITSVDGNGNVVPLSDSATITPAAITISAADVTKVYDGTLTVSDGEAVAINGTELFADDQFSGGSFAFTDKNVSRDANDAVLSDKRVTVSGVGIDDGNGGANYTISFADNTTSTITPAPITITGIAGVDRTYDGTDTVDVTDSGVTIAGEVSGETGTLSLDLSGASGTMDDRHANELKPITVSGIELDGTGAGNYDIESVFGAAEGELPTVTITPAPLTVTIEDFTKTYDATTAVDGAVAIVDPNSNTQLFATDKLGEVFASFDNKNAGSGKTITLTGVVVGEDYATTDEDGNAITALAPIGGNYTITLVANTNSTIEKADLVLQGLSAQDKPYDASTSATLEGSAFVSALASDVVRLDGSGSGAFANANVELDATTGNPGLKQVSISGYTISGADSGNYNLLMPSDVLATITPVSLTLSGISVDDKTYDASTIGSYTLSSTTLSTGIGSETLTIRESGFDITGEAINARAVFSGKDVAFDANGNVTTVAASVEGFSLGNGTNGGLAVNYVLELPDDLTATINQAALTVSGAVVANKVYDTTTEALLQDAGSVSALGRDQVNVDSSEAIATFDNKNAGTGKSVTLSGYKLSGADAANYTIGQPTGLTADITKADLVLSGISIDDKTYDGSTTATANIDADAGITITALPGDTVTLSGTASAAFTSANAGTDVGVTVSGLSLGGTDAGNYQIVTDDLTATIFQRAVTISGATAASRTYDGTLTTTISGGSLAAITGEANSGVISADSSAVSLDGSNATGTFADKNVAWTISYAADGITETGRTAAAKDVSVSGFSLTGGAAGNYRLEQPEGLSATINPAALTISGITAATREYDGSTDATLDFSGLSLSGLVSGDQILVDGTGVFADANAGSGKTVNLTTTVSGIDVENYTVTKQATATGTINPKLLTLSGITAEDKEYDGGTTATVDFSAVDLVAAGLIVGSDGTADDVSISSVSGVFTDANAGGNKTVNLTITGGGTDLANYNFGGQTITTATINPKLLTISGTVVDDKTYDGSTNATFTTIGSLSGLVSGQSLTVDAAGSFASKDVVLAPTFNADGTAGADAPAEQAVTVSYTLADGTGLASNYRLADEQLAAVISPAALTITANDVKKVITELDPTLTVRAAGFVAGETTADLSSFSVSRVAGETAGTYAITVSADSTNYDLTLTDGTFKILGAGELLVTLGDVTAEYGTGAANGTTNARYYSALSQAIVTLSDISGDANNGFTIRENGADVFTYGVTTVEAAGDRSTGNALKVGSYQIQGSNATLTAPHLTGAEFSDGWLTVTPQAINALSITSGGTRQYDGTTAMAALTLEAANQVSGDALTISGRGTYASANAGDNLGYTLSGLALSGADAANYFLSANSFTVAPGATGVSITPKQLTVTGSSAADKTYDANRTAVVSAGSLSGFVGTETVSISSVSGQFASADVARDGSNNVVDQDVTATYTLADGSGGGLASNYTVLDQTLQAAINPKTLTLTGVTVSSRAYDGTTTVDASQISSGGVGLSGVINSDAVSVNTGTITGTYNSEDVATATTASLSGFSLTGDKAGNYSLGGSSVDVAAAITAKALTISGTTVADKAYDGNTAATVTANSLNLSGLVGSETLGVSATGTFASQNVAYSGATVANQDVTVSYALADGSGQNAGLASNYSLSGEVLSNAAKITPKALTITGSTAADKVYDGDTSAVVTAGSLSGFIGSETVTIATATGQFASADVARNGSGDVVDQNVTATYTLANGSGGGLAGNYSLADTTGIQAAITPKALTITGASVTTRDYDGSTAATIDTTGASLGGLVNGQTLDVSGSGTFDSKNVGLRTATVTYSLADDTGLASNYSLDGSFSLNGYIDPKAITITAPTVSKTYDGSTAFDLDGADVLALNTTLQTDGTLESGDSLTAASVRFTDKDADGSAGVVLTGVTINDGNFGDNYNVSFAQGTGSIGEQDYVVWIGGTSGDWFDPNNWAVGEVVDSGSISAPGLNLGTGKGLARGRAGAVPDKENVRTVVIPVGVDITFNDSAAGRRGAAKAGEVVLQNLLFDGYGSGSAGELQLTTGTLKAITVKAGGLDLSTGSTLDVSGSIDIELPNGRTSIAAGTIKGAAPLVVKGAGVLRLSGSNTFVGNATIDDGAVLEISSDDALGDAANDITIQGGGVLRAAGTTTIGADRAISLGTGGGSLEAASGKTLTLSSAVSGSGSGNNLVLGGSGTIDLGHGVSLSSGAGISGGSGSYNLKLGGSVSVAGATALNTTGTIELTSGNTYNFTGGFNAASGSTTKLAGSIDTSNSTISLGNVVLTGNTTLDTVNSPGDDVTISGDVSGDYDLTITAGDGTVTFADRIAVKSLDVSADAISFDAAYVVDANDNTTITSHSITTTGTQLFQGGGGAGTDAAITLGANTSLQGSSITLMGAINSATSTSNNLVIAGDAVFGGAAGSTVGSTTALGSLSVSGSTTLDADTSLSSANLNLADVALSNGANNYALTLKPGTAGTVSGVISGGGSLAMGGNGTLSLNGANTYSGGSSVTAGTLVAGDNAAFGAGSVSVSSGAALDLAGFSVANDLNLAGTGVSDSGALFNSASTAATASGAISLSGNTSIVTAGDLTLSGGISDGSGGNNAELIFSNITGETGTVLLGADVTTGGLQRYLANVEATSAVTVTASSLELGANLSSSGVDLTVDAPITLLDDALNSGSGTPQTRTISTGSGAGNLQLAAITGANNSLSLISGSGTTTVSGAVSGVNALSLQAAGASGAVSFHGNLSATSLTTAAAAYNLSLLGSTTTFTDAVSFANTGTLTLGDGDSDSLTFTAGLTAAAPSLVNLRGNLIATGSGAINLGDADTAVAISGVTRIGGPSDATSSGAITLSDVTLADGASLTLGDAAATASADLGSNAITLTSVAAASGSSTAPNLTINSSGAFQSGAIGASSGTELGTISLSRVGGATFTGAVNAASLEFADGVAGSSDTIAVQGDLTLTSGFTVGTGAYAISLTGSSNSIAGSTAFANGGTVTLGDASGDGFNFVGGLSFSGNAPISLAAAVESSTGSLHLGSGTLTLAANSELAAATNLTVGGSLSGSSRTLTIAAGSANTASFLGTVTLADLITSAGSYGVSLTGASNTFTSAIDFANTGAVTLGDATTDLFSFGDGLAISGNGSVNLGATINSSADQLNFGDGSLTLTANSVVDATNNAEVASAAGNTIRFGGSIGDGANAYNLTVNAGSAGDISFIGAIGTNNDDIGAISITVADQVTFDGTVNAASFTQLDAPNTGLTTFTDNFALIGNFDFTGQELKLQGAASTAGGSIEITNAGTYTLDSGASIAADSGITVNGAGGVSLAGDIDSDGSALEFSGPVIVAADITISTGTGAGTISFDKAVSGSGVLTLAAGTGDVIFAAGADVGTSAAKAGGLEISGKNITLRNVYTTGQQDYSATGTITTNSSYVTDGASVRFDGPTVFNDATVVDTTDGGNTTTGADVTFTATVDGDGVGDPSTLTISAGTAGDVTFTGLVGDSTPLGAVTINNAKDVSVNGLIADGVDIAANSITLAGDVDTAGADARFRNAVTLSSAVAVNSANGAITFDSTINGNSALNLTAGTGTVTLTGIAGTSNGSSGELASLTINSASAASLNNIFTTGAQTITADAITLTGNDYASDSTVTYTAPVTLSGRTYIVGTTVTFNDTVDSSQTGSTTDNDSLYVVGNAVLNDVVGETTILGALDVSGTTALNGDGSNPMVVSTTSSQTYANTVTLGADTTLNAKGMDAQAIGMGSNNLTVNETGTAANTNAGNIAGVISGSGTFTKTGAGELTLAGANSFTGDTSITTGRLIVSGTLANVNVIVNSGTTYEVGATDTIGSIAGAGDIEMASGVTLTVGANNSTADFSGVLSGDANFAKLGTGTQTLSGANTYTGTTSIQAGTLVAKNATALGDRSAVSLSNVSGAELVITNPVASPSTDMALTVGSLAGGGTTGGNIELGADTLLNVGDATSDTSFGGEISGDGALQKVNTSELTLTNMNSFAGGTTVDGGTLWLANASSTNAGTVGGVLTINTGATVDFKAHNATGTRDVTNKAQLTEVNINGGTFGGSDYSNYYYFTVNMNDGTWILGGDAAGSNGNDVFDGDINVTGSTSSVIRSIASDLTPGSLRMRNAMSIDVATGATLDVQAAIGSAAEAGSTSLAGTAGITKTGSGTLLLSGANQYQGDTDIDGGTLTVTGSLSDQTAVDLANGTTYNVDSTDTIGSLNGAGNVVFASGMTLTTGGNNDTTTLSGAISGDGNLTKAGNGTLTLAGANTYTGTTTISGGGLTVTGTLGDDGAGTGSYAGTISNSGTLTINTTANQLLSGDISGSGSFAQTGAGTTTLTGDNSYTGATTISAGDLIIENDAPSLSSSSYSGAGDLVIRSAADSFDSALTLPLSKFATTLGSLTVGKASNQTEIVINANVTTDGLQSFYGPVTVNNNVTLESTNGNVAISGAITPDTDGTRSLTIQALNGDISIGGDIGTSAKPFFDLELYAQGMKVNRDTEFHTDNDVVMDFAVTHDVATADTLTVKAGRHITLGTNSSINATDGSLSVLLHADTGNTGNGIIQFFGSSITTGGGSFQTGTGSTHATGGYLTGGDIYFARSGAQSINTGGGDFTIHGETLVATPAGLTIDTGAGNVDFKGVVNSANQYEFVSGTQTWSDARTAAKGSTTGGSTVGDSYLVTITSRLENSIAGLAANYAASWHGAYRPDDKSANWTWSDGPEAVSVFYIQGSPSTGTVQANGKTQPGWYSNFGSGEPNGSLSGGGETRGQFIGTAGFWNDLGSSSTTSGYVKETNLAASELTITSTGNVNFEKAVGFGKTLANLSVTGDEVTFKDTLALDSTGGTITNTGVSSVAGAVTGSGALTKDGAGVLTLQATNTYSGDTTITAGTLEVTGTLGAGNYAGNIANTGTLVINTTADQTLSGDITGTGGVLTKQNTGKLTLTGTNTYTGGTNLTAGILNLGSAAAIGNTGTIDLGGGTLQYSANNNTDYSGRFATTDQTYNIDTNGRDVTFATALTSTTAALNKLGTGTLTLAGANTFEGDITISAGGLTVTGTLDNVDATTGSYAGAISNSGALTIDSAASQTLAGAITGTGSLTQAGAGETILTSTSNSYTGATTISAGTLRVGNGGANGSLGGAGTIANDGAVIFDTSNDITVSKSISGSGTLEQAGSGETTLTGNNTYSGTTSISQGTLQIGSGGTTGTIGTGNITIDTGATLATNRSNGFSITADIDGHGQLIKYAAGLLNLTGTNSFGGGVDVKDGTLALSTTGSSGFGGTLTMGADGNASTTLVLGPSVEVSNAITLNGAVEVMLGLPVDYLVVGGGGGGGGRDIAGGGGGGEVQTGSMILTGSSASVTVGDGGSGGYDVNDSADQNRHGLRGNSSSFFTITSAGGGGGYGWNSASLDSQRSGGTASDGGEIKSGGDGAGTSGQGPNDANPGYGGNGLYVAWADAIGLGDSGYFGAGGGGSSHRSNDDPLFLGVGGLGGGGDALIAGGQAGANNTGGGGGASRDLRKSGGKGGSGIVVVRYLSDTDRAQGGEESSSDGYRVHTFKTVGSSSFSLDVQDFTASLTGSISGSGSLTADASAGELTISGANTYTGATDITGGTVTVTNATGLGNRSAVSLSNVADTKLVVTNPAASPASDMALTIGSLAGGGTTGGNVQLGADTVLNIGDTSSDTSFGGVISGDGALHKVNTSQLTLSNMNTFSGGTTVDGGTLWLANASGTDPGTVGGVLTINTGATVDFKAHNTTGTTNASNTAQLTEVNINGGTFGGSDYSNYYYFDVNMNGGTWILGGTEADGDGNDVSGDIIVTGSSTSVIRSITGDTDPGSLRMRSAITIDVDTDATLDVQAVIGSATGASDTSLAGPAGITKTGAGTLLLSGASQYTGATDIDGGTLSVTGALSDLTAVDLASGTTYNVDATDTVGSIAGAGNIVLGSGFTLSAGANDGSTTFSGVLSGDGTFEKVGSGTLTLTGTNTYTGGTTVTDGVIEGDTAAIQGDITNNALTRFIIADGDSETYAGTMSGSGVLGKTGTGTLTLSTNNDHTGGVTINAGKLIVTADGALGDATSKTLASGTFVKSGATLELQGVNYTQGEPLTMQGGTLISVGSSTWTGLLALDANTSSTISLASATDPLTISGVVSGSGNFTKTGNGQLSLTNDNTHTGGVTVTGGELRLTGNNRTSSYQIDSGAVLNYEIATGTKQADTTTYTGTGTLRKSGAGELQWNTSASSVGTFSLSAGALMDVQAGAMTTGWGSNEVFTNNLADLNIASGATFRNVNSAARFNALTGSGTLESGWGSDVDNVFVGVNNATSTFAGTLADSGENGGKLTLIKEGTGTLTLTGTSTYAGDLYVHDGMVTVDSGGSVSGLRRLDVSGAAGTTLNVQGSVATADGSAFFTGINADGIVNVHGTLTIGDGSEVRIGGRYGDLTQNTRGEGALNVNSGGLVEVGASGGTTNTTNIEVVSNGNADTVGVININSSGVLLTKRSIAGTGSTTSKTTALNLDGGTLKAGADNLNLIVDRNTLVVSLLSGGGTIDTQSYNATITETIEGAGELTKIGSGRLTIEGFHPWTGDTIINAGTLELKSTGDSTTVNSVGEHGTSTVAGAGNQYEINNGSTLLISGSRIDFNGATFRFDSAGGGTINSTSSNFVNRNTTYVTTGGAQNQILSPTTSGGSQLYYNLDTGTVTFDVPAGTNANSDLYIDGYLNNRGEVRKTGAGVMSFERDMRYSGGTTVDAGTLILNDVANNGQGVVKGALTVNSGATVQLTGNNSALGWTGDKVSTLNINGGLVEALTPSGTLNDNTDRMYIWDTAVNFSDGGELRVNGGTSNAAASRRWEISGVTFNVTNPTATASITGRVHFRDSATEFNVASDNADPELLVSAALTEDSANYGFSKSGAGTLKLTGANTYTGGTTISAGVLEVADIKDNAASNLGSGSGSTGFVELSGTGTLRYTGSGAQSTGRTLRIDDANTTATIDISHANGSLQFTSTGGTRDEAFTKAGAGSLRIDGAFSGAAAITTNAGELILTGANTNTGAWAVNNSSRLQIGVGSAAGTLGDGGTVTIANGAEMDVFRSDTALSINNPIDGSGTLRLRGTGNDGESSYTITSAGSFSGATVIDQARLIQEDPLSLGTSTITVQNNGTLQLNMGGASISNALTLNSLGWNLDGSTQLGALEFASTTADTYAGTITLEANSRIGASQNGTISAAIGESGGAFGFTQVGSGTLTLTGANTYTGKTAIDTGTLQLGAGGTTGSLASGSDADFINNGTLVINRSNAVTLFQNISGSGHLIQQGSGTTTLTGSNTHAGTTTINAGTLVAGSTGAITNARVVIADAAGATLQLIDHNATIDRLSGGGSTGGTVNLGGRVLSFGRDNTNSSFAGLISGSGALVKQGSGSYTLSGANTYSGGTTVEAGVLQAGDNAAFGTGRVSVASGAGLDLNGNTIANALTLAGTGFSNSGALFNSSASAATVNGAIALSANTTARNNGALVINGSINAANGASGSALTFANTGLLTLAGTVGGSAPIASLQIDAAAVLDADITTAGSQTYKGAITLGSGITLATTNAAVEFQAALDSAATEANALTINSGTGAVTFADAVGTATGGALGALVVNSGGQTWFQNAVTAASISTDSAGTLLVAGGPISASGVISFGEGMTLSADTRFIATNFSAAAINNAGHQLTIDERGSGQISGVISGNGAFIKEGSGTLALSGANTYSGTTSVDAGVLQLGVSSVVANSAISSSALGLGSTSVASGAALDLAGYSLANALTLSGSGISNSGALYNSSASSTASDVSGAISLAGNTLIQTDGALTISGSIDAATAGGASALTIGNSTGGSGVITLAGAIGSGNAITSLTVADDLNLAASVTSSGNQTFNDAVTLGADVTLTSATGNVQFDSTIDSDSTARALTINAQSTASGKGSVTFDGVVGGTKLAAVDITGHAVTINQAFSSSSTVEITNAGLLTVADDATITAAGGFTQDGAGSMSLGADISTTNNDLTIGSALTLLDDGTNPQTITLSTGSGGGALSLAAITGANNSLDLISGSGTTTVSGAVSGVNALSLQAANATGAVSFQDDLSATSLTTDAGGYNLSLLGTTTNFTDAVSFANTGGLTLGDGDSDRLVFSGGVTATAPSAVHLRGTLEATGTSTISLGDGDTAIAISGITRIGGPSDATSSGAITLSDVTLADDASLTLGDAAATSSANLGSNAITVDTLSGTTGSNASNLVVNSTGSLSAGTIGTDIGSLTLTRAGGATFSSSVDAANLILANAVAGSGQTIAVQGDLTLTSGFTVGTGAYAISITGANNTIAGNTTFTNSGTVTLGDAVGDAIAFTGGLTATAPAKLITAGTVGTSSAAINIGTLELAAATTINSVNSPGADITIASASGPEALTLTAGTGTLTLSGDVDVSSVDASADTININGSTDAVTTTGTQLYTGAVVLGSDTTLLAKDGSTLSSITFAGTLDSSNSGGATPASTFRTLGIIGDAVFDAAVGDTFALGGLTVSGTSALNGGSIKTSGLQTYTGAVTLAANTTLTSGGGAITFDSTLNSDANGNRTLDLTSNAGDITFSGIVGGAQNGTLGAVTINAANNVTLSSTFDAASFSQATAGGGTFQLDGNLTASTGAITINSNAVDLNADLTADGSGKAIAITGSTDLGGDLSSNAGAITLHSPVTLSGAARSISTGSNSAGDITFSGTLDGAQNLTLTAGSGDITFSNTVGGTTRIGALTIASATDVTVTDGKAFSAASIAQLAGSGTTTFGGTLNTNAQIGGSPANDNGIDLTGKAFTFKDTVTTIGSGAVAINNSGLLTINSGASFSLDGAFDQSGAGSISLGAGITTADANITFADAITLTQGVTLSTGTSGAGDISFSNVINSDGTARALTLTAGTGDVVFNTNATAGLTNALASLTITGDNITLRDVTTTGDQTYTASGVIDTNSTYTSSGGAITFDGDTVINSALTIDTTNGGSAANGGAVTFSGSLDSEATEANTLTLTAGTGNIDFDGAVGSATDGALGAVTIHSAGDLTADQSITAASFTQNAGTLTTFRGDITTSTASGLNLTATTIALDGLTIDASSGNGVVRFGGNTRLDDAVTISRGSGAVTFSGTLNSADAESNALTLNGAGGGSITFSGAVGTAGTNNAGRIGALTIDSATDVTVADDKAFYAASIQQLAGSGTTTFGGTVNTNGQIDPSGTTPNTNGIDLTGTNFTFKDTVTTTGSGAVAIVNSGLLTINSGAAFSLDGAFDQSGTGSIRLGAGITTADSAITFADAVTLTQGVSLSTGTSGAGDITFSSALDASTAGTETLTLTAGTGAITFSDVVGATRLGAVTINQAKGVTISQAFSAASFSQADGSNAGTGTFLLDGDLDTNTGAITISSDTVDLNADLTTSAGGTNGLVTINAGSGGLTLDGGTITTTASAAGAASGAIDINSDGNVALAGNLVATGVAGDSTTNAGATGGAVTIDTTGAATLSIANITTSGGDAANGSNGDGGAAGSITLTTAGTITLNSSTITAAGGAGANSGSQGAGADISFSNAVDLAGGDASISTGDTAGDITFDSSVDGNKDLTLTAGSGDIDFDGAVGGSTRIGALTINSANNVTVADTKAFSAASIQQLAGSGTTTFGGTVNTNAQIGGSPANANGIDLTGTNFSFKDTVTTTNGGAVAIDNSGTLTINSGAAFSLAGAFDQSGGGSISLGANITTADANITFADAITLTQSVTLTSSSTVAANPATTGGDITFSDVINSDSTARALTLTAGTGNVVFNTNATAGLTNALASLTISGDNITLRDVTTTDAQTYTATGVIDTNSTYTSSGGAITFAGNTVINSALVIDTTNGGGATGGAIAFNSSLDSKANEAHTLTLTAGTGDITFDGAVGSATDGALGAVTINSANNLTADNVFYAASLRQVAGSGTSTFSGALSTTAADGIELDGTNFDFNSTVSLTLGSLDLDADDTVRFNGLVTTSDTNAGQGLVTVSNGGALTLTATGDMNLAGAFLQDGAGSSSIAADITTTDDNITFQKAVTLTGNVLLDSGAGAGTIAFNSSLDSKATEANTLTLTAGSGNIDFDGTVGSATNGALGAVTINSANNLTADDVFNAASLSQLAGSGTTTFSGALSTTAADGIQLDGTNFDFNDTVTLSLGSLDLDADDTVRFNGLVTTSDTNAGQGLVTVSNAGLLTITSTGEMNLTGAFLQDGAGVVLTAGDITTTDDNITFQKAVTLTGNVLLDSGAGAGTIAFNSSLDSKANAANTLTLTAGTGNIDFDGAVGSATDGALGAVTINSANNLTADNVFYAASLRQVAGSGTSTFSGALSTTAADGIELDGTNFNFNDTVTLTLGNLDLDSTGTVRFNGLVTTSDANNGLVTITNGGALTLTATGDMNLAGAFLQDGAGSSSIAADITTTDDNITFQKAVTLTGNVLLDSGAGAGTIAFNSSLDSKANAANTLTLTAGSGNIDFDGTVGSATNGALGAVTINSANNLTADDVFNAASLRQVAGSGTSTFSGALSTTAADGIELDGTNFDFANTVSLTLGNLDLDADGTVRFNGLVTTSDANNGLVTITNGGTLTLTATGDMNLAGAFLQDGAGVVLTAGDITTTDDNITFQKAVTLTGNVLLDSGSGAGTIAFNSSLDSKANAANTLTLTAGTGNIDFDGAVGSATDGALGAVTINSANNLTADNVFYAASLRQVAGSGTSTFSGALSTTAADGIELDGTNFNFNDTVTLTLGNLDLDSTGTVRFNGLVTTSDENSGLVTITNGGTLTLTATGDMNLAGAFLQDGAGVVLTAGDITTTDDNITFQKAVTLTGPVALSTDSGAGDITFSDTLDATTAGSETLTLTAGTGDISFSDVVGAGARLGAITINQAADVTLSKAFSTASFSQASAAAGTGTFLLDGDLDTDAGAITISSDTVDLDASITTTTGGANGLVTINAGSGGLDLASNQSITTTAATAGDTSGAITINSDGNVALAGNLVATGVAGDSTTNAGATGGAVTIDTTGNSATLSLSDITTSGGDAATGSNGDGGAAGSITLTTTGTITLDNSTITAAGGAGANSGSQGAGADISFSNAVALTTGASSISTGATTGDITFLSTINGAQGLTLTAGTGSLTLTGIAGTDANSADRLASLSVTSAANAALNDVFSTGVQSITATDITLTGTTYNAGSSTITLTGAAVLNENTTIAAATTTFAGTLDSSNNSNTSNLRTLGITGNAVFDAAVGNAYALGGLTVSGTSAINGGSIATLSDSANNISGNQTYTGAVTLAANTTLTSGGGTIWFKDTLNSDANGNRTLDLTSNAGDITFTGITGGTNRLGGVTINQAHNVTLSQAFSAASFSQASGTAGTGTFKLDGDLDTNTGAITISSATVDLNADITADGSGKAITITGATDLGGDLTSNAGDITLHSPVTLSGAARTITTGSGAGDIWFKDTLDGAQNLTLTAGSGDITFSDTVGTTRIGALTINSATNVSVADGKAFSAASIQQQAGSGTTTFGGTLNTNGQIDPSGTPVNLNGIDLTGKAFTFKDTVTTTNGGAVAIDNPGTLTINSGASFSLDGAFDQSGGGSIRLGAGITTADANITFADAITLTQGVTLTSSSTVAANPATTGGDISFSDVINSDSTARALTLTAGTGDVVFNTNATAGLTNALASLTITGDNITLRDVTTSGTQTYTASGVIDTNSTYTSSGGAITFDGDTVINSALVIDTTNGGGATGGAIAFNSSLDSKANAANTLTLTAGSGNIDFDGTVGSATNGALGAVTINSANNLTADDVFKAASLSQLAGSGTTTFSGALSTTAADGIELDGTNFNFNDTVTLTLGNLDLDSTGTVRFNGLVTTSDESAGLVTITNGGALTLTATGDMNLAGAFLQDGAGSSSIAADITTTDDTITFQKAVTLTGNVLLDTGAGAGTIAFNSSLDSKANEAHTLTLTAGTGNIDFDGTVGSATNGALGSVTINSANNLTADAVFNAASLRQVAGSGTSTFSGALSTTAADGIELDGTNFDFASTVSLTLGSLDLDSTGTVRFNGLVTTSDESAGLVTITNGGALTLTATGDMNLTGAFLQDGAGSSSIAADITTTNDNVTFNAATTLTGPVALSTDSGAGDITFSDTLDATTAGSETLTLTAGSGDITFSGVVGGAQNGRLGDVTINQADDVTIAGGKTFSAASFSQASGTAGTGVFSLGGDLDTNTGAITISSATVDLNASITTTAGNDGSTDNGLVTINAGSGGLDLASGNSITTTAATAGTQSGAIDINSDGNVNLAGNLVATGVAGDSTTNAGATGGAVTITTTGTATLSIANITTSGGAADANNTAAGGDAGSITLTTAGTITLDNSTITAAGGAGANSGSQGAGADISFSNAVALTTGAATVDTGATGGDITFDSTINGAQGLTLTAGSGTLTLTGDVNVASIDASGATININGGTDAVTTTGTQTYTGAVVLGSDTTLTASNSGTLSSITFAGTLDSSNNSNTSNFRTLGITGNAVFDGAVGNSYALGGLSVSGTSALNGGSIATSTATGISGNQTYTGAVTLGADTTLTSGGGTIWFKDTLNSDANGNRTLDLTSNAGDITFSGIVGGAQNGTLGAVTINAANNVTLSQAFSAASFSQTTAGGGTFQLDGNLTASTGAITINSNAVDLNADITADGSGKAITITGATDLGGDLTSTGGAITLHSPVTLSGAARTITTGSGAGDIWFKDTLDASTAGAQDLTLTAGSGDITFSNTVGGTTRIGALTIASATDVTVTDGKAFSAASIEQRAGSGTTTFGGTLNTIAQIGGSNANGIDLTGSAFTFKDTVTTTNGGAVAINNSGLLTINSGASFSLDGAFDQSGAGSIRLGADITTTDDNITFQKAVTLTGNVLLDSGSGAGTIAFNSSLDSKANAANTLTLTAGTGNIDFDGAVGSATDGALGAVTINSANNLTADNVFYAASLRQVAGSGTSTFSGALSTTAADGIELDGTNFNFNDTVTLTLGNLDLDSTGTVRFNGLVTTSDANNGLVTITNGGALTLTATGDMNLAGAFLQDGAGSSSIAADITTTDDNITFQKAVTLTGNVLLDSGAGAGTIAFNSSLDSKANAANTLTLTAGSGNIDFDGTVGSATNGALGSVTINSANNLTADQSITAASFSQNAGTGTSSFDGALNLTGAFDFTGQALTLNAAGNTIGGAMTVANAGTFTTADTADLSITGAFQQTGNGSSSLGANLTATGGIAFAKAIALTGSDAVVLATGGASGQDITLGSSTSTGISGTGQALTLNAGSAGDITITGAIGANGSALGAITVSNGDQVAFQGAITAASYTQAAAASTGLTTFDGALNLSGAFDFTGQALTLNDSLNSGSSVEITNAGLLTTAAAADITATAGFTQNGAGSSSIAGNITTTDSNISFLRAVTLTGPVALSTDSGAGDITFSDTLDATSAGAQDLTLTAGSGDITFSGVVGGTTRLGGVTINQAADVNLSNAFSAASFSQASGTAGTGIFTLGGDLNTDTGAITIDSKEVALNANLTTTAGSTNGLVTINAGVGDANGLALTLASGNTITTTAATAGTQSGAITINSDGNVALAGNLITTGSAGAAGGNVTITTTGTTATLSLSDITTSGGAAASSSNGNGGAAGSISIGLTTTGTITLNNSSITAAGGLGDGTGSQGAGTAISFSNAVALTTGAATVDTGATGGDISFLSTINGAQNLTLTAGTGDITLSGAVGGDVNGRLGALTIASANDLSAAAITAASLTQQAGSGTATFSGAINTNTAAGISLTGTNLVLNGSLTTTTGGTLTIAQSGTASIAAAADINADGAVSLTANGGITTAADITTTGDNVTVASATTLSGPIAITTGGGNLIFSSTLDSDANGGRALTITAGSGDITFSGDVGTAGSNNAGRLGAITIASAGNLTATGALNAGSYTQTTGTGLSTFGGAIDLTGAFAFSGEALTLNAALNSGSTVTVTNAGTFSTAAAADITATSGFTQNGTGSSSIAGDITTDAAGISFSKAITLTGDLSLSTGSGTDAGDIAFSETINSDGTARALTLTAGAGDVVFQSGATVGTSSTAGSELASLTISGAALTLRDVTTSGDQTFTASGGINTNSTYTSSGGAISFTGDTVINDALTINTTAGGATGGNVAFSGTLDSKANAANNLSITAGSGNITFSGLVGDTTPLGAVTIASANDVTVNGLRALSLAQTTGTGTTALNGGTFSSGTDQALGTTGSAGVVINNAAISLADSIDTTSSGVVTLNATGGALTIAAAGDINADGTVSLTVTGGINTAGDITTTADNVSLNSPVTLTGDVAINTGAGGGNISFSDVINSDGTPRALTLTANSGNVTLAGIAGTSNSSTGRLASLTVASATNAALNNVFSTGAQSITATGISLTGTTYDAANSTITLNGAAVLEQNTAITAATTSFAGTLDSSNNGASPAVSDFRTLAVTGNAVFDGAVGNAYELGSLSVTGTSALNGGSIKTSGLQTYTGAVTLAANTTLTSGGGAITFDSTLNGGYTLAVNTTGTTTFSGAVGNSTALVSLSTDAGGSTAINGGSIATSGAAGMVFGDAVSLGAATTLTATNGAITFSDTLDSDATAARTLTLTAGSGDITFSEITGGTNRLGAATINQADDVTIAGGKAFSAASFSQASGTAGTGTFTLGGDLNTDTGAITISSATVDLNASITTTAGGANGLVTINAGSGGLDLASGKSITTTATTAGTQSGAIDINSDGNINLIGDLITTGSAGAAGGNVTIDTTGTTATLSISDITTSGGAAASSSNGNGGAAGSIGLTTTGTITLNNSSITAAGGLGNGTGSQGAGAAISFSNAVALTTGAATVDTGATGGDIAFSSTINGAQGLTLTAGTGTLTLSGDVNVASVDASAATINIDGGTDAVTTTTAQLYTGAVVLGSNTTLTADNSGTLSSITFDGSLDSSNDGAATPASNFRTLGITGNAVFDGAVGSSYALGGLTVSGTSALDGSSINTTGAQTYTAAVTLAANTTLTSGGGAISFGSTLNSDGTARDLTLTAGSGDIDFDGIIGGAQNGALGAVTINAANNVTLSNTFSAASFSQATAGGGTFQLGGNLTASTGAITINSNAVDLNADLTADGSGQAIAITGTTDLGGDLSANGGSITFNSPVSLTDAARSISTGSTGGDITFSGTLNGAQDLTLTAGSGDITFSDTVGGSTRLGALTINSATNVTVADTKAFSAASIKQQAGSGTTTFGGTLNTNAQIDPSGTPVNLNGIDLSGSAFTFKGGVTTTGGGAVAIDNSGLLTIGNSAAFSLDGAFAQSGGGSINLGAGITTTDDDIAFSDAITLTNGVSLSTGSGTGTISFSGDINSDSTARALTLTAGTGDVVFQSAADVGTAAAGSELASLSISGNNLTLRNVTTTGAQTFTATTGINTNSTYTSSGGAITFAGDTVINDALVINTTAGGATGGAVTFSGTLDSESTEANTLAITAGNAAIDFDGAVGSALNGALGAVTIHSAGNLTADVAFKAASYTQSAAAAGSLSRFDGALTLSGAFDFIGQALTINGAGNTIGGAMTVANAGTFTTTDNADLSITAAFQQTGNGTSSLGANLTATGGISFAKAIALTGTDAVVLATGGAAGQDITIGTSTIPAGITGSGQDLTLNAGSDGDISVTAAIGASGSTLGAITITGADQASFSGAIDAASFTQSAAAGLTTFDGALNLSGAFDFTGQALTLNDSLNSGSTVEITNAGLLTTATAADITATGAFTQNGAGSSSIAGDISTTDSNISFLRAVTLTGPVALSTGSGAGTITFSSILDATTAGSETLALTAGSGDINFSDVVGGTNRLGAVTINQAADVTLSKAFSAASFSQASGTAGTGIFTLGGDLNTDTGAITISSATVDLNASITTTAGGANGLVTINAGSGGLDLASGKSITTTATTAGTQSGAIDINSDGNINLIGDLITTGSAGAAGGNVTIDTTGTTATLSISDITTSGGAAASSSNGNGGAAGSIGLTTAGTITLDNSTITAAGGLGDGTGSQGAGATISFSNAVALTTGAATVDTGATTGDIAFSSTINGAQGLTLTAGTGDVTLSGITGTAAGDANALASLTVTSANNAALNNVFATGAQSITATNITLTGTTYDADSSTITLTGDTGLDQNTAISAATTSFNGTLDSSNTGGATPASTFRTLGITGNAVFGGAVGNTFALGGLTVSRTSNLNGGSINTTGAQTYTAAVTLAANTTLTSGGGAITFGSTLNSDGTARDLTLTAGSGDIDFDGIVGGATGGTLGAVTMNAANNVTLGDTFSAASFSQATAGTGVFQLDGNLTASTGAITINSKVVDLNASIATTGGNDGSTDNGLVTINAGIGDSNGLALSLVSGETISTTAASDGTQSGAININSVGNVDLAGNLITTGSAAAAGGAITITTSGSGTSISLASLNTSGGAAGNGTGSAGGDAGTIALETPNGQGIVLNNSVIRSAGGLGDGAGAQGAGADISFKNVLSLNGGSITIDTGATGGDLELLGALDGGLAVTLTAGTGDLNIGLNGAIGAITPLASLNISAANLYLFDVTTTGDQTYTSAGTITTNSTYRSAGGAITFAGAVVTNGELVVDTTNNGAVTAGGAVSFQGTVNSAQGLANNLTVDAGNGSVAFDAAIGSTTTLGAITLNTAGLTDIQSTVNAVSISTDAPGTVQLGGNITATGAAGVVFNENASLANTLTITASDANGAVTFGSSLDSAASLASSLTITAGGPVSFVGAVGAASNGELGALTVNTGALTDFQSTLQVASVLTDAPGTVQLGGNITATGSAGAVFNENATLTADVTINTSAGNGPITFGGAITNTDGESLVFDSGNDGDITVTGDIGDLGTGVVTITDANDATFFGSVTAASFTQIDGSGTTTFSDAISLSGDLDFNGTNLTLSGSGNVIGGAMTVTNTGVFTTGNGADLSAGSFAQSGGGTNVIGEDISTTTGALSFTGDLKLTGDQNEAITFSTNGAAGSDITIGGDITNTAGESLVFDSGNDGDITVSGDIGDLGTGAVTITDANDATFNGTLTAASFTQIDGTGTTTFGGKLDLDSSFAFSGNNLTLTGSGNTIGAAMTVANSGVFTTGNGADLSAGSFAQSGGGTNVIGEDISTTTGALSFTGDLKLTGDQNEAITFSTNGAAGSDITIGGAITNTDGESLVFDSGNDGDITVTGDIGDLGTGVVTITDANDATFNGSVTAASFTQIDGSGTTTFSDAISLSGDLDFNGTNLTLSGSGNVIGGAMTVTNTGVFTTGNAADLTAGSFAQSGGGTSVIGEDITTTTGALSFTGDLKLTGDQNEAITFSTNGAAGSDITIGGDITNTAGESLVFDSGNDGDITVTGDIGDLGTGVVTITDANDATFSGSVTAASFTQIDGSGTTTFSDAISLSGDLDFNGTNLTLSGSGNVIGGAMTVTNTGVFTTGNAADLTAGSFAQSGGGTNVIGEDITTTTGALSFTGDLKLTGDQNEAITFSTNGAAGSDITIGGAITNTNAESLVFDSGNTGNIAVTGDIGDLGTGAVTITDANDATFNGTLTAASFTQIDGTGTTTFSDAISLSGDLDFNGTNLVINGVPNTIGADLLVTNSGVFSTGNNAVLAISGALIQDGTGSNTIGADITADQGITIATDITLDGDQDEVITFSTDGNPDSDITIGGAISNTDGESLVFDSGNTGNIAVSGDIGDLGTGSISITNANDATFTGSVTAASFSQSAGTGTTTFSDAITLTGDLDFNGTNLVINGQPNSIGADLLVTNTGTFTTGDNAVLSIAGELIQDGTGTSTIGADITADQGISIATDITLDGSANEVITFSTDGTAGSDITIGGAITNTNAESLVFDSGAAGNIAVSGDITLTDGPSTPSVGGDLTINTANDVLISGILDLTGDLEAITLGQVSLGITSIQGNASITSSNGPILQTGHITVDGDTDLNAGLGDINLPGPGNDFSGSLSAQGRVVRVLAVGLQIPAPPSSGGGGSGGSQAPTAPEQTTVPPTTTSEPRPEPSAPTPPAPPVPPSTTSEPRPEPPVLPGVVPTTTQPTPQAPSVREVIASSTSTALPSLLTNTDPSVVRVQTSTTTTTVLNPISSLTNSQPLAAATTGAATPYPLSMSNPSPSIATAPQTITTTSGSERTSATGNPSLDRQDSSSETTGEATAARGTGSVVQEGPLKPNFRVENQQPERYNMGTASFEIQPGNEVCVSGSGCGSSVTTNTSQEQISPTGTISSPTDDDALSRSNGDDTKPKSQLLSRISRWLMRSL

SEQ ID NO: 2053 - protein, 324 aa, Kluyveromyces lactis
MSTTQTQTQNKLSVQSQSVEHCLSDVVKQDDWSDFAFAPIREATVSRAMTSRYFKDLDKFAVSDVVIIGAGSSGLSAAYVIAKNRPDLKIAIIEANVAPGGGCWLGGQLFSAMIMRKPADKFLDELNIPYEDEGHYVVVKHAALFMSTVLSEVLKFPNVKMFNATAVEDLVTRPADDNSQHVNVAGVVTNWTLVTQNHDTQSCMDPNVIELSGYKDNGERDLSQKHGVILSCCGHDGPFGAFTVKRMASIDSSKSYAGMKGLDMNRAEDAVVKNAGAYDKVGSVYFAGMEVAEHAGLNRMGPTFGAMAVSGIKAAEDILKHFAA

SEQ ID NO: 2054 - protein, 138 aa, Bacillus halodurans
MRIALIAHDKKKDEMVQFTIAYKDVLKDHELYATGTTGMRIMEAAQLPVKRFKSGPLGGDQQIGALVAENKFDLIIFLRDPLTAQPHEPDVTALVRLCDVQRVPLATNIGTAEILIKGLARGDFTWRELVHDEEEPRV

SEQ ID NO: 2055 - protein, 834 aa, Sinorhizobium meliloti
MTGELTRREMLKAHAAGIAAATAGIALPAAAQPVPGGVEALQITWSKAPCRFCGTGCGVMVGVKEGQVVATHGDMQAEVNRGLNCIKGYFLSKIMYGTDRLKTPLLRKRNGAFAKDGEFEPVSWDEAFDVMAEQAKKVLKDKGPTAVGMFGSGQWTIFEGYAATKLMRAGFRSNNLDPNARHCMASAAYAFMRTFGMDEPMGCYDDFEHADAFVLWGSNMAEMHPILWTRLADRRLGHEHVKVAVLSTFTHRSMDLADIPIVFKPGTDLAILNYIANHIIQTGRVNEDFVRKHTTFMVGATDIGYGLRPDNPLEVKAVNAKDAAKMTPSDFESFKSFVSEYTLDKVVELTGVEAGFLEQLADLYADPKRKVMSLWTMGFNQHVRGVWVNQMVYNLHLLTGKISEPGNSPFSLTGQPSACGTAREVGTFAHRLPADMTVTNPEHRKHAEEIWRIPHGIIPEKPGYHAVEQDRMLKDGKLNFYWVQVNNNVQAAPNTQNETYQGYRNPDNFIVVSDVYPTITAMSADLILPAAMWVEKEGAYGNAERRTHVWHQLVDAPGEARSDLWQMVEFSKRFTTDEVWSTDILDANPGYRGKTLYDVLFKNGNVDSFPASEINKEYANREAEAFGFYIQKGLFEEYASFGRGHGHDLAPYDRYHDERGLRWPVVDGKETLWRYREGYDPYVKPGEGVKFYGRPDGKAVILAVPYEPPAESPDDEYNVWLVTGRVLEHWHSGSMTMRVPELYKAFPGAVCFMNAGDARDRGINQGAEVRIVSRRGEIRARVETRGRNRMPPGVIFVPWFDASRLINKVTLDATDPISKQTDFKKCAVKIVSVA

SEQ ID NO: 2056 - protein, 1462 aa, Cryptococcus neoformans
MAASTLSNYQLGDLLGRGASGNVYRALNFLTGETVAIKSISLLSLPPSSLPDIMSEIDLLKNLNHANIVKYKGFARDKENLWIILEYCENGSLQTILKKFGKFPESLVAVYISQVLEGLIYLHEQGVIHRDIKGANILTNKDGSVKLADFGVSSRAPTAVLDQSGKSNDGEAEVVGSPYWMAPEVIEQSGASTASDIWSVGCVVVELLEGKPPYGDLAPMQALWRIVQDESMRIPEGASPIVKDFLYHCFQKDPNLRISAKKLLRHPWMLSVKKSASNRPPITPSLVDTTFDHSIDPKANSDGITPQAQRDGNKSRPEREGENEKQSRQGTVKPRKKIMTVYDEAVQRVQEWNEALKASPKNLSKPSPSPSPSTSSASASTSASKALLLPVPSTNPLISKARQRGESNPPLSLFSLLPTSNSKPLSSSLSQEQPLSLPLQLRNQVGQGGGLLSKNYMVSDVLERAKEEGEERWDDDFAEGISFSKLGRTEIYKHPQAHHHTHLTSSASSASTAREEAEEANQKTLRQNRALALPTPSSKPGRKSNLSRPVGEVEDYSDMEQAFGENEGSLEKKMRILKLKAIGRKGLMHPDDIHKYPLSPVKRKPSSRVDVRGNSSTSTTATTCASASASNPGAPPITVPLSSSIPIPNSSFPRRRAPSNPIPSSFSTLTIPSLSETGTGMSTETKNRNRDNSFLSQDAPTRSSPSSRSSSLRNKAKVGEEVEEQIKKYTENEEENYEDIFGGANKTFSSSQEVPLKLVLLPSHPLSSSSALRNGGGGGRGSSEGGISFTDPHSHINFDYPESDEEDMLDPFAEIEDEFDTAEDLEKKLMRDKKVMMQGKVSKLVDELMIGGVGGGGLRGVCDDLFGILENSSPEMGLEAHFVAQHGLIAVLEVLESRLSRDVVVRLLKLVNLIVTSNVELLESFCLIGGIPVIIPYTSKKHSLETRLEASRFIRQLTRSALTLQMFISCRGLRILVELLDEDYALNKTLILSSLEGINSVFELQSPTPRNDFVRMFVREGVIDPLSTALLAILKDKYEDRSANDDGNGNGNGEMEDGQGQERGQFMMEQASRSVGVLLFFCQVAQADARVREAFATRTIMIRLLKACDLLPRKLLVTAIKAIKHLSTSPQLIEVLQNSNAMEILVDLLGKNIKGSHSNEICSHIFQTIYSMTRLSKSRQEEAASSGIIPLLKRVIQNKSPLKQFALPILCDMANAGKGSRRLLWHYDGLGLYLDLLEDPYWRVSALDAILAWMQDETARVEDVLLEKSASDSLVRCFVQASGVSFEGILDPLFKVLRLSTSLTSSLSHPPFFSRLSESLERSSKAVIKLNLLRLTKVVCECHPDKATLVERFGLAQIVERLSKQDGAVLVRELAKEILPGLLFGGDAPDPAASFRYTSSGTVGEERGGRTMKSQGRMEGRRSSQLRRTLSENVATDLLHPAPPVAPFPSTVSRCKYTKERG

SEQ ID NO: 2057 - protein, 403 aa, Roseovarius nubinhibens
MLLIFGAVTALIWANVDGHSYHAFVDFVIWDHAPIGHLHDGHRTLTLHYLVNDVLMALFFAIAAKEVWEAVILENGSLRGKKAATPLFATAGGMFGPIGVYLGLAMIMGSDTYNAVANGWAIPTATDIAFSYLVGRIVFGAGHPAVRFLLLLAIADDAAGLIILAIFYPSGDLAPEWLLLSFGAALAVFVLFNWLPRRMDRGRPERPHSTRVRKALGGLPYVIAGCISWYGFMQSGLHPALGLLPVVPAIPHADRAFGIFAEAEEHLHDLLNVLEHALKHPVEIVLFFFGLLNAGVEFSSMGDATWLVLAGLIIGKPVGILFFGWLAARPLKLGIPEGMRIIDLVVIGFVAAIGFTVSLFVASVAFDAGPVQDAAKMGALFSFAAAILSIVAGKVLRVQKMDG

SEQ ID NO: 2058 - protein, 585 aa, Oryza sativa
MVDRRMAFAAEADVDSKAAFGFFGGECFVGEGDLVNPAPPPPQQQQVHEGGFAAEDESDGDDDDDDDDVDDIEELERRMWRDRVRHKRLKELQQSRAGRESRAGDAGGGGRQQRQSQEQARRKKMSRAQDGILKYMLKMMEVCNAQGFVYGIIPEKGKPVSGASDNLRSWWKEKVRFDRNGPAAIAKYQADNAVPGCDGDAGGAAPAGPHSLHELQDTTLGSLLSALMQHCDPPQRRFPLEKGVPPPWWPEGSEAWWPEAGVPKELGPPPYKKPHDLKKAWKVAVLTAVIKHMSPDVDKVRRLVRQSKCLQDKMTAKEIVTWLAVLKQEEDLYLKLHPGALPPPLSAASFNASVSGEYDVEGVDGDEAGNNNLQKAQNDATAFMDLTTTMDAALSNNKFLIMPLMKEEAIDVDFIQKRSEPELMLSSDSHARVYTCGNVQCPHSNYALGFLDRNERNAHQYACKHNAAAAAAESKPPPPHIFEPLGSFDFDLPVDGQRCLAGLMTMYDNDVAAATQMHHHHHQQQQANFFIRDDAPFGGDVAATAAAASEFRFSSNFNVSGGGAVDYGGAMQQPPAKYAGSNWFY

SEQ ID NO: 2059 - protein, 351 aa, Gelidium crinale
MEKSFDQLLSLNVDEGCIVEYVWIDGYDAVRSKGRYLKNIPSKASDLPDWNYDGSSTNQASGEDSEVIIKPQRIFPDPFRGKPNLLVMCDTYTPNGEPLKTNTRFECERIMNQAKDLKPWFGLEQEYFLINPNTGKPLGFPNDKDPEPQGPYYCGVSGSKMFGRDIADAHFKACVYAGIKISGINAEVAPGQWEFQVGPCVGIEEGDELWMGRYLLQRIAEMKGLDVNYDPKPVKGDWNGSGCHSNFSTKPMREKDGYQNAIIPALEKLSKKHKEHIAAYGIGNEDRLTGKHETASIEQFKWGVADRGASCRVGHDVEKKGYGYFEDRRPAGNCDPYVVTMMLVKTCCLED

SEQ ID NO: 2060 - protein, 261 aa, Picea glauca
MEDMNMNIGGAATFYGVNMNEYGDTGVGSMMALMTEQEPGNESIMSTMTMTIPSSAFSSYSHAGQVEGLLSAAAATMFNQGGHHHHQKHLVGGHFPPEQLVMNEQAAVISDSSLSSVKTEVCSNQLESHRKTSGGGRSCCPQPSLVVRAPQQQQQQQHHHQEASRMVTSLEVDIDSACSSNPNDSIDTLKTKIACHPHYPQLLAAYMDCQKIGAPPEVVTVLDEISQENQLGRHLATMDIGVDPELDQFMEAYCQMLIKYH

SEQ ID NO: 2061 - protein, 239 aa, Oryza sativa
  misc_feature (88)..(88): Xaa can be any naturally occurring amino acid
MAGSGDELMLLGKWPSPFVTRVELALGLKGLSYEYVKQDLVNKSELLLASNPVHKKIPVLIHNGKPVCESSIIVQYIDEAFPDAGAGXALLPADPYERAVARFWVAYVDDKFVPAWVATFRGKTEEEKAEGMKQLLAAVETLEGALKDCSKGKPFFGGDTVGIVDVALGGLISWVKATEVLAGSKIFDEEKAPLLAAWAQRFGELDVAEKVLPDVDGVVEFAKMRLAEAAAAAAAASKN

SEQ ID NO: 2062 - protein, 327 aa, Escherichia coli
  misc_feature (296)..(296): Xaa can be any naturally occurring amino acid
MSKIFEDNSLTIGHTPLVRLNRIGNGRILAKVESRNPSFSVKCRIGANMIWDAEKRGVLKPGVELVEPTSGNTGIALAYVAAARGYKLTLTMPETMSIERRKLLKALGANLVLTEGAKGMKGAIQKAEEIVASNPEKYLLLQQFSNPANPEIHEKTTGPEIWEDTDGQVDVFIAGVGTGGTLTGVSRYIKGTKGKTDLISVAVEPTDSPVIAQALAGEEIKPGPHKIQGIGAGFIPANLDLKLVDKVIGITNEEAISTARRLMEEEGILAGISSGAAVAAALKLQEDESFTNKNIXVILPSSGERYLSTALFADLFTEKELQQNASL

SEQ ID NO: 2063 - protein, 251 aa, Unknown
  Tetraselmis sp. RG-15
MAAVAARSFAATVAGQVGASARGQKQVTRAAVEFYGPDRAKWLGPFSDDTPSYLTGEFPGDYGWDTAGLSADPETFASYRELELIHARWAMLGALGCVTPELLSKYAGVEFGEAVWFKAGAQIFADGGLDYLGNSSLVHAQSILAILGCQVVLMGGAEAFRVNGGPLGEDLDKLHPGGAFDPLGLADDPDTFSELKVKEIKNGRLAMFSMFGFFVQAIVTGKGPVENWAEHIADPSGSNGFVYATKFVPGN

SEQ ID NO: 2064 - protein, 379 aa, Ralstonia metallidurans
MAKRDYYEVLGVGKNASDDEIKKAYRKLAMKHHPDRNPDNKEAEEKFKEVKEAYEMLSDPEKKAAYDQYGHAGVDPNMAGGFGGGGFGGGGFAEAFGDIFGDIFGQAAGGGRRGGGPQAYRGADLRYSMEISLEQAAHGHEAQIRVPHWDDCEHCHGNGAEPGSSVETCPTCNGVGQVRVSQGFFTMQQTCPKCHGSGKFIPKPCTKCHGQGKLKSQKTLEVKIPAGIDEGMRIRSSGNGEPGINGGPPGDLYVEVHIKQHPVFERDGDDLHCQMPISFATAALGGDIEVPTLGGRASFPVPEGTQAGKTFRLRGKGIKGVRSGYPGDLYVHVNVETPVKLTEAQKDILRQFDRSVHEGGSRHSPQEQSWLDKVKSFFS

SEQ ID NO: 2065 - protein, 607 aa, Cryptococcus neoformans
MPPRRQSQASQTKGKQPAQETQDDSDEETQGGRSGPLTDADIESRAGMLVRLALFQEYKRIPIRRTEVAKQILPDNTRAFPLVFARAQTILRDTFGCELYEIRARGKGESTEDPSQTQAMTQTQKKGKGKGRQPNRGLDAIDEEEEEEDEEEEDATITQKVKRETGTKVYILQNILPGKIIEAMAEPAPLPHGIEVEGDDDDSGALLQWDKGDGGIIGHVGLLGIRTLILSLVLCHNRIINDDHLHALLRRLNLHRETVLPYASKDTTDPHLTLDKYLELLAKYQYLEKIKNPGPMGQAEGGTVEWKWGSREAEFSSKAAAKFMEEIMLGKEGESDSEEEDEDQPRRRGRGAPRERASRPQKRQKLRDDIIKAAGGVPLKPRHSAHYGQRQHPHQHLHPQQNYNHQHASMSEHGQEEYPPVPLQTGPMIAPHQDLHSFLESFWTRQMDTVEGETPDWKSYNLPLARIKKVMKSDEEVKMISAEAPIMFSKACEIFISELTCRAWLVAESHKRRTLQKSDVAAAIAYSDMFDFLIDIVPRDDGGVGGGGSGGGVGGSGTVTGAGSVVADEGMERDEDDPEGDEGEGEGEGFDGQEEEGDLYSEYVQGD

SEQ ID NO: 2066 - protein, 1268 aa, Yarrowia lipolytica
MLRLQVYAISPCLESETVTTWAPDRSMQTRSIDEAGMRVEKKFLHFTDPRSSLLELCHEIAERFKSIYPDNFEPRIDFLQSDTGLDLSPSFVSGDVFKSGDVVRAILRLPTDIEEFRKFQGEAPGIRFLEEDVGEAGEVSKIEAQVDDSTMSRDGRKRRRYTLPKEITKRLKRDSSVYSDGFGVRDPESFDHTMEEEAIYAHTVTVRRPRSRYSQGGTGTGHNSILESSTTSLIPPPRPDFASSSTTGPSPPASNNHYPQLESSQVAAGSSTPIRLSSKLGSTVVDKGNVSNPTPVRGSTSLDTIQTPVLSPQPKAAIQGSPMKSPPHAQKAISLPPVKKEPTSKESKDKEPVAKRAKIEPRVERKPEPESDTSFLAEFSDDGKFPTALMQARAQQKAAIEESRLTQQALRLHIKSPQYHIPSELGDHISPAKAKASLNAWLGWKHAQESNSPDIELARHRLVHCTFSALAEAANKQLDIANNKVQKGQLMAYRETFSVRADNSYKCLTAEQVAAEKLAADEEVAKEVARIKARQVSKDARDTKRRVRRESTAAANAHEAAVMAAKEEHDRAEAMRAREAKVREQEGAEARKEMIEDEKARQLKLKKEEEAKKRKEEEAKKRKEEEAKKKKEEEAKKKEEEEAKKKKEEEEAKKKEEEAKKKKEEEAKKKEEAKKKEEAKKKEEEAKLLELKKKEEAKKKEEAKKKEEEAKLLELKKKEEAVRAAEEAKRKEEAKLKDAEAKEKAAKEAAKKLEVEIKEKAAQAAKGSAKAEADKKKIEEAEKAKQLEAEEAREARARLAQEQREAKAKAAQEAKEAREAKKAEQQAAREAKLRAAAEAKEARARAAAEAKEAKLRAAAEAKEAKARAAAEAREAKKMAEEAKAKKNAEAEAKQKAAESKTEVKKRTLGAAKAAPISSQDTHVSDSQAEDKMDVDSDSDSDSDSDSDSDSDSDSDSDSDSDSDSDSDSDSDSDSDSDSDNGPKPEIKAKPAAKKSSQMPPSTQPPPKVKQTAPKSSQPTPAKKAMKEESESESDSDSDDDDSDDSDSDSEDTSKKRTIVKTPAKNAKATTKPEPKTAAKPASKTEAKPASKTEAKPASKTGAKPASKAETKPTVKTEPKTAVMSEPAKTAPKATASKSSTTVKPEANGSAIKKEGEAPKKSPFSNLKSLQSLAKMGVPEVKDSIPSSQPRFSQASQKKTEKEEESDSDDDSDDSDDSDDSSDDSDDSDDSDDSDDSDEQPAAKTKRAGAGLKKKKKNSGFASLMNKFM

SEQ ID NO: 2067 - protein, 269 aa, Triticum aestivum
PRVPHSHHQPTTGTPAATPSGRPSAPRRIGKPCRDPPATPPPAWPLGSFGQIQSPPPRGPDLRPAPRGFPPTLEDPRVLAREPVFSVSEVEALYELFKKISSAVIDDGLINKEEFQLALFKTSKKESLFPDRVFDLFDTKHNGILGFEEFARALSVFHPSAAPDEKIDFSFQLYDLKQQGFIERQEVKQMVVATLAESGMNLSDEVIESIIDKTFEEADTKHDGKIDKEEWRNLVLRHPSLLKNMTLQYLKDITTTFPSFVFHSQVDDT

SEQ ID NO: 2068 - protein, 421 aa, Unknown
  Acinetobacter sp. ADP1
MQDSIEQYMQAVGQQARKASRVLSSASTHTKNNALSAIYTALVNHEPEILAANAVDMQKGRDSHLDSALLDRLELTPTRFKGMLQGLKDVIALTDPIGEITDLAYRPSGIQLGKMRVPLGVIGMIYESRPNVTLEAASLALKSGNAIILRGGSEALQSNKAIATAIQHGLKVAGLPEHAIQVIETADRAAVGQLITMTEYVDVIVPRGGKSLIERISNEARIPVIKHLDGNCHVFIDVEADLHKALPIALNAKTHRYGVCNAMETLLVHEEIAEEFLPRIAELYAEKHVELRGCQETRRILGSSVKTATEEDWYTEYLAPILAIKVVEHIDQAIEHINKYGSHHTDAIVTENYSKVRKFLAEVDSSSVMINASTRFADGFEYGLGAEIGISTDKIHARGPVGLEGLTSQKWIVFGDGQIRH

SEQ ID NO: 2069 - protein, 100 aa, Unknown
  Synechococcus sp. CC9311
MFQVADFKVTILSKGEETVINCPDDQYILDAAEEHGIDMPYSCRAGACSTCAAKVTAGSIDQSDQSFLDDDQIAAGFALLCVSYPVSDCSVIANAEDDLY

SEQ ID NO: 2070 - protein, 303 aa, Escherichia coli
MSTLEQTIGNTPLVKLQRMAPDNGSEVWLKLEGNNPAGSVKDRAALSMIVEAEKRGEIKPGDVLIEATSGNTGIALAMIAALKGYRMKLLMPDNMSQERRAAMRAYGAELILVTKEQGMEGARDLALEMANRGEGKLLDQFNNPDNPYAHYTTTGPEIWQQTGGRITHFVSSMGTTGTITGVSRFMREQSKPVTIVGLQPEEGSSIPGIRRWPAEYLPGIFNASLVDEVLDIHQRDAENTMRELAVREGIFCGVSSGGAVAGALRVAKANPGAVVVAIICDRGDRYLSTGVFGEEHFSQGAGI

SEQ ID NO: 2071 - protein, 406 aa, Candida glabrata
MTVTIQELTNHSYIDHELSATLDSTEAFEGPEKLLEIWFFPHRHCIPKDENGDMKTLRSIAVEKWVAILKLVKCEVLSIKSTEKMDAFLLSESSLFVCDHKITLKTCGTTTTLFCLEELFRIVEEELGWDMRAKKEENVGKYHPHKVFYSRRCFMFPLKQRSIHKRWSDEIEYLNKFFCYGSSYLVGRSDQSNHWNLYVTETNKNMNITDDCGEDDEDETLEILMTELDQTCAQQFSCKREVKTVEQSQQDENTSEDEGHLSGYKMTNATRLDRVYNNEKNVSFHHDAFAFTPCGYSSNIIMDEEYYYTLHVTPEKGWSYASFESNVPVRHVSNNKQDNISVINHVLSVFQPRDLCITFFCKSMDNESFKKLMKTSGEIPNYTKKDRIIYDLDDYHLLYIRFERNC

SEQ ID NO: 2072 - protein, 1090 aa, Ustilago maydis
MSSSTSAAIPPQANSDESNPLRTPPPPSSSTSSSSSSLSASTVSTPTPLAAGATSSSAVQSASASSPDPAVAFIPTPSSSSAPVTAQVSPPKITPATPSSSFSPPPPSSSSPSATVSVSSSPPTSSTIHHATVSDPTTEDIDMAVSTVSHPAPDLVLTDLGASSKRITPLASATIPHNSPQLEGTPLNPSQQQLALDALVPASALSTSSQPFSPISNSPQPMQPTKSSPATPTSLVKHSELTPSPRDRSAASGSASSSTPASSTTPALPPKVAPVMAGMGTLPPNVPPPSASASASTSAFSASDTLRAIPTNKNNPAFLNKLRSMVDDPNTDELIRWSPDGASFFVPNHVRFGDQVLPRFFKHNRFSSFVRQLNMYGFHKVPHLQQGALKHDSPQESELWEFSNPHFHRDHPDWLSKVQRKKGPRDDKDNHADREASATTGQELMHAGALMRTDFGMNNLGADANADGALQLASVLNAINAIKNAQTSISADLRHLQNSNQNLWQEAVESRQRAKRQQETINKILRFLAGVFGNQEDTETPVPGKKVSGKARAGKRVGVRPQQQQQQQQQHQQHQQQRSKSRLMIEDGNASSSSSHRGIQGLDLPLDQEEIEEMPYHLRFQEASNSDSPKVQSPSANLGASRFTQIGSPPSSSSAADFGRQLSEAVSTPGGSRRLSSQASNQVLNALASGEGNAWLASLFGASLANQGSKSTGPASGGGLKLDPHMVAALQQALASAGGVNSASDNTGDYFGSTTGAPADDGSSRFSAFPSSSSNASAVSSSNSAQANALGLDADALARFGASISHALVQSPARPNPNAGASNTQPTNYSVTSPSKGGSANLFDMGNDEVTSSGNNNQQLALSLSRATRDLQNTSSDVDQVQSSINSLIQGLQGIAGQAPASASASASDRAAVVPWQTTSGAAFDAAPATFGDASGSASVGNQFEAPSGTTPPSSTVDVGATSGTNAGMDDFDVDSFLSQFVDSSQAPGGGVTSPTPNNAYGESPSFAFSPATTAAFLHGAATSASDLPYAQQLTSKAESGTSSNSSSSRLNGKADSNAPKKRKPSTSGVELAVDVDMPDRPLKKSGRKA

SEQ ID NO: 2073 - protein, 545 aa, Xylella fastidiosa
MHSIQIVLAMLLVVAASGYLVRIIPFSMPLPLLQIALGAVISGVFDGGYELQPEVFFLLFLPPLLFLDGWRIPKQGLFRDKNVILELALGLVVFTVLGIGFLIHWMIPTMPLALAFALAAILSPTDPVALSSITSRVRIPKRMMHILEGESLLNDATGLVCFQFAIAAVLTGHFSLATASLTFVWVLVVGLSLGMTTTYVLSRVQRWVWRHFGGEPAAAILVNLLTPFAAYLLAESMQASGILAAVAAGITMSYVELSGNAPATIRVQRWAVWETVQFTFNGIIFVLLGEQLPGILDDLVHSAQQAGHMNVGWLLVDVAVISAGLMLLRFLWVWLSLQWNLFKAVCCGKQRISPPWQIVVAMSLSGVRGAVTLAGVLTLPLLMPDGTPLPARQLVIFLAASVILVSLLLASVALPYLLRGLELPEKSSYDKEEDFARRVSAQAALEAVERLRQRLVEDSANAERYNEAAHQVSQLYQRKLGAVDLANVDPQETKVFEQVVRRFRQVGLAAERDELFRLAREHNISDELLQRMVRNLDLIEARRRS

SEQ ID NO: 2074 - protein, 455 aa, Francisella tularensis
MDNNQDKLKRDILSRHIVMISLGGTISASFFLGIGSILNTVGAFGTVIGFFIGGIIMMLVMISLAEMAFEMPISGSFQSYATKFISPYSGFLTGWLYLLNWLTAAAGGLVAAGIICNNFYPAISVWQFCLAIILIVSLLNLCAVRVFAEIEFWLSAIKIITIIIFIIIGIGIIGGFLHSNKPIAGLVNFYVDGLFPNGFKAFLFGLVIIVCTFQGAEVVGIAAGETKEPEKNIRKAIRSVAVRILLFFVFSSFIIAYVIPYKDSGITNTPFVTVLQLVNIKYVDTIMQLVILSASLSAVNSCFYTCARLMWSMAEANQAPKIFAKISKKQVPIYGVVFVALLSCICLITKFIGAEKIFILVISSSGMVGCMIWIIISMCHIYFRKSLTASQIESLRFKAWGFPLIPYTSILFNSCVILAMFWDPEQRMVVYSGVILILLFSFLYKFYYKKIIVKT

SEQ ID NO: 2075 - protein, 445 aa, Shigella dysenteriae
AVMGRNLALNIESRGYTVSIFNRSREKTEEVIAENPGKKLVPYYTVKEFVESLETPRRILLMVKAGAGTDAAIDSLKPYLDKGDIIIDGGNTFFQDTIRRNRELSAEGFNFIGTGVSGGEEGALKGPSIMPGGQKEAYELVAPILTKIAAVAEDGEPCVTYIGADGAGHYVKMVHNGIEYGDMQLIAEAYSLLKGGLNLSNEELAQTFTEWNNGELSSYLIDITKDIFTKKDEDGNYLVDVILDEAANKGTGKWTSQSALDLGEPLSLITESVFARYISSLKDQRVAASKVLSGPQAQPAGDKAEFIEKVRRALYLGKIVSYAQGFSQLRAASEEYNWDLNYGEIAKIFRAGCIIRAQFLQKITDAYAENPQIANLLLAPYFKQIADDYQQALRDVVAYAVQNGIPVPTFAAAVAYYDSYRAAFLPANLIQAQRDYFGAHTYKRI

SEQ ID NO: 2076 - protein, 317 aa, Cucumis sativus
MAAELSLGSAASKPQTENGVSDSISSVIPGWFSEISPMWPGEAHSLKVEKVLFQGKSDYQDVLVFQSSTYGKVLVLDGVIQLTERDECAYQEMITHLPLCSIPNPKKVLVIGGGDGGVLREVARHLSVEQIDICEIDKMVVDVSKEFFPRVAIGYEDPRVTLHVGDGVAFLKAVPEGTYDAIIVDSSDPIGPAQELFEKPFFASVAKALRPGGVVCTQAEGIWLHMHIIEDIVTNCRQIFKGSVNYAWTTVPTYPSGVIGFMLCSTEGPTVDFKHPVNSAEVNGIDTAKSPLKFYNSEIHAAAFCLPSFAKKIIDSE

SEQ ID NO: 2077 - protein, 445 aa, Shigella sonnei
AVMGRNLALNIESRGYTVSIFNRSREKTEEVIAENPGKKLVPYYTVKEFVESLETPRRILLMVKAGAGTDAAIDSLKPYLDKGDIIIDGGNTFFQDTIRRNRELSAEGFNFIGTGVSGGEEGALKGPSIMPGGQKEAYELVAPILTKIAAVAEDGEPCVTYIGADGAGHYVKMVHNGIEYGDMQLIAEAYSLLKGGLNLSNEELAQTFTEWNNGELSSYLIDITKDIFTKKDEDGNYLVDVILDEAANKGTGKWTSQSALDLGEPLSLITESVFARYISSLKDQRVAASKVLSGPQAQSAGDKAEFIEKVRRALYLGKIVSYAQGFSQLRAASEEYNWDLNYGEIAKIFRAGCIIRAQFLQKITDAYAENPQIANLLLAPYFKQIADDYQQALRDVVAYAVQNGIPVPTFAAAVAYYDSYRAAVLPANLIQAQRDYFGAHTYKRI

SEQ ID NO: 2078 - protein, 601 aa, Zea mays
MITGTDFYHVMTAMVPLYVAMILAYGSVRWWRIFTPDQCSGINRFVALFAVPLLSFHFISTNNPYTMNIRFIAADTLQKLIVLALLTAWSYLSRRGCLEWTITLFSLSTLPNTLVMGIPLLKGMYGDFSGSLMVQIVVLQCIIWYTLMLFMFEYRGARILITEQFPDTAGAIASIVVDPDVVSLDGRNDAIETEAEVKEDGKIHVTVRRSNASRSDIYSRRSMGFSSTTPRPSNLTNAEIYSLQSSRNPTPRGSSFNHTDFYSMVGRSSNFAAGDAFGLRTGATPRPSNYEEDPQGKANKYGQYPAPNPAMAAQPAKGLKKAANGQAKGEDGKDLHMFVWSSSASPVSDVFGNGAAEYNDAAAVKEVRMAVASPRKVAADGRKERGEDFAERDDFSFGNRGAAERDAEAGDEKAAAAAAAAQGNAGAVAAPAAMPPTSVMTRLILIMVWRKLIRNPNTYSSLIGLIWSLVCFRWNFEMPAIILKSISILSDAGLGMAMFSLGLFMALQPRIIACGNKVATFAMAVRFLTGPAVMAAASFAVGLRGTLLHVAIVQAALPQGIVPFVFAKEYGVHPDILSTAVIFGMLIALPITLVYYILMGL

SEQ ID NO: 2079 - protein, 342 aa, Streptomyces avermitilis
MTFKAEYIWIDGTEPTAKLRSKTKILADDAKGAELPIWGFDGSSTNQAEGHASDRVLKPVATYPDPIRGGDDVLVMCEVLNIDMTPHESNTRATLAEVEEKFGAQEPIFGIEQEYTFFKGSRPLGFPEGGFPAAQGGYYCGVGSDEIFGRDVVEAHLENCLKAGLGISGINAEVMPGQWEFQVGPLAPLEVSDQLWVARWLLYRTAEDFGVSATLDPKPVKGDWNGAGAHTNFSTKAMREGYDAIITACESLGEGSKPLDHVKNYGAGIDDRLTGLHETAPWNEYSYGVSNRGASVRIPWQVEKDGKGYIEDRRPNANVDPYVVTRLLVDTCCSALEKAGQV

SEQ ID NO: 2080 - protein, 141 aa, Bacillus anthracis
  misc_feature (25)..(25): Xaa can be any naturally occurring amino acid
  misc_feature (77)..(77): Xaa can be any naturally occurring amino acid
  misc_feature (132)..(132): Xaa can be any naturally occurring amino acid
MGYVEELRKIVGHRPLILVGAVVLXINEHGYVLLQQRTEPYGKWGLPGGLMELGESPEETACREVYEETGIEVKNLXLINVFSGANYFTKLANGDEFQSVTTAYYTDEYDGDFVMNKEEAVQLTFFPLTELXDYIVGSHKK

SEQ ID NO: 2081 - protein, 595 aa, Zea mays
MITGTDFYHVMTAVVPLYVAMILAYGSVRWWRIFSPDQCSGINRFVALFAVPLLSFHFISTNNPYTMNLRFIAADTLQKLMVLAMLTAWSHLSRRGSLEWTITLFSLSTLPNTLVMGIPLLKGMYGDFSGSLMVQIVVLQCIIWYTLMLFMFEYRGARMLITEQFPDNAGAIASIVVDPDVVSLDGRRDAIETEAEVKEDGRIHVTVRRSNASRSDIYSRRSMGFSSTTPRPSNLTNAEIYSLQSSRNPTPRGSSFNHNDFYSMVGRSSNFGAADAFGIRTGATPRPSNYEDDASKPKYPLPVVNATSGAGAAHYPAPNPAVAAAPKGARKAATNGQAKGEDLHMFVWSSSASPVSDVFGGGAPDYNEAAAAKSPRKMDGGKDRDDYVERDEFSFGNRGAMDRDAEAGDGKAAAAGGDPSTVAAPTAMPPTSVMTRLILIMVWRKLIRNPNTYSSLIGVIWSLVCFRWNFQMPAIVLQSISILSDAGLGMAMFSLGLFMALQPRIIACGNKVATFAMAVRFLTGPAVMAAASFAVGLRGTLLHVAIVQAALPQGIVPFVFAKEYNVHPDILSTAVIFGMLIALPITLVYYILLGL

SEQ ID NO: 2082 - protein, 161 aa, Candida glabrata
MSADHSRDPCPIVILNDFGGAFAMGAIGGVVWHGIKGFRNSPLGERGLGAMSAVKARAPVLGGNFGVWGGLFSTFDCAVKAVRKREDPWNAIIAGFFTGGALAVRGGWKHTRNSAITCACLLGVIEGVGLMFQRYAAWQAKPMAPPLPEGAGSAPPQPLQA

SEQ ID NO: 2083 - protein, 111 aa, Unknown
  Synechococcus sp. RS9916
MSDTSAATYSITVDLDGEQHSFSCRSDQTVLAAAEAAGVMIPSSCCAGVCTTCAARIGEGEVHQPDAMGVKEDLRKDGFALLCVSYPRSDLKVLAGQEDALYEAQFGQYQK

SEQ ID NO: 2084 - protein, 210 aa, Bordetella pertussis
MAKNKFSKDWIHQHINDPYVKLAQQKGYRARAAFKLLEILDAEKLMRRGDVVVDLGSAPGSWSQVARERLAGPGGVVDGRIIALDLLPMEPVAGVEFIQGDFREEEVLEQLARMVDGQPVDLVISDMAPNLSGVGVADSARIQHVCELALEFACAHLKPNGALIVKAFHGSGFSQIVQSYKQRFKRVVERKPKASRDKSSETFLVARDLK

SEQ ID NO: 2085 - protein, 527 aa, Neurospora crassa
MFGGGSSSAASKSVSGSASDSGSSGKDRSSSKSPSPEKEAPGNGGASPKSIKSADQSTAGDTQIGNGSPPSAGSSSDSKKKRSSGVSGRASSLIAQAKNTLFTQVANRNSGDMSTDSKNSNQTSLQKLGKQDQALAVPQGQHNNAAGESLPGPRSTFKVGVWEDRNKKCRRTMEDTHAFLYNFLHTPAPTDNGYFAIFDGHAGTFAADWCGKKLHIILEDIIKKNPNAPIPELLDQTFTTVDTELEALPLKNSGCTAAVASATRQRVLYTANVGDARIVLCRSGKALRLSYDHKGSDENEGKRIANAGGLILNNRVNGVLAVTRALGDTYIKDLVTGHPYTTETVIQPDWDEFMIIACDGLWDVCSDQEAVDLVRDIQEPVIAAKKLVDHALSRFSTDNLSCMIVRFDKQALLENQNNKDSAIGVEGDATTAAGTVTESEKIVTATKQKIAEGSTPAVGISASNFGRGHDPTPLEDGEKKPFVPTTIEGSVEEEPVVLSDSPEATPDGSVTAMKLDSLPEAKKSLDA

SEQ ID NO: 2086 - protein, 467 aa, Musa balbisiana
MEAKSTGRFTLGKQSSLAPDRDDGELQALRSGDLDGLQVPEEVDANIRLMYLANEGDLAGIEETLASGVDVNFRDIDDRTALHVAACQGFADVVQLLLDRGAQVDPEDRWGSTSNFITIAPAKQPLADAVHYKNHEVIKLFEKHGAKLRVTPMRVENAREVPEYEIDPSELDFTNSVNITKGTFIIAKWRGIQVAVKKFNDDVMADEDKLWDFFIFCRRAFRDELALLQQIRHPNVVQFLGAVTQSSPMMIVTEYLRKGDLRAYLNRKRTLRPSSAVLFALDIARGMNYLHEHKPEAIIHRDLEPSNILRDDSGHLKVADFGVSKLLKVAKTVKEERPLTCLDTACRYVAPEVFLNEEYDTKVDVFSFALILQEMIEGCPPFSYKQDNEVPKAYVSKQRPPFRAPPKQYAHGLKELIEHCWSENPADRPTFREIIDRLSKIQNHIAQKRRWKVSLFNFYLGLQLFSL

SEQ ID NO: 2087 - protein, 442 aa, Arabidopsis thaliana
  misc_feature (229)..(229): Xaa can be any naturally occurring amino acid
  misc_feature (242)..(242): Xaa can be any naturally occurring amino acid
MNALAATNRNFRHASRILGLDSKIERSLMIPFREIKVECTIPKDDGTLVSYIGFRVQHDNARGPMKGGIRYHPEVDPDEVNALAQLMTWKTAVADIPYGGAKGGIGCSPRDLSLSELERLTRVFTQKIHDLIGIHTDVPAPDMGTNAQTMAWILDEYSKFHGHSPAVVTGKPIDLGGSLGREAATGRGVVFATEALLAEYGKSIQGLTFVIQVKPLSANLRSQALLCIXYKTEMLRDLDDMXQGFGNVGTWAAKLIHEKGGKVVAVSDITGAIRNPEGIDINALIKHKDATGSLNDFNGGDAMNSDELLIHECDVLIPCALGGVLNKENAGDVKAKFIVEAANHPTDPDADEILSKKGVIILPDIYANAGGVTVSYFEWVQNIQGFMWEEEKVNLELQKYMTRAFHNIKTMCHTHSCNLRMGAFTLGVNRVARATQLRGWEA

SEQ ID NO: 2088 - protein, 388 aa, Haemophilus influenzae
MIKLIQRFFKLESAGGILLLFSAVVAMLLANSPLSNQYNDFLNLPVSLQIGSFSINKTLIHWINDGFMAVFFVLVGMEVKKELFEGALSTYQQAIFPAIAAIGGMVIPAVVYWFIAKQDPSLANGWAIPMATDIAFALGIMALLSKQVPLPLKIFLLALAIIDDLGAIVVIALFFSHGLSVQALIFSAVAIIVLILLNRFKVSALCAYMVVGAILWASVLKSGVHATLAGVIIGFSIPLKGKKGERPLDDFEHILASWSSFVILPLFAFANAGVSFAGIDVNMISSPLLLAIASGLIIGKPVGIFGFSYISVKLGLAKLPDGINFKQIFAVAVLCGIGFTMSMFLASLAFDANAGESVNTLSRLGILLGSTVSAILGYLFLKQTTKLS

SEQ ID NO: 2089 - protein, 763 aa, Brucella melitensis
MFCLSGPFLFQLCRRSSLDDKNNKRKPMNHSPQSARPVSIMRRFLDSEAAGGITLMAAAALALIVANSPFAQTYFDALHLYIGPLSLAHWINDALMAIFFLLVGLEIKREMLDGQLASWPNRMLPGIAAAGGVILPAIIFAVLNHDNPAKLRGWAVPSATDIAFALGVLSLLGSRAPSSLKVFLATLAILDDLAAVVIIAIFYTAEISMPYLGAAFITAAVLFVMNRMDVVKLLPYLISAVILWFFVFNSGVHATVAGVVAALMIPLKPAPGRPDDMTSPLHKLEHALAKPVAFIVVPIFGFANAGISFKGLEASVLGDTLTLGILLGLFLGKQFGVFGAAWLAIKTGLAEKPMGASWVQLYGVAILCGIGFTMSIFIGLLSFPSDLMQTETKIGVLSGSALSAICGYLLLRAARPDQSAANPLWKADESPEAKNFGRFLCVFHFASYIASTYCTERLQAASSLLRRSSLEFALPGLLKRLIPRRFRAVETEIPVVRLHGAIMTGGTSLRPTLSLASTAGILEKAFADKHAPAVAISINSPGGAPVQSRLIYRRIRDLAAEHQKKVFVFVEDVAASGGYMIALAGDEIIADPSSIVGSIGVVSASFGFPELLKKIGVERRVYTAGSNKVTLDPFQPEKAEDIERLKALQLEIHATFIDMVKERRAGKLGDNPDLFSGLFWTGTTAASLGLIDGLGDMLSFLRKTYGDKVKLKLIQPQRGLLGRKLPGIGMDSGSVEPAQIAAHLGDGLLCVAEEKAIWARYGL

SEQ ID NO: 2090 - protein, 453 aa, Myxococcus xanthus
MALRVAIIGAGPSGLAQLRAFESAARKGAEIPEIVCFEKQEDWGGLWNYTWRTGLGRYGEPVHGSMYRHLWSNGPKEALEFADYSFDEHFGRPIPSYPPREVLYDYIRGRVEKCDVRKYIQFNTIVRWLSWSEETRKFTVVVDDLAKREVREESFDRVVNATGHFSTPNVPFFEGIDSFPGRVLHAHDFRGAEEFAGKNLLLIGSSYSAEDIGVQCHKLGAKSVTISYRSAPMGFRWPMGMKEVPLVKRFEGNRAHFADGTSATLDAVILCTGYQHKYRFLPNALRLESHNRLYPPGLYKGVFWQGQPELAYLGMQDQYYTFNMFDAQAWLVRDVIMGRTALPSAEEREADIAAWVEREEGIQDSFGAVDFQTAYIRDLLDRTDYPGFSVEKVAELLKQWLRDKQEDILGYRDRTFTSIVTGTRATPHRRKWMDELDDSAESFLAEAPERRTG

SEQ ID NO: 2091 - protein, 606 aa, Unknown
  Delphinium 'MagicFountains dark blue'
MDSCACIETQWPADELLVKYQYISDFFIALAYFSIPLELIYFVQKSAFFPYRWVLMQFGAFIVLCGATHLINLWTFSMHSKTVAMVMTIAKISTAVVSCATALMLVHIIPDLLSVKTRELFLKNKAEELDREMGLIRTQEETGRHVRMLTHEIRSTLDRHTILKTTLVELGRTLGLEECALWMPSRTGMNLQLSHTLRHQIPVGSTVSTNLPIVTQVFNSNQAIKIPHTCPLARIGPTAGRYVPPEVVAVRVPLLHLSNFQINDWPELSAKSYAVMVLMLPTDSARKWHDHELDLIEVVADQVAVALSHAAILEESMRARDMLMEQNIALDMARREAEMAIRARNDFLAVMNHEMRTPMKAVIALSSLLLEIELTPEQRVMIETVLKNSNLLAALINDVLELSRLEDGSLELDIRTFNLHGIFREVLNMIKPITAVKKLSLTLMLSPDLPVVAVGDEKRLMQIMLNVVGNAVKFTKEGYVSVIASVAKAESLREWQAPEIFMVSSDSHFHLCVQVKDSGCGISPQEIPHLFTKFTQLRSGQNRSNDGAGLGLALCKRFLNLMEGHIWVDSDGTDKGCTVTIIVKLGICEGQPEPSNLQVVSRPRLS

SEQ ID NO: 2092 - protein, 326 aa, Triticum aestivum
  misc_feature (278)..(278): Xaa can be any naturally occurring amino acid
MAGDGTDAAFEDEVEPTVTISEYMDGIEAEELEADLVLGGDDGNECTYGAGYLKRQAVFSCLTCVPDGVAGVCTACCLACHDGHEVVELWTKRNFRCDCGNSKFGGHLCKLSPEKDPENPANSYNQNFKGSYCTCSRPYPDPEAKEQVEMIQCCICEDWFHEDHIGLDSLEKIPRDEEGEPLYEEFICHQCSPVCYFLKLYPDTIWASSKQSSASEAVTADSNGMEGGSSGHADTEKNENGAPVDRQSIENTSVEENRTIDIAASDKSILGDNSGGNXKIGVDINTTSADSEKTMPLFMSKGWRETLCKCGTCTNFYAQRGMHIHG

SEQ ID NO: 2093 - protein, 430 aa, Bacillus halodurans
MKTTIAKIGQYVDQEVTLGAWLANKRSSGKIAFLQLRDGTGFIQGVVVKAEVGDEWFQKAKNLTQESSLYVTGIVRKDERAPSGYELTVTSFDIIHEATDYPITPKEHGTEFLMDHRHLWIRSRKQHAVLRIRNEIIRATYEFFHENGFVKVDPPILTGSAPEGTTELFHTKYFDEDAFLSQSGQLYMEAAALAFGRVFSFGPTFRAEKSKTRRHLIEFWMIEPEMAFVEFEESLEIQENYVAYIVQSVLKHCAIELKTLGRDTSVLESIQAPFPRISYDDAIKFLHEKGFDDIEWGDDFGAPHETAIAEHFDKPVFITHYPTSLKPFYMEPDPNRDDVVLCADLIAPEGYGEIIGGSQRISDYDLLKKRLEEHDLSLDAYAWYLDLRKYGSVPHSGFGLGLERTVGWISGAGHVRETIPFPRLLNRLYP

SEQ ID NO: 2094 - protein, 377 aa, Agrobacterium tumefaciens
MAKADFYETLGVSKTADEKELKSAFRKLAMKFHPDKNPDDADSERKFKEINEAYETLKDPQKRAAYDRFGHAAFENGGMGGGGMGGGGFANGGFSDIFEDIFGEMMGGGRARRSSGGRERGADLRYNMEITLEEAFAGKTAQIRVPTSITCDVCSGSGAKPGTQPKTCATCQGSGRVRAAQGFFSVERTCPTCHGRGQTISDPCGKCHGQGRVTEERSLSVNIPSGIEDGTRIRLQGEGEAGMRGGPAGDLYIFLSVRPHEFFQRDGADLYCTVPISMTTAALGGTFDVTTLDGTKSRVTVPEGTQPGKQFRLKGKGMPVLRSAQTGDLYIQIQIETPQKLSKRQRELLQEFEQLSSKENNPESTGFFARMKEFFDG

SEQ ID NO: 2095 - protein, 606 aa, Unknown
  Delphinium 'MagicFountains dark blue'
MDSCACIDTQWPADELLVKYQYISDFFIALAYFSIPLELIYFVQKSAFFPYRWVLMQFGAFIVLCGATHLINLWTFSMHSKTVAMVMTIAKISTAVVSCATALMLVHIIPDLLSVKTRELFLKNKAEELDREMGLIRTQEETGRHVRMLTHEIRSTLDRHTILKTTLVELGRTLGLEECALWMPSRTGMNLQLSHTLRHQIPVGSTVSTNLPIVTQVFNSNQAIKIPHTCPLARIGPTAGRYVPPEVVAVRVPLLHLSNFQINDWPELSAKSYAVMVLMLPTDSARKWHDHELDLIEVVADQVAVALSHAAILEESMRARDMLMEQNIALDMARREAEMAIRARNDFLAVMNHEMRTPMKAVIALSSLLLEIELTPEQRVMIETVLKNSNLLAALINDVLELSRLEDGSLELDIRTFSLHGIFREVLNMIKPITAVKKLSLTLMLSPDLPVVAVGDEKRLVQIMLNVVGNAVKFTKEGYVSVIASVAKAESLRDWQAPEIFMVSSDSHFHLCVQVKDSGCGISPQEIPHLFTKFTQLRSGQNRSNDGAGLGLALCKRFLNLMEGHIWVNSDGTDKGCTVTIIVKLGICEGQPEPSNLQVVSRPRLS

SEQ ID NO: 2096 - protein, 220 aa, Unknown
  Chrysanthemum x morifolium
MSSSASFSPDHHHHHLSPTSEQLCYVQCNFCDTVLAVSVPCGSLFTTVTVRCGHCTNLLSVNMRALLFPASVTTTAAANQFHLGHNFFSAQSLMEEMRNTPANLFLNQPNPNDHFGPVRVDELPKPPVANRPPEKRQRVPSAYNRFIKEEIQRIKAGNPDISHREAFSAAAKNWAHFPHIHFGLMPDQPVKKPNVCQQDGEDLLMKDGFLATANVGVSPY

SEQ ID NO: 2097 - protein, 360 aa, Unknown
  Frankia sp. CcI3
MVTHPRLRIPGSASPAPHPRPLGDLPHPPVSSLTMTDAAAPRTPSRGSLGAVAPQPLRVEPAEVDRNRLAVIVNPSAGHGRAMRMLDGVRVELARWARDVRVTPTRDLAHADDLAAAATAQGRVVVALGGDGLAGSVAGGVARCGGVLAVLPGGRGNDFVRGLGLPRDPCRVAAGLAHARERRVDLPEVGGRPFLGIASVGYDSDVQVIANRTRFLRGQQVYTYAALRALAAWRPARFTVTVDDLAPRDLVGWTVAAANSAYYGGGMRFAPGADIADGLLDVLLISRTSRLTFLALFPRVFSGRHVDTRHVRVLRARRVRIEADRPFAVYADGDPLASLPAEIVVRPGALRLLVPVIPAS

SEQ ID NO: 2098 - protein, 657 aa, Haemophilus somnus
MSLGKPYPLGCTECCMEGIAGFNFAIYSSQASAVELCIFNKNSVQETCYSMYCTENIWHIWVTELEYGTEYGFRIHGVDGSLSNPNKLMLDPYAKAVVGKPDLSCVENRAWFLLEDERDNAHLAPKALIESSSFDWEEDILPQTPWSESIIYELHVKGFTQLREDIPEAIRGTYAGLAHQNVIAYLKELGVSAVELLPINYHLDEPHLQEKRLQNYWGYSPLAMFAVESKYWSNQADTTPLTEFKSMVKALHKAGIEVILDVVFNHSVESEKYFPTFSQRGIDDRTYYWQDEAGNYINLTGCGNTLNLSIELGRKWIIDCLCYWVEECHVDGFRFDLASVLGRETPDFNANALLFKEIEQVSILQKVKFIAEPWDIGMGGYQVGNFPAYFAEWNDRFRDDMCRFWLWKSGELGVFAERFAGSSDIYRCQGKLPHNSVNFITAHDGFTLHDLVSYNQKHNWANGEDNRDGRSENYSYNHGMEGYKEGNSLVEEARYLSRSALLLSLLLSNGTPMLLAGDEFGNTQYGNNNAYCQDNETTWLKWQYFEQDLFNLVKQVIALRKQIPSLQRDNWWQESNVSWLNIDAEKMSLDEWHNKESKALQILLDSKYLFVINAKTSSQKFLLPQGNWEILCYSKVVHLENKQLEMTDLAFGVLQKK

SEQ ID NO: 2099 - protein, 384 aa, Arabidopsis thaliana; identical to SEQ ID NO: 345

SEQ ID NO: 2100 - protein, 228 aa, Agrobacterium tumefaciens
MRRGGTGRTEDRMFLFDTLSKKTTMPTEETALPGREEALAVPETHFVNGRPLKGPYPDGLEIIYLGMGCFWGAERLFWKTPGVWVTAVGYAGGFTRNPTYHETTTGQTGHAEVVKVVYDPAVISLSGLLKIFFEEHDPTQGMRQGNDVGTTYRSAIYATTEGQLQQAQKARDAFQQALDEAGHGHAITTEIGPLETFYYAEDYHQQYLAKNPGGYCGLRGTGVSCNIG

SEQ ID NO: 2101 - protein, 911 aa, Solanum tuberosum
MAASVENRQFTHLEPGLSGVGRTFKPRPDSPVRGCNFPPSSNHELPFQKQQNLPIYLDYSSSEDEDDDDEKNEYVQMIKKGKTELEPSIHDTRDEGTADNWIQRNFSLIRLTGKHPFNSEPPLARLMHHGFITPVPLHYVRNHGPVPKASWADWSVEVTGLVKRPMKFTMDQLVNEFPSRELPVTLVCAGNRRKEQNMVKQTIGFNWGAAAVSTTVWRGVPLRPLLKRCGVHSKKKGALNICFEGSDVLPGGGGSKYGTSIKNEFAMDPSRDIIVAYMQNGEMLSPDHGFPVRMIIPGFIGGRMVKWPKRIVVTTQESESYYHYKDNRVLPPHVELELANAEAWWYKPEYIINELNINSVITTPSHEEILPINAWTTQRPYTLRGYAYPGGGKKVTRVEVTLDGGETWSVCTLDHPEKPTKYGKYWCWCFWSLEVEVLDLLRAKEIAVRAIDETHNTQPEKLIWNVMGMMNNCWFRVKMKCVKPHKGEIGIVFEHPTQPGNQSGGWMAKERHLEISAVAPPTLKKSISTPFMNTASKMYSMSEVRKHNSSDSAWIIVHGHIYDASRFLKDHPGGVDSILINAGTDCTEEFDAIHSDKAKKLLEDFRIGELITTGYTSDSSPNTSVHGSSSISSFLAPIKELVQTPTRSVALIPREKIPCKLVDKQSISHDVRKFKFALPSEDQVLGLPVGKHIFLCATVDDKLCMRAYTPTSTVDEVGFFELVVKIYFKGVHPKFPNGGQMSQHLDSLPIGAFLDVKGPLGHIEYQGKGNFLVHGKQKFPKKLAMIAGGTGITPVYQVIESILKDPEDDTEMYVVYANRTEDDILLKEELDAWAEQIPDRVKVWYVVQESITEGWKYSTGFVTEAILREHIPQPSHTTLALACGPPPMIQFAINPNLEKMGYDIKEELLVF

SEQ ID NO: 2102 - protein, 119 aa, Clostridium perfringens
MKIALIAHDKKKEEMIELAKDFEDKLSKHILVATGTTGLKIMQNTSLEVKRCKSGPLGGDQEIGAMVANHDVDMVIFLRDPLTAQPHEPDISALLRLCDVYKVPLATNTESAKLIMADI

SEQ ID NO: 2103 - protein, 272 aa, Cryptococcus neoformans
MALYAPPPPSYQDHAAGPVQHHGFNPYSDNGGSILAIAGKDFSIIAGDTRQSEGYSIQTRYARKVWQLTDKVVLATNGFAADGNNFVKRVKQRLEWYEHAHNKAMGLKSIARMIQTMLYGKRFFPYYVYNILGGIEEDGSGAVYSFDPVGSYEREACRAAGAAQSLIQPFLDNQVYFKNQQPEPGAAPFVPGNLPLSTVLSLVVDSFTSATERHIEVGDGMEIYVVMAKGRSTDDLLGEGNLVPGMEVEELPSLGESGSERAFLVRMPLKRD

SEQ ID NO: 2104 - protein, 276 aa, Brassica napus
  misc_feature (111)..(111): Xaa can be any naturally occurring amino acid
  misc_feature (185)..(185): Xaa can be any naturally occurring amino acid
MAVHTVKYWLTEHPNIVNFRWSPTQSYASTWFFLFAAVSSYVIAAVSLHILLAVTRRRRGLSLGPIPALHSLAMALISAVIFVGILLSAAAEIRDTRWLWRRTRTTALQWXFLCFPVGTRASGRVFFWSYAFYLSRFLHLFRTFFAVIRRRKLSFFQLINQSSLLCISFLWLEYSQSFQVVASTXRPVSYAVVYGYRFWTAIGLRGACFPLVVNCQAVLLGCLTVCHVGVLCIHLVKRGGCNGIGAWLFNSVLNAVISLLYLKFYVKTRSLSLRKQ

SEQ ID NO: 2105 - protein, 339 aa, Sinorhizobium meliloti
MSLLEKFERYPLTFGPTPIEHLPRLTAALGGKVEIYAKRDDCNSGLAMGGNKLRKLEYIVPDAIASGADTLVSIGGVQSNHTRMVAATAAKIGMKCVVIQEKWVPHYDAVYDRVGNILMTKLMGADSRLVEDGFDIGIRKSWEDAIQSVEDAGGKPYAIPAGASVHKFGGLGYVGFAEEVAAQEKDLGFIFDYIIVCVVTGSTQGGMIVGFAALDRADRVIGIDASGTLQQTRDQVRKIVDATSELVNLGRSVREDEIVINPDYAYPAYGVPSEETNEAIRLAARTEAMITDPVYEGKSMQGMIDLARKGFFPEGSKVLYAHLGGAPALNGYSYYYRDG

SEQ ID NO: 2106 - protein, 878 aa, Clostridium perfringens
MNYLEVKKDIYWVGSLDPELRVFDIIMYTPYGTTYNSYVVKGSEKIAVFETVKEKCFDDYLSKLNSLGIDPKSIDYIVVDHTEPDHAGSVEKLLELSPKAKVIGSMQAIEFLKDIVNKDFEYIVVGDNDTISLGNKTLQFISAPFLHWPDSMYTYIPEDKALITCDSFGSHYSCEEVFNDLVPNEEEYLDALRYYYDCIFGPYKPYVLKAIDKIKDLDIELVCPGHGPILRQDPWKIINTYKEWSTPVKPKINGDKKVTIPYVSAYGYTKELAEEIAKGIQSEHNVEVKLYDLTYSKQEDVLADIGESDGILFGSPTIVGELLPPIRILLANLNPIIHGGKYAAAFGSFGWSGEAVPRIEARLKELKMNIFGPGLRIKFKPSTTELKEAFEFGRDFSRTMFGEKELDYAPNNATETKEVLTGNGKTRYWKCLVCGEIFESPVCPEVCPVCGAGKEQFIEVEMDTFEKNDTNDNFVIIGNGAAGFYAAKTIREINSTASVKLLSSEEVSSYSRPNLSDLLNEEMNLDTFYLAKSSWYKENNIEELLGVTVTSIDKDAKKVILKDGTEIPYTKLILANGSHNFIPPFRIKNNDEEVTLNCENIHEFKGIYSIKDLKDTFDVKEEMKEAKKAVVIGAGPLGLEAAWEMKLAGLDVTVVEFLPNLMNNQLDQEGADIFKNQVSDCGITFITSDECTEIITKDSKLTSLNLKSGKTLDADILLVSTGIRSNIELAKESGIECNRGVIVNERMETSVKDIYACGDVAEFNGLVYGNWPAAIEMGKTAGANACEAEKAFENFTPSIILDALNTHVFSAGLIRFNDSSYEKISSKDESKGQYTKLFFKDNILVGGIIVGDISKAGQIIIAIDNKLSKAAALSNDLL

SEQ ID NO: 2107 - protein, 164 aa, Ralstonia metallidurans
MSNVYQFEANSLSGQPQPLADYRGKVLLIVNTASECGFTPQYAGLQTLQASYQARGFDVLGFPCNQFGKQEPGDAEQIGAFCESRFHVTFPMFEKIDVNGADAHPLYKWLTSEKRGFLGTQAIKWNFTKFLLRRDGTVFKRYASTTKPEEIRADIESLLAEQPA

SEQ ID NO: 2108 - protein, 312 aa, Mycobacterium avium
MAPHDKQHRDWSEADVGDQSGRVVVITGANTGIGYETAAVLAHRGAHVVLAVRDLEKGNAALSRIVAASPNADVTLQQLDLASLASVRSAAEALRAAYPRIDLLINNAGVMWTPKQVTEDGFELQFGTNHLGHFALTGLLLDHLLGVRDSRVVTVSSLGHRLRAAIHFDDLHWERRYDRVAAYGQSKLANLLFTYELQRRLAAAPDAKTIAVAAHPGGSNTELARHLPGIFRPVQAVLGPVLFQSPAMGALPTLRAATDPAVQGGQYYGPDGFLEQRGRPKLVESSAQSHDEQLQRRLWAVSEELTGVHFPV

SEQ ID NO: 2109 - protein, 998 aa, Gloeobacter violaceus
MSEPTIDRELDLHTFWQDASEPAPDTTIPAVALANGKGHLDYTDRFAGRHIGPDGREVERMLSTLGFESLDALIERAVPAQIRMERPLRLPKGLSEYEVLARLRAIAAQNRVFRSFIGMGYAECITPLVIQRNILENPGWYTQYTPYQAEIAQGRLEALLNFQTMVIDLTGLEIANASLLDEGTAAAEAMAMSFGIKAKGRAKRFFVSEHCHPQTIAIVQTRALPLGIDVIVGDHRAFDFQVQPCFGALVQYPATDGALFDYRAFVEAAHRAGALVTVAADLLSLALLVPPGEFGADIAVGNTQRFGVPMGYGGPHAAYFATRDAYKRQIPGRIVGVSTDAHGQRALRLALQTREQHIRRDKATSNICTAQVLLAVMAGMYAVYHGPVGLRRIAARIHRLTRTLAAGLVRLGHLLGSAPYFDTLRVELNGIDTRTIVERAEARRLNLRVLDERTIGVSLDEATSTRDLEDLLAIFALEGEPDFTIAELAAEVSQVQAPEVFGRQSAYLTHPVFNRYHSETELLRYMRRLESRDLSLTTSMIPLGSCTMKLNATAEMLPVSWPEFAKLHPFVPLSQARGYQILFEQLEAALAEITGFTAVSLQPNAGSQGEYSGLLVIRAYHHSRGEAHRDVCLIPQSAHGTNPASAVMAGMQVVPVACDEQGNIDVADLEAKATTHAARLAALMVTYPSTHGVFEEAIVRICAIVHGRGGQVYMDGANLNAQVGLCRPGDFGADVCHLNLHKTFCIPHGGGGPGMGPIGVASHLAAFLPRHPVVSQVGGQAGIGAVAAAPWGSASILTISWVYIFLMGGPGLTEATKVAILNANYIAHRLAPHYPVLYKGAGGLVAHECILDLRKLKTTAGIEVDDVAKRLMDYGFHAPTVSWPVAGTIMIEPTESESLEELDRFCEALIAIRHEIAAIERGEADRADNPLKNAPHTAAVLLADSWEHPYSRAQAAYPAPWLYQHKFWPVVSRIDNVYGDRNLICSCLPMEAYAQDGK

SEQ ID NO: 2110 - protein, 605 aa, Thermobifida fusca
EPAFNYAEALQKSMFFYEAQRSGKLPENNRVSWRGDSGLNDGADVGLDLTGGWYDAGDHVKFGFPMAFTATMLAWGAIESPEGYIRSGQMPYLKDNLRWVNDYFIKAHPSPNVLYVQVGDGDADHKWWGPAEVMPMERPSFKVDPSCPGSDVAAETAAAMAASSIVFADDDPAYAATLVQHAKQLYTFADTYRGVYSDCVPAGAFYNSWSGYQDELVWGAYWLYKATGDDSYLAKAEYEYDFLSTEQQTDLRSYRWTIAWDDKSYGTYVLLAKETGKQKYIDDANRWLDYWTVGVNGQRVPYSPGGMAVLDTWGALRYAANTAFVALVYAKVIDDPVRKQRYHDFAVRQINYALGDNPRNSSYVVGFGNNPPRNPHHRTAHGSWTDSIASPAENRHVLYGALVGGPGSPNDAYTDDRQDYVANEVATDYNAGFSSALAMLVEEYGGTPLADFPPTEEPDGPEIFVEAQINTPGTTFTEIKAMIRNQSGWPARMLDKGTFRYWFTLDEGVDPADITVSSAYNQCATPEDVHHVSGDLYYVEIDCTGEKIFPGGQSEHRREVQFRIAGGPGWDPSNDWSFQGIGNELAPAPYIVLYDDGVPVWGTAP

SEQ ID NO: 2111 - protein, 420 aa, Methanosarcina mazei
MRSHLVKPGSVYDGIEPGELGETTESVQDRVRQLESRNSFLEEQCSQIESEKRYLENQKIKYEREIRKLQSELDRMKTSPLIIGTVIDVIKNDRIIVRSSNGPQFLVNVSQYIDEKKLLPGAKVALNQHTLAIAEVIPSTEEPFVAAMEVIESVEVDYDQIGGLDEQIQELQEAVELPLTSPERFARIGIEPPKGVLLYGLPGTGKTLLAKAVAHRTNATFIRVVGSELVQKYIGDGSKLVREIFEMARKKAPSIIFIDELDSIAARRLNETTGADREVQRTLMQLLAEMDGFDKRKNIRIIAATNRPDVLDPAILRPGRFDRLVHVPMPGIEARGKILKIHCEKMTLAEDIDFKKLAKATEGMSGADLKAIATEAGMFAVRRDKELVEMEEFLEAVEKVSMAADTQKMMPSNLPETMFV

SEQ ID NO: 2112 - protein, 655 aa, Clostridium perfringens
MRRNFNSKEFNDKYYYDGELGAIYNKEETIFRVWSPEAKSLELLLYRDGNTESLIERDLLHKKSNGLWEIVKKGDLNGVYYKYHIVGEDFEHDFVDPYCKALGVNGYRAMVIDLKKTNPKGWENEKKPSLENPLDSILYEMHIRDFSIDKSSGVSLENRGKFLGIIEENTKVPGTEVKTTLDHLKELGITHVHLLPSFDFGTVDEERLDEEQYNWGYDPVNYNVPEGSYSKNPYKGEVRIKEFKEMVLKLHRAGIRVIMDVVYNHTYSGENSNLNLSYPGYYHRQDDFGNFSNGSGCGNELASERLMVRKYMVDSLKYWAKEYHIDGFRFDLMALHDIETLKEIREELNKIDPSILIYGEGWNGGDSPLPKEEACFKCNISKFDKLQIAAFSDDMRDGIKGHVAHLKEGGFVNGGEDFEESIKFGIVASTYHEGVDYNKVNYSDSPWANEPYQTVNYCSAHDNNTLHDKLKIVCENASEEEIIEMNKLSAAIFLTSQGIPFIHSGEEFLRTKTNEKGEFIENSYNSNDFVNKIDWTRKVKYMDLFKYYKGLIELRKEYPLFRLESNKEIREKISFIESELGIKKKGIVAYRLKDHNNEFIVVFNSNNNEVKINLPKGLWGVMVNNKFSGKEIRDEARDFYDIIRKSACVLKKLSD

SEQ ID NO: 2113 - protein, 314 aa, Ralstonia eutropha
MSRFVHVAAAQLGPIQRSDSRRDVVARLLAHLHHAHEMGCHLVVFPELALTTFFPRWYMDDPEELNAFYEREMPGPETRILFDTAARLGIGFYLGYAELAVEQGVERRYNTAILVGRDGKIVGKYRKVHLPGHDQHEPWRAFQHLEKRYFEPGDDFGVWQAFGGVMGMALCNDRRWSETYRVMGLQGAEMILLGYNTPVHNPPAPEHDDLSMFHNHLVMQAGAYQNGTWVVGVAKAGKEEGCEMIGGTSIIAPSGEIVAACSTKGDELAIARCDLDLCQSYKSTTFNFDRHRRPEAYGRITSQRGATPPQPVAA

SEQ ID NO: 2114 - protein, 305 aa, Desulfovibrio desulfuricans
MQIAIIGLGRMGMNMARRLLRGGHEVAVWNRSPAKTQVMEAEGAAGFTSLQALAASLAPPRTLWFMLPAGEATQQRMDEVLPFLQPGDVVVDGANAYWKDDRPRADRLAAHGIRYVDAGVSGGIWGLENGYCTMLGGEAADIRHLAPVLDTLAPPQGWMHCGPAGAGHFVKMVHNGIEYAMMESYGEGFDLLRNGPFSGLDLQGIAALWNRGSVVRSWLLELLDAALKKDPGLASLKGYVDDSGEGRWTVTDAVDHAVPVPVLAQALFRRFESRQDDLFSNKVLAALRNEFGGHAVKNTDEGDAS

SEQ ID NO: 2115 - protein, 1016 aa, Musa balbisiana
MLTSEMMGVAALRVIASKLEKKWDFSVDPCSQTNGWVVPGRSDMPVFTDNVTCDCNRTSNICHVTSIKLKGQNLTGTLPPEFSKLPFLTDIDLTWNYLNGTIPAAWASLPLVHLSLLGNQVSGPIPEEFAKMITLEELVLEGNQLQGPIPAALGKLANLKRLLANGNYLSGELPESLGNLKNLIMFLIDGNQISGKIPNFIGNWTQLQRLDMQGTAMEGPFPPSFSALKSLKELRVSDLKGGIGSFPQLQNMRNMTKLVLRNLSISGELPDYIGEMKALNSLDVSFNNLSGPIPGSYAALTSSLNFMYLSNNNLNGKIPDWILNSAQKFDISYNSFTGSPAPAICQRGRCWCNLTAPFYRTLSCLRRNLPCSGESRNYNLFINCGGPKMRIDDIEYEGDILDLGTSEFYDPESGKWAYSSTGDFVDNQNPKFITANTTALDITKPELYMTARLSPLSLKYYGLCLYKGNYTVNLHFAEIMFTDDETYSSNGRRLFDVSIQGQKVLKDFNIAKEANGTGKEIIKSFTIMVDGTLEIHFYWAGKGTNSVPLRGVYGPLISAISVTPNFKIDTGENKLTIGTILAIVAAACIIVLLILCLIFLYIRRKNSKNNDVQQASYLVDCLKKLTPKPVVELYSMVNSICLLYPYVLMVMIYSPQSSSKLRGLELQTGQFSLRHIKAATKNFHPANKIGEGGFGPVYKGVLPDGSEIAVKQLSSKSKQGNREFVNEIGVISALQHPNLVKLYGCCIEGNQLLLIYEYMENNSLARGLHGPEGYQLRLDWQTRWKICLGIARGLAYLHEESRLKIVHRDIKATNILLDKDLNAKISDFGLAKLNEEENTHISTRIAGTLGYMAPEYAMRGYLTDKADVYSFGVVTLEIVSGMSNTKYRPEEDCVYLLDWAYVCHEKGNLLELVDPALGSSFSTEEALQMLKLALLCTNISPTLRPNMSAVVSMLEGKTPIELLSVQSSITKGDDLRFKAFEKLSRDSQTEINSTDWPWPDSSVSAQSTKGDTSLLH

SEQ ID NO: 2116 - protein, 828 aa, Escherichia coli
MKLSRRSFMKANAVAAAAAAAGLSVPGVARAVVGQQEAIKWDKAPCRFCGTGCGVLVGTQQGRVVACQGDPDAPVNRGLNCIKGYFLPKIMYGKDRLTQPLLRMKNGKYDKEGEFTPITWDQAFDVMEEKFKTALKEKGPESIGMFGSGQWTIWEGYAASKLFKAGFRSNNIDPNARHCMASAVVGFMRTFGMDEPMGCYDDIEQADAFVLWGANMAEMHPILWSRITNRRLSNQNVTVAVLSTYQHRSFELADNGIIFTPQSDLVILNYIANYIIQNNAINQDFFSKHVNLRKGATDIGYGLRPTHPLEKAAKNPGSDASEPMSFEDYKAFVAEYTLEKTAEMTGVPKDQLEQLAQLYADPNKKVISYWTMGFNQHTRGVWANNLVYNLHLLTGKISQPGCGPFSLTGQPSACGTAREVGTFAHRLPADMVVTNEKHRDICEKKWNIPSGTIPAKIGLHAVAQDRALKDGKLNVYWTMCTNNMQAGPNINEERMPGWRDPRNFIIVSDPYPTVSALAADLILPTAMWVEKEGAYGNAERRTQFWRQQVQAPGEAKSDLWQLVQFSRRFKTEEVWPEDLLAKKPELRGKTLYEVLYATPEVSKFPVSELAEDQLNDESRELGFYLQKGLFEEYAWFGRGHGHDLAPFDDYHKARGLRWPVVNGKETQWRYSEGNDPYVKAGEGYKFYGKPDGKAVIFALPFEPAAEAPDEEYDLWLSTGRVLEHWHTGSMTRRVPELHRAFPEAVLFIHPLDAKARDLRRGDKVKVVSRRGEVISIVETRGRNRPPQGLVYMPFFDAAQLVNKLTLDATDPLSKETDFKKCAVKLEKV

SEQ ID NO: 2117 - protein, 484 aa, Triticum aestivum
MEAQVSLPLMAMALLPLRRLIFLLCFFSALPRRCRFLAAEAAPTLVASLPGFDGPLPFRLETGYVTVDEQNGAELFYYFIESEGDPRSDPVIVWITGGDRCSVLSALLFEIGPLKLVGQPYNGTIPRLRYHPYAWTKVASILFVDSPVGAGFSFSRDPRGYDVGEISSSLQLKKFLTKWFTEHPDCLSNPFYVGGDSSGGKIVPFLAQKISEDIEAGVRPLINLKGYLVGNPATGEYNIDYGSRVPYLHGMGIISDQLYELIMEHCQGEDYSNPKNALCAQVLDRSNQLWNEISHPHILYKKCVYASSGPNDGSTERKILKEEVGVLKHPPPRPSMGCQTYGNYLSYFWANNNLTRKALGIKKGSKDEWVRCHERDLPYSLDIKSTIKYHRNMTLKGYRALVYSGDHDSVIPFLGTQSWVRSLNFPIVDEWRAWHLDGQSAGFTITYRNNLTFATVKNGGHTAPEFEPERCLAMFARWVSHESL

SEQ ID NO: 2118 - protein, 380 aa, Musa balbisiana
MDSVSPVTLDLNKEEGHCSNSAVVFDTSFLRRQAKIPESFVWPRSERPHPLEELEVPVVDLRGLFEGDEASISRAAEASRAACVRHGFFQVINHKVDAKVSGDALDAAGDFFKLPLSTKLRARRQPGSAWGYVGAHADRFASKLPWKETLTFGYDYGERGDGVVDYFTSKLGEGFEPMGRVYRRYCEAMKELSLSIMELLGISLGVGREYYRQFFEDGSSIMRCNSYPPCQEPELALGTGPHCDPTALTILLQDQVGGLQVFTEGKWQAVRPVRSAVVINIGDTFMALSNGRYKSCLHRAVVNSERERLSLAFFVCPRGDRVVRPPRELLLLLEEEEEAVPRAFPDFTWTELLEFTQTHYRADTTTLQSFSRHRFLASSP

SEQ ID NO: 2119 - protein, 353 aa, Kluyveromyces lactis
MDFDYENAKFSMPEKRIFDSQGTLDFQNSVAMVRIQYHLQKYITLCKGQQIPDTIKESFFTNIVVELLKRLSALIDETPPERMHSRYGNLSYRDWQTKFQNQLENWLHELLPEKYNNSIIELSYYISNAFGSKERIDYGTGHELSFLAVIICLDMLKIETIKGPALLYCFNSYYDVIQKLILTYKLEPAGSHGVWGLDDHFHFSYILGATQLLDVNTSLIPKDISNTRLMEQNSSSNLFCKSIRFINVVKSGPFSNHSPLLYNISRSVHTWHKMQQGLIKMYKVEVLNKFPVVQHFWFGTAFFPWTSYGNNHSLPIYQPAENNDDADFLTANNATTKMPPPLSTSTSRFIHRR

SEQ ID NO: 2120 - protein, 568 aa, Clostridium perfringens
MFCFQCQETAGCTGCTKFGVCGKSPDLARMQDLLIYTTKGLSEVTTRLREEGNKIDSKVNHLVTINLFTTITNANFDDEIFYERVKETLRVKESLLNTLKNKKNLSEAALWNASNKNEIDEKVSLLQKIKNAFSKKEEISIDSILDEKSTKVGVLATKDEDIRSLRELIIYGLKGMSAYMKHANALGYDKEEINAFMQSTLAKTLDDSLTIDELIALTLETGKVGVDGMALLDSANTGTYGHPEVTKVNIGVRKNPGILVSGHDLKDLEMLLKQTEGTGVDVYTHSEMLPAHYYPAFKKYSHFAGNYGNAWWKQKEEFESFNGPILMTTNCIVPPKDSYKDRLYTTGAAGFAGCTHIKGNSESDKDFSVIIEHAKKCKAPKQIETGEIIGGFAHNQVLALADKVVEAVKSGAIKRFFVMAGCDGRAKSRNYYTDFAKALPKDTVILTAGCAKYKYNKLPLGDINGIPRVLDAGQCNDSYSLALIALKLKEVFELEDINDLPISFNIAWYEQKAVIVLLSLLYLGVKNIHLGPTLPAFLSPNVAKVLVENFGIGGITNVEDDIKMFLNN

SEQ ID NO: 2121 - protein, 467 aa, Unknown
  Synechococcus sp. RS9917
MAAETGLTPGTTAPDTENLVIIGSGPAGYTAAIYAARANLSPLLITGFQRGGIPGGQLMTTTHVENFPGFPDGVLGPDLMDLMKAQAERWGTRLLEADADAIDLSRRPFRIEADGCSIQAQAVILATGASANRLGLPQEERFWSKGISACAICDGATPQFRNEELAVVGGGDSACEEAVYLTKYGSHVHLLVRSGQLRASAAMADRVQANPQISVHWHTEVADAEGDDWLASLRLRNRQSGEERQLPVRGLFYAIGHTPNTELVQGQLSCDAKGYLVTQPGRPETSLEGVYAAGDVADAEWRQGITAAGSGCQAALAAERWLSHHNLASLVSRDSVEPAQAATPQTSETTTEASYDPDALWQKGSYALRKLYHDSSKPLLVVYTSPSCGPCHVLKPQLKRVLDELGGRAQGLEIDIEADQEIAQQAGVNGTPTVQLFFGKELKQQWRGVKQRSEFRSAIEALLGAPV

SEQ ID NO: 2122 - protein, 501 aa, Tuber borchii
MQLSLLWKAPTVNPVNHKAQSVPILNPFDKYGRTFFFCTFGFMIAFLSWYAFPPLMGKTIKKDLHLSQTEVANSNVLALTATLVVRFLIGPLCDRFGPRLCFAGVLLAGAVPTALAGLVTNATGLLALRFFVGVLGATFVPCQVWSTGFFDKNVVGTANGIMAGIGNAGGGITYFVMPAVFDSLVHERGLTPHKAWRVPFVVPFILIVIMALGMIFLCEDTPTGAWADRHNFSPRTIEGKIVDATRNISDAPTTDKDAKGTSYTEKDKKNSDPESASSNGSIDLETVAQSEVIQAPTFKEAMQVIFSLTMSYARGTYACSFGGELAINSIWIFYMKNFLPCETKSGRWAAMFGLLNLFCRPAGGIIADIIYRHTKSVAAKKWWLVFIGSIEGVFCLAIGLVNPHHESTMFGLVAGLAFFMDASNGASFRIVPHVHPFANGILSGVVGASGNLGGVQFFSIIFRYNGVKYDRVIMIIGGICIGINLSISWIRPIPKGQIGGK

SEQ ID NO: 2123 - protein, 1144 aa, Saccharomyces cerevisiae
MSDISKLIGAIVGSDDPVIIEFVLNIINKSGNLQEFIRNIQKLDAGISYEDSIKMYNAFLGKQEEEKVRNKVKSSPLSQKINQVLKDDVNLDDPVVTEFVLSILNKSKSITEFQEQLNLMQSGLDNETIFKIYQIASPPVMKEEVSVLPSTKIPAKIEAKIEEEVQKIESLDPSPVLHKVYEGKVRNITTFGCFVQIFGTRMKNCDGLVHISEMSDQRTLDPHDVVRQGQHIFVEVIKIQNNGKISLSMKNIDQHSGEIRKRNTESVEDRGRSNDAHTSRNMKNKIKRRALTSPERWEIRQLIASGAASIDDYPELKDEIPINTSYLTAKRDDGSIVNGNTEKVDSKLEEQQRDETDEIDVELNTDDGPKFLKDQQVKGAKKYEMPKITKVPRGFMNRSAINGSNAIRDHREEKLRKKREIEQQIRKQQSFDDPTKNKKDSRNEIQMLKNQLIVTEWEKNRMNESISYGKRTSLPISAQRQTLPVYAMRSELIQAVRDNQFLVIVGETGSGKTTQITQYLDEEGFSNYGMIGCTQPRRVAVSVAKRVAEEVGCKVGHDVGYTIRFEDVTGPDTRIKYMTDGMLQREALLDPEMSKYSVIMLDEAHERTVATDVLFALLKKAAIKRPELKVIVTSATLNSAKFSEYFLNCPIINIPGKTFPVEVLYSQTPQMDYIEAALDCVIDIHINEGPGDILVFLTGQEEIDSCCEILYDRVKTLGDSIGELLILPVYSALPSEIQSKIFEPTPKGSRKVVFATNIAETSITIDGIYYVVDPGFAKINIYNARAGIEQLIVSPISQAQANQRKGRAGRTGPGKCYRLYTESAFYNEMLENTVPEIQRQNLSHTILMLKAMGINDLLKFDFMDPPPKNLMLNALTELYHLQSLDDEGKLTNLGKEMSLFPMDPTLSRSLLSSVDNQCSDEIVTIISMLSVQNVFYRPKDRQLEADSKKAKFHHPYGDHLTLLNVYTRWQQANYSEQYCKTNFLHFRHLKRARDVKSQISMIFKKIGLKLISCHSDPDLIRKTFVSGFFMNAAKRDSQVGYKTINGGTEVGIHPSSSLYGKEYEYVMYHSIVLTSREYMSQVTSIEPQWLLEVAPHFYKAGDAESQSRKKAKIIPLHNKFAKDQNSWRLSSIRQSRERALGIKR

SEQ ID NO: 2124 - protein, 163 aa, Brassica rapa
SPEEEDTPKLDLVTPLVFNPSMLNLQATIPNQFIWPDDEKPCLEAPELDVPLIDLQNFLAHSHSTLDASRLISEACYKHGFFLVVNHGISEQLTSDAHEYMSRFFDMPLSEKQRIQRKAGESCGYASSFTGRFSTKLPWKETLSFQFCDDKSRPKNVQDYFCD

SEQ ID NO: 2125 - protein, 277 aa, Synechococcus elongatus
MIDRDRVTAAIREAAAAGAELIVLPEIHGGYYFCQTEDPAQFDRAESIPGPSTDYYSAIARELSVVLILSLFERRAAGLYHNTAVVIERDGTIAGRYRKMHIPDDPAYYEKFYFTPGDLGFEPIQTSVGKLGVLVCWDQWYPEAARLMALAGAELLIYPTAIGWDPQDVPEEQQRQLEAWQTVQRGHAIANGIPVLSVNRVGFEPSPDPAAAGSQFWGSSFIAGPQGEWLAKAGDREPELLIADLDRDRSEQVRRIWPFLRDRRIDAYGDLVRRYRD

SEQ ID NO: 2126 - protein, 597 aa, Oryza sativa
MASSNETYRVELRAAARQLGERGLYSAAKWAAELLVGIEPDATPAPSSVMDTPSSSGSAASGGRLLHLHRSGGSSFRRRLRPGAAEAGTPLGGVSYVSTPIPDDDAFDVGGDRYLLAKTYFDCREYRRAAHVLRGQTGRKAVFLRCYALYTAGEKRKEEETVELEGSLGKSNAVNQELVALERELATHRRTGAIDSFCLYLYGIVLRDKGSEALARTVLVESVNSYPWNWSAWLELQSLCTSSDILNNLNIKNHWMKDFFLASAHLELKMHEEALKRYERLMGVFRCSDYIQAQIATVQYSMRDLDEADMIFEELLRTDPFRVDSMDVYSNLLYAKESSTALSFLAHRVFLTDKYRPESCCIIANYYSLKGQHEKSVLYFQRALKLNRKYLSAWTLMGHEFVELKNTPAAIDAYRRAVDINPRDYRAWYGLGQIYEMMGMPFYAVYYFRKSSYLQPNDARLWNAMAQCYESDQLQMIEEAIKCYERSANNNDTEGIALHQLAKLHGMLGQSEEAAFYYKKDLERMEVEERQGQNFVEALLFLAKHCKSIGRFEEAEHYCTRLLDYTGPERETAKSILQGLKRAQSVLPLMDIDHFAM

SEQ ID NO: 2127 - protein, 591 aa, Unknown
  Synechococcus sp. CC9311
MATSSLKPSVTASSTSPRLSLQSEVIAADSSTIRSLDWERSRFDIEFGLRNGTTYNAFLVRGERTALIDTSHAKFRDTWLPLLQEQIDPKQIDYLIVSHTEPDHSGLIGDLIDMNPEIEIIGSKVAIQFLKDQVHRPFSSRAVKSGEELDLGINPESGVQHRFEFLSAPNLHWPDTIFSFDHGSGILYTCDAFGLHYCSEDVFDSDPGAIAPDFRFYYDCLMGPNARSVLQALKRMDGLPEINTIAVGHGPLLRHHLSHWINDYREWSGKRNKGESYAAVCYLSQYGFCDRLSQAIAHGIGKTDAQVQLVDLRATDAQELTALISEAKAVVVPTWPANADAELQSSIGTLLAALHGKQLVGVYDAFGGDDEPIDSVAGQLRSQGQKEAFSPLRIRQLPQGGDYQRCEESGTDLGQFLTRAKTIAAMKSLDGDLDKALGRLSGGLYVVTASQGAGDSLRRSAMVASWVSQASFTPPGITVAVAKDRAIEALMQVGDQFVLNILREDNHQQLLRHFLKRFPPGADRFAGINVLESEAEGGPVLGDALAYLGCRVEQRMEGPDHWVIYAVVEQGNVADANAMTAVHHRKVGNHY

SEQ ID NO: 2128 - protein, 168 aa, Beta vulgaris
DYGWDTAGLSADPETFAKNRELEVIHCRWAMLGALGCVFPELLARNGVKFGEAVWFKAGSQIFSEGGLDYLGNPSLVHAQSILAIWACQVILMGAVEGYRVAGGPLGEVVDPLYPGGSFDPLGLADDPEAFAELKVKEIKNGRLAMSSMFGFFVQAIVLVKVHWRTSL

SEQ ID NO: 2129 - protein, 112 aa, Gloeobacter violaceus
MKKIEAIIRPFKLDEVKIALVNAGIIGMTVSEVRGFGRQKGQTERYRGSEYTVEFLQKLKIEVVVDDGLVDLVMDKIMVAARTGEIGDGKIFVSDVDRVVRIRTGERDDEAL

SEQ ID NO: 2130 - protein, 197 aa, Leptospira interrogans
MFNFKILIFIYIIFFSPNLMATPKTEKATFAGGCFWCMEGPFESLPGVISVVAGYSGGKEFYPTYQEVSRGKTGHRESVQIEFDSSKIRYEELLTVFWNQIDPTDNGGQFADRGNQYRTGIFYHNQTQKKAAEKSKREISESKKFPGSIVVEIIPFTSFYPAEDYHQNYYKTNSEQYKKYKKYSGREDYLEKMCRQR

SEQ ID NO: 2131 - protein, 271 aa, Bacillus halodurans
MKVALYQMDILPGDPRGNERKVKEWIEDVMQQEDVPDLLVLPEMWTTAYTLDQLEHLAEGEERYTELFLKELAREHNVNIVAGSIAKKEKGKLYNRALVFDRRGHTVYQYDKIHLVPMLSEPDYLTGGDAAASVFELEGTKMGLVICYDLRFPELMRSLALEGAEIVFIVAEWPEARAVHWEVLQRARAIENQSYVISCNRVGAYAGVTFAGRSMVIDPWGDVLIQGSRDQEQTLTTKLNPDKVSEVREAVPIFQSRVPTKYKPLHKEDVT

SEQ ID NO: 2132 - protein, 342 aa, Solanum lycopersicum
MECFSSLGWFCISNPSFIGLKSKKKYSLSRKCRSFNEVGSKCVRMSYTENESSGVSYKKLIHFALEETNTHTLLSPSPLQEKYSSLLSMDDKTELQMLSFEAHKIRLLRSLCIEGTDGMQVLDFAAFPKPEFDLPIFCANFFTTAKMNIIVLDLNPLHDIMDQEDYKEKYYKDLITLGLKYSKLLPWGGKLTSESLRFFSPIVIWTRFSSSPHNHSVLFSAFKDYYQAWLGLMDRSEGETDASQIACNCEAQHRYLTWRSEKDPGHGVLKRLIGEDLAKDVITKFLFNGVNELGNKTFLDYFPEYRCEDGKVNEKRSMIGKSFENRPWNARGEFIGDRVEIV

SEQ ID NO: 2133 - protein, 504 aa, Desulfitobacterium hafniense
MDKGYVYLVGAGPGDPKLITVKGAECIAKADVLIYDRLASRRLLTLARPDCELIYVGKSPDRHTLRQEEINALLVQKGLEGKIVTRLKGGDPFVFGRGGEEAEDLLQAGIPFDIVPGVTSAISVPAYAGIPVTHRDLTSSFAVITGHEDPTKNSSALAWEHLATAHGTLIFLMGMENLSLIATKLMENGRSPSTPVGIIQWGTRPEQRVLVGELQNIAQLVKEEGFTNPSIIIVGEVVQLREKLQWFEKRPLFGQRIIVTRARHQASALSQGIEDLGGEPWEFPAIEIVPPRDPQPLIQAIKNLKRFEWLIFTSVNGVEEFFKVLMEQGRDVRDLAGMDVVAIGPATRDALEKRCLKVSFVPEEYRAEKIIEGLASRVLPGQSVLLARAEEARDILPESLKALGADVWDVPTYRTVLGNANKEELLKLLEEKAVSAVTFTSSSTVRNFLQLIDGRQSLLDGVKLYSIGPITSKTAQEFGLSIYREAKQYTIKGLLETLARGNEE

SEQ ID NO: 2134 - protein, 458 aa, Oryza sativa
MYDDNGAADLPTSQSASIKTIVCVPFIMHGVLELGTTDPVSEDPALVDRITASLWDTPPRAAFSSEAGVADIVVFEDLDHGNTAVEATTTMVPGEPEPHAVAGGEVAECESNAHNDLEQITMDDIGELYSLCEELDVLDDDSSSWVADPWSSFQLVPTAEATDVDDAVVAALGAIDGSCRPSPSSFVAWKRTPDSDEVQAVPLISGEPPQKLLKKAVAGAGAWMNNADGSAATMTTDQGSSIKNHVMSERRRREKLKEMFLILKSVVPSIHKVDKASILAETIAYLKELEKRVEELESSSQPSPRPMETTRRRCCKSTGKKVSAGARAKRKAPAPEDTDGERRHCVSNVNVTIMDNKELLLELQCQWKELLMTRVFDAIKGVSLDVLSVQASTSDGLLGLKIQAKVVVSAAKSSQQICSIVYLSIYQSLYLRLFGVLILAILLLHACSLPHLLPSNLG

SEQ ID NO: 2135 - protein, 223 aa, Unknown
  Silicibacter sp. TM1040
MGRLDTLKHFTLAALIIVGVLTKGSALRAQTQDTLIVAGGCFWCVESDFESVRGVSEAISGYTGGTTENPTYKQIGSGRTGHYEAVKILFDPTIVSRESLLDLFFRSIDPTDTGGQFCDRGAPYRTAVFVSNEDEKAIAQAVKAEAEAELGQQIVTPILEASPFYEAEAYHQDYYKGEGLVLTRFGPLRQSKAYVRYRKACGRDARIAELWGRDAPFIGSYGF

SEQ ID NO: 2136 - protein, 546 aa, Clostridium perfringens
MFCYQCEQTVGGKGCTKRGVCGKTPEIANLQDLLIYQLKGISCYAKEILDKGGNIDQEVVKFVENGLFTTLTNVNFDPEVHINLLKKSQKIKEKLRKIAPKGEYPEHAIYNLSDSKDEMLKDAIKAGIMYDDSLDQDIRSLRSTILYGLKGIAAYGHQARFINFIDKEVDNFYFKALEATTNDKLSSEDLIELTMKTGNIAIAVMKLLDDANTSKYKNPTPHKVNVTLKKGPFIIVSGHDLRDLEMLLEQSEGKGINIYTHGEMLPAHGYDGLKKYKHLVGNFGSAWQNQQKEFDDIPGCILMTTNCLMQPRESYKDRIYSTSVVGWEGIKHIKADENGYKDFSEIINKALELGGYDEDEECKEILVGFGHKATLSNAEKIVSAVNEGNIKHFFVIGGCDGARPGRNYYTDFAKLVPKDCIILTLACGKYRFNKLEFGEVAGLPRLLDIGQCNDLYSAVKIATSLADAFDTNVNSLPLSIILSWYEQKAVADLLALLALGIRGIYLGPSLPAFLSPNVLQYLVDNFDLKPISTPDEDLKSCLRQNL

SEQ ID NO: 2137 - protein, 99 aa, Brassica napus
  misc_feature (24)..(24): Xaa can be any naturally occurring amino acid
  misc_feature (47)..(47): Xaa can be any naturally occurring amino acid
MCLRELLITCHAWSPNLSSASFFXFANNEVHSYKSSQDQWERLHVLXKDWSSKSNKIVTVSHDRNSYVWNLEGDEWIPTLIILRLSRAAFCVRWSPKGK

SEQ ID NO: 2138 - protein, 84 aa, Staurastrum punctulatum
MEKERKSMRKQNLIEMEGIVTESLPNAMFRVCLDNGCQVLAHISGKIRKNYIRILLGDRVKVELSPYDLTKGRITYRLRTRSPS

SEQ ID NO: 2139 - protein, 301 aa, Musa balbisiana
MESDSIECVSSIDGIDEEATSLPHHSSKSHGAAAPPAGIVPSTSVHELLECPCQNGHTLCSTCKTRVHNRCPTCRQELGDIRCLALEKVAESLELPCKYYSLGCPEIFPYYSKLKHESQCNYRPYSCPYAGSECSVVGDIPCLVTHLRDDHKVDMHTGCTFNHRYVKSNPREVENATWMLTVFNCFGQYFCLHFEAFQLGMAPVYMAFLRFMGDENEARNFSYSLEVGANGRKLIWEGTPRSIRDTHRKVRDSHDGLIIQRNMALFFSGGERKELKLRVTGRIWKEQQNNDAGVCMPNLCS

SEQ ID NO: 2140 - protein, 304 aa, Agrobacterium tumefaciens
MTRQMILAVGQQGPIARAETREQVVGRLLDMLTNAASRGVNFIVFPELALTTFFPRWHFTDEAELDSFYETEMPGPVVRPLFETAAELGIGFNLGYAELVVEGGVKRRFNTSILVDKSGKIVGKYRKIHLPGHKEYEAYRPFQHLEKRYFEPGDLGFPVYDVDAAKMGMFICNDRRWPETWRVMGLKGAEIICGGYNTPTHNPPVPQHDHLTSFHHLLSMQAGSYQNGAWSAAAGKVGMEEGCMLLGHSCIVAPTGEIVALTTTLEDEVITAALDLDRCRELREHIFNFKAHRQPQHYGLIAEF

SEQ ID NO: 2141 - protein, 267 aa, Musa balbisiana
MAATMALSSPSLAGKAVKLAPSASDVLGEGRVTMRKSTAKAKPAAASGSPWYGPDRVKYLGPFSGEPPSYLTGEFPGDYGWDTAGLSADPETFAKNRELEVIHCRWAMLGALGCVFPELLARNGVKFGEAVWFKAGAQIFSEGGLDYLGNPSLIHAQSILAIWACQVILMGAVEGYRIAGGPLGEVTDPLYPGGSFDPLGLADDPEAFAELKVKEIKNGRLAMFSMFGFFVQAIVTGKGPLENLADHLADPVNNNAWAYATNFVPGK

SEQ ID NO: 2142 - protein, 174 aa, Clostridium perfringens
MEDKNRNLLISENQIKEQIAIVGKKITEDYKDKNLYVLSLLRGSFIFTADLVRTIDTKTQIGFMTTSSYGHGEESTGIVKVVNDIPDNIEGLDVLIVDDIIDSGITMDFVINHVKSLGAKSVKTCTLLDKPSRRKVDLKPDYCCFEIEDLFVVGYGLNYGDHYRNIPYIFNWEK

SEQ ID NO: 2143 - protein, 618 aa, Chromobacterium violaceum
MCGIAGFFSRRPVNPAVPQAMLDELHRRGPDDASRLLLDSELNPADGGAIHNAMLHARLAIVDPRPVANQPMASDDGQVWICYNGEVYDWEIGKAELEAGGAVFRTHSDTEFILRGYQAWGIEGLLERLRGMFAFAILDKRCEKVHLARDRMGEKPLLYSLQDGDFAYGSLVRAVLPFLPADKRAFSPAAIDAYLAHRYIPSPATVFSHINRLENGYRLEFDLNTRQLTKQRYWQPKAESGDWLPELDRAVAMRTVADRPLGVLLSGGIDSTVIASRLAIQQLTQFSSFTAAFPGSTLDESGDAADSARRMGLPNVRVDMPENLAADFERIVADLDQPFADPSSFPTWYLAREVTKHVKVVLVGDGGDELLAGYKRMGKHLRTRWRQNIRLPLPIKPQLDSKRGKLATELAMDWKSAYSLRFSGFTPGQRSFLQGGRKLEKLCHWRAPDDIGPEPGDGSPGLHQLLELDFANYLPDYILQKSDLCTMAHGLEGRAPLLDHGFYQRLLSTSAAERYTRPAKLIFRRAIHPALPTDFFQRKKRGFNPPLSGWLKTSLAPRFDGLGSRLAEASGGQLDAGAVDAFARAYRDGAGHLAEQMLQLLILDESLTQLRRLCRELG

SEQ ID NO: 2144 - protein, 287 aa, Oryza sativa
MEAAAIHAPTTTTSSDSGSCVTNGTREKREISKHKQLKRKRSTSPAPPPGCGGGQGQEAAVETDADAGAAGEEESSSCGGAGAGEGERKRGDAGRHPSYRGVRRRSWGKWVSEIREPRKKSRIWLGTFPTAEMAARAHDVAALAIKGRAAHLNFPSLAHTLPRPASTSPSDIQAAAALAAAAAATDQCESSSSAVAAATATDAEAAESTSSAAASPCAATSSVEENALFDLPDLLLDLSDGLWCSPVWTTAPADQYDAGDDGDDAAAPLLWAEQCWMDAPAAPVQPD

SEQ ID NO: 2145 - protein, 294 aa, Saccharomyces cerevisiae
MKTLVHVASVEKGRSYEDFQKVYNAIALKLREDDEYDNYIGYGPVLVRLAWHISGTWDKHDNTGGSYGGTYRFKKEFNDPSNAGLQNGFKFLEPIHKEFPWISSGDLFSLGGVTAVQEMQGPKIPWRCGRVDTPEDTTPDNGRLPDMDKDAGYVRTFFQRLNMNDREVVALMGAHALGKTHLKNSGYEGPWGAANNVFTNEFYLNLLNEDWKLEKNDANNEQWDSKSGYMMLPTDYSLIQDPKYLSIVKEYANDQDKFFKDFSKAFEKLLENGITFPKDAPSPFIFKTLEEQGL

SEQ ID NO: 2146 - protein, 177 aa, Unknown
  Candidatus Desulfococcus oleovorans Hxd3
MSMPELVPVLSAQQVEEIVVALGQRISSDFGEKGGVAVCVLKGAFVFFADLIRTLTIPVEVDFVGVASYGAQTESSGNIELTKPIESDITGRQVLVVEDIVDTGATARFLLDYLGGFEPARINLCAFLDKRERRNHAVRVDYSGHVVRDGFLVGYGLDWNGCYRNLKGIHRLEQNNP

SEQ ID NO: 2147 - protein, 138 aa, Arabidopsis thaliana
  misc_feature (5)..(5): Xaa can be any naturally occurring amino acid
  misc_feature (30)..(31): Xaa can be any naturally occurring amino acid
  misc_feature (34)..(34): Xaa can be any naturally occurring amino acid
  misc_feature (42)..(42): Xaa can be any naturally occurring amino acid
  misc_feature (46)..(47): Xaa can be any naturally occurring amino acid
  misc_feature (50)..(52): Xaa can be any naturally occurring amino acid
  misc_feature (58)..(58): Xaa can be any naturally occurring amino acid
  misc_feature (60)..(61): Xaa can be any naturally occurring amino acid
  misc_feature (66)..(66): Xaa can be any naturally occurring amino acid
  misc_feature (69)..(69): Xaa can be any naturally occurring amino acid
  misc_feature (72)..(72): Xaa can be any naturally occurring amino acid
  misc_feature (79)..(80): Xaa can be any naturally occurring amino acid
  misc_feature (84)..(84): Xaa can be any naturally occurring amino acid
  misc_feature (89)..(90): Xaa can be any naturally occurring amino acid
  misc_feature (95)..(96): Xaa can be any naturally occurring amino acid
  misc_feature (98)..(99): Xaa can be any naturally occurring amino acid
  misc_feature (101)..(102): Xaa can be any naturally occurring amino acid
  misc_feature (107)..(108): Xaa can be any naturally occurring amino acid
  misc_feature (111)..(113): Xaa can be any naturally occurring amino acid
  misc_feature (115)..(116): Xaa can be any naturally occurring amino acid
  misc_feature (118)..(122): Xaa can be any naturally occurring amino acid
  misc_feature (124)..(133): Xaa can be any naturally occurring amino acid
  misc_feature (136)..(136): Xaa can be any naturally occurring amino acid
RRTMXSSMLSSATMVASPAQAIMVAPFNGXXSSXAFPATRKXNNDXXSFXXXGGRVNXLXXWPPIXKEXFLXFFFYFFXXTDSXWGGGXXLLYPXXLXXLXXIFLLXXVFXXXWXXNXXXXXLXXXXXXXXXXSFXWL

SEQ ID NO: 2148 - protein, 263 aa, Unknown
  Mycobacterium sp. CH-1
MSAVKAGDRRVAIVTAAAAGIGKAIALRWCREGGCCVMADTDGEGLDAAVAELAESGAAVCGVAGDVCLSDVANSVVERALTEFGRLDTLFNVVGGSLARNVEEISEEQWRSQIDMNLGSVFQMSKPVIPLLRQGGGGSIVNVASTAGILAENRCSAYSASKGGVVLLTKNMALDFARDNIRVNAIAPGGTRTPRIERFLAEHPEHASMMVDLCAMQRFAGPDEIAAPAVFLASPEASYITGAVLPVDGGMTAGVTFRAFEAV

SEQ ID NO: 2149 - protein, 148 aa, Medicago truncatula
MATTTAALSGTMVSTSFIRRQPMNTSLTAFPNVGQTLFGVKAGRGSRITAMATYKVKLITPDGTKELTCPDNEYILDVAEEQGIDLPYSCRAGACSSCAAKVVEGEVDNSDNSFLDDDQLSAGFVLTCVAYPRSDLVIETHKEEDLVS

SEQ ID NO: 2150 - protein, 454 aa, Medicago truncatula
MDPCPFVRLTIGNLALKIPVASKPARSVVHPSSSPCFCKIKLKNFPLQTALVPFIPHENNSPDSQIQPIAASFHLSKADLDRLTGKSIFAKKLTLKIAIYTGRSGTTCGVNSGRLLGKVSVPLNLTGTLTKATVFHNGWITVGKDDKGGSAQFHLNVKAEPDPRFVFQFDGEPECSPQVFQIQGNISQPVFTCKFSFRNNSGDRNQRSRSMQSEVGASRSWLSSFGSERERTGKERKGWSITVHDLSGSPVAAASMVTPFVASPGSDRVSCSNPGSWLILRPGDGTWKPWGRLEAWRERGGSDGLGYRFELMPDTNGSMSAGGIVIAESTLSLTRGGKFVLDLSSRCGGGGGSNGRATPGNATSPVCSPRGSGDYGYGLWPYCMYRGFVMSASVEGEGRCSKPTVEVSVPHVNCTEDAAAFVALAAAVDLSVDACRLFSQRLRKELCQQMDLVG

SEQ ID NO: 2151 - protein, 319 aa, Saccharomyces cerevisiae
MVHNKVTIIGSGPAAHTVAIYLARAEIKPILYEGMMANGIAAGGQLTTTTEIENFPGFPDGLTGSELMDRMREQSTKFGTEIITETVSKVDLSSKPFKLWAEFNEDAEPVATDAIILATGASAKRMHLPGEETYWQKGISACAVCDGAVPIFRNKPLAVIGGGDSACEEAQFLTKYGSKCLCLSEKTICVLLPLCKKRAEKNEKIEILYNTVALEAKGDGKLLNALRIKNTKKNEETDLPVSGLFYAIGHTPATKIVAGQVDTDEAGYIKTVPGSSLTSVPGFFAAGDVQDSKYRQAITSAGSGCMAALDAEKYLTSLE

SEQ ID NO: 2152 - protein, 481 aa, Pinus taeda
MADQISLLLVVFTAAVALLHLIYRWWNAQRGQKRTSNEKNQELHLPPGSTGWPLIGETYSYYRSMTSNRPRQFIDDREKRYDSDVFVSHLFGSQAVISSDPQFNKYVLQNEGRFFQAHYPKALKALIGDYGLLSVHGDLQRKLHGIAVNLLRFERLKFDFMEEIQNLVHSTLDRWVDKKEIALQNECHQMVLNLMAKQLLDLSPSKETNEICELFVDYTNAVIAIPIKIPGSTYAKGLKARELLIRKISNMIKERRDHPHIVHKDLLTKLLEEDSISDEIICDFILFLLFAGHETSSRAMTFAIKFLTTCPKALTQMKEEHDAILKAKGGHKKLEWDDYKSMKFTQCVINETLRLGNFGPGVFRETKEDTKVKDCLIPKGWVVFAFLTATHLDEKFHNEALTFNPWRWELDQDVSNNHLFSPFGGGARLCPGSHLARLELALFLHIFITRFRWEALADEHPSYFPLPYLAKGFPMRLYNRE

SEQ ID NO: 2153 - protein, 487 aa, Pinus taeda
MGSGIMTETLTDSWLVGLLCLVLGFLLLQLYKLVWGASSRAYKLPPGSTGWPLIGETISFFRGINSTAQPRQFIQEREQRYGEIFRSNLFGRSRIVVSVDPEFNKHVLQHEGRQFQANYPKPLRNLIGKYGLLSVHGDLQRKLHGAAVNLLRFERLSVDFMEDIQNLLHITLAKWEAKRDIHLQEECHQLVLNLMAKQLLDLSPSKDTEEICEAFGHFSEALLAVPIKIPGTKYARGFKAREFLIKKIYESIEDRRQHPEAVHNDLLTKLLKEDSFSEEIIADFILFLLFAGHETSSRSMSFAIKFLTDCPRALEELKAEHDALLKRKGNLKNQKLNWDDYQSLKFTQCVIHETLRVGNFGPGVFRETKEDIKTKGGFVIPRGWTVYVFLTGTHLDEKYHSSALKFDPWRWQPHLQDQELLKNPSFMPFGGGARLCPGMHLAKMELALFLHNFVTKFRWEALQDDKISYFPFPRLIKGLPIRLRLRE

SEQ ID NO: 2154 - protein, 121 aa, Zea mays
MFLHIAACNVPQGNSSDQQVQHPPLSSALVISLSTGVSLFLGRFVFFNFQRENVAKQVPAQNGKTHFDAGDERAKEFAALLKSNDPVGFNLVDVLAWGSLGHIVAYYILATSSNGYDPNFF

SEQ ID NO: 2155 - protein, 361 aa, Daucus carota
MSSEVSAIGFEGFEKRLEISFFEPSFFADPEGKGLRVLSKNQLDEFLGPAECTIVASLSNEHVDSYVLSESSLFVYAYKIIIKTCGTTKLLKSIPPILKLADSLSLTVRSVRYTRGCFIFPGAQSYPHRSFSEEVSVLDNYFGKLGSGSKAYIMGGSDKQQKWHVYSACAASTRTLDPVYTMEMCMTSLNRDKASVFYKTNSSSATSMTDNSGIRDILPNSRICDFEFDPCGYSMNAVEGPAVSTIHITPEDGFSYSSFEAVGYDPKSVNLSDLVARVLNCFQPGEFSIALQADIASELLEKTSSVHVKGYRVEEKTCEELGMDGSIVYQKFVKTTERCESPRSVLKCCWKEEEKEEKEYQ

SEQ ID NO: 2156 - protein, 457 aa, Staphylococcus aureus
MAIAVLLNRMFRMEHNPLFEYIYQQKEDIDACYFIIPEEDMSSASDLKAQFYRGTLQRFYQSLHAEKLTPYVMSYDDIISFCKENNISEVVTAGDIMSYHLEEYDILHQRSLFNEARIAVTLIRGNHYFKASKTMNQQGEPYKVFTSFYKKWRPYLRHRDVYHYDLKSFEDFVIASPDDLVFDDIAFGSSQIIEQNKWQHFLDQDIQNYESGRDYLPEVLTSQLSVALAYGLLDIIEIFNDLLARYDEDEANYEAFIRELIFREFYYVLMTQYPETSYQAFKPKYRQIKWSQNEADFNAWCEGQTGFPIIDAAIMELTQTGFMHNRMRMVVSQFLTKDLFIDWTWGEKFFRKHLIDYDAASNIHGWQWSASTGTDAVPYFRMFNPIRQSERFDAKALYIKTYLPIFNQIDAKYLHDTQRNESNLFEQGIELGSHYPRQMVDHQEKRTQVLATFKALD

SEQ ID NO: 2157 - protein, 134 aa, Streptomyces avermitilis
MNEIRRGTLQEQTFYEQVGGEETFRRLVHRFYEGVAGDPLLKPMYPEEDLGPAEERFTLFLIQYWGGPTTYSEQRGHPRLRMRHAPFAVDRAAHDAWLKHMRVAVDELGLSEEHEHTLWNYLTYAAASMVNTES

SEQ ID NO: 2158 - protein, 814 aa, Xanthobacter autotrophicus
MQKLVVIGAGMASGRVLEHLFETDPDAYQVTLFNAEPRGNYNRIMLSPVLSGEKSYEEIVIHDDAWYVRHNVICRFGERVLEVDRARKVVVGPKGEIAYDKLLIATGSVPFIVPVDGHKLPGVISYRDLDDTNAMVEAAGVPGARAVVIGGGLLGLEAAAGLRLRGMEVTVVHLAGHLMERQLDEAAGYLLSKDLERRGIAVITRASTKAIVGTERVEGVQLEDGTLLPADLVVMAVGIRPAADLAKQSGLDVGRAVRVNAQMQTSDPDIYAVGECVEFEGTLFGLVAPLYDQAKVVAKSLLGEADAFAVKELSTKLKVTGCDLFSAGSFADGAGREDIVLRDPARGIYKRLVIEDDRLVGAVMYGDTSDSNWFFGLIRDGVKIADMRDTLIFGPSFQGGTPLDPMAAVAALPDEAEICGCNGVCKGTITAAIAAKGLTSLDDVRAHTKASASCGSCTGLVEQIMQISLGDSYTAAAVQPICSCTTLGHDDVRRLIKAKSLKTIPQVMQELEWKTSCGCAKCRPALNYYLVCDWPDEYADDYQSRFVNERIHANIQKDGTYSVVPRMWGGVTSSSELRAIADVVDKFAIPAVKVTGGQRIDMLGIKKEDLPAVWADLGKAGFVSGQAYAKGLRTVKTCVGTDWCRFGTQDSTGLGIRIEKFMWGSWTPAKLKMAVSGCPRNCAEATCKDIGVICVDSGYEIHFAGAAGLDIKGTEVLGLVKSEDEALEHIVALTQMYREQGRYLERIYKWAKRIGLAEIRQQIMEDHDKRRAYYDRFVFSQKFAQVDPWSERVSGKDKHEFRPMAELDITQAAE

SEQ ID NO: 2159 - protein, 873 aa, Aspergillus nidulans
MSTTVTQVRTGSIPKTLKTSQIRVEEQEITELDTADIPLPPPSKEPTEVLSLDKTTPDSHVPRDPRLIRLTGVHPFNVEPPLTALFQQGFLTPPELFYVRNHGPVPHVRDEDIPNWELRIEGLVEKPITLSFKQILQNYDQITAPITLVCAGNRRKEQNTVRKSKGFSWGSAALSTALFTGPMMADIIKSAKPLRRAKYVCMEGADNLPNGNYGTSIKLNWAMDPNRGIMLAHKMNGEDLRPDHGRPLRAVVPGQIGGRSVKWLKKLIITDAPSDNWYHIYDNRVLPTMVTPDMSSQNPSWWRDERYAIYDLNVNSAAVYPQHKETLDLAAARPFYTAKGYAYAGGGRRITRVEISLDKGKSWRLARIEYAEDKYRDFEGTLYGGRVDMAWREACFCWSFWSLDIPVSELASSDALLVRAMDEALSLQPKDMYWSVLGMMNNPWFRVKITNENGRLLFEHPTDITGSSGWMEQIKKAGGDLTNGNWGERQEGEEPVEAEPVVEVNMKKEGVTRIIDLEEFKKNSSDERPWFVVNGEVYDGTAFLEGHPGGAQSIISAAGTDASEEFLEIHSETAKKMMPDYHIGTLDKASLEALRKGNADTTDSSSDPRPTFLTPKAWTKATLTKKTSVSSDTHIFTLSLEHPSQALGLPTGQHLMLKTPDPKSSSSGSIIRSYTPISPSDQLGMVDILIKIYAETPSIPGGKMTTALDTLPLGSVIECKGPTGRFEYLDRGRVLISGKERFVKSFVMICGGTGITPVFQVLRAVMQDEQDETKCVMLDGNRLEEDILLKNELDEFEALAGKKEKCKIVHTLTKGSESWTGRRGRIDEELIRQHAGTPDRETMVLVCGPEAMEKASKKILLSLGWKEENLHYF

SEQ ID NO: 2160 - protein, 416 aa, Flaveria trinervia
MCHRHLASLSITLTPRRLHHQRLSSPASIRCSVTSSDQIQAPLPAKQKPECFGVFCLTYDLKAEEETKSWKKIINVAVSGAAGMISNHLLFKLASGEVFGPDQPISLKLLGSERSFAALEGVAMELEDSLYPLLRQVSIGIDPYEIFQDAEWALLIGAKPRGPGMERADLLDINGQIFAEQGKALNAVASPNVKVMVVGNPCNTNALICLKNAPNIPPKNFHALTRLDENRAKCQLALKAGVFYDKVSNVTIWGNHSTTQVPDFLNAKIHGIPVTEVIRDRKWLEDEFTNMVQTRGGVLIKKWGRSSAASTAVSIVDAIRSLVTPTPEGDWFSTGVYTNGNPYGIAEDIVFSMPCRSKGDGDYEFVKDVIFDDYLSKKIKKSEDELLAEKKCVAHLTGEGIAVCDLPEDTMLPGEM

SEQ ID NO: 2161 - protein, 1104 aa, Aspergillus nidulans
MPLLDGPRNGETVTASAHNGIPIIDGVDPSTLRGDIDQDPNRRQKIVVVGLGMVAVAFIEKLVKLDSERRKYDIVVIGEEPHIAYNRVGLSSYFEHRKIEDLYLNPKEWYGSFKDRSFDYYLNTRVTDVFPQHKTVKTSTGDIVSYDILVLATGSDAVLPTSTPGHDAKGIFVYRTISDLERLMEFAANHKGQTGVTVGGGLLGLEAAKAMTDLEDFGSVKLIDRNKWVLARQLDGDAGSLVTKKIRDLGLEVLHEKRVAKIHTDDDNNVTGILFEDGQELDCCCICFAIGIRPRDELGGSTGIQCAKRGGFVIDESLRTSVNDIYAIGECASWENQTFGIIAPGIEMADVLSFNLTNPDKEPKRFNRPDLSTKLKLLGVDVASFGDFFADRDGPKFLPGQRPSAESIGAADPNREEEPQVKALTYRDPFGGVYKKYLFTMDGKYLLGGMMIGDTKDYVKLNQMVKSQKPLEVPPSEFILGAQSGGEENADDLDDSTQICSCHNVTKGDVVESVKSGTCKTIADVKSCTKAGTGCGGCMPLVQSIFNKTMLDMGQEVSNNLCVHIPYSRADLYNVIAIRQLRTFDDVMKSAGKCPDSLGCEICKPAIASILSSLFNPHLMDKEYHELQETNDRFLANIQRNGTFSVVPRVPGGEITADKLIAIGQVAKKYNLYCKITGGQRIDMFGARKQDLLDIWTELVDAGMESGHAYAKSLRTVKSCVGTTWCRFGVGDSVGMAIRLEQRYKSIRAPHKFKGAVSGCVRECAEAQNKDFGLIATEKGFNIFVGGNGGAKPRHSELLAKDVPPEEVIPILDRYVIFYIRTADKLQRTARWLESLPGGIEYLKDVVLNDKLGIAAEMERQMQELVDSYFCEWTETVRNPKRRKYFQQFANTDETVENVEIVKEREQVRPTYWPKDGANEDFKGHQWSSLSWQPVIKADYFSDGPPAISSANIKRGDTQLAIFKVKGKYYATQQMCPHKRTFVLSDGLIGDDDNGKYWVSCPYHKRNFELNGEQAGRCQNDEAMNIATFPVEEREDGWIYMKLPPVEELDSVLGTEKWKVKKGEAVDPFEAYDKKYSGMKGKRAGAKGIEGSKPTRSPSNTIDW

SEQ ID NO: 2162 - protein, 897 aa, Xanthobacter autotrophicus
MATGAAHDVKTTCPYCGVGCGVIATVTPDGSVSVSGDPEHPANFGRLCSKGSALAETIDLDGRLLRPHIDGRPADWDEALDLVAARFASTIAEHGPDSVAFYVSGQLLTEDYYVANKLMKGFIGSANIDTNSRLCMASSVAGHRRAFGTDTVPGNYEDLELADLIVLVGSNLAWCHPVLYQRIAAEKERRPSLKIVVIDPRRTMTADIADMHLAISPDGDVALFGGLLSWIANTGALNYSYISNFTTGAAQALRFGAQDLRAVSRKCGIAPSQLIEFYSLFTRTERTVTVYSQGVNQSETGTDKVNAIINCHLATGRIGKPGASPFSVTGQPNAMGGREVGGMANMLAAHMDIENETHRARVQRFWQAPTVATRPGRKAVEMFEAIGQGHIKAVWIAGTNPVDSMPEADRVRAALAACPFVVVSDVLADTDTTRVAHVLLPAAAWGEKDGTVTNSERRISRQRPFLPLPGSARPDWDIMADVARRMGFAEGFSYTTAAEVFAEHAALSAFENDGERDFDIGAHAGIDAVGYEALAPFQWPQRRGAVTGTERFFAAGGFFTPEGKGRFVAPREARAGTGPLARLPAQEPTDQGFILNTGRVRDHWHTMTRTGKSPRLSQHMAEPFVEIHPDDAVQSGIAEASLVRLSKGPAQAIARALITNRQRRGSVFVPMHWNDRFASNARIDALVDAVTDPVSGQPALKQARASLASFNAAAYGFAVVARKPADIPADYWAIARCTGGWRLELAFGQAKDDWHAFALRLFGGGEHVDILAYNDVGAGRYRIAAFDGAALLGALFIAPQPVGVARGWLVEQLATSHDLQRQRLAVLATRPSAGQSDKGAIVCSCFGVGSNEIAAAIASGCRTVKAVGDATQAGTNCGSCRAEIKGIIDAKHLQAAE

SEQ ID NO: 2163 - protein, 490 aa, Xanthobacter autotrophicus
MRNISRQPSDQDAARIRPLTVLPVFLDLAGKRAVVAGGSAAACWKAELLLSAGAKVFVHASDEDLCEDFAKLIERHGPAALHHGRSWDRTDLAGAAVAICDARDEQEAAAFAAAAAAAGVPCNVIDQSAFCSFQFGAIVNRSPVVIGISTTGAAPILGQAIRRRIETLLMPPLAEWAALAARIRGRVAATLNPGAERRRFWERLAERAFGDAPGPQVEQELFEEARTVGASRASAGRVTLVGAGPGEAELLTLKAVRALQSADVILFDDLVSDEVLELARREAKRIQVGKRGGRPSCRQEDINALMLTLAKAGRHVVRLKSGDPMIFGRAGEEIAMLEAAGIPVAIVPGISAGVALASALRMSLTHRDHAKSVRFVTGHSRNGGLPEDLDWRSIADPSATTIFYMGGRNAGQIADRLISLGVPASMPVAVGAGLGRREQQLRIADLATLGEAVNQMNSDQPIVIGVGRAFAQHRATGLERDPPLPVAATG

SEQ ID NO: 2164 - protein, 507 aa, Aspergillus nidulans
MDFAKLLVASPEVNPNNRKALTIPVLNPFNTYGRVFFFSWFGFMLAFLSWYAFPPLLTVTIRDDLDMSQTQIANSNIIALLATLLVRLICGPLCDRFGPRLVFIGLLLVGSIPTAMAGLVTSPQGLIALRFFIGILGGTFVPCQVWCTGFFDKSIVGTANSLAAGLGNAGGGITYFVMPAIFDSLIRDQGLPAHKAWRVAYIVPFILIVAAALGMLFTCDDTPTGKWSERHIWMKEDTQTASKGNIVDLSSGAQSSRPSGPPSIIAYAIPDVEKKGTETPLEPQSQAIGQFDAFRANAVASPSRKEAFNVIFSLATMAVAVPYACSFGSELAINSILGDYYDKNFPYMGQTQTGKWAAMFGFLNIVCRPAGGFLADFLYRKTNTPWAKKLLLSFLGVVMGAFMIAMGFSDPKSEATMFGLTAGLAFFLESCNGAIFSLVPHVHPYANGIVSGMVGGFGNLGGIIFAIIFRYSHHDYARGIWILGVISMAVFISVSWVRPVPKSQMRE

SEQ ID NO: 2165 - protein, 441 aa, Arabidopsis thaliana
MAELSTPKTTSPFLNSSSRLRLSSKLHLSNHFRHLLLPPLHTTTPNSKISCSVSQNSQAPVAVQENGLVKTKKECYGVFCLTYDLKAEEETRSWKKLINIAVSGAAGMISNHLLFKLASGEVFGPDQPIALKLLGSERSIQALEGVAMELEDSLFPLLREVDIGTDPNEVFQDVEWAILIGAKPRGPGMERADLLDINGQIFAEQGKALNKAASPNVKVLVVGNPCNTNALICLKNAPNIPAKNFHALTRLDENRAKCQLALKAGVFYDKVSNMTIWGNHSTTQVPDFLNARINGLPVKEVITDHKWLEEGFTESVQKRGGLLIQKWGRSSAASTAVSIVDAIKSLVTPTPEGDWFSTGVYTDGNPYGIEEGLVFSMLCRSKGDGDYELVKDVEIDDYLRQRIAKSEAELLAEKRCVAHLTGEGIAYCDLGPVDTMLPGEV

SEQ ID NO: 2166 - protein, 464 aa, Carboxydothermus hydrogenoformans
MVETEKELKRGLEARHIELIALGGTIGVGLFMGSASTLKWAGPSVILAYIIAGIFIFFIMRTIGEMLYIEPITGSFATYAHKYIGPLWGYLTAWSYWFMWVAVGMSEVTAVGIYMKFWFPTLPQWVPGLIAILIVGTANLAAVKYYGEFEFWFALIKVVTIVVMIILGIGMIFFGFGNHGRPIGLENLYIHGGFFPNGIKGFLFALCLVVAAFQGVELVGVTAGEAKDPQRTLRRAVQNITWRILIFYIGAIFVIVALYPWNKLGTIGSPFVLTFAKVGIPAAASIINFVVLTAALSGCNSGIYSSARMLYTLSQNGQAPKFLAKVSPSGVPVNSLLVTIACLLIGVALNYIAPQKLFVYIYSASVLPGMMPWFVILISQLKFRKLKDNEIKDHPFKAPLSPYSNYLTIIFLVLVLVGMWLNSDTRLSLIIGAAFMALIIISYYVFGIDKKQVPEVKKIKEEAI

SEQ ID NO: 2167 - protein, 145 aa, Oryza sativa
MGFSETQEELVLRSWQSMKKDSESIALKFFLRIFEIAPAAKQMFSFLRDSGDDVPLESHPKACESATQLRKTGDVKVREATLRRLGATHVKAGVADAHFEVVKTALLDTIKDAVPEMWSPEMKGAWEEAYDQLAAAIKEEMKKAA

SEQ ID NO: 2168 - protein, 350 aa, Thermus thermophilus
MKDYYAILGVSREASQEEIKKAYRRLALKYHPDRNPGDKEAEERFKEINEAYAVLSDPKKRAAYDRGHLEAPEYRPEDLFDLFFQEVFGVRGHRRPPRGEDLEAEVEVELQDLLHGAEKEVRYTRLVPCEACGGEGGRRTPCPTCRGQGVVESYRQSFFGTVVTRTACPHCKGRGYLLAETCPACRGRGRVPREERVRVQVPPGMDEGHLLRVPGYGNLGPGGPGDLYLRIRVRPHPHLERQGPDLVYRLRLGLAQAALGARVVVPGLEGPIPLDIPPGTGHGEVFALEGGGLPLPGGRGRGTLRVVVELAVPKKLSPKAQKLLRAYAEEVGEEVAPEGFWERLKGFFRK

SEQ ID NO: 2169 - protein, 348 aa, Musa balbisiana
MESDPPGIQPRRARDEDPTTAASSSAEIPAPTGLVAKPVEARGRCLWRKGGAAAVSWGAASTVGRRKEMEDAVAVAPAFMALTCERVGGCAAPPGSGEVSHVRFFGVYDGHGGAQVADYCAKRVHEVVAEEWDRIQNPECWKRRWETAFHDGFKRVDNEVIDEAVAPDIIGSTAVVVVISGCQIISSNCGDSRALLCRGNQRIQLTIDHKPDREDELMRIESLGGRVINWQGCRISGVLAVSRSIGDRYMRPWVIPVPEISFMSRSEDDDCLILASDGLWDVMSIEEVGDMACRHFRWQRRNGLVDGVSPAQAVADHLTELAYQKNSSDNISVVVVDLKSRSRRRPRQ

SEQ ID NO: 2170 - protein, 259 aa, Brassica napus
NKIVSLLSNDYKKMTSSNRSSSPTSSSSDQSDVTTTTSTHLSETSPRNNKRKRSKDSSSSSSSSSSKLKHPVYRGVRMRSWGKWVSEIRQPRKKTRIWLGTFATADMAARAHDVAALAIKGSSAVINFPELASILPRPASSSPHDIQAAAAEAAAMVVDGKLSESESAATEMKEAPPSPESSCAATESKKEERLEEIVELPNIEEGSYDMSVKSRSDLDYSEPLDCWVYPPPAIDLYEEFLEFDFLELWSFPHTELINP

SEQ ID NO: 2171 - protein, 112 aa, Unknown
  Acidovorax sp. JS42
MQMITAVIKPFKLEEVREALAECGVTGLTVTEVKGFGRQKGHTELYRGAEYVVDFLPKVKIEVVVRTEDVDRCVDAIVGAARTGKIGDGKIFVTAVERVVRIRTGDLDDAAV

SEQ ID NO: 2172 - protein, 609 aa, Bacillus cereus
MCMCGITGWVDWKEDLSNQHVILKKMANSIEHRGPDAEGFWFSPHAAFAHRRLIVIDPEGGTQPKTFRAGDYTYALTYNGEIYNFRELKEQLQKCGHAFETHSDTEVLLHAYLEWKEDCVQHLNGIFAFALWDDQKQQLFLARDHLGVKPLFYTERNDSIIFGSEIKALLAHPSVPAEIDADGINEIFGLGLFRTPGCGVFKHIQEVRAGHSITFTRHKKVVTKYWNLESKFHTDSIEDTSSHILSILQDTVKRQLIADVPLVCMLSGGLDSSGITALAGKEFAAENKTLHTYSVDFVNSAKDFELTFARTGLDAPWVKRVSEHVGTAHHDIIVNAEELANHLFVPLHAKDLPSAGEMETSLYLLFCEMKKDATVALSGESADEVFGGYPWFHQEELLYVDKFPWLTNWKNTSPLLLNEVSNQCNLENYIDTRFQEAILEVPTLEGESKKSAKQRQMFYLFLTRFLPFLLDRKDRMSMAVGFEVRVPFCDYRLVEYLWNVPFNIKSIDNIEKGILRRALQPALPDDVRNRRKSAYPTSQDPHYLQTIRNLTLDMCSHKNNPIFSLINHSILLSIADQSNKEINNFEARSAMEYMLQVNEWLKTYHIHIA

SEQ ID NO: 2173 - protein, 566 aa, Musa balbisiana
MTSTLFLSSLQPTASPRNCRFHVSSSSSSSSGSGRPSFDSFDTICRRRRRAWESAKASVGVEPRPTVSVGPAETGPVDCGGKLAAWTSIRQERWEGKLVVEGDVPRWLNGTYLRNGPGLWHIDDYNFRHLFDGYATLVRVYFEQGRVMASHRQVESEAYKAAMKNRRLCYREFSEAPKPANFLAYVGEVASLFSGASLTDNSNTGVVRLGDGRVLCLTETIKGSIQIDPDTLETIGKFVYEDNLGGLIHSAHPIVTESEFLTLLPDLVRPGYLVVTMKPGSNERRVMGRVNCRGGAAPGWVHSFAVTDRYVVVPEMPLRYCVHNLLRAEPTPLYKFEWHPESGSYMHVMSRATGKIVASVEVPPYVTFHFINAYEEVDEDGRITGIVADCCEHNADTSILDLLRLQNLRSFAGVDAMPDARVGRFRIPLDGRPRGELHAALDPEEHGRGLDMCSINPAYLGKKYRYAYACGAKRPCNFPNTLTKIDLVEKKAKNWHEDGAVPSEPFFVARPGATEEDDGVAISIVSDKNGEGYALVLDAVTFEEIARAKFPYGLPYGLHGCWVPNK

SEQ ID NO: 2174 - protein, 276 aa, Glycine max
PTVHRKGSRAQFPWTQQQHQHGMGVATGASQMAYSSHYPTAPMVASGTPAVAVPSPTQAPAAFSSSAHQLAYQQAQHFHHQQQQHQQQQLQMFWSNQMQEIEQTIDFKNHSLPLARIKKIMKADEDVRMISAEAPVIFAKACEMFILELTLRSWIHTEENKRRTLQKNDIAAAISRNDVFDFLVDIIPRDELKEEGLGITKATIPLVNSPADMPYYYVPPQHPVVGPPGMIMGKPVGAEQATLYSTQQPRPPMAFMPWPHTQPQQQQPPQHQQTDS

SEQ ID NO: 2175 - protein, 702 aa, Clostridium perfringens
MNHTHETIIAGRPMKVEFGKLGMLSDAAILMSYGDTVILTNVNASEKPREGIDFFPLSVEYEERLYSVGKIPGGFIKREGKPSEKAILNGRAIDRPLRPLFPKGYRNDVQVVCTVVSVENDNLPEILAINAASMALCLSSIPFTTPVAAVQVGLIGEEFILNPTSKEREESSLQLTVCATKERVMMIEAGGDEIPEDTMINAIKFGFDKCQDIIKFQEEAVSMFGKEKKVPELHKVPEEIEEAVREFAFDMISESMHITDRDERNAAMDEVKAKINEEFEEKYPDNMSDIGEAVYDMQKEVVRHMLLKEGKRPDGRAFDEVRNIGCEVGLLPRTHGTGLFTRGLTQVMTVATLGAISEIQILDGIGEEESKRYMHHYNFPAYSVGEVRPLRGPGRREIGHGALAERALEPLIPSEAEFPYTIRLVSEVLSSNGSTSQASVCGSTLALLDAGVPIKRPAAGIAMGLITSKDLTEEEVLTDIQGLEDFFGDMDFKVAGTEEGITSIQVDTKIKGLSEKVIHDAIYGARKARLMILDKIKECIPAPREEVSKYAPKTSTLQIDPEKIRDVIGAGGKVINKIIADTGVKIDIKEDGLVYVSSAESEGVKEAVKIIEGLTKEVKSGEIYLGKVTKIAQFGAFVEVLPNKEGLVHISKLDNKRVEKVEDIVSVGDEILVKVTEIDSQGRINLSRKDAIKEAEEENKQQ

SEQ ID NO: 2176 - protein, 70 aa, Beta vulgaris
AEDVAKRLMDYGFHGPTMSWPVPGTLMIEPTESESKAEMVRFCDALISIREEIAEIENGKADANNNVLKG

SEQ ID NO: 2177 - protein, 422 aa, Medicago truncatula
MGGKKTSKTKSLLSFRRRSNKLPSPPPRSPPPTLEITGSPSENRLVPKPKKKTGGARLWMRFDRFGKSELVEWEKNTIIRHAAIPARDLRILGPVFSHSSNILAREKAMVVNLEFIKAIVTAEEILLLDPLRQEVLPFVEQLRQQLPHKTQPKLLGGAGGGDESVPEGAEELPLPFEFQVLEIALEVVCTYLDKNVAELEKGAYPVLDALAKNVSTKNLEHVRSLKSNLTRLLARVQKVRDEIEHLLDDNEDMAQLYLTRKWLQNQQLDAHLGATASNNLLNTSHSVRRINSTRSGSLVTSSDDNDVEDLEMMLEAYFMQLDGTRNKILSVREYIDDTEDYVNIQLDNHRNELIQLQLTLTIASFAIAFETLVAGAFGMNIPCTLYTQNGIFWPIVGGMTAVSILLFLVVLAYAKWKKLLGS

SEQ ID NO: 2178 - protein, 263 aa, Arabidopsis thaliana
MQKPYKFNIPNYIYISLALFFVLAPCSSSDFSFEVKWLTLQLRETLPAFVVEEYKADPYLATVLNCALWVFYGLPMVQPDSLLVITINGTGLAIELVYLAIFFFFSPTSRKVKVGLWLIGEMVFVGIVATCTLLLFHTHNQRSSFVGIFCVIFVSLMYIAPLTIMSKVIKTKSVKYMPFSLSLANFLNGVVWVIYALIKFDLFILIGNGLGTVSGAVQLILYACYYKTTPKDDEDEEDEENLSKVNSQLQLSGNSGQAKRVSA

SEQ ID NO: 2179 - protein, 528 aa, Nostoc punctiforme
MDARALWQRYQNWLYFHEGLGLYLDISRMRFDDAFVESLQPKFDKAFADMAELEKGAIANPDENRMVGHYWLRNPDLAPTPELTQEIVQTLEQIEAFAEKVQTGAIHPPRASRFTDIISIGIGGSALGPQFVAEALAPDFPPLKIHFIDNNDPAGIDRVLNHLRNSLASTLVLVISKSGGTPEPRNGMIEVKKAYAGHNLEFAQYAVAITSVDSNLDKLAKDEGWLARFPMYDWVGGRTSEMSAVGLVPAALQGIDVRAMLDGAKEMDDATRVPDVKNNPAALLALSWYFAGNGKGEKDMVVLPYKDSLFLFSRYLQQLVMESLGKEKDLDGNVVHQGIAVYGNKGSTDQHAYVQQLREGVANFFATFVEVLEDRQGPSTEIDPGVTSGDYLSGFLQGTRQALYENHRDSITVTIPQVNPRTVGALIALYERAVGLYASLVNVNAYHQPGVEAGKKAAASILDLQTRVVAVLQKEKTPISLDELAKKAGASDQIEAIYKILRHIHANQRGVVLQGDLHKPGSLTVSAS

SEQ ID NO: 2180 - protein, 470 aa, Chromobacterium violaceum
MEFFPIFLKLRHQRCLLVGGGEVALRKARLLLAAGASLQVVAPELAPELADLAERGELEHLPGRYAPALLDGMRLAVAATDDAEVNRAVAADAEARGILVNVVDDAEASRYISPAIIDRSPLMVAVASGGSVPVLARSIRARLESLIPAGYGRLARFGSSFRDAVKARFPDVDARRRFWETVLEGPLADAVMNGDEAAARAEMEKRIAAGGADRAGAVYLVGAGPGNPDLLTFRALRLMQQADVVLYDKLVAPELLELVRRDAERVYVGKARANHALPQDDINQLLVDLARQGKRVLRLKGGDPFTFGRGGEEIATLAEHGIAFEVVPGITSASGAAAYAGIPLTHRDYAQSVTFVTGHKQDGSIDLDWQALTRPQQTVVVYMGVSTAAELCQAFVDNGRAASTPAAAVEWATTERQRTVCGTLAALPGLMASHGIASPALIIVGEVVELADKLSWYRRSENSAVTIQED

SEQ ID NO: 2181 - protein, 253 aa, Brassica napus
KSLGVKMVLSGEGSDEIFGGYLYFHKAPNKQEFHQETCRKIKALHKYDCLRANKATSAFGLEARVPFLDKEFINTAMSLDPESKMISPEEGRIEKWVLRRAFDDEERPYLPKHILYRQKEQFSDGVGYSWIDGLKAHAAENVNDKMMSNAAFIFPHNTPLTKEAYYYRMIFERFFPQNSARLTVPGGATVACSTAKAVEWDASWSNNMDPSGRAAIGVHLSAYDGSKVALPLPPHKAIDDIPMMMGQEVVIQT

SEQ ID NO: 2182 - protein, 784 aa, Glycine max
CFLSRSLQTIMDTPDRSKINTPLSQFEDSPVFKYISNLSPIEPVKSVHVTQTFNSYSFSSPPSVFTSPHGNCHKESRFLRRHNLLETSKPKVSSEDVNNVYSCEETPADSAQACHESSEQQENTAQKISVADASIEPCNENKNPNISIELPQVLKYNLGSPGYEPLLYGDEANSLLELPGNGKPASDVASVPEGSEKDSIEGEMHLPGLCQIEEAKVEGQDCGVDSLITEASDLLMFSPPEAFKGLNKQLNPSIELSNIMTVIPQFATNDGQQMHIGNAVASGSEHEIEDHPSESAAATGTSQRQDNLGNLALVTSNPSEKMDNKLVYVTHRGIRRRCLDFEMASVQRRNPADNSNTNSSTAKSEERNVSNEKQLLPTKHSGDSRRCVLPGIGLHLNALASLKDCKNIKIDTLSSGRQPNLLSSPSSVQLSPSQEHQLSLVPASVERDLEPLENEVQPGEDCTQSLVLVQMAGEDFQQNSPKKKRRKLEPAGEGESCKRCNCKKSKCLKLYCECFAAGVYCIEPCACRDCFNKPIHVETVLQTRQQIESRNPLAFAPKVIRSSDSVSEIGDDLNKTPASARHKRGCNCKKSSCLKKYCECYQGGVGCSVSCRCEGCKNTYGRKDGSVPSGLEAEPEEETEACEKGVVENASWKTETQNTEDHPDQSLATTPLPLSRSLLPLSFSSKGKPPRSFVTTISSSGLFVSQKLGKSNAPRSQHQPKCVKPLQTVPDDDSPVTCIKTSSPNGKRISSPNCDVGSSPTTRRGGRKLILQSISSFPSLTPHH

SEQ ID NO: 2183 - protein, 320 aa, Fusarium oxysporum
MAPPAAVSPPSRSAELATSTKLPVMSKNINTKTVEEMLGQWDDFKFAPIRESQVSRAMTRRYFQDLDNYAESDIVIIGAGSCGLSAAYILGKKRPDLKIAIIEASVSPGGGAWLGGQLFSAMIMRKPADAFLREVGVPYEDEGNYVVVKHAALFTSTIMSKVLQMPNIKLFNATCVEDLITRPSEEGVRIAGVVTNWTLVSMHHDDQSCMDPNTINAPLIISTTGHDGPMGAFCVKRLVSMQRIEKLGGMRGLDMNLAEDAIVKGTREIVPGLIVGGMELSEVDGANRMGPTFGAMALSGLKAAEEALKIFDTRKKQNDL

SEQ ID NO: 2184 - protein, 108 aa, Desulfovibrio desulfuricans
MKLLIAYIRPEKLSTVKKALYARGIYAMSVTNALGSGQQKGFTETYRGIVTEVNLLKKVRIEVGVPADKAEDALAALQTGAHTGREGDGIIFVQDVARTVRVRTGEAP

SEQ ID NO: 2185 - protein, 543 aa, Acinetobacter sp. [sequence omitted]

SEQ ID NO: 2186 - protein, 354 aa, Ostreococcus tauri
MRTSSGAGGTRARRHCATTDVARSFDAVRREMREARGIADVPWSSLKRLLGVSCVSAIYTSWILSPVMSALAVWRYEWLRAYVACYLFASYALGVAMPMNALHRFFCWLETGEENGWQLVVEDDCDVDCSKRAYLFTAHPHGLFASGCVGNVVLSGRALKRFRARRIWFFINELLIRVFPIIKDVLSMLGFVPCTAKMMKKVLGRGETGLIVVGGVQEVVLTGNVDEEELYLKNCFGFVKVAMQAGTPLVPVYTFGESLATGPDWVPFRELRKRLSYKFVFPFRSLGIIHRWGLCFPKAKLTTVVGAPIEVKQNPNPTREEVAAVHQQYCDALLAMIERNKARAGYPTQRTKLV

SEQ ID NO: 2187 - protein, 269 aa, Arabidopsis thaliana
MYVITGGIGIEYSNPTLASAIGNIVPALTFILAVIFRMEKVSFKERSSVAKVMGTILSLIGAFVVIFYHGPRVFVASSPPYLNFRQLSPPLSSSKSDWLIGGAILTIQGIFVSVSFILQTHIMREYPEAFTVSILYILCISIVTSMIGLVVEKNNPSIWIIHFDITLFTIVTTGIITSVYYVIHSWAIRHKRPLYLAIFKPLSILIAVVMGTIFLNDSLYLGCLIGGILITLGFYVVMWGKANEEKNKLLSFSGKEKTPLLLSGKNDQI

SEQ ID NO: 2188 - protein, 501 aa, Ralstonia eutropha
MLAQIAAMYRYFMSVVPFRLTPAIISTVVLVTLLLLPAPEGLKPEAWHLVAIFLTTIVAIILKVMPIGVMAMMAIVIVSLAQVTSNSSKGAIADALSSFDNPLIWLIVVAILISRGLKKTGLGSRIGLIFISLLGKRTVGIGYGLAICELVLAPFTPSNTARGGGIVHPIMKSIAGAFDSDPAKDTQGKVGTYLALVNYHANPITSAMFVTATAPNPLVVDYVAKASGGALNLSWTTWALCMLVPGLLCLLVMPLIIYVLQPPELKATPNAIDYARGELERMGPLSGQERVMMGVFAVMLVLWANLPAMIFGPGLTLDPTVVAFLGLFALIITGTIDWDDVLSEKSAWDTLIWFGALVMLAEQLNKLGVITWFAADMRDAIEASGMGWLATAAVLVLAFVFSHYLFASTTAHISAMMLAFLTVGVHLIPQPYVPVFMLMMTAGSAIMMTLTHYATGTSPIIFGSGYVTLGQWWRVGAVMCVFELIVFAVVGGIWWKILGFW

SEQ ID NO: 2189 - protein, 186 aa, Nanoarchaeum equitans
MARLRRWHCYRKLEVPYTRVSRSKNKNYIPGAKPTMVRLFHMGELTRNPSEWQYEASLVAKENHQIRDNAIEAIRVMVNKYLESTLGKKRYLFIIRKYPHHIYREKPVVGGYAGADRISQGMRLSFGRPKGRAVQIYEGEKLLSIFFDDITKAKDIKYFLQVARSKLPWRYREEIVEVKSGKPLAL

SEQ ID NO: 2190 - protein, 320 aa, Diospyros kaki
MEAFPVINMEILNGEGREAAMEKLRNACENWGFFEVVNHGISHELMDSVERLTKEHYKKFMEQRFKEMVASKGLEVVQSEINDLDWESTFFLRHLPSSNLSELPDLEDDYKKAMKEFAEDLEKLAEQLLDYLCENLGLEKGYLKKAFYGSKGPTFGTKVSNYPPCPRPELIKGLRAHTDAGGIILLFQDDKVSGLQLLKDGQWIDVPPLKHSIVINIGDQLEVITNGKYKSVMHRVIAQTDGNRMSIASFYNPGSDAVIYPAPALVEKEADHEQKQVYPKFVFEDYMKLYAGLKFQAKEPRFEAMKAMETPLNLGPIATV

SEQ ID NO: 2191 - protein, 348 aa, Cryptomeria japonica
MELLKQHRYMFLLISCIVILLNSMHADCEQIGVNYGMDGNNLPSAGDVVSLMKKNNIGKMRIFGPNADVLRAFANSRIEVIVGVENKGLEAVASSQDSANGWVNDNIKPFYPSTNIKYIAVGNEVLEMPDNAQYVSFLVPAIKNIQTALENANLQNNIKVSTAHAMTVIGTSSPPSKGTFKDAVKDSMSSILQFLQDHGSPFMANVYPYFSYDGDRSIKLDYALFNPTPPVVDEGLSYTNLFDAMVDAVLSAMESLGHPNIPIVITESGWPSAGKDVATIENAQTYNNNLIKHVLSNAGTPKRPGSSIETYIFALFNENLKGPAEVEKHFGLFNPDEQPVYPVKFSLN

SEQ ID NO: 2192 - protein, 391 aa, Glycine max
MISSMKCTASSLTCSAFSNRKIPIARPQLVTLPTINNVEQNTGLSQLCSQKPLYLSSTENLALVKRRRETECQAYEADRSRPLEINIELPGEEAAQRFKIGLYFATWWALNVVFNIYNKKVLNAFPYPWLTSTLSLAAGSLMMLVSWATRVAEVPKVNLDFWKALFPVAVAHTIGHVAATVSMSKVAVSFTHIIKSGEPAFSVLVSRFLLGEAFPMPVYLSLLPIIGGCALAAVTELNFNMIGFMGAMISNLAFVFRNIFSKKGMKGMSVSGMNYYACLSIMSLLILTPFAIAVEGPKVWIAGWQTAVSQIGPNFVWWVAAQSVFYHLYNQVSYMSLDQISPLTFSIGNTMKRISVIVSSILIFHTPVQPINALGAAIAILGTFLYSQAKQ

SEQ ID NO: 2193 - protein, 111 aa, Oryza sativa
  misc_feature (11)..(11): Xaa can be any naturally occurring amino acid
  misc_feature (51)..(51): Xaa can be any naturally occurring amino acid
MQTAVSSVVGXLSAELPADVNALSLPILAALRGALRDLAAADGVAFDAAEXTYSSNISVFTMEACYLIGGEACNVQMYSEAKLSSSGACAVSRAAAEEVDRDYLSYDEPTH

SEQ ID NO: 2194 - protein, 448 aa, Borrelia burgdorferi
MVYRIKNENLDFKIDSLGECKQNNPLIDFYASEGSSHFVNEKNKIKFSVYRNEDKGDRYEDVLLEKAGPREKIYFVPRHVKAAITTCGGLCPGFNDVIRSIVRTLWKIYGVRNIYGVKFGYQGLLPESNSPFINLNPDVVDDINKFGGTILGSSRGGIKPVEIVDTLERMNINMIFNIGGDGTQKGSLLIAEEIEKRNLKIAVVGIPKTVDNDFMFVQKSFGFETAVEQAVAAVAGAHFEANSAYNGIGLVKVMGRDSGFIAAHTALSSNDVNFCLIPELDFDIEGPNGFLVHLERRLLEKESLEEIPHAVILIAEGAGQKYFDHFPKKKDDSGNLLYEDIGLYIKDKITEYFKAKNIQFTLKYIDPSYIIRSSPANASDSLYCARLGSNAVHAAMAGKTKMLISLWSTKFVHIPIKMAVIDRNKVNPNGSFWRDVLSSTGQPISMKN

SEQ ID NO: 2195 - protein, 1064 aa, Clostridium perfringens
MFDSVKRKLVCYDDNEYYIEISPLTNTIRATLCCKGAIEAYLVGDFNNWEKSENFKLNWGLDTNDGRVKMIKDITFPCGLKKGEYKYGYIIITLDGKEIYVDNLNEEKNDFYFLWEPFEESLEIKSSRDFISTRYPVELIAVKNSFYGNITIEEAVLSLENSLKGVTLENGFLKINEEVAPGTKIIVKAYDSLNDMTAYKEIEVREEGEKGTFVQFLKNDGLYYGENFSWNIWGFGENSSGKEFNLNIKTDLGVGTFVDEEKFIVRKRTWGCNWVNDWNEQTYTFYLGKKDRNLFCIYENNKILTSLKTAIEETTPKIQVALMDHKNTIKAYLSHKPLIGVKYGLYINGIKAKGVSTIVRENEKEVLITNLPSDIDPSDLLEVRASSMFSSCKVIVRDYLNDYYYGGNDLGVRFSEENISLRLWAPTAKKVELLIYEDYKSLRENPLRKYDMNREKENGTHLIKVPRKENEGKYYLYRLYFNDLSKEGKHINKITYAVDPYAVSVGVNGEKGALVDLFSKECVPEGWNKYNKPKLINKEDSIIYEMHIRDFTINENSGVSERLRGKFLGAVEEGTFYINKENGNKVKTGLDHLKELGITHVHLLPVFDFASVNEEISNDENNRNWGYDPKNFNAIEGSYSTDPYTPSRRIIEFREMIKRFHDNGIRVILDMVYNHMYETSNMDNIVPLYYFRSDKLGKYTNGSGCGNEMASEKPMVRKFILDSILHWIKNYHIDGLRFDLMELIDLDTMKEIVKRSEEIDEKILIYGEPWKGGDSPLSNGTYKGSQKGLGFSIFNDDFRNALRGNNDPSNGFINGEQHNKNKAWQVIEGIKGSINSITYKPMESINYLEAHDNYTLWDQIVKSQNHSVEKGHYRDFNEENILDNFYVKEDLLGASILFTSQGIPFIQSGAEILRSKDGDHNSYKSPDSINALNWAEKEKYIDVFNYYKDLISLRKNHSAFRMKKPEDIIENLEVYFYDNNDTSGVIIAHYKNNANEDLWKDIVVIYNGTTIDDYNVISSMPKSSNGFWNIAVKNGGVNQLGIERVSEDEIPKIKSHSMMILYDE

SEQ ID NO: 2196 - protein, 291 aa, Musa balbisiana
MTDHVKWTSVESKTSTNAAPISSSSSSRSPSMASSSGAGTAVEHKRARDIRKHPVYRGVRMRAWGKWVSEIREPRKKSRIWLGTFATPEMAARAHDAAVLSVKGAPAAAAVLNFPELAGSLPRPASLSPRDVREAAARAAAMDMPRANAAALVVEDDELEEIVELPRLGQDLFGSAHLAGEFVFHDSISTASGALSFGASSKCPSCLLLHVLLLPSTAQLTRKERRNSVLLLARNRCKSISCLSPKRLSSRRNSWCSSRGTNSREQTAAIIPRLAFCSSLEDPTIIADAFH

SEQ ID NO: 2197 - protein, 443 aa, Glycine max
MEGLGGLGHLFVTMFVSGFGGVIVLPAITDVTMAALCPGQDQCSLAIYLSGFQQAMAGVGSVVMTPLIGNLSDRYGRKALLTLPLTVSVIPQVILAYSRDTQFFYAYYVVKTLAAMAGEGSFHCLALAYVADKVPDGKRTSAFGILAGVGSASFVGGTLAARFLSTALTFQVASVLSMVALVYMRIFLKDSVPGGALRQPLLKEVEEPCDEDDSSPRATGTFKKLPSLGDLICLLRCSPTFSQAAMVSFFNSLADGGLMAVLLYYLKARFQFNKNQFADLLMITGIGATLAQLFFMPILVPVIGEEKLLSTGLLISCINVFVYSIAWTAWVPYALAGCSVFAVFVRPSLCSIASKQVGPTEQGMVQGCLSAISSFANIIAPLIFSPLTALFLSEEAPFYFPGFSLMCLGLALMVAFFQSLIIRAVPPIAGGKISSNRCTDTLV

SEQ ID NO: 2198 - protein, 168 aa, Rhodomonas salina
SVAAAQLMTGVLWVVPLWILGLRTAPKMTTENWMQMAPIGIFAAGAHGGSVVALGAGAVSFGQILKACEPAFSAVNEIIFLGEVQAWQVYMTLIPIIGGVAFASLKELSFSWLAVISAMLANQSAALKAVFGKSVMKQPWAKAMGPANQYGVVNIISVLATLPLVLGL

SEQ ID NO: 2199 - protein, 352 aa, Desulfitobacterium hafniense
MAKIAVYGAGSWGTALAVSMGKAGHEVALVGRNLSEMDLMEQRRENRPYLPGVVLPPTVRPTGDAGVLEEAEMLVLSVPSHSVRETAQKIRAYLQPGTIVVNTAKGLEEGSHKRLSQVLTEELPHHPIVVLSGPSHAEEVGKDMPTTVVVASQNSQAAEAVQDMLMTPKFRVYTNPDTIGVELGGAFKNIIALCAGFADGLGFGDNTKAALMTRGIAEITRLGAAMGGNPLTFAGLAGVGDLIVTCTSRHSRNHRAGVALGEGKPLEQVLKEVGMVVEGVRTTRVAYELSRQYEISMPITEQAYQVLFQGADPRAAVSALMMRGKKHEIEEVALIAMEQGSYQENGPDDHGE

SEQ ID NO: 2200 - protein, 378 aa, Arabidopsis thaliana
MAVVDVHRFAESITCHAWSPDLSMVALCPNNTEVHIYKSLSQDHWERLHVLQKHDQIVSGIDWSSKSNKIVTVSHDRNSYVWSLEGAEWVPTLVILRLNRAALCVQWSPKENKFAVGSGAKTVCICYYEQENNWWVSKLIRKRHESSVTSVAWHPNNVLLATTSTDGKCRVFSTFIKGVDTKYAHYLNGAFFLLKQQILQLDLSYSWAFGVKWSPSGNTLAYVGHSSMIYFVDDVGPSPLAQSVAFRDLPLRDVLFISEKMVIGVGYDSNPMVFASDDTGIWSFIRYIGEKKAASSNSSYSSQFSEAFGKFYGSQSKSTTANDASESRGGVHDNCINSIVSLSKAGSPKVMRFSTSGLDGKVAIWDLENMEQELGNQF

SEQ ID NO: 2201 - protein, 317 aa, Cucumis sativus
MAVFPIINLENINGDGRAKILEQIEDACQNWGFFELVNHGIPHEFLDMVEKMTRDHDKKCMEERFKETVLSKGLEAAQAEVNDMDWESTFFLRHLPESNISQMSDLDEEYKKIMKEFAKKLENLAEELLDLLCENLGLEKGYLKNAFYGSKGPTFGTKVSKYPPCPKPDLIKGLRAHTDAGGIILLFQDDKVGGLQLLKDGDWIDVPPMRHAIVVNLGDQLEVITNGRYKSVMHRVLITQTSGTGRMSIASFYNPGSDAVIYPAPALVEKDEEKKEVYPKFVFEDYMKLYLGVKFQAKEPRFEAMKANANLGPMATA

SEQ ID NO: 2202 - protein, 338 aa, Oryza sativa
MPNLECRMYEAPFPEVETAVMIQVKHLAELGAYVSLLEYNNIEGMILYSELSRRRIRSIPSLIKVGRQEPAVVLRVDHDKGYIDLSKRRVSHHDRRTCEDRYSKSKFVHSIMRHLAETLHLDLEPLYHRIAWPLYRTYGHAFDAFKLIVADPDAAILDSLTYDLTETGPDGQEVTKTLPAVTPEIKDALIKNIRRRMTPQPHKIRADIDMKCFQYDGVLHIQEAMRKAEAAGNKDCPVKIKLVAAPLYVLTTETLDKHQGISVLNNAIKACGETIEKHKGKLVVKEAPRAVSEREDRLFMDDIEKLKIANEEVDGDEDSEEDTGMGDVDLTKTGVGSQ

SEQ ID NO: 2203 - protein, 156 aa, Zea mays
MAAATALVSSSSLRAPAAFSVVVRAASRPAPVVAVVTPLPAAKAAAARGARLRAQATHNVKLITPDGEVQVQLKMPGDVYILDYAEEQGLDLPYSCRAGACSSCVGKIVSGSVNQFDQSFLDDDQVAEGFVLTCIAYPTSDLVIQTHKEDALVESY

SEQ ID NO: 2204 - protein, 691 aa, Crocosphaera watsonii
MWKAFTETITWQLAGTDKKYLKCQGKECLQLKTEGLNTFKPKLSDVFVPLELSGNLFPDSQGRLTPPVLQGFNWRRNLTQNEDRQKDLSIWYILRKAQQNPLYRSLVIISKGGYGKTTLVRHITYIYTTNNLYEQKAYNAPKLLPVLLYLRKWQDLIADEKAPDLPTLIEKHHLPSLAGGDSLKLPPNWAKNHLDDGTMLVMLDGFDEVKEEWQKSVSEWISQQLKKYSNSFFILTSRPAGYHQYQGENKPQTPLFVKPLNEDLQNRFIEKWYLSWEGHISQELDPNEAQRKAAHLSQQLKPIENEINPLSDFATIPLLLNMIVNLDANYPQEKLPSRRTDLFLSIVRLQLGNRPLAKQVEMPLEPGESQQVLQQLALLMMEENQTKIEPDLRLENLTNYLACIDESVSATNFLKKIEEVSELLVKIDDQYEFAHKNFQEYLAAAEIKRTKQEQILYANYQEQWWQDTILLYAAQLKNPTDFIRYLLNLNTNSATQLAYQCFRETTRQLDPEVEVKVKLKSLSTAVKNALYQKIEQLLKNQQFKDADYETYRVMIETVGKEEGESFDTKDFDTFPCDDLRTLDQLWVKYSKGKFGFSAQKKIYMDELGGTRDYNKEIWDKFCDRIGWRKGRWYVNYSDLIFELQDSTPVGHLPLIGGSGWWIGGGCWTWFLSLTQRLVNCNISPHASQRQK

SEQ ID NO: 2205 - protein, 453 aa, Musa balbisiana
MESKSTGRFTLGKQSSLAPDRGCSDDSSYGDGFRFPDDVDANIRLMYLTSEGDLEGIEEILASGVDVNFRDIDGRTALHVAACQGFADVVRLLLDRGAQPLADAIHYNNHEVIDLLEKHGAKLSIIPMHVKNAREVPEYEIDPSELDFTHSVNITKGTFRLATWRGIRVAVKKYGEDVLVDENKLWVGRAFRDELALLQQIRHPNVVQFLGAVTQSSPMMIVTEYLPKGDLRAYLKHKGALKPSSAVRFALDIARGMNYLHEHKPEAIIHRDLEPSNILRDDSGNLKVADFGVSKLLKVAKTVREERSLTHLGTACRYVAPEVFCNEEYDTKVDVFSFALILQEMIEGCPPFCYKQDNEVPKAFVSKQRPPFGAPPKLYVHGLKELIEECWSENPADRPTFKDIIDRLLNIQNYIDRKRHWRVSFLNFYLMMHFFSFWSSYYLAHKKQLLFSL

SEQ ID NO: 2206 - protein, 319 aa, Clostridium perfringens
MKKIAVLTSGGDAPGMNAALRAVTRMALHHGLEVMGVQRGYAGLINGELFKMDRKSVSEIINRGGTILRTARCLEFKQEEVREKAAQILKAYGVEALVVIGGDGSFMGAKLLSKLGVKTVGLPGTIDNDLSYTDYTIGFDTALNTVVDAINKLRDTSTSHERVSIVEVMGRNCGDLALYAGIAGGAEAIIVPEMPFDKDELIKTILEGRTNGKTHSIIVVAEGVGGSAELAKEIESVTGIETRATILGHIQRGGSPTADDIVLASRMGAKAVEVLLEGKTSKVIGIKENRIFDMDIDEALDIERSFDESLYEMASAINK

SEQ ID NO: 2207 - protein, 472 aa, Pediococcus pentosaceus
MDQPQIGVVGMAVMGKNLALNIESRGYTVAIYNRTASKTEKVMQDHSEKKLVPAYSIEEFVNSLEKPRRIMMMVKAGKPTDAVIAELLPLLDKGDVLIDGGNTNFEDTMRRNKELDESGINFIGTGVSGGELGALQGPSMMPGGQKEAYDLVAPIFEQISAKAKDGDPCVTYIGPNGAGHYVKMVHNGIEYGDEQLIDESYDLMRKLLGLPVKEIADIFADWNQGELDSYLIDITADILTRTDDLGSDKPIVDLIMDKGGNKGTGKWSSQNALELGVPQSLITESVYARYISVLKDERVAASKVLAGPEKKIDVDKDEVIEKIRRALYFSKIMSYAQGFEQMRVASENYDWNLNFGEIAKIWRAGCIIRAQFLQNITDAFDKNPELNNLLMDSYFQEIAAKYQEAVRDVVALAVKAGIPVPALSAAVAYYDSYRSAVLPANLLQAQRDYFGAHTYERVDREGIYHFPWYEEQ

SEQ ID NO: 2208 - protein, 979 aa, Bacillus anthracis
MKNNMVHITIDGKKYTAEPSSTILGVINENGIEHPQICYVPEVDPIQTCDTCIVEVDGKLMRSCSTVVTEGMNIERNSTRAKEAQTEAMDRLLENHLLYCTVCDNNNGNCKLHNTAELMEIEHQKYPYEPKVDVSEVDMTHPFYRYDPNQCIACGQCVEVCQNLQVNETLSIDWEAERPRVIWDEGVSINDSSCVSCGQCVTICPCNALMEKTMLGEAGFMTGLKPDILEPMVDLIKEVEPGYSGIFAVSEVEAAMRDTRTKKTKTVCTFCGVGCSFEVWTKGRKILKVQPSSDAPVNAISTCVKGKFGWDFVNSKERITKPLIRKNGTFVESTWEEALNVVANKLGSIKEEYGKDAIGFISSSKITNEDNYVIQKLARQVFETNNIDNCSRYCQSPATDGLFRTIGMGGDAGTIKDIAQSGLVIIVGCNPTEGHPVLATRIKRAHKLHGQKLIVADLRKTEMAERSDVFISPKQGTDQVWLMAVTKYMIDQGWHDQQFIDENVNFFEDFKESLTEYTLEYAEEVTGISKETLIQMAEMIRDADGTCILWGMGVTQNTGGSDTSAAISNLLLATGNYRRPGAGAYPLRGHNNVQGACDMGTLPGWLPGYQHVTNDMERAKFEMAYGVKINSEPGLNNIEMLHAIDEGEMKAMYLVGEDMALVDSNANHVHEVLSSLDFFVVQDVFLSKTAQYADVVLPAAPSLEKEGTFTNTERRVQRLYQVLPTLGDAKPDWWIVQAIANKLGANWNYSHPSEIFAEMASLSPLFSQANYEVLEGWNSFHWGSFDGTNTPLLFQDGFNFPDKKARFAIADWVRPAEFPAEFDLHINNGRMLEHFHEGNMTNKSTGIQTKVPGVFVEVSPALAKERGVKTGSLVRLVSPFGALKLRVLVTDRVKANELYLPMNSTDNETAINFLTGPAVDTRTNTPAYKQTKVRMEVLEVDGENPMPKANPRNKKRHPQSGIEVHRKWARPGYVHLTDK

SEQ ID NO: 2209 - protein, 536 aa, Thermus thermophilus
MEDKATQTPEQTFSMEAALQETEARLEKRVRPGQILTGKVVLVGSEGVAVDIGAKTEGIIPFNQLTTKPLSEEELRNLLSPGDEVKVQVLRVDPETGQILLSRKKIEAQEKWDRIQELYEKGEPVTVTIKERVKGGVVAELDGIQGFMPASQLDLRRVPNLDEFVGQQVLAKIIEFHRRKGRVILSRRAVLEEEQKKAREAFLKSLEPGQVVEGTVVEVTDFGVFVNLGPVDGLVHRSEITWGRFNHPREVIQKGQKVKAQVLSVDPEKERVNLSIKALIPDPWTTVAEKYPVGTRVRGKVVGLTQFGAFVEVEPGLEGLIHISELSWTKRPKHPSEVVKEGDEVEAVVLRLDPEERRLSLGLKQTQPDPWQQLTEKYPPGTVLKGKVTGVTDFGVFVEIEPGIEGLVHVSELDHKRVENPAALFKKGDEMEVVVLNIDPVEQRVSLSRKRLLPPPLPQEEERPRRARSGKERARRKGAPRREDRREYEYGAVAEYNLYDASSVPTTTATVKLGDLYGDLLASLGLEEEAEEKSRG

SEQ ID NO: 2210 - protein, 949 aa, Roseovarius nubinhibens
MAFEPTDYLPYDFANRRHIGPSPEEMQEMLQVVGAGDLDDLIDQTVPKSIRQEVPLNFGKPKSERELMHFMRLTASKNKVMVNMIGQGYYGTVTPPAIQRNILENPAWYTAYTPYQPEISQGRLEALLNFQTMISDLTGLEVANASLLDEATACAEAMTMAQRVSKSKAKAFFVDRDCHPQNIAVIQTRAEPLGIEVIVGNPDKMEASEVFGAIFQYPGTYGHVRDFTDYIAALHEHKAIAVMSADPLALTLLKEPGEMGADIAVGSTQRFGVPMGYGGPHAAYMACKDAYKRSMPGRIIGVSIDAHGNRAYRLSLQTREQHIRREKAMSNVCTAQALLAVMASMYAVFHGPKGLKAIAQRIHRKTVRLAKGLEEAGFKVDPQVFFDTITVDVGPLQAAVLKSAVDEGINLRRVGESRVGISLDEATRPKNIEAVWRAFGITRADEDFTPEYRVPENMHRTSAYLTHPIFHMNRAETEMMRYMRRLADRDLALDRAMIPLGSCTMKLNSAAEMMPVSWREFSRLHPYCPVDQAEGYKVMIDDLSAKLCEITGYDAISMQPNSGAQGEYAGLLTIAAYHRAQGEGHRNVCLIPMSAHGTNPASAQMVGWKVVPVKSAETGDIDLADFRAKAEQYAETLAGTMITYPSTHGVFEEHVKEITAITHEHGGQVYIDGANMNAMVGLARPGDIGGDVSHLNLHKTFCIPHGGGGPGMGPIGVKAHLAPYLPGHPSTGGGEGPVSAAPFGSPSILPISWAYTLLMGGEGLTQATRVAILNANYIAKRLEGAYEVLYRGRNDRVAHECIIDTRPFEESAGVTVDDIAKRLIDNGFHAPTMSFPVPGTLMVEPTESETKAELDRFCDAMLAIREEIRDIEEGRIDAANNPLKHAPHTVEDLVGEWDRPYSREQACFPAGAFRVDKYWPPVNRVDNVYGDRNLVCTCPPMEEYAEAAE

SEQ ID NO: 2211 - protein, 406 aa, Chromobacterium violaceum
MDDAATRRALLKAGLAAGLLGLAGRPRAAWLEQGFDNGWRELVPYPQKMPLLRITTRPVHLETPFSQFDRGLITPNEAVFVRYHLAGHPLDIDPAAHTLTIDGKVRRPLTLTLSELQRFPRFKQTVVMQCAGNGRGLFQPRVQGAQLGNGSMACVEMAGARLADVLAAAGVIDGARQIACRGTDQPALEVTPAFVRSLDLADALRPEAMIAWEMNGQPLPVLNGYPIRLVIPGFYAAYWIKHLSHIEVLDHVFDGWFASQAYTVPDTPDNGVPPGTKPDRTARLTRMKVRSFITHPAHGDAIAAPDGRLALRGIAFDGGSGIRRVDVSADGGDSWRQAELGPDIGRFAFRPWTLTLDGVKPGPLTLMARAAANDGQRQPLRQPWNPGGYARNVAERVEIVVAEVKR

SEQ ID NO: 2212 - protein, 192 aa, Musa balbisiana
MIYQKSLWTCKHELTEKSNLHILTREFDNLITLDREQICSACSTFGFLYRAITSAYYRGAVGALLVYDVTRHTTFENVSRWLRELRDHTDPNIIVMLIGNKSDLRHLVAVPTEDGKAYAEKESLYFMETSALEATNVDNAFAEVLTQIYHIVSRKAVEAGDDAASSAPPSTGERINVKDDASTMRKLSCCST

SEQ ID NO: 2213 - protein, 238 aa, Brassica napus
  misc_feature (137)..(137): Xaa can be any naturally occurring amino acid
  misc_feature (226)..(226): Xaa can be any naturally occurring amino acid
MASLALSGSCSLAFPLKSRPLLLPRPPSSLNLLKKPLRSTESRFSSVKSPLHIALTKRSTLVKASSSASSPAPVAPAPWQGAAIKPLLASIATGVIIWFLPVPEGVTRSAWQLLAIFLATIVGIITQPLPLGAVALXGLGASVLTKTLTFAAAFSAFGDPIPWLIALAFFFARGFIKNGLGNRVAYQFVRLFGSSSLGLGYSLVFSEALWAPAIPSVSARAGGIFXPWVKSLCVGCGS

SEQ ID NO: 2214 - protein, 356 aa, Medicago truncatula
MTKNQNSNLIPSLPDDVAINCLARVPRSHHTTLTLVSKPIHSLLSSSLFFTARSLIPSTQHILYLSLRTRSTSLQFFTLHNNHRLLPLPPLPSPTIGSAYAVIHHKIYLIGGSVNDVPSRHVWILDCRFHRWLPGPSMRVAREFAAAGVIDGKIYVIGGCVPDNFSRSANWSEVFDPVNNRWESVPSPPEIREKWMHASAVVDGKVYAMADRGGVSFDPYNGAWESVGRELDIGWRGRATVVDGILYCYDYLGKIKGFDVKKGLWKELKGLDKSLPRFLCGATMADVGGKLVVVWECQRNLNGKGKEMEIWCAEIDVKKKKKKNKDGELWGEVCWLNNVLSVPKGSSIVHCNSVAL

SEQ ID NO: 2215 - protein, 781 aa, Oryza sativa
MERREIFQVADLAHILRGKPVDHLQQPNLLDNHQFQQAFQHQQQQHHLLDQIPAKTAESGDNMIRSRASDPLGGDEFESKSGSENVDGVSVDDQDPNQRPRKKRYHRHTQHQIQEMEAFFKECPHPDDKQRKELSRELGLEPLQVKFWFQNKRTQMKNQHERHENSQLRSDNEKLRAENMRYKEALSSASCPNCGGPAALGEMSFDEHHLRIENARLREEIDRISAIAAKYVGKPMVPFPVLSNPMAAAASRAPLDLPVAPYGVPGDMFGGGGAGELLRGVQSEVDKPMIVELAVAAMEELVRMAQLDEPLWSVAPPLDATAAAMETLSEEEYARMFPRGLGPKQYGLRSEASRDSAVVIMTHANLVEILMDANQYAAVFSNIVSRAITLEVLSTGVAGNYNGALQVMSVEFQVPSPLVPTRESYFVRYCKQNADGTWAVVDVSLDSLRPSPVLKCRRRPSGCLIQEMPNGYSKVTWVEHVEVDDRSVHNIYKLLVNSGLAFGARRWVGTLDRQCERLASVMASNIPTSDIGVITSSEGRKSMLKLAERMVVSFCGGVTASVAHQWTTLSGSGAEDVRVMTRKSVDDPGRPPGIVLNAATSFWLPVPPKRVFDFLRDESSRSEWDILSNGGIVQEMAHIANGRDQGNCVSLLRVNSSNSNQSNMLILQESCTDASGSYVIYAPVDVVAMNVVLNGGDPDYVALLPSGFAILPDGPAHDGGDGDGGVGVGSGGSLLTVAFQILVDSVPTAKLSLGSVATVNSLIACTVERIKAAVSGESNPQ

SEQ ID NO: 2216 - protein, 616 aa, Glycine max
MMMFEDMGFCGDLDMLCGSLGDGDIAVRQTEPDPVVEDDYSDEEIDVDELEKRMWRDKMRLKRLKEQTKSKEGTDAAKQRQSQEQARRKKMSRAQDGILKYMLKMMEVCKAQGFVYGIIPEKGKPVTGASDNLREWWKDKVRFDRNGPAAIAKYQADNAIPGKNDGCNSIGPTPHTLQELQDTTLGSLLSALMQHCDPPQRRFPLEKGVPPPWWPTGNEEWWPQIGLPKDQGPPPYKKPHDLKKAWKVGVLTAVIKHMSPDIAKIRKLVRQSKCLQDKMTAKESATWLAIINQEEALARELYPDYCPPFSSAVANGSMVINDCSEYDVDGAEEEPNFDVEDRKPDHLHPSNLGMERMMGRMPIQQPSHPMKGDVVTNLDFIRKRKISSDFNMMMDQKIYTCEHPQCPYSEVRLGFHDRSARDNHQLNCAYRNSSADYGGGPNFHATEVKPVIFPQSFVQPNTTAQSASLVAPSFDLTGLGVPEDGQKMISDLMTIYDTNVVGNKNLSSTNCVTAENHNLSQASLQRQDSFFPGQGMVLEGNLFAREEGQFDRFKATMNMNMNMNMNTPFDTNHNNNNIHLMFNSPCDLSSFDFKEDIQGVGMDSLQKQQEVSIWYQ

SEQ ID NO: 2217 - protein, 570 aa, Clostridium tetani
MSMFCYQCQEAAGCKGCTVRGVCGKTEDVAKSQDLLIYILKGISVYGVKGREVGVINKEVDNFMVEGLFATITNANFDREVFIERIKRGLQLRQELKEQVIKAGGNVENSHANKNWLDKMLSFVGLKKEEETKLPDAATWFADNVEEFNAKAEKVGVLATKDEDIRSLRELITYGIKGLAAYVEHAHNLNFDNEEIHGFMHKALAATLDDTLTVDDLVALTLETGKYGVEGMALLDKANTQTYGNPEITKVNIGVRNNPGILISGHDLRDLEQLLEQTKGTGVDVYTHSEMLPAHYYPAFKKYSHFAGNYGNAWWKQTEEFEKFNGPILMTTNCLVPPKDSYKDRVYTTGVVGFPGLKHIDADEKGEKDFSSIIEHAKKCAAPTEIEKGEIVGGFAHNQVFQLADKVVEAVKTGAIKRFFVMAGCDGRAKSRNYYTEFAQKLPKDTVILTAGCAKYKYNKLNLGDIGGIPRVLDAGQCNDSYSLALIALKLKEVFELEDINELPISYNIAWYEQKAVIVLLALLHLGVKNIHLGPTLPAFLSPNVANVLVENFGIGGITNVEDDMKMFLG

SEQ ID NO: 2218 - protein, 185 aa, Lactobacillus johnsonii
MKDVKSLDINENSHYDTAIFAGGCFWCMVAPFDTYPGVIKVESGYTGGVVPNPTYEQVCTGLTGHTEAVRITYDPNKLSYKDLVNIYWQVTDPTDAMGQFQDRGSQYQPVIYYNSLEQKEIAEQSRKSLADSNKFSDPIVTRIEPAKPFYLAEDYHQDFYKKDPARYALEEAGGREQFIKEHWKK

SEQ ID NO: 2219 - protein, 119 aa, Nostoc punctiforme
MCELSGTTAVQRKWLYFTEVENTSAVDLQTINNLWLVHSEGKFGFSVQREIWLSLGKNWENFWPKIGWKAGNNWTRYPNGFTWDLSAPRGHLPLSNQLRGVRVFASLLSHPAWSKNPEK

SEQ ID NO: 2220 - protein, 597 aa, Arabidopsis thaliana
MATGENRTVPDNLKKQLAVSVRNIQWSYGIFWSVSASQPGVLEWGDGYYNGDIKTRKTIQAAEVKIDQLGLERSEQLRELYESLSLAESSASGSSQVTRRASAAALSPEDLTDTEWYYLVCMSFVFNIGEGIPGGALSNGEPIWLCNAETADSKVFTRSLLAKSASLQTVVCFPFLGGVLEIGTTEHIKEDMNVIQSVKTLFLEAPPYTTISTRSDYQEIFDPLSDDKYTPVFITEAFPTTSTSGFEYEPEDHDSFINDGGASQVQSWQFVGEEISNCIHQSLNSSDCVSQTFVGTTGRLACDPRKSRIQRLGQIQEQSNHVNMDDDVHYQGVISTIFKTTHQLILGPQFQNFDKRSSFTRWKRSSSVKTLGEKSQKMIKKILFEVPLMNKKRRVVTGHTRGKPGNHALSEKKRREKLNERFMTLRSIIPSISKIDKVSILDDTIEYLQDLQKRVQELESCRESADTETRITMMKRKKPDDEEERASANCMNSKRKGSDVNVGEDEPADIGYAGLTDNLRISSLGNEVVIELRCAWREGILLEIMDVISDLNLDSHSVQSSTGDGLLCLTVNCKHKGTKIATTGMIQEALQRVAWIC

SEQ ID NO: 2221 - protein, 1717 aa, Magnaporthe grisea
MAPAPPPLPTRFPCWCRAVYSWGGESKRDLGFIEGDLIECLNAGDGSWWTGRLRRDRRMVGVFPSNFVELLPDNFRPMSRSTSPLPQNNTPSPKDTPQKSRTFRKPFEAYAKAPHYTTAKQPETYKESPTHSRDASATSVAARAPSPAPPRAHHQSSHHQSSHRAVSPAPTHRYDDMRRAASPAPSHRYDDIRRAASPAPTQRYNDMRRAASPAPSHRYDDMRRAASPAPLQRYEGMRRAASPAPLQRYEEMRRAVSPGGFDAFGSRAPSPAPSDIAYKPYRPSVGSFDSAQQLNLQDGPESPPPPAPPPHRHVPRHNSNMSYDSQNGAGLERHVSNLSYDNRQAGLSRHGSNVQYDHQQPEIEGSRHGSNVPYGLRTTGYHTPRAPSPCPPSPGLGRGGMTPSPLREAMDGVMEQLGALGLPPQDPSPEPTTFDPWSPESFDMVHQQSRRRNNKKEQLRPQTSMGIARADSGYETYSGGSSQGGSQENTLNNVGHDPDELGLPQLSNYVERMETRLRNMHNQSSSRVDDEMAPPPPPKSQAYERPKSSMGGSIHGSSGHSGSQPKLRHRKSAYDVGRQVLGRTFTTKTNSTSTSSGNQSTTTQSTSHSLMSGASAGGISATSAGSLARKNQHRRAQSAMSMREPELDRPETPFTGVTYHSSHASDAQVTRPKSQVAYHNDDPMANIGGLGGLTTPKTKKSNFFKKILESAKTGVASTRGSIATAGAGSMNSPRGRSTPNGFIGIAGGLAGPGAGRDTAREMGLGAGVDWVQIRRDVNRSNTLSRNEGSERRERCQMMDYPALDPVDELYGSIDGDEGADGMAVAEPMNYAAINLSQVDKNSRFISGLPPTTTSITLATTYVCRPYRSDVQRLRAIFTWVAEKICWEEDFEGQIDTRRSIASKRGCAEEYAVLVYEMCAAVGIHCEVVRGYLKSPGEVPEMGLMPRSNHWWNAVLVDNEWRMIDACLASPSNPQRGLYSSAGSGVADAFWFLTRPTEICWTHIPEHHGQQHICPPVAHEILLNLPCASPPYFRNGLHLVDYNTSLTRIEDLEMVHVKFTVPEDVEVAAEVEVRAFSRDADGDIFESGDVVKKRALAQADWVGGEKRYTVKALLPGDEGTGVLKVYAGKRGLMHSIKDIPHPVAFAVPIMHTGENPPYEFVTRHPTPHAQRHDIYVVQPQCQRLALNNTFVFAIRQHPSSLGTGSAMTPSSNPGGASPIPFARPGSAMSMTSSSAAGSMPSSASTNGSGVVSGKKPAKLAIQTPGGKILRLMRKEERRNGAVGVGGRTAGSDEDASDGGTWETIIKCSEKGVWRGLVLADRTARWCVFAEWAGDGRLRPATIMTSEQQPPSPPTASQKRHAFSWFTDANYLSINQLKTLPEPKSDFTGKTVIVTGGNSGLGREAARYFARLGAAKVILACRDTAKGEVARADIEVSTRSSRPPSAAGVRLAVEVWQVDMSSGSSVHDFCARVERELPRLDSLVLNAGVAIGAFVECEGGWESSVAINVIGTFLMAVLCLPIMRRTAAQHNVAPTIAVVASEAHVFASFAERKRQGLIFDAFKSAADMNEDRYNVTKLLDVLLARELAARLGPDSPVVVNALNPGLCQSELFRHCPFPLSALLRLGLMILGRKTEVGSRTLVAAAAAGRETHGKYMDSCELANESAFVRSDEGRASGVRVFDELMGIMEGLAPGARGNLNASTTTSMATAPASTAQASS

SEQ ID NO: 2222 - protein, 101 aa, Robiginitalea biformata
MKASFSDLIRSENPVLVDFYADWCGPCKTLAPILKEVKGELGDRLRVVKVDVDRNQEVAGRYQVRGVPTMILFKNGKVLWRQSGVLSKPDLLRALEPLLAS

SEQ ID NO: 2223 - protein, 497 aa, Bordetella pertussis
MTAPAAVPAPQSPPKVKIPIGLIAGIIAMVVVLLLPLPAELPPAGHRMLAILAFAVVVWITEAVSYEASAIMITTLMAFLLGTAPNVKNPDVLYGTSAAISMALTGFSNSALALVTGALFIAAAMTFTGLDKRIALVTLARVGTSTRRILLGAIAVTIVLSLVVPSATARSAAVVPIMLGVIAAFGVDKRSNIAAGIMIIVAQATSIWNVGIQTAAAQNLLTVGFMDKMLGERVAWSDWLIAGVPWSLLMSAVLVFVVLRLLPPESDAIAGGKEAVEASLRELGPMTSAQKRLILVSIMLLLFWSTEGKLHKFDTTSTTYFGLVLLMLPRFGVMTWKDVQTRIPWGAVIVFGVGISLGTALLTTQAGQWLGAQVVAHTGLDHLGPLGIFAILSAFLILIHLGFASATALTSAMLPILIAVLQTLPGDFNRLGMTMLLGFVVSYGFILPINAPQNMVALGTETFTAKQFAKVGIVLTIVGYLLMLLMSVTYWRWLGWM

SEQ ID NO: 2224 - protein, 195 aa, Geobacter sulfurreducens
MSRKATIERVTKETQIKLSLEIDGTGEAKICTSVPFLDHMLDLFARHGLFNLQVDATGDIDIDFHHTVEDIGIVLGQALKEALGDKKGIRRYGQATVPMDETLASVAVDISGRPYLVYHVSLPKVKIGEFDVELVREFFQAVVNNLGANIHVNVMYGDNVHHIVEACFKAFARAVDQATQVDSRIQGVMSTKGKL

SEQ ID NO: 2225 - protein, 239 aa, Francisella tularensis
MSLMKEMLSVGVHFGHKKAFWNPQMKEYIFGINHGVHIINLEKTVPLFQDAVNFVGKTVANGGKILFVGTKRQAQDIVEAEAKRCGMSFVSHRWLGGMLTNYKTVRQSIKRLAQLEKMREDGTLESLTKKEMLQNIRTIEKLEKVLGGIKEMGGLPDAIVVIDSNKEHIAIQEAQKLGIKVVAIVDTNSNPEGIDYIIPGNDDAVKSISFYMKKFADAVIDAQGLDRAVEAKADEAAQA

SEQ ID NO: 2226 - protein, 143 aa, Triticum aestivum
MAAALSLRAPFSLRAVAPPAPRVALAPAALSLAAAKQVRGARLRAQATYKVKLVTPEGEVELEVPDDVYILDQAEEEGIDLPYSCRAGSCSSCAGKLVSGEIDQSDQSFLDDDQMEAGWVLTCHAYPKSDIVIETHKEEELTA

SEQ ID NO: 2227 - protein, 447 aa, Lactococcus lactis
MKDLISIIDVKDHVGETVKIGAWVADKSGKGKLQFLQLRDGTAFFQAVVFKPNMIENFGEEEGTAKFDEIKHLSQETSVYVTGVVKEDSRSKFGYELDVTDLEVIGQSHDYPITPKEHGVEFLLDNRHLWLRSKRQMAMMQVRNAIIYASYDFFAKNGFIKFDSPILSGNAAENTTELFETDYFGNSAFLSQSGQLYLEAGAMALGRVFDFGPVFRAEKSKTRRHLTEFWMMDAEYPFVTHDESLDIQEAYVKALIQGVLDNAAYALETLERDTSMLQKYIDTPFKRVSYDAAIDLLQAHENDEDTDYEHVEHGDDFGSPHETWISNYYGVPTFIVNYPASFKAFYMKPVPGNPERVLCADLLAPEGYGEIIGGSERETDYDLLLKKIADFGLDPKDYDWYLELRKFGSVPHAGFGLGLERMVTFVAGTEHIREAIPFPRMINRIQP

SEQ ID NO: 2228 - protein, 468 aa, Escherichia coli
MSKQQIGVVGMAVMGRNLALNIESRGYTVSVFNRSREKTEEVVAENPGKKLVPYYTVKEFVESLETPRRILLMVKAGAGTDAAIDSLKPYLDKGDIIIDGGNTFFQDTIRRNRELSAEGFNFIGTGVSGGEEGALKGPSIMPGGQKEAYELVAPILTKIAAVAEDGEPCVTYIGADGAGHYVKMVHNGIEYGDMQLIAEAYSLLKGGLNLTNEELAQTFTEWNNGELSSYLIDITKDIFTKKDEDGNYLVDVILDEAANKGTGKWTSQSALDLGEPLSLITESVFARYISSLKDQRVAASKVLSGPQAQPAGDKAEFIEKVRRALYLGKIVSYAQGFSQLRAASEEYNWDLNYGEIAKIFRAGCIIRARFLQKITDAYAEDPQIANLLLAPYFKQIADDYQQALRDVVAYAVQNGIPVPTFAAAVAYYDSYRAAVLPANLIQAQRDYFGAHTYKRIDKEGVFHTEWLD

SEQ ID NO: 2229 - protein, 453 aa, Pseudomonas putida
MHKQELPRAQKLAERAFANLERFLHIEAVSGIVLLIAAVAALIWANSPAADSYEALWHTPLTFGVGSHVYSQSLHFWINDGLMTIFFLVVGMEIRREIHEGALSSLRQATLPMAAAVGGVAVPALLYLSFGHAPADQQGWAVPTATDIAFAVGVLALLGKSIPSNVRVFLLALAIIDDIIAVLIIAFFYSGGLDYTGFGVAVIGLLMVIGLQKIGVGSAYAYVIPGAIVWLGILLTGAHPTLAGVVLGLMTPVTAMPMRERPLDAITRFTGELLGRAKAPEQDASDLMDPLKRLRLAQRELLPPVVRMQGTLHPWVAFGIMPVFALANAGVSLSGVDLSAEGPQWVMIAVAVALVAGKPLGIVSVSWLMVRLGWCVLPAEVNWRSIMLVGLLAGIGFTMSIFIANLAFVDPGSLGAAKLGVLSASLIAAVLGLTWGVWSMRSAASATKAGSPT

SEQ ID NO: 2230 - protein, 251 aa, Arabidopsis thaliana
MVNATVARNIAGICGNVISLFLFLSPIPTFITIYKKKKVEEYKADPYLATVLNCALWVFYGLPMVQPDSLLVITINGTGLAIELVYLAIFFFFSPTSRKVKVGLWLIGEMVFVGIVATCTLLLFHTHNQRSSFVGIFCVIFVSLMYIAPLTIMSKVIKTKSVKYMPFSLSLANFLNGVVWVIYALIKFDLFILIGNGLGTVSGAVQLILYACYYKTTPKDDEDEEDEENLSKVNSQLQLSGNSGQAKRVSA

SEQ ID NO: 2231 - protein, 472 aa, Listeria monocytogenes
MAKQEIGVIGMGVMGRNLALNIESRGHTVSIFNRSTEKTKAVMEENADKKLVPTYSLEEFVESLEVPRRILIMVKAGDATDMMIEAVKPFLNEGDILIDGGNAFFKDTIRRNKELSEEGFNFIGTGVSGGEEGALKGPSIMPGGQRKAYDLVAPILREIAAVADGEPCVTYIGPDGAGHYVKMVHNGIEYGDMQLIAEAYTILKEIGGLSHDELADVFEEWNNGELDSYLIEITKNILKVKDEETGKPIVDVILDKAGQKGTGKWTSQSALDLGVPLSLITESVFARYISALKEERVYASTVLTGPSNYRFEGDKKAFVESVRRALYFSKIASYAQGFAQMRAASEEYNWDLQYGEIAKIFRAGCIIRARFLQKITDAYNQDKNLKNLLLDPYFKDIAHNYQGDLRTVVAEAVKAGIPVPTFTAAISYYDSYRSEVLSANLIQAQRDYFGAHTYERVDKPGVFHTEWPQVED

SEQ ID NO: 2232 - protein, 214 aa, Unknown
  Nocardioides sp. JS614
MFLTRKAQLVTPDQALPGRSERTFALPERHRVLDAPVFTEEIPAGYEVALFGLGCFWGAEEIYWQVPGVWSTSVGYAGGTTPNPSYEEVCTGATNHTEAVRIVFDPARVSFADLVKTFFEVHDPTQGFRQGNDVGTQYRSAIYFTTPEQERVARELTEVYGAELRRRRLGDVTTEIREAPTYYYAEDVHQQYLAKNPNGYRCHANTGIKFPETA

SEQ ID NO: 2233 - protein, 433 aa, Picea mariana
MEHLNTAAAQASSSLYGVGMAEYGDAGVSSMMALITQHEPHDSESIMSTRMPSSFSSFHGHADCLLSAAMFQASQGDHKLKRQPGMDQLVSEQAVMSDSSMPSVKTEVCSGLRNQFEFHREQTGNCYTDQSPNTPVNPLVTSLASQARGEAQMIPSLDANSPHFNVDNEEYAIKSKILAHPQYPSLLGAYIDCQKIGAPPEAVARLDALTHEYQNQQRRTVSIGMDPELDQFMEAYCEILTKYHEELAKPFKEAMTFLMKIEAQFNSLGKGTIRISPPAENDEKTEGGGSSEEVEDGSGGETDFQEVDHHAVEDRELKDHLLRRYSGYLSSLKQEFMKKKKKGKLPKDARQKLLDWWSLHDKWPYPSETEKIALAECTGLDQKQINNWFINQRKRHWKPSEDMHFMVMNSHSPHSAALYVERHLMTEGYHLDC

SEQ ID NO: 2234 - protein, 259 aa, Brassica napus
MAMAAVTGAVLSGLGSSFLSGGKRSITALGSGVGTGAARVGRKTLIVAAAAAQPKKSWIPAVKGGGNFLDPEWLDGSLPGDFGFDPLGLGKDPAFLKWYREAELIHGRWAMAAVLGIFVGQAWSGVPWFEAGADPRAIAPFSFGSLLGTQLLLMGWVESKRWVDFFNPDSQSVEWATPWSRTAENFANYTGDQGYPGGRFFDPLGLAGKTRDGVYEPDREKLERLKVAEIKHSRLAMLAMLVFYFEAGQGKTPLGALGL

SEQ ID NO: 2235 - protein, 103 aa, Pyrenomonas salina
MSGRGKGGKGLGKGGAKRHRKVLRDNIQGITKPAIRRLARRGGVKRISGLIYEETRSVLKVFLENVIRDAVTYTEHARRKTVTAMDVVYALKRQGRTLYGFGG

SEQ ID NO: 2236 - protein, 464 aa, Carboxydothermus hydrogenoformans
MALKIDFNNVFHPYLQKERLGEADIDGYKEKFTSALVSLREKKEKGELGFFHLPYLPEEEIAEIEKTAREVREKFKYFVVLGIGGSALGPLAVHTALNNLRYNELSEELRGGPKFYVEDNIDPERMASLLKVIEPEKTVFNVITKSGATAETLSQLLIVTEVLKKKVGKRFTEHLIFTTDPEKGSLRALARELGVKTFAIPPNVGGRFSELTPVGLLPAAVTGINIRELLAGAREMAERCERENLWENPAGLAAAIHVLLLERGKNMAVMMPYADSLKYMADWYAQLLGESIGKRLNRRGEEVFVGQTPVKALGVTDQHSQVQLYTEGPFDKLLIFLEVERYRNRVVIPPDFPQYAELKFLGGHTLNELIIAEKKATEFALLKARRPNYTVIFPEVNPYTVGELLYFLEAKIAFMGEYLDINAFDQPGVEEGKKATYALLGREGFEEKRQEVLKVKKEPRFILE

SEQ ID NO: 2237 - protein, 278 aa, Unknown
  Mycobacterium sp. MCS
MAGRTIVITGASDGVGAAAAKRLSRSGENVVVVGRSPQKTAAVADALEADSFVADFSDLAQVRDLAQRLLDAYPRIDVLANNAGGMMNTRETTVDGFEKTFQVNHLAPVLLTTLLLDRLVQCRASVLNTSSMANKFVRTGFDDLDAVQKQSGSVAYSSSKLANILFTKELHRRYHGAGISTAAFHPGPVASNFSAEVDNPMFGVIYRSPLRHLALIGTEQGSDELVWLASATPGVDWRSGEYYHKHKVAKANKLADDAGMAERLWENSLELLGERAVS

SEQ ID NO: 2238 - protein, 413 aa, Crocosphaera watsonii
MGGSVSTLILTLELAQVEEKRLMGLQEADNDPVLLELYQSQQQQIFRNAFILHRAAQLMLKTVDLINKNIQKLAEDQVQQKSLLENMVGKLSKYQKAYALQQEINKIEKDINKLADVAMNFENIMSNFLGPFQGLIEQVVSIDEELSGTVEEIRVLAGDILNQDARLFAFEESESLSDSVVDFLATSYGKRERIGDALENMRFETVKSLDESLLPPEVLENTSLTTALDSIQNDVESNLNQLRNNYTNQTVDINDYTVPLVSEVELKSARNVDYAKLRDLLAAGNWKEADQETARVMLQAANRVKEGYLTVNDIDNFPCEDLRTINQLWLSYSEGKFGFSVQKEIYHRLGGTREYNREVWESFGDAVGWRQGGSWLNSKNLTFASIKAPSGHLPFLVGRRGKSLFSRVKTCKL

SEQ ID NO: 2239 - protein, 442 aa, Picea mariana
MKKLFHSDMEHLNAAAAQASSSLYGVSMAEYGDVGVSSMMALMTQHEPHERDSILTTSMPSSFSSFHGHAECLLSAAMFQASQGDHKLKRQPEMDQLVSEQAVMSDSSMPSVKTEGCSSLRNQFEIRREQTGNCYTDQSSNAPVSPLVTSLVPQAGGEARMITSLEADSSHFSGGNEAEAIKAKILAHPQYPSLLGAYIDCQKIGAPPEVVARLDALTHEYENQQHRTTVSIGMDPELDQFMEAYCEMLTKYHEELTKPFKEAMSFLKKIEAQLNSLSKGTIRISPSAENDEKTEGGASSEEVEDGSGGETDFQEVDHHAVEDRELKDHLLRKYSGYLSSLKQEFMKKKKKGKLPKDARQKLLDWWTVHYKWPYPSETEKIALAECTGLDQKQINNWFINQRKRHWKPSEDMQLMAMDGQSPHGATLYVERHLMTEGYHLDC

SEQ ID NO: 2240 - protein, 369 aa, Unknown
  Synechococcus sp. RS9917
MSVSSTDQVQDHAVESAATVTDAAEPVAAQAEVLTADEAFDENDLSIPEDVPTADDPSSRASSRDLDNAGFTLDEFAALLSKYDYNFKPGDIVNGTVFALESKGAMIDIGAKTAAFMPMQEVSINRVEGLSDVLQPGEVREFFIMSEENEDGQLALSIRRIEYQRAWERVRQLQKEDATIYSEVFATNRGGALVRVEGLRGFIPGSHISTRKPKEELVADFLPLKFLEVDEERNRLVLSHRRALVERKMNRLEVGEVVIGTVRGIKPYGAFIDIGGVSGLLHISEISHEHIETPHSVLNVNDQMKVMIIDLDAERGRISLSTKALEPEPGDMLTDPQKVFEKAEEMAARYKQMLLEQAEEGDDGYGMMG

SEQ ID NO: 2241 - protein, 634 aa, Zea mays
MDGCDCIEPLWPTDDLLVKYQYISDFFIALAYFSIPLELIYFVKKSSFFPYRWVLIQFGAFIVLCGATHLINLWTFTTHTKTVAMVMTIAKISTAVVSCATALMLVHIIPDLLSVKTRELFLKNKAEELDREMGLIRTQEETGRHVRMLTHEIRSTLDRHTILKTTLVELGRTLGLEECALWMPSRSGSSLQLSHTLRHQITVGSSVPMNLPVVNQVFSSNRAIIIPHTSSLARVRPLAGRYVPPEVAAVRVPLLHLSNFQINDWPELSAKSFAIMVLMLPSDSARKLHVHELELVEVVADQVAVALSHAAILEESMRARDLLMEQNVALDLARREAEMAIRARNDFLAVMNHEMRTPMNAIIALSSLLLETELTPEQRLMVETVLKSSNLLATLINDVLDLSKLEDGSLELEIKAFNLHAVFKEVMGFIKPIASIKRLSVSVMLAPDLPLCAIGDEKRLMQTILNISGNAVKFTKEGHITLVASIVKADSLREFRTPEFHPTASDEHFYLKVQVKDTGCGVSPQDLPHVFTKFAHPQSGGNRGFNGSGLGLAICKRFVSLMGGHIWIDSEGTGRGCTATFVIKLGVCDNTNTYQKQLVPLIWPSSADSNLSAPKVLPDGRGSVSLKSRYQRSV

SEQ ID NO: 2242 - protein, 321 aa, Oryza sativa
MGKASKDKRDIYYRKAKEEGWRARSAFKLLQIDQEFNIFHGVKRVVDLCAAPGSWSQVLSRNLYVPAKQSPDCKEGDLPLIVAIDLQPMAPIEGVIQVQGDITNARTAEVVIRHFDGCKADLVVCDGAPDVTGLHDMDEFVQSQLILAALTIVTHVLKVGGKFVAKIFRGKDTSLLYCQCFMQLKLFFSQVTFAKPKSSRNSSIEAFAVCENYSPPEGFKEKDLYHLLEKVGTPSGADDLDCRSGWLEGPNKVYIPFLACGDLSGYDSDRSYPLTSTEGGSYQSLDPVQPPIAPPYKTALEMKKVASHGIGADISKLSLDS

SEQ ID NO: 2243 - protein, 776 aa, Salmonella enterica
MMNDSFCRIIAGEIQANAGQVEAAVRLLDEGNTVPFIARYRKEITGGLDDTQLRNLETRLGYLRELEDRRQAILKSISEQGKLTDELAGAINATLSKTELEDLYLPYKPKRRTRGQIAIEAGLEPLADLLWNEPSHDPDVKAAKYIDGDKGVADTKAALDGARYILMERFAEDAALLAKVRDYLWKNAHLVATVVSGKEEEGAKFRDYFDHHEPIANVPSHRALAMFRGRNEGILQLSLNADPQFDEPPKESYCEQIIMDHLGLRLNNAPADSWRKGVVSWTWRIKVLMHLETELMGTVRERAEDEAINVFARNLHDLLMAAPAGLRATMGLDPGLRTGVKVAVVDGTGKLVATDTIYPHTGQAAKAATVIAALCEKYHVELVAIGNGTASRETERFYLDVQKQFPNVTAQKVIVSEAGASVYSASELAAQEFPDLDVSLRGAVSIARRLQDPLAELVKIDPKSIGVGQYQHDVSQTQLARKLDAVVEDCVNAVGVDLNTASVPLLTRVAGLTRMMAQNIVAWRDENGQFQNRQQLLRVSRLGPKAFEQCAGFLRINHGDNPLDASTVHPEAYPVVERILAATQQALKDLMGNSNELRHLKAADFTDDKFGVPTVSDIIKELEKPGRDPRPEFKTAQFADGVETMNDLLPGMILEGAVTNVTNFGAFVDIGVHQDGLVHISSLSTKFVDDPHTVVKAGDIVKVKVLEVDLQRKRIALTMRLDEQPGETAARRGGGADRAQGNRPASKAAKPRGRDAQPAGNSAMMDALAAAMGKKR

SEQ ID NO: 2244 - protein, 1100 aa, Rhodopseudomonas palustris
MNKMTSIAPSDRPDAETSDELWYKDAIIYQLHVKAFADSNNDGIGDFAGLTEKLDYLQELGVNTLWLLPFYPSPQRDDGYDIADYGSINPDFGTMKDFRRFIVEAKKRNLRVITELVINHTSDQHAWFKRARRSPKDSSARDWYVWSDTDQKYLGTRIIFTDTEKSNWTWDPEAGQYYWHRFFSHQPDLNFDNPRVVSAVVKVMKRWLDTGVDGFRLDAIPYLCERDGTNNENLPETHAVIKRLRAELDAYAKGKLLLAEANQWPEDVQQYFGDGDECHMAYHFPLMPRIYMAIAQEDRFPITDIMRQTPEIPANCQWAMFLRNHDELTLEMVTDVERDYLWKTYAADPRARINVGIRRRLAPLMDNDRRKIELMNSLLMSFPGTPIIYYGDEIGMGDNIYLGDRNGVRTPMQWSPDRNGGFSRADPARLYAPPIMDPVYGYASVNVEAQQRSLSSLLSAMKRLIAVRKSTPAFGRGSITFIRPSNRAVIAYVRQYKDEVILCVANLSRAAQATELDLSPWKDRVPQEMLGRTKFPPIGDPAYMITLAPFGFYWFKLQEPGTAAHVAPVSTVPEFVTLVVPLGSTWMTLGRTRSMFEHEVLPTFLSRTRWFPERNPRAIHPRLTSAIPFANDGDNRPWLAFFEATQRGTTARYLLPMQIDWVRFDRERYNPRAYAAVRQGAREGTLLDVAADPSFIDLLLENVRDAVTVTGDNGDRLEFRPGSKLAERPAGPFQNIRAVETEQSNSTALVDGDYVVKLYRRLQIGINPELEMGRFLTEVAGYANTPALLGSVELIEGDKTSAVAVVHEFARNQGDGWTVTSGYLDRYIDEQRVLSRAEEKTESDQLAPYLHFMQQTGKRVAEMHIALASHPEVPDFAPEPITLDASRDWAETVAASADRMLDELRRRRDTLKEGDRTLVDELLAARDVLMSRIHGLLGDDGGLNIRHHGDFHLGQMLIVKDDIYIIDFEGEPRRTLDERRAKAPAARDVAGLIRSIDYSTTAALERALKAASDEPGRLTEALDLWRIRATGAFLDAYRQTMGDSPVWPADIAAADRVLDFFLIEKALYEIDYEIAHRPDWVHVPLVGILRILSPPPEELP

SEQ ID NO: 2245 - protein, 550 aa, Salmonella enterica
MQNPYTVADYLLDRLAGCGIGHLFGVPGDYNLQFLDHVIDHPTLRWVGCANELNAAYTADGYARMSGAGALLTTFGVGELSAINGIAGSYAEYVPVLHIVGAPCSAAQQRGELMHHTLGDGDFRHFYRMSQAISAASAILDEQNACFEIDRVLGEMLAARRPGYIMLPADVAKKTAIPPTEALALPVHEAQSGVETAFRYHARQCLMNSRRIALLADFLAGRFGLRPLLQRWMAETPIAHATLLMGKGLFDEQHPNFVGTYSAGASSKEVRQAIEDADRVICVGTRFVDTLTAGFTQQLPAERTLEIQPYASRIGETWFNLPMAQAVSTLRELCLECAFAPPPTRSAGQPVRIDKGELTQESFWQTLQQCLKPGDIILVDQGTAAFGAAALSLPDGAEVVVQPLWGSIGYSLPAAFGAQTACPDRRVILIIGDGAAQLTIQEMGSMLRDGQAPVILLLNNDGYTVERAIHGAAQRYNDIASWNWTQIPPALNAAQQAECWRVTQAIQLAEVLERLARPQRLSFIEVMLPKADLPELLRTVTRALEARNGG

SEQ ID NO: 2246 - protein, 140 aa, Oryza sativa
  misc_feature (119)..(119): Xaa can be any naturally occurring amino acid
MDTTIGSVPTASDAAAPAPAANSAPREVGARDVFTVPGDFNLTLLDELEAEAGAGHGGVRLVGCCNELNAAYAANGYARARGGGVGACAVTFTVGGLSAINAVAGAFSENLPVVCIVGXPNSNDYGSNRILHHTIGLPDF

SEQ ID NO: 2247 - protein, 160 aa, Bacillus cereus
MTVYDFSAKTITGEDKSLKDYEGKALLIVNVASKCGFTPQYKGLQEVYDKYKDQGLEILGFPCNQFGGQEPGTEADITSFCELNYGVNFPMFAKIDVKGDKAHPLYTYMTEQAPGLLGMKAVKWNFTKFLIGKDGKVVGRFAPQTKPVDLEVEIEKVLGE

SEQ ID NO: 2248 - protein, 75 aa, Glycine max
SYVGPPPPCVSLFLFTSGVIGFMLCSTEGPPVNFKHPINKLNPEKNGVAKGPTKFYNPEIHAAAFCLPSFVDKVD

SEQ ID NO: 2249 - protein, 693 aa, Rhodopseudomonas palustris
MRLTAGTDSRLGATWDGRGTNFALFSANAHKVELCLFDAQGRRELERIELPERTEDVWHGYLNDVSPGQLYGYRVHGPYDPDRGHRFNAHKLLLDPYAKRLNGRLVWSEAHFAYRTGSPREDLSFDRRDNARGMPKVVVVDETVGSGRRETRPGVRWEDTIVYEAHVKGLTQLRDDVPPGLRGTFGGLACPTMIAHLKRLGVTTIELLPVQGFVDDRVLVEKKLVNYWGYNTISFFAPEARYAPDKDNPLDSFRTTVARLHDAGIEVLLDVVYNHTAEGNHLGPTLSFRGIDNASYYWLKPDNPRYYDDFTGCGNSMNLTHPRVLQMVMDSLRYWVEVCHVDGFRFDLATTLARGSNGFDRNSGFFTAIRQDPILAGVKLVAEPWDLGMGGYQVGAFPSQWSEWNDRYRSVMRRYWSGEGSLIGEVSRRMTGSSDMFNRDGRMPRASINHVTVHDGFTLADLFSYERKHNVANGEDNRDGSNDNHSINCGVEGPTDDPKLLGMRRQLRKNQLACLFLAQGVPLLLAGDEVGNSQAGNNNAYCQDNEIGWVGWDGTNTEDDMVEFVGLMTDIRRRFPQLRSRRWLDGRRADGSYGVLWLTPSAAEMTDQDWAFPDGRFLAYVLSPSEPGGSAIFIVLNSGVQEIEFHLPKLPEYQTWKELFDTTKNTVQVATLGCGNPMIAPPRSVLAFSGTTE

SEQ ID NO: 2250 - protein, 72 aa, Triticum aestivum
  misc_feature (26)..(26): Xaa can be any naturally occurring amino acid
  misc_feature (59)..(59): Xaa can be any naturally occurring amino acid
MGKKHWGRLSPSDSLIPTGGCHFTEXPTPLGSINAASWGSDWSVPIAYTYIARMGSKGXLTAAAKNAILNAN

SEQ ID NO: 2251 - protein, 836 aa, Corynebacterium glutamicum
MTSTIEHSYQVWPGHAYPLGSTYDGAGTNFALFSDVAERVELCLLDADNNETRIPLEERDAHIWHCYLPGVQPGQRYGFRVHGPWNPDEGKRCDANKLLVDPYARAFDGDFDGHPSLFSYDITNPNDPNGRNTEDSIDHTMKSVVVNPFFDWGNDRAPRIPYNETVIYEAHVKGMTMTHPDVPEELRGTYAGLAHPTIIQYLSDLGVTAIELMPVHQFLQDDRLRDLGMRNYWGYNSFGFFAPYNDYAANKNPGGAVAEFKGLVRSYHEAGLEVILDVVYNHTAEGNHMGPTIAFRGIDNEAYYRLVEGDRRHYMDYTGTGNSLNVRDPHSLQLIMDSLRYWVTEMHVDGFRFDLASTLAREFDDVDRLATFFDLVQQDPVVSQVKLIAEPWDVGEGGYQVGNFPPLWTEWNGKYRDTVRDFWRGEPATLGEFASRLTGSSDLYANNGRRPTASINFVTAHDGFTLNDLVSYNEKHNMANGEDGRDGESHNRSWNCGVEGPTDDPEIMQLRAQQRRNFLTTLLLSQGTPMLSHGDEMARTQNGNNNVYCQDNELAWVNWDQAEENADLVSFTRRLLRIRANHPVFRRRQFLAGGPLGADVRDRDIAWLVPNGTLMTQDDWDFAFGKSLQVFFNGDAIEEPDYRGQKIHDDSFILMFNAHFEPIDFNLPPEHFGMKWKLLVDTTEAVGHPLEDLTIEAGGTITVPARSTMLLRQVEAPDYTKLEEKIAAEKREQELAAEKEAAEKRELELAAAKEAEDAAEALHLAAERASTQEAELAHQHGADAIADEVAEEPQELPQDEVAAEVETEPDTEPDTESDSEQAEVASEEPEADEEEK

SEQ ID NO: 2252 - protein, 311 aa, Arabidopsis thaliana
MGSFLGHVLPGFAFVALGLWHLFNNIKLFCLHPNTFSSSTWFPISKLRHLELYLIMLSSTASISMELFIGPRRHHPFDVDGTIPSNHLHNFEHSSISMSFLVYAVLALVLDRARPRAAASEGLTMLAAAAAFSQQLLLFHFHSTDHMGVEGQYHVILQVVIFVSLLTTIMGIFLPKSFLVSLVRSSSIAFQGVWLIVIGCMLYTPSLIPKGCYIHDEGRHIIVKCSTEEALHRAKSLVNLEFSWLFVTNTLFVVTLYLILDRVYGENVEYSSLTTNNQTYQDDEEQHFESKSTQKTSFVQMGKLVGHGQKM

SEQ ID NO: 2253 - protein, 383 aa, Bacillus halodurans
MKKEIVGMLLAGGEGKRLGQLTRKLAKPAVYFGGKYRIIDFPLSNCTNSGIDTVGVLTQYEPLALNGHIGIGSPWDLDRRHGGVTVLPPYIEKQGGSWYKGTADAIYQNRYYIEQYDPEYVLILSGDHIYKMDYDRMISHHKKLGADATISVIEVPWEEASRFGIMNTNEEMTITQFEEKPTTPISNLASMGIYIFNWSVLKSYLIQDAKQANSSHDFGKDIIPKMLAKDLKLVAYPFEGYWKDVGTIKSYWEANMDLLDEHSSLMLNDPSWRIYSVNRNQPPQYISTRAYVRCSLVNEGCVVHGNVEQSILFPGVHIGANSSVFESVLMPNVKVGENVVLRRTIIMEGACIPSGTHLAPSDPDDILVIDKDTEFSPSIAANQ

SEQ ID NO: 2254 - protein, 512 aa, Bacillus halodurans
MSKIDMSKFEKKMILRNIHEDDFDAIIAMQQICFPNMEPWKREHLESHLKIFPEGQFCVEYDGKVIGSCASLIINFDEYDDQHTWDEITDNGFITNHDPEGYNLYGIEVMVHPEYRRMKIGRRLYEARKDLARQLNLKSIIIGGRIPNYYKHADQMTPRQYVEEVMMHNIYDPVLTFQVMNGFTLKRVNNNYLQDDKASMKYATLMEWNNIDYRPSSPKRQFKTAFPVRITTIQYEMKKISSFEDFAIQCEYYTDVAASYQSDFAVFPEIFTLQLLSFLPEKSPSLAIRRLTEFTEDYIELFTNLAIKYNINIIGGSHFVEEDGKIYNIAYLFRRDGTIEKQYKLHITPNERKFWGITGGDEVRVFDTDCGKIAIQICYDIEFPELARIAVDKGANIIFTPFCTDDRQGYLRVRYCSQARAIENQVYTVLSGTVGNLPDVENMDIQYAQSGIFSPSDFTFARDGVVGECSPNIETVVVGDVDLEILRRHRRAGSVNQLRDRRHDIYGIQYKK

SEQ ID NO: 2255 - protein, 511 aa, Oryza sativa
MGKAAAVGTAVVVAAAVGVAVVLARRRRRRDLELVEGAAAERKRKVAAVIEDVEHALSTPTALLRGISDAMVTEMERGLRGDGHAMVKMLITYVDTSPPGFSDRNEQGLFYALDLGGTNFRVLRVQLGGKEKRVVQQQYEEVSIPPHLMVGTSMELFDFIASALSKFVDTEGDDFHLPEGRQRELGFTFSFPVSQTSISSGTLIKWTKGFSINDAVGEDVVSELGKAMERQGLDMKITALVNDTVGTLAGGRYADNSVVAAIILGTGTNAAYVENANAIPKWTGLLPRSGNMVINTEWGSFKSDKLPLSEFDKAMDFESLNPGEQIYEKLISGMYLGEIVRRILLKLAHDAALFGDVVPSKLEQPFVLRTPDMSAMHHDSSHDLKTVGAKLKDIVGVPDTSLEVRYITSHICDIVAERAARLAAAGIYGVLKKLGRDKMPKDGSKMPRTVIALDGGLYEHYKKFSSCLESTLTDLLGDDVSSSVVTKLANDGSGIGAALLAASHSQYAEID

SEQ ID NO: 2256 - protein, 426 aa, Carboxydothermus hydrogenoformans
MSDKVIYLSQEQFDEVVLKSDVPVIVDFYSEDCPPCEALAPAYEKLAQQYGDKFKFVKIYRQQNRPLAEKLGVKGSPTVLFYVNGQEVGQRLTGYISKRQLREAMEKAFGQKLLPEVPETVKYDVIVLGGGPAGLSAALYTARAKLRTIVVDESVPGGQAATTYHIANYPGTPGTIRGKELTQNMLNQALAFGAEVDDLKEVLKVELTGEVKRVITEDKIYEAPAIILATGAEPRKLPAEGEDLFRGRGVHYCATCDGAMYQGMKVVVVGGGNSAVEEAVFLTRFATEVTIIHQFDHFQASKVAQEEAFANPKIKVIWDSEVRKVVGDKHVTGVVIENLKTKELSTVPTDGVFVYIGTQPKTNLFAGQVEMNEWGYIITDEEMRTNIPGVFAAGDLRQKSVRQAVTAAADGVIAAVNVERYLASKK

SEQ ID NO: 2257 - protein, 178 aa, Lactobacillus johnsonii
MNNDIESVLYTQNDLNNRMDEMAAELNKKYKNEEPIIVPVLNGAMIFASDMIKRLSFKLTIDPIKASSYEGSHSTGKVKITQDIKSDVKNRPVIFMEDIIDTGRTLQALSEIMKERGAKSVEVVSMLDKPETRVVDFHVDYYGFKAPDEFLVGYGLDYNGLYRNLPYVGILKHEVYAS

SEQ ID NO: 2258 - protein, 766 aa, Zea mays
MVVGTAPCGVSVSSVWILLLLSSLLLSPSAASVDFGHCGCDDADDGALSSTYNILQCQKVSDFLIAAAYFSIPLELLYFATCSDLFPLKWIVLQFGAFIVLCGLTHLITVFTYDPHSFHLVLALTVAKFMTALVSFATAITLLTLIPQLLRVKVRENFLVNKARELDREVGMMKMKEEASWHVRMLTQEIRKSLDRHTILYTTMVELSKALELQNCAVWMPDETRSEMILTHQPRERDIMDQQNCSIPIDDPDVQEIKATKDAKVLGPDSALGVATRKLDVGPVAAIRMPMLRVSNFKGGTPEVMQTSYAILVLVLPNDGSLGWGRRELEIVEVVADQVAVALSHAALLEESQLMREKLAEQYRDLLQAKHEAMRAGEARNSFQTAMYDGMRRPMHSILGLVSMMQQESMNPEQRVVMDAIAKTSSVASTLMNDVMQTSTMNCEHLSLVRRPFNLHSFIKEAVGVVRCLTGCKGVEFEFQVDNSLPERIIGDEKRVFHIVLHMVGTLINRCNVGCISLYVNGHNEVEERHNHDWMLRRTNFSGGYVCVKFEIRIRKSKDYLLSSNGQISHGSKPNNSEMGLSFNMCKKIVQMMNGNIWSVSDSKSVGETIMLVLQFQLQPLTAVSSAASSDLSRSSAIPNFNGLRVLLADSDDTNRAVTHRLLEKLGCRVLSVASGVQCTSSFAAEPSFQLVVLDLALQRTDGLEVARAIRKFSSNSWLPLIVALAARIDDKVRDGCQRSGISGLIQKPATLAALGDELYRVLQNS

SEQ ID NO: 2259 - protein, 1250 aa, Oryza sativa
MPKPTQHIPIVQRLCAHSRQIKIGRDGALRADSETASRSGLGPAPAFGTWAERNIILAHLIPTARTMWAEPEIAVNYGPRRGGCESSSSRPTLQPAPILRHPFAGGFSPPLPPPLHRRPRNLDTSPLAGDHHHGASRFASTSVVKQSSGGLLGWFLGGNSSQLPPLDVPLPGVIISPPLPDFVEPSKTKITTLPKGIKIASETSPIPAVSVRLYIDCGSVYETSSSSGTSHLLERMAFKSTTNRSHLRLVRECYAPEMVEVLIDSGRNPAFLEWEVKEQLQKIKSEISEVSGDPHGLLMEALHSAGYSGALAKPLMASESAVNRLDVATLEEFVSENYTAPRMVLAASGIEHDELVSVAEPLLSDLPSVKRPEEPKSVYVGGDYRCQADSTSTHIALAFEVPGGWRQEKTAMIVTVLQVLMGGGGSFSTGGPGKGMRSWLYLRVLNNYGQIESFSAFSSIYNNSGLFGIHATTNPDFVSSAVDLAARELHEVATPGKVTQEQLDRAKEATKSSVLMDLESRIVASEDIGRQVLTYGERKPIEYFLKTVEEITLNDISSTAKKIISSPLTLASWGDVACCVFVQTHANIVLPVLHFNIESDVMASWLSHLPIHRCQLSFPAAQASYATPGIDSALLLDVDDMAGGDAGLNEGLKKQAKPRLRLPKPAAKRSESEFLRSRPLALLMASSHIILPPDDDDEEQRRLEEEEDEDPWARSGPPPAAPEHAVKAALPFSATCVRISRDSYPNLRALRNASSVSLADAAYVKISEGDFGYVLDDVPHLVDHLPDAPTYPNPLQDHPAYSTVKQYFVNEDDTVPQKVVVQKNSRRGVHFRRAGPHQKVYFESDEVKACIVTCGGLCPGLNTVIRELVCGLAHMYNVSKIYGIQNGYKGFYSSNYLTLTPKSVDDIHKRGGTVLGTSRGGHDTKKIVDNIQDRGINQVYIIGGDGTQKGAYEIFKEIRKRGLKVSVAGIPKTIDNDIAIIDKSFGFDTAVEEAQRAIDSAHVEACSAENGIGLVKLMGRYSGFIAMYATLASRDVDCCLIPESPFYMDGEGGLLQYVERRLKENKHMVIVVAEGAGQDLIAKSLSTSEQQDASGNKLLLDIGLWLTHKIKDHFKSKKIEMTIKYIDPTYMIRAIPSNASDNVYCTLLAHSAIHGAMAGYSFTVGNVNGRHAYIPFYRVTSTRNKVKITDRMWARLLSSTNQPSFLSQKDIDEAKENDRTANKPPLPTGLSHHVANSFDQSASSSSNSQI

SEQ ID NO: 2260 - protein, 362 aa, Nicotiana plumbaginifolia
ALQMAAIILLGLLVSSTEIVGAQSVGVCYGMLGNNLPPASQVVQLYKSKNIRRMRLYDPNQAALQALRGSNIEVMLGVPNSDLQNIAANPSNANNWVQRNVRNFWPAVKFRYIAVGNEVSPVTGTSSLTRYLLPAMRNIRNAISSAGLQNNIKVSSSVDMTLIGNSFPPSQGSFRNDVRSFIDPIIGFVRRINSPLLVNIYPYFSYAGNPRDISLPYALFTAPNVVVQDGSLGYRNLFDAMSDAVYAALSRAGGGSIEIVVSESGWPSAGAFAATTNNAATYYKNLIQHVKRGSPRRPNKVIETYLFAMFDENNKNPELEKHFGLFSPNKQPKYPLSFGFSDRYWDISAENNATAASLISEM

SEQ ID NO: 2261 - protein, 491 aa, Zea mays
  misc_feature (83)..(83): Xaa can be any naturally occurring amino acid
  misc_feature (119)..(119): Xaa can be any naturally occurring amino acid
  misc_feature (134)..(134): Xaa can be any naturally occurring amino acid
  misc_feature (147)..(147): Xaa can be any naturally occurring amino acid
GCLAASAASCSSSPPPPSPGGGRVVTTLPGYEGRLPFHLETGYVEVDEDAGAELFYYFVRARVRRRRQRHPVRPSGSPGGQRXCSAFSGLAYEIGPIMFVVEPYNGSLPRLRYNPNSWXTKVAHILFVDSPVGXGFPFSRDAKGYNXGAVSTTLHLAKVLKKWFNDHPEYHANPFYIDGESYAGKIVPFLAQMISEGIGAGMKSAPRLKGYLVGNPSTEERIDVSARVPCAHGFGIISHQLYEMILGHCHGEDYSNPAKELCGQALKTFNNLTSEVAQGHVLQEKCVAASSSPVPNANSRVAGGSSSWASDGRKILREEEMVGRRGVVLGKLFHPPALPPFSCRVYRYYLSYFWANDRRTRDALGIKEGTVDEWVRCHNDDQELPYESELKSVVKYHRNLTSRGYRALVYSGDHDLLVPHLGTQAWVRSLNFPVVDDWRAWHLGGQSAGFTTTYSNNMTFATIKGAGHTAPEYEPERCFAMFSRWILNRPL

SEQ ID NO: 2262 - protein, 180 aa, Arabidopsis thaliana
MASSMLSSATMVASPAQATMVAPFNGLKSSAAFPATRKANNDITSITSNGGRVNCMQVWPPIGKKKFETLSYLPDLTDSELAKEVDYLIRNKWIPCVEFELEHGFVYREHGNSPGYYDGRYWTMWKLPLFGCTDSAQVLKEVEECKKEYPNAFIRIIGFDNTRQVQCISFIAYKPPSFTG

SEQ ID NO: 2263 - protein, 318 aa, Geobacillus kaustophilus
MADEKIYDVIIAGAGPAGLTAAVYTSRANLSTLMIERGVPGGQMVNTEEVENYPGFETILGPELAAKMFEHAKKFGAEYAYGDVKEIIDGEAYKTVIVGDKEYKARAVIIATGAEYKKLGVPGEAELGGRGVSYCAVCDGAFFKGKDLVVVGGGDSAVEEGVYLTRFANKVTIVHRRDKLRAQKILQDRAFANEKIDFIWNHTVKQINEKDGKVGSVTLVHTQTGEEREFPCDGVFIYIGMVPLSKPFANLGITNENGYIVTNEKMETKVPGIFAAGDVREKTLRQIVTATGDGSIAAQSAQHYVEELKEKLNKQGVS

SEQ ID NO: 2264 - protein, 373 aa, Pisum sativum
TINRVEDLLNLDITPFTDSIIAEYIWIGGTGIDVRSKSRTISKPVSHPSEVPKWNYDGSSTGQAPGEDSEVILYPQAIFKDPFRGGNNILVVCDAYTPAGEPIPTNKRHRAAEIFSNPKVEAEIPWYGIEQEYTLLQTNVKWPLGWPVGGYPGPQGPYYCAAGADKSFGRDISDAHYKACIYAGINISGTNGEVMPGQWEYQVGPSVGIEAGDHIWASRYILERITEQAGVVLTLDPKPIEGDWNGAGCHTNYSTKSMREDGGFEVIKKAILNLSLRHKIHIEAYGEGNERRLTGKHETASINDFSWGVANRGCSIRVGRDTEKNGKGYLEDRRPASNMDPYVVTALLAESTLLWEPTLEAEALAAQKIALKV

SEQ ID NO: 2265 - protein, 628 aa, Francisella tularensis
MCGVVGFYSFNKEEGFDSIINQSLLSIKHRGSDDSGYWCDNQVTLGHTRLSIHDITNAGHQPMLSNSGNTAIVFNGEIYNYLSIKNQLLSEYSNLKFKSNSDTEVLVNAIELWGIDKTLEKCIGMFAFGVYSRKTSCLILARDRFGEKPLYFGIQNGILGFASELKALKPLKECGWRFDIDRDALAAYMRYAYVPTPYSIYKNISKLNVGSYIKFDAKGNSKEYKYWDSKKVLDSEKYKDSYDQAILDLEIKLKSTLSIQMQSDVPLGAFLSGGIDSTTVIALMQSMSKDKINTFSIGFNQKEYNEAEHARAVAKHIGTNHTDMYVTERDALDVIPKLAGIYDEPFADSSQIPTYLVSKIAKSKVTVALSGDAGDELFGGYNRYFLAPNIAKKIKFAKLLKYAPDAWIKKAEILNFGKFALLADKLLKLKRVLEKAKTNKELYVLLCSQINDTSFVLGAKEYDILRDKNIYDIPQLSFQEWMMFVDSNTYMIDDILVKVDRAAMANSLETRVPFLDHNIYEFAYSLPIDYKIQRGNGKRILKDLLYKYVPESLVNRSKMGFGIPLAKWLREDLREWADNLLDYSKIDKQGYLSPEVVQKYWQEHLSGKRNWQAILWNILIFQEWLDNE

SEQ ID NO: 2266 - protein, 465 aa, Pseudoalteromonas tunicata
MSHSAIAQLLKGAVAVDSQVTVKGWIRTRRDSKAGISFLAVHDGSCFDPIQAVVPNSLNNYNDVTTLTAGCSVEVTGKLVRSEGQGQSFEIQADEVNIVGMVENPDTYPMAAKRHSIEYLREHAHLRPRTNMIGAVTRVRNCLAQAIHRFYHERGFLWISTPIITASDCEGAGEMFRVSTLDMQNLPRDDKGNVDYSEDFFGKEAFLTVSGQLNGETYCSAMSNIYTFGPTFRAENSNTSRHLAEFWMVEPEVAFADLNDIAKLAEDMLKYVFSAVLAERRDDMEFFAERVEKTAISRLESFVEKDFAQVDYTDAIEILKNCGKKFEFAVEWGVDLQSEHERYLAEVHFEAPVVIKNYPKDIKAFYMRQNEDGKTVAAMDVVAPGIGEIIGGSQREERLDILDARLEEMGLNKDDYSWYRDLRKYGTVPHSGFGLGFERLVAYVTGMGNVRDVIAFPRTKGSATY

SEQ ID NO: 2267 - protein, 494 aa, Populus alba
MANATTFSLMLQFFFVTFCCLSYFSFAFTSQDYANALEKPILFFEGQRSGKLPSNQRLAWRGDSGLSDGSTYHVNLVGGYYDAGDNVKFGLPMAFTTTLLAWSVIEFGSSMQNQIENAKAAIRWSTDYLLKAATATPDTLYVQVGNPNMDHRCWERPEDMDTPRNVYKVTIHNPGSDVAAETAAALAAASIVFKESDPSYSTKLLHTAMKVFDFADRYRGSYSNSLNSVVCPFYCSYSGYQDELLWGASWIHRASQNGSYLTYIQSNGHTMGSDDDDYSFSWDDKRPGTKILLSKEFLEKTTEEFQLYKSHSDNYICSLIPGTSSFQAQYTPGGLFYKASESNLQYVTSTTFLLLTYAKYLGSNGGVARCGGSTVTTESLIAQAKKQVDYILGDNPARMSYMVGFGNRYPQHVHHRGSSVPSIHAHPNRISCNDGFQFLYSSSPNPNVLVGAIIGGPDNRDNFADDRNNYQQSEPATYINAPFVGALAFFSAKN

SEQ ID NO: 2268 - protein, 320 aa, Nostoc punctiforme
MRIAKDITELIGRTPLVQLNKIPQASGAVARIVVKLESMNPASSVKDRIGASMVEMAEEAGLIHPGKTVLVEPTSGNTGIALAMVAAAKGYHLILTMPDTMSHERRSMLKAYGAQLELTPGVEGMRGAIGRAEQILAQTPNAYMLQQFRNPANPKVHAETTAEEIWNDTDGEVDILVAGVGTGGTITGVAEVIKGRKPSFQAIAVEPSSSPVLTGGKSGPHKIQGIGAGFVPAIYRPELVDEVIQVADEQAIAYSRRLAKEEGLLSGISTGAALYAAIQVAQRPENAGRLIVMIQPSFGERYLSTSLFKDPEENEWLSKV

SEQ ID NO: 2269 - protein, 488 aa, Unknown
  Acidovorax sp. JS42
MPASALVWLRRDLRCHDHAALYHALRRFERVYCVFVFDTDILDALPTRCDRRVEFIHASVCALDEDLRALAARSGAPGGGLIVRHGTAVQCIVQLARSLGVREVLANRDYEPAALARDRRVADGLAACGIAFSDYKDQVLLEQGEVLNQQGQPYSVFTPYKRTWLQKLDAFQTKPYPVERHAQHLAVPPAGERLPTLADLGFVPTNLADLQLPVGSRGAQQLLQDFLPRMAAYKLARDFPGRKGVSYLSVHLRFGTVSIRQLASLAARQAAQGCQGAQTWLSELAWRDFYFMILWHHPHVVTQAFRPEYDRVQWDDAPEYWQAWCAARTGYPLVDAAMRQLLQTGYMHNRLRMVVASFLTKDLGIDWRRGERFFAQHLNDYDLAANNGGWQWAASTGCDAQPWFRIFNPVAQSQKFDPDGRFIRRYLPELACVPDKHLHFPAGMKPLELQACGLRLGIDYPLPVVDHASARERTLMRFHFLGRGREAS

SEQ ID NO: 2270 - protein, 277 aa, Oryza sativa
MAAASRARRWSLAGKTALVTGGTKGIGRAIVEELAGFGVRVHTCSRHDADLQDCLRRWNAAGEGGGAAALVTGSVCDVSVRGDREALVAAARAALGGRLDMLVNNAGQVVVGPAAETAPEEYARLMATNLESCFHLAQLAHPLLRDAAAGGGAAASVVNISSTAAFYAAPHLAVYSATKGGMNQLTRCLAAEWARDGVRVNAVAPGATRTDICDTSGVALGEETRRRLADAGAMDRVPIRRIGEPEEVAAAVVFLCMPAASYITGQVICVDGGRTLL

SEQ ID NO: 2271 - protein, 473 aa, Burkholderia vietnamiensis
MKTLFLQAPSYDGFDGGAGSRYQAKREIRSFWYPTWLAQPAALVPGSRVVDAPADGLSVEETLKIANDYDLVIIHTSTPSFPTDAMFAQDLKKMKPSLLVGMVGAKVMVDPHNSLTASDAIDFVCREEFDYTCKEIAEGKPFPEIKGLSWRAKDGSIEHNEARPILENMDELPFVAPIYKRDLKIDNYFIGYLNYPYVSIYTGRGCKSRCTFCLWPQTVSGHRYRTRSVENVLAEAKWIRDNMPEVKELMFDDDTFTDDLPRAEAIAIGLGKLGMTWSCNAKANVPYKSLKIMKENGLRLLLVGFESGDDQILVNIKKGVRTDFARRFSADCKKLGIKIHGTFILGLPGETPETIKKTIEYAKEINPHTIQVSLAAPYPGTTLYKQAVENGWMEENKTINLVSKEGVQLAAIGYPHLSRDEIYHHLEQFYREFYFRPSKIWEIVREMLTSWDMMKRRLREGVEFFRFLRAHEA

SEQ ID NO: 2272 - protein, 195 aa, Geobacillus kaustophilus
MAREAMIARTTNETSIQLSLSLDGEGKAELETGVPFLTHMLDLFAKHGQFDLHIEAKGDTHIDDHHTTEDIGICLGQAIKEALGDKKGIKRYGNAFVPMDDALAQVVIDLSNRPHFEFRGEFPAAKVGAFDVELVHEFLWKLALEARMNLHVIVHYGRNTHHMVEAVFKALGRALDEATMIDPRVKGVPSTKGML

SEQ ID NO: 2273 - protein, 561 aa, Bacillus thuringiensis
MIHLKTHYTVSTYLLDRLSELGIEHIFGIPGDYNLAFLDDVIAHEKLEWIGNCNELNAAYAADGYARIKGIAALITTFGVGELSAINGIAGSYAENVPVIKITGTPTTTVMENGELVHHTLGDGKFNHFSNMYREITVAQTNLTPEHAVEEIDRVLRACWNEKRPVHINLPIDVYNKPINKPAGPILHKPILSNKETLDKMLLHAISKINSAKKPIILADFEVDRFHAKEYLYQFVEKTGFPIATLSMGKGIFPEKHPQFIGIYTGDVSSPYLRKRIDESDCIISIGVKLTDTITGGFTQGFTKEQVIEIHPYTVKITDKKYGPVVMKDVLQQLSDVIEHRNEETLDIKPFISESLSMTEEFNPKAQMVTQKRFWQQIYHFLQENDVLLAEQGTPFFGSAAIPLPNDTTYVAQPLWGSIGYTLPALLGTQLANLSRRNILIIGDGSFQLTVQELSTMLRQNLKPIIFLINNNGYTVERAIHGQIEPYNDIQMWEYTKLANVFGTEEKSQTFKVENETELQEVLTKISIDKDQLTFVEVVMSQGDQPELLAKLGKRFGQQNS

SEQ ID NO: 2274 - protein, 312 aa, Saccharomyces cerevisiae
MSKEDIEGTNILDEPVHGIYIPAALFVVGVAITTYMSGELKILWSLPILFMIIFVRAYSAYKRRRSLYPDRWTSLELEDQTIISKNTALYRFKLKTRLESLDIPAGHHVAVRVPIDGKQEVRYYNPISSKLESGYLDLVVKAYVDGKVSKYFAGLNSGDTVDFKGPIGTLNYEPNSSKHLGIVAGGSGITPVLQILNEIITVPEDLTKVSLLYANETENDILLKDELDEMAEKYPHFQVHYVVHYPSDRWTGDVGYITKDQMNRYLPEYSEDNRLLICGPDGMNNLALQYAKELGWKVNSTRSSGDDQVFVF

SEQ ID NO: 2275 - protein, 266 aa, Triticum aestivum
  misc_feature (239)..(239): Xaa can be any naturally occurring amino acid
  misc_feature (251)..(251): Xaa can be any naturally occurring amino acid
AYLGDTIEQVCTKKQAGTGPEFPGYRRPTRPLGSCTMKLNATVEMMPVTDPKFANMHPFAPIDQAAGYHEMFDNLGDLLNTITGFDSFSLQPNAGASGEYAGLMVIRAYHKARGDHHRNVCIIPVSAHGTNPASAAMCGMKIVAVGTDAKGNINIEELRKAAEANKDNLSALMVTYPSTHGVYEEGIDEICRIIHENGGQVYMDGANMNAQVGLTSPGFIGADVCHLNLHKTFCIPHGXGGGPGMGPIGVXKHLAAFFASHPVDPT

SEQ ID NO: 2276 - protein, 160 aa, Clostridium difficile
MKKEMLAMILAGGQGSRLGVFTKRIAKPAVSFGGKYRIIDFVLSNCSNSGIDTVGVLTQYRPLILNSHIGMGSHWDLDRINGGVYVLQPFMNEKEGNWYNGTAHAIYQNMDFVDTYNPEYVLILSGDHIYKMDYSKMLKFHKEKGSKATIAVIEVPWDEA

SEQ ID NO: 2277 - protein, 554 aa, Clostridium acetobutylicum
MKSEYTIGRYLLDRLSELGIRHIFGVPGDYNLSFLDYIMEYKGIDWVGNCNELNAGYAADGYARINGIGAILTTFGVGELSAINAIAGAYAEQVPVVKITGIPTAKVRDNGLYVHHTLGDGRFDHFFEMFREVTVAEALLSEENAAQEIDRVLISCWRQKRPVLINLPIDVYDKPINKPLKPLLDYTISSNKEAACEFVTEIVPIINRAKKPVILADYGVYRYQVQHVLKNLAEKTGFPVATLSMGKGVFNEAHPQFIGVYNGDVSSPYLRQRVDEADCIISVGVKLTDSTTGGFSHGFSKRNVIHIDPFSIKAKGKKYAPITMKDALTELTSKIEHRNFEDLDIKPYKSDNQKYFAKEKPITQKRFFERIAHFIKEKDVLLAEQGTCFFGASTIQLPKDATFIGQPLWGSIGYTLPALLGSQLADQKRRNILLIGDGAFQMTAQEISTMLRLQIKPIIFLINNDGYTIERAIHGREQVYNNIQMWRYHNVPKVLGPKECSLTFKVQSETELEKALLVADKDCEHLIFIEVVMDRYDKPEPLERLSKRFANQNN

SEQ ID NO: 2278 - protein, 462 aa, Streptomyces avermitilis
MSSRTTLDTAPETSAADAPLSHGLKQRHLSMIALGGVIGAGLFVGSGAGIAAAGPSIVIAYSVSGLLVMLVMRMLGEMSAAYPSSGSFSAHAERAIGPWAGFTAGWSFWVLLCTAVGLEGIGAAKIVTGWLPGTPEWGWVALFMVVFCVANLAAVKNFGEFEFWFAALKVGAISLFLVLGVLAMTGVLPGTDSPGASNLHDFLPNGSEGLVIGLLASVFAYGGLETVTIAAAESENPVQGVARAVRTAMWRIALFYIGSMAVIVTLVPWDSKEVVEKGPYVAALDHLGIPGAGQLMNVVVLVALLSAMNANIYGSSRIAYSLVERGQGPKALGRVSGGVPRIAVLVSCVFGFVCVVLSYWRPNDVFPWLLNMIGAVILVVWIFIAVSQLLLRRKVEREAPEKLVVRMWAYPVLTWVALAGMAAIFILMARQPDTRVQLYSTGAMTLVLAAVGYAWQRARARA

SEQ ID NO: 2279 - protein, 675 aa, Coccidioides immitis
MTQLFNSSSGSSGVGSEKRPFPGLSLPSRKHSGDPSHFPTRLKNFFRINSSSSSNTPTVSNSGGGSGSGGAHHTSSGHAHLSTKPESKSTFRQSRFLPTIGRNRSTTVASEGNPLDEIASPTADANPYFHHQGYPALRHRNDDSAPSSPPDTPELQVEGVPASDQATAAGKEELARKLRRVASAPNAQGLFSGDGSGDRPKTAELGKEPLVASGGASPKLSFVDQPGSQAASISDERASTLSVPRSFVNCRRTYSSNSIKVRNVEVGPGSFDKIKLIGKGDVGKVYLVREKKSNRLYAMKVLSKKEMIKRNKIKRALAEQEILATSNHPFIVTLYHSFQSEEHLYLCMEYCSGGEFFRALQTRPGKCIPEDDARFYAAEVTAALEYLHLMGFIYRDLKPERHIMLSDFDLSKQSGPGGAPTMIVGRNGTSSSSLPTIDTKSCIANFRTNSFVGTEEYIAPEVIKGDGHTSAVDWWTLGILIYEMLYGITPFKGKNRNATFANILRNDVPFPDHAGAQQISNLCKSLIRKLLIKDETKRLGARAGASDVKTHPFFRTTQWALIRHMKPPMIPHQGRAIDTVNFRNMKESASVDIGGTSKLKGVPMDSGLATPGEQIPDPFEDFNSVTLHHDGDYHGQLADDSFNGYYSRLVCIQPPSIKVLAEISKMQTEPLGMKI

SEQ ID NO: 2280 - protein, 759 aa, Saccharomyces cerevisiae
MPAPKLTEKSASSKSTQKTTNYSSIEAKSVKTSADQAYIYQEPSATKKILYSIATWLLYNIFHCFFREIRGRGSFKVPQQGPVIFVARPHANQFVDPVILMGEVKKSVNRRVSFLIAESSLKQPAIGFLASFFMAIGVVRPQDNLKPAEGTIRVDPTDYKRVIGHDTHFLTDCMPKGLIGLPKSMGFGEIQSIESDTSLTLRKEFKMAKPEIKTALLTGTTYKYAAKVDQSCVYHRVFEHLAHNNCIGIFPEGGSHDRTNLLPLKAGVAIMALGCMDKHPDVNVKIVPCGMNYFHPHKFRSRAVVEFGDPIEIPKELVAKYHNPETNRDAVKELLDTISKGLQSVTVTCSDYETLMVVQTIRRLYMTQFSTKLPLPLIVEMNRRMVKGYEFYRNDPKIADLTKDIMAYNAALRHYNLPDHLVEEAKVNFAKNLGLVFFRSIGLCILFSLAMPGIIMFSPVFILAKRISQEKARTALSKSTVKIKANDVIATWKILIGMGFAPLLYIFWSVLITYYLRHKPWNKIYVFSGSYISCVIVTYSALIVGDIGMDGFKSLRPLVLSLTSPKGLQKLQKDRRNLAERIIEVVNNFGSELFPDFDSAALREEFDVIDEEEEDRKTSELNRRKMLRKQKIKRQEKDSSSPIISQRDNHDAYEHHNQDSDGVSLVNSDNSLSNIPLFSSTFHRKSESSLASTSVAPSSSSEFEVENEILEEKNGLASKIAQAVLNKRISENTAREEEEEEEEEEEEEEEEEEGKEGDA

SEQ ID NO: 2281 - protein, 466 aa, Borrelia burgdorferi
MINKMFASIKDILKNPILNSNVTINGWIRTKRSNGKIGFIEINDGSTLKGIQAVINEEENQFSEKDLKKLTTGTSISLTGLLVESPAKGQNYEIKTHSFNVIGETDPETYPLQKKRHSFEFLREIPHLRIRTNTFGAIARVRNKISYKIHEYFQKNGFFYINTPIITSNDGEGAGEMFRVSTLKFNKLNNALSNIDFKDDFFGKEAFLSVTGQLHGEAYAMALSKIYTFGPTFRAENSNTTRHASEFWMIEPEMAFYKLNDNIALAEDLLKYLLSSILNECSQDMDFLENYIEKGLIKKLENVINSNFEVITYTKAIEILENSKKNFEIKPYWGIDLQTDHERYLTEETFKKPVVVIDYPKNFKAFYMKANKDNKTVKGMDILVPKIGEIIGGSEREDDLQKLENRIKELNLNIEHLNWYLDLRRFGSAPHSGFGLGLERLVQYSTGISNIRDSIPFPRTPKNLYF

SEQ ID NO: 2282 - protein, 57 aa, Triticum aestivum
  misc_feature (7)..(7): Xaa can be any naturally occurring amino acid
  misc_feature (25)..(25): Xaa can be any naturally occurring amino acid
  misc_feature (34)..(34): Xaa can be any naturally occurring amino acid
  misc_feature (39)..(40): Xaa can be any naturally occurring amino acid
  misc_feature (45)..(45): Xaa can be any naturally occurring amino acid
  misc_feature (51)..(51): Xaa can be any naturally occurring amino acid
MGRRPAXCYRQIKNKPYPKSRYCRXVPDPKIRIXDVGMXXNGVDXEFPSCXHLGQLR

SEQ ID NO: 2283 - protein, 773 aa, Lactococcus lactis
MAKETFSIEFAGRTLTVETGQVAKQANGAVVVRYGDTTVLTAATMGKMATGDFFPLQVNYEEKMYAAGKFPGGFNKREARPSTDATLTARLIDRPIRPMFAEGFRNEVQVINTVLSYDENASGRVAAMFGSSLALAISDIPFDRPIAGVEVAYIDGEYIINPTVAEKEASSLELSVAGNINAINMVESGAKELSEEVMLGALLAGHNAVKELIEFQNEIVAKVGKEKAEVELLHVDEDLKAEVIAAYNSDLQKAVQIEEKLARESATKAVKEAIISVYSAKYENDENLSIILRDLAEILEGMEHAEVRRLITEDKIRPDGRKIDEIRPLDAEIDFTPRNITHGTGLFTRGQTQALSTLTLAPMNEAQIIDGLNDEYKKRFMHHYNFPQYSVGETGRYGAPGRREIGHGALGERALEQVLPSLEEFPYAIRLVAEVLESNGSSSQASICAGTLALMAGGVPIKAPVAGIAMGLISDGTNYTVLTDIQGLEDHFGDMDFKVAGTRDGITALQMDIKISGITPEILAEALAQAKTARFQILDVIEATIAQPREELAPSAPKIDTITIPVDKIKVVIGKGGEQIDKIIAETGVKIDIDDEGLCSIFSSDQAAIDRAKEIIAELVREAKVGEIYDAKVVRIESFGAFVNLFGKQDAMVHISEMAWARTENVEDVVKLGDTVKVKIMKIDDKGRVDASMRALVEKPEGYVEPERKPRERRENGDRRKGNGNSNRGNGFDRRNNDRNNQGNKVGNHSFELRERKSHIDEEFPELSTKKPE

SEQ ID NO: 2284 - protein, 439 aa, Thermosynechococcus elongatus [sequence omitted]

SEQ ID NO: 2285 - protein, 498 aa, Kineococcus radiotolerans
MARAPPPRGAPSDRGAGPGDPGTTVEEDVVQLAPQEQSGLGTGLKPRHITMISIAGVIGAGLFVGSKTAIAEAGPGVLLSYAFAGLLVVLVMRMLGEMATAHPDTGSFSTYADRALGRWAGFSVGWLYWWFWVLVIPVEATAAADILSSWIGAPQWVWALLVTLALTASNLTSVGNYGEFEFWFAGVKVVAIVGFIAVGLLAIFGVLPGSDISGTPGFSLTGDAGGFLPNGFSAVLAGILLTMFSFMGTEIVTIAAAESPDPQKGVRRAVNSVIGRIGVFYLGSIFVVVALVPWNSAALDADGSFQTTLQAIGIPGAATIMDVVILTAVASCLNSALYTASRMVFSLSRRGDAPVWLSHVSRRGVPYPAILASTVVGFLAVVGNYLLPEKIFEYLLATSGALALVIYAFIALSQVVVRRRLDEAGERPAVRMWLFPWLTYATIAFIAVVLVLMVVLPGQRVQLALSLVLTVVVVALGLRHQRRRGPAARPADEAAAHR

SEQ ID NO: 2286 - protein, 532 aa, Cryptococcus neoformans
MSVDGLVPSLGHIEADQYAMRSTQRRLSSLPPTIRSLLSSRRSTLPSVSSTTHLETVSCANEPVEVNGWIKSVRAHKNVAFVEVSDGSTGENIQAVLKGKSKAEGLSIGASAKLKGRLEQSRGRGQDVELVVEDAQVLGTCDAEAYPIQKKSLPASVLRDNAHLRFRTSQTAAVMRIRDALARDWHDWFESHDFVHVHTPILTGSDCEGAGEVFTIVDHPPPSSSSSPQPFFPHPVHLTVSAQLHLEAPTHALSRTYTLSPSFRAEPSLTSRHLSEFHMLEAEVAWENDLDGLLSVVEEGVKSTVGNILNGEKRGKRLRDDLSIVAKSLRDVDDLGSVIDPAQEFADPLYHLQLVMDKPFTRITYTSALELLSSLHADSPSTISPPPLWGQGISTDHEKLLAAHFNGPVFVTRYPKELKPFYMLPTPSTIENEKTHASQGSTVECFDLLFPHWGEMAGGSLREHRLTELTHAIEEMGMKKEEYNWYLDLRKYGSAPHGGWGMGWDRWVGWVTGLGNVRDVVPYARWKGHCKY

SEQ ID NO: 2287 - protein, 178 aa, Hibiscus rosa-sinensis
ECALWMPSGTGMHLQLSHTLNYQIQVGSTVQINLPVVNEVFNTGRALRIPYTCPLARIRPLAGRYVPPEVVAVRVPLLHLSNFQINDCPDLSAKNYAVMVLILPTDSARKWRDHELELVEVVADQVAVALSHAAILEESMRARDQLMEQNVDLDLARREAERAIHARNDFLAVMNHEM

SEQ ID NO: 2288 - protein, 328 aa, Nocardia farcinica
MSTPVRDLIIVGSGPAGYTAAVYAARAELKPLLFEGTQFGGALMTTTEVENFPGFRNGIMGPDLMEEMREQAKRFGAEIRTEDVDALDLTGPVKKVTVGDETYEAYAVILAMGSAARYLNVPGEERLLGRGVSACATCDGFFFRGQDIVVVGGGDSAMEEATFLTKFASSVTIVHRREEFRASRIMLERAKANSKIKFVLNAEVTEVHGDTSVTGLTLRDTRTGETSHLAATGLFVAIGHDPRSELVRDQVELDAEGYVVVEHPTTATKIPGVFAAGDLVDHTYRQAITAAGTGCRAAIDAERWLAEQGDITDNTLDNAGEPVAVNAN

SEQ ID NO: 2289 - protein, 711 aa, Myxococcus xanthus
MTVATREHTRTLRAAESLGKDLGRGLARMDPADMKRLGAHVGDIVTLSGKRRSAAKVMPSYPDARGRGILQIDGVTRANTGVQLDEPVKLTLAPARHAEKVVLAPLEFTPAQRDLAYIGTLLDGLPVVKGDRVRALLFGSRTADFRVVETTPVGAVVIHPNTLLEVAKAPEKEKVTHERARAVSYEDVGGLKRELGRIREIVELPLRYPEVFERLGIDAPKGVLLYGPPGCGKTLIARAVAHETAAAFFTITGPEIMHKFYGESEAHLRQIFDEAQRRAPAIIFVDEIDAIAPRRENVQGEVEKRVVAQLLSLMDGLAQRRHVIVLAATNIPNVLDPALRRPGRFDREIAISIPDRTARKEILAIHSRGMPLAEDVDLDHLAAVTHGFVGADLQALCREAAMLCLRRLIPHIDFASAEIPYDELIQVQVTMADFQAALHEVGPSAIREVFVETPDVGWKDVGGLGQLKQRLIEAVEWPLRYPEEFARAKVRPPKGVLLSGPPGCGKTLMAKAAAHESQVNFISVKGPALLSKFVGESERGVRETFQKARQAAPCIIFFDEIDSLVPTRSAGGMDERVTERVVSQFLAEMDGIEELTGVLVLAATNRADLLDPALLRPGRFDLLVDVPLPDREARRDIFQVHLRDKPVEKDLDLGGLAARSESFSGADIQAVCNQAAWEAVRHVISGKGKRLVITSESLLKAIRGHKEARRP

SEQ ID NO: 2290 - protein, 110 aa, Nocardia farcinica
MSENGKTVTVTDASFADDVLMSEKPVLVDFWADWCGPCKMVAPVLEEIAGTHADKLTVAKLDVDANPATARDYQILSLPTMMLFRGGKPVKQIVGAKGKAALLRELDGVI

SEQ ID NO: 2291 - protein, 507 aa, Oryza sativa
MAPMAGGGGVPWGDRARVVGAQIRSRFRVGVVPVDRRWLWRRGDGRVASEAVRQWTERVRSLWQREKSTDQISSSPGTSQAAAAAKPSSSALRFYRKKVGKEVDGIEDSVIFRSLQALAVPLIGNACHIFMHGLNSVQIYGAEKLQQALQERPKGKPLLTVSNHVAAMDDPFVIASILPPSVMLEAQKLRWTLCASDRCFTNPILSTFFRSVKVLPVSRGDGIYQKGMDMALSKLNNGGWVHIFPEGSRSKDGGKTVAPAKRGVGRLVMDADSLPVVIPFVHTGMQDIMPVGKRIPRAGKRVIVVVGDPINFNDLIIDNSDETQHISRGILYDKATERIGQRLQELKAEVDRLAAEQKSELQHHHARDTVNYGTRLWQQVDWEAFGMESSMLSPEPSDVQEPLKKAKPVLHLESEHAKPELHLEPEQAKHELHTEQCVPAAPSAEICSDFGAPLFFRQHTDPSELMGFAARGLLKNGRFMEEEGYRELQRQGAMNMFWGSQANNTVL

SEQ ID NO: 2292 - protein, 628 aa, Bordetella bronchiseptica
MCGVLGAWWRHHDEHEDARFAAGLRKLAHRGPDDRGSEHFAAPHGRLSLGHTRLAVIDLSAAGHQPMHADADRLAVVFNGEIYNYRELRSELRQIGASFRGDSDTEVLLAAWQHWGVAALRRFKGMFAFALYDRRQQTLTLARDAFGIKPMYYHAAPERLLFGSELPAVQALLPHPPRLNWQRAYDYLAYGQYDQPPDTFIAGIRQLPAGHLLTLDLRTGQAGEPMAWDDPASQECRPIGFQEAAEELRARFLDNVRLHLRSDVPIGAALSGGIDSSAIVCAMRWLEPDLPIQTFSFISDDTHRSEERWVDLVNQHCGATGHKIHIAPHELLDDLDDLIRVQGEPVGSTSIYAQYRVFKLAREHGVVVTLDGQGADELLGGYGGYPTERLASLLETGRLGAAARLLRQQGRGAPARLLQAAALAAGGRHLANLRHATGRQHAPAWLDAQVLRDQGVTMREPAHAWAAATPLRGRRLVNELAHALYHRGLGALLRHGDRNSMRFSVESRVPFLTQDLAEFALSLPERYLVSDSGQTKHIFRKAMRGIVPDSILDRDDKIGFATPEQQWMQATAPQMRQWLVDAADIPFLRNAEVTAQFDAMIAGATPFSWQAWRWVNFQRWMQHATVLP

SEQ ID NO: 2293 - protein, 374 aa, Pinus taeda
MAMSNGRLCEDLDRIKGPWSPEEDASLQRLVQKYGPRNWTLISKGIPGRSGKSCRLRWCNQLSPQVEHRPFTPSEDAAILQAHAQHGNKWATIARALPGRTDNAIKNHWNSTLRRRCRDPEKGIVVHLDDEISSLDAARKRSSDGFSHDGSSALEDNGCSSWEVDSKRLKRLGELGTEQGPEVEAEVEVSDRSDANPGRVLYRPVPVVSFFSSFGKTVANLQETAAGAVGVDPPTSLSLSLPGLDPAIPSPKLSTQKDSHNNSTVNNNIPIPPVVEYMRADEAVVERLSTAVKATVASMLTPVLNSSPRGYNPPAVSSDVLALMRDMVAKEVQKYMSSHHQPGMYTPLSPHPEFLGAANLVRNVVLGGALHLNK

SEQ ID NO: 2294 - protein, 296 aa, Triticum aestivum
ELVQKHVDDNADITLSCAPVGESRASEYGLVKFDSSGRVVQFSEKPKGDDLEAMKVDTSFLNFAIDDPAKYPYIASMGVYVFKRDVLLNLLKSRYAELHDFGSEILPRALHDHNVQAYVFTDYWEDIGTIRSFFDANMSLCEQPPKFEFYDPKTPFFTSPRYLPPTKSDKCRIKEAIILHGCFLRECKIEHSIIGVPSRLNSGSELKNAMMMGADSYETEDEISRLMSEGKVPIGVGENTKISNCIIDMNARIGRDVVISNKEGVQEADRPEEGYYIRSGIVVIQKNATIKDGTVV

SEQ ID NO: 2295 - protein, 982 aa, Ralstonia solanacearum
MNAPHPASAALTQTLAARPTLAELEARDAFAERHIGPSPDEQAAMLATLGYASRAALIDAVIPPAIRRQDGMPLGEFTQPLTEEAALAKLRGIAGQNRVVRSLIGQGYYGTHTPGVILRNILENPAWYTAYTPYQPEISQGRLEAMLNFQQMVMDLTAMDIANASMLDEATAAAEAMTLLQRVGKHPSNVFFVADDVLPQTLDVVRTRAEPIGVQVVTGPAADAAKHNAFGVLLQYPGTGGALLGGLSTYQALTDAVHAAGGLVVAAADLLALTLLAAPGEWGADVVIGNTQRFGVPFGFGGPHAGYMAVRDAFKRSMPGRLVGVTVDAQGNPAYRLALQTREQHIRREKATSNICTAQVLLGVMASMYAVYHGPQGLKRIAQRVHRLTATLAAGLRQIGYTLEAGAFFDTLTVATGPRTANLHIAAQAHGFNLRQIDDGRLGVSLDETVTRAEVVALWEIFAHAAHAGAPDFDQVEAGIADAFPASLARQSAYLTHPVFNAHHSEHEMLRYLRSLADKDLALDRTMIPLGSCTMKLNATAEMLPVTWPEFANIHPFAPADQTVGYREMIDQLEQMLCAATGYAAVSLQPNAGSQGEYAGLLIIHAYHASRGESHRDVCLIPSSAHGTNPASAQMAGMKVVVVACDERGNVDLADLEKKAAEHSANLAAIMITYPSTHGVFEEGVKRVCEIVHSHGGQVYVDGANMNAMVGTAAPGHFGGDVSHLNLHKTFCIPHGGGGPGVGPVAVGAHLAPFLPGRAASGEDASQNIGAVSAAPFGSASILPISWMYIAMMGAAGLTAATEAAILSANYVARRLSPYYPVLYTGAHGLVAHECILDIRPLQKESGISNEDIAKRLMDFGFHAPTMSFPVPGTLMIEPTESEPKVELDRFIDAMIAIRGEVDQVISGAFDREDNPLKHAPHTAQVVMADDWSHRYTREQAAYPVASLRTRKYWPPVGRADNVYGDRNLFCACVPMSEYAQD

SEQ ID NO: 2296 - protein, 382 aa, Unknown
  Rhodococcus sp. RHA1
MARDYYATLGVDQKATDQELKRAYRKLARELHPDVNPDEAAQARFRDISTAYEVLSDPEKRRIVDLGGDPLSSGGGGGAGFGGGFGGGLGDVFEAFFGGGGGAGRGPRGRVQPGADSLLRTRLTLAECATGVSKQVTVETAILCDSCTGAGTNGDSKPVRCETCGGAGEVQSVQRSFLGQVMTSRPCPTCRGAGETIPDPCHKCGGDGRVRARRDITVKVPAGVAGGMRIRLAAQGEVGPGGGPAGDLYVEVVEQAHEVFVRDGEDLHCTIRVPMIDAALGTTVTIDTIIDGPKEITIEPGTQPGSVTVLRGHGMPKLRSGIRGDVHAHLEVVVPSRLDHKETKLLRELKDLRDRDVAEVVSTQSQHSGGLFSRLREAFSGR

SEQ ID NO: 2297 - protein, 323 aa, Salmonella enterica
MSKIYEDNSLTIGHTPLVRLNRIGNGRILAKVESRNPSFSVKCRIGANMIWDAEKRGVLKPGVELVEPTSGNTGIALAYVAAARGYKLTLTMPETMSIERRKLLKALGANLVLTEGAKGMKGAIQKAEEIVASDPQKYLLLQQFSNPANPEIHEKTTGPEIWEDTDGQVDVFISGVGTGGTLTGVTRYIKGTKGKTDLITVAVEPTDSPVIAQALAGEEIKPGPHKIQGIGAGFIPGNLDLKLIDKVVGITNEEAISTARRLMEEEGILAGISSGAAVAAALKLQEDESFTNKNIVVILPSSGERYLSTALFADLFTEKELQQ

SEQ ID NO: 2298 - protein, 233 aa, Unknown
  Frankia sp. CcI3
MFFGRHKTTLPTPEQALPGRDRPVFAGDVPHTVLGTPLAGPFPAGLETAVFGLGCFWGAERAFWKVPGVYTTAVGYAGGHTPHPTYEEVCSGLTGHTEVVLVVYDPAKVGYEELLRVFWEGHDPTQGMRQGNDTGTQYRSAIYTTTAGQAAAAAASREAFQQVLTAAGLGAITTEIAPAGPFYYAEEYHQQYLSDAKNPGGYCGLGGTGLSICGPWSERESTSEPARTEQAQG

SEQ ID NO: 2299 - protein, 168 aa, Arabidopsis thaliana
  misc_feature (38)..(38): Xaa can be any naturally occurring amino acid
  misc_feature (68)..(68): Xaa can be any naturally occurring amino acid
  misc_feature (114)..(114): Xaa can be any naturally occurring amino acid
  misc_feature (122)..(122): Xaa can be any naturally occurring amino acid
MEVKLLNDKGERDMYENFVERYAINIITATEKLDKVIXETEYVFHFKKLSATVKDMVPNIERFAETYXMDSYCGTSRCATMASTSSSASAVAECVQNFFTSMGALKLNMVAVDXVYPLLSDXPASLNKLMYQPPTLTVLAKFKAQHIKNCKEEEKNGRDEEKVPIIVT

SEQ ID NO: 2300 - protein, 616 aa, Oryza sativa
MASSNETYRVELRAAARQLGERGLYSAAKWAAELLVGIEPDATPAPSSVMDTPSSSGSAASGGRLLHLHRSGGSSFRRRLRPGAAEAGTPLGGVSYVSTPIPDDDAFDVGGDRYLLAKTYFDCREYRRAAHVLRGQTGRKAVFLRCYALYTAGEKRKEEETVELEGSLGKSNAVNQELVALERELATHRRTGAIDSFCLYLYGIVLRDKGSEALARTVLVESVNSYPWNWSAWLELQSLCTSSDILNNLNIKNHWMKDFFLASAHLELKMHEEALKRYERLMGVFRCSDYIQAQIATVQYSMRDLDEADMIFEELLRTDPFRVDSMDVYSNLLYAKESSTALSFLAHRVFLTDKYRPESCCIIANYYSLKGQHEKSVLYFQRALKLNRKYLSAWTLMGHEFVELKNTPAAIDAYRRAVDINPRDYRAWYGLGQIYEMMGMPFYAVYYFRKSSYLQPNDARLWNAMAQCYESDQLQMIEEAIKCYERSANNNDTEGIALHQLAKLHGMLGQSEEAAFYYKKDLERMEVEERQGQNFVEALLFLAKHCKSIGRFEEAEHYCTRLLDYTGPERETAKSILQGLKRAQSVLPLMDIDHFAIKLHIAGDVDLVCMMISSSC

SEQ ID NO: 2301 - protein, 806 aa, Oryza sativa
MVEMIRPTGPEPRTMPVKSPSNDPPTKPFLSVMYGRMPKKSNNTKYYEVLGVSKTATQDELKKAYRKAAIKNHPDKGGDPEKFKELAQAYEVLNDPEKREIYDQYGEDALKEGMGGGSSSDFHSPFDLFEQIFQNRGGFGGRGHRQKRGEDVVHTMKVSLEDLYNGTTKKLSLSRNALCTKCKGKGSKSGAAATCHGCHGAGMRTITRQIGLGMIQQMNTVCPECRGSGEMISDKDKCPSCKGNKVVQQKKVLEVHVEKGMQHGQKIVFQGEADEAPDTVTGDIVFVLQLKDHPKFKRKFDDLFTEHTISLTEALCGFQFVLTHLDGRQLLIKSNPGEVIKPGQHKAINDEGMPQHGRPFMKGRLFVEFNVEFPEPGALTPGQCRSLEKILPPRPRNQLSDMELDQCEETTMHDVNIEEEMRRRQQHRRQEAYDEDDDEDAGAGPRHARNNSARLGLDVETDAPLVATGQLHLFKKILTSESSENLNRYVHHCRRLHCRSFGCTSRKQYWILQGREEAAMEAAAIHAPTTTTSSDSGSCVTNGTREKREISKHKQLKRKRSTSPAPPPGCGGGQGQEAAVETDADAGAAGEEESSSCGGAGAGEGERKRGDAGRHPSYRGVRRRSWGKWVSEIREPRKKSRIWLGTFPTAEMAARAHDVAALAIKGRAAHLNFPSLAHTLPRPASTSPSDIQAAAALAAAAAATDQCESSSSAVAAATATDAEAAESTSSAAASPCAATSSVEENALFDLPDLLLDLSDGLWCSPVWTTAPADQYDAGDDGDDAAAPLLWAEQCWMDAPAAPVQPD

SEQ ID NO: 2302 - protein, 112 aa, Brassica napus
  misc_feature (93)..(93): Xaa can be any naturally occurring amino acid
  misc_feature (100)..(102): Xaa can be any naturally occurring amino acid
  misc_feature (104)..(104): Xaa can be any naturally occurring amino acid
  misc_feature (107)..(107): Xaa can be any naturally occurring amino acid
MASSMLSSAAVATSPAQATMVAPFTGLKSSAAFPVTRKSNTDITSIANNGGRVSCMKVWPPVGKKKFETLSYLPDLTDVELAKEVDYLLRNKXFPCVEFXXXPXFVXKTCIP

SEQ ID NO: 2303 - protein, 188 aa, Oryza sativa
MDDSSFGSEPTTSSSGLEAPASPPSTASSSSDGAGGKKKRPRKDGHHPTYRGVRMRSWGKAAPRTSTSRTSPTSCRGPATAAPKDVQAAAALAAAADFPASSANAGASNNPDGSDDASAGSASPPPPPDAADDALFDLPDLLLDLRYGPPSSGLSCASSWEDEVGLISGAGAAAAGVFRLEEPLLWEY

SEQ ID NO: 2304 - protein, 303 aa, Salmonella enterica
MNTLEQTIGNTPLVKLQRLGPDNGSEIWVKLEGNNPAGSVKDRAALSMIVEAEKRGEIKPGDALIEATSGNTGIALAMIAALKGYRMKLLMPDNMSQERRAAMRAYGAELILVTKEQGMEGARDLALAMSERGEGKLLDQFNNPDNPYAHYTTTGPEIWRQTSGRITHFVSSMGTTGTITGVSRFLREQEKTVTIVGLQPEEGSSIPGIRRWPTEYMPGIFNASLVDEVLDIHQNDAENTMRELAVREGIFCGVSSGGAVAGALRVARATPGAIVVAIICDRGDRYLSTGVFGEEHFSQGAGI

SEQ ID NO: 2305 - protein, 313 aa, Nanoarchaeum equitans
MFRISRTSFKPLDKQWDVIIIGGGPAGVVAGLYSARYGLKTLLISPDKGGMLTEASFIENYPGFISISGPDLAERLFEQYEKNGGHYLKDKVSDIKKDKNFIVITEGGYELEAKAIILATGSRRRKLNVKGENLPGVSYCAECDAPLFKGKTVAVVGGGNTAFHDALVLSNYANKVYLIHRRDQFRAESYLVENAKKKDNIEFILNSVVKEIRGQNKVESIIVQDKEGNTKELKVDGVFVAIGMETNIELAKKLGVQLDERGKIIVDRCQRTNIQYVYAAGNITNNCCDLDQIVTSMAQGAIAAKSAYEDLLK

SEQ ID NO: 2306 - protein, 346 aa, Mesorhizobium loti
MTKYKLEYIWLDGYTPVPNLRGKTQIKEFAEFPTLEQLPLWGFDGSSTMQAEGRSSDCVLKPVALYPDPARTNGILVMCEVMMPDGVTPHESNSRATILDDEDAWFGFEQEYFFYKDGRPLGFPESGYPAPQGPYYTGVGYKNVGDVARKIVEEHLDQCLAAGINHEGINAEVAKGQWEFQIFGKGSKKAADQIWMARYLLLRLTETYGIDIEFHCKPLGDTDWNGSGMHCNFSTKFMREVGGKAYFEALMAQFDKNLMDHIAVYGPDNDKRLTGKHETAPWNKFSYGVADRGASIRVPHSFVKNDYKGYLEDRRPNSQGDPYQIASQVLKTISQVATDAKVSAAA

SEQ ID NO: 2307 - protein, 494 aa, Streptomyces avermitilis
MTSQPTLSKAENGPDRPGEPGGGLQAGLKNRHLSMIAIGGVIGAGLFVGSSTGIATAGPGILLSYALVGTLVVLVMRMLGEMSAANPTSGSFSAHADRALGRWAGFSIGWLYWFFWVVVLAVEATAGAKILEGWMPGVPQWGWALIVMVVLTATNLVSVGSYGEFEFWFAGIKVVAIGAFIVVGGLAIFGVLPGVDAPKAGLGNLTDSGGFLPHGPGAILTGVLLVVFSFMGSEIATLAAGESEDPQRAVTKSTNSIIWRIGVFYLGSILVVVSLLPWNDPSIKDKGSYVAALDSLGIAHAGQIMNFIVLTSVLSCLNSGLYTASRMAFSLGQRGDAPKAFARTTSRGVPLAAIVVSVVFGFVAVFFNYKFPDSVFLFLVNSSGAVALFVWLVICFSQLRMRKIIQRESPEKLVVKMWLYPYLTWATAALIVFVLGYMLTDTEHDGRETVLLSLLVAAVVLVIAVVKQKLDGSRAVAAAGADEPAVAEAVADAH

SEQ ID NO: 2308 - protein, 74 aa, Brassica napus
  misc_feature (55)..(55): Xaa can be any naturally occurring amino acid
NKGQGEAHSLKVEKVLFKDKSDYQEVLVFESATYGKVLVLDGILQLTEKDEFAYXEMIAHLPLCSTPSPKMSWL

SEQ ID NO: 2309 - protein, 286 aa, Unknown
  Synechococcus sp. WH 5701
MDPTAGWVDEIHQGVRYGLEAEVLLEQSSPYQRVTIIESRRYGKGLLLDGCWMTAERQERHYHEPLVHPALCAAASLERVLVIGGGDGGTARECLRHPGVRHLDLVEIDGLVVECAQRYLPSLGGGCWDDPRFQLTVGDGIAWVSAAAAASYDVVIVDGSDPAGPAEGLFNRAFFQQCRRLLRPGGVFATQSESPEAFREVHLATVRLLREVFGHADPLYGWVPMYPSGWWSWTFAAVDGPRYLEPRPERAEAVAAGCEIWSPRWQRGAFEAIPAGIERALDHPQA

SEQ ID NO: 2310 - protein, 115 aa, Triticum aestivum
  misc_feature (52)..(52): Xaa can be any naturally occurring amino acid
MESKGGKKSSSSRSSLMYEAPLGYSIEDVRPAGGIEKFRSAAYSNCSRKPSXIIPLQSLFSLYQPSETMAVSAIGFEGYEKRLEITFSEAPVFTDPNGRGLRALSRAQIDSVLDL

SEQ ID NO: 2311 - protein, 381 aa, Unknown
  Mycobacterium sp. MCS
MSPPQQRHQRVVVVGAGPCGLAIARQLLHEQRIEPLVLDRATAPASTWRDRYEGFRLNTCGYWSHLPGQPIPRRYGRWPKRDDMVDYFDSYVRRQRIPLSLGVTVTRIDRDGDRWLITTDGDTYTADAVVIATGNYHTPALPAWPGMEGYTGDLLHSADYRNPWPFAGRDVLVVGSGNSATDIALQLSDEVAGRVRLAVREPPHLMPRSAAGIPVDAFSAAFSRLPVPVIDHAAALASRLWFGDLTSVGLPAPRRGIYRALLDDGSIPTLGDELVPQIKAGRIEVVAAVESFEGDSVVLADGRTIRPDVVIGATGYRHGLEPLVGHLDVLDEDGAPLVNGLPPAAPGLWFAGYEEPIIGPLQSFRLQAGPLAAEVAGFAAG

SEQ ID NO: 2312 - protein, 243 aa, Oryza sativa
MAAGGGGGDELKLLGLWASPYVLRAKFALSFKGLSYENVEEDLHNKSELLLSSNPVHKKVPVLIHNGKPICESQIIVEYVDEAFPDAGESLLPSDPYDRAVARFWAAYINDKFMPAWQKASLGLTEKKKAKAVKQMLAAIENLETAFKELSKGKPFFGGDTAGYLDVTLGAVVGWARAGEVLFGRKLFDATRSPLLAAWMERFVALDAVKAVLPDNAELIEYGKMRMAHYAKLAAALAAANKK

SEQ ID NO: 2313 - protein, 150 aa, Zea mays
MAPKAEKKPAAKKPAEEEPAAEKTTAGKKPKAEKRIPAGKSAGKEGGEGKRGKKKGKKSVETYKIYIFKVLKQVHPDIGISSKAMSIMNSFINDIFEKLAGEAAKLARYNKKPTITSREIQTSVRLVLPGELAKHAVSEGTKAVTKFTSS

SEQ ID NO: 2314 - protein, 296 aa, Pediococcus pentosaceus
MPKYTVIYNEDAGKNDNKSIAERFQQAAERLKRSTTLKATSSRQEALDYVVDHIDQLDTVITIGGDGSINTVFSAFLKAKKSVEVGIIPGGTVNNFAKALEIPQDEEAAFDTILNGHPLAVDLAHTEDRAIISSLTLGTLADMARHVGQDEKKKWGPLIYLSKGIRQLIAKKSYQIKVSTADGDHVYRTRFLLATTTNSVGGFTNFDTSASPADGKIHLVILKHFSFMRLLGYLSYFLTGRFRDIKDVDQLTAQEVEISAVDSHLKVETRIDGDPSDQLPIKLGVEQGFVQVMVPK

SEQ ID NO: 2315 - protein, 461 aa, Escherichia coli
  misc_feature (193)..(193): Xaa can be any naturally occurring amino acid
MADNKPELQRGLEARHIELIALGGTIGVGLFMGAASTLKWAGPSVLLAYIIAGLFVFFIMRSMGEMLFLEPVTVAFAVYAHRYMSPFFGYLTAWSYWFMWMAVGISEITAIGVYVQFWFPEMAQWIPALIAVALVALANLAAVRLYGEIEFWFAMIKVTTIIVMIVIGLGVIFFGFGNGGQSIGFSNLTEHGXFFAGGWKGFLTALCIVVASYQGVELIGITAGEAKNPQVTLRSAVGKVLWRILIFYVGAIFVIVTIFPWNEIGSNGSPFVLTFAKIGITAAAGIINFVVLTAALSGCNSGMYSCGRMLYALAKNRQLPAAMAKVSRHGVPVAGVAVSIAILLIAHAWNYIIPNPQRVFVYVYSASVLPGMVPWFVILISQLRFRRAHKAAIASHPFRSILFPWANYVTMAFLICVLIGMYFNEDTRMSLFVGIIFMLAVTAIYKVFGLNRHGKAHKLEE

SEQ ID NO: 2316 - protein, 173 aa, Brassica napus
MQSLQEKASAWSGVDQADAFAIDESNLFEKLGLQSFINLSTNFYTRVYDDEEEWFRSMFANSKKEDAIQNQYEFFVQRMGGPPLYSQRKGHPALIGRHRPFPVTHEAAERWLQHMQNAMDESVDIDQDSKVKMMNFFRHTAFFLVAGNELQNQNQNQNNQVACKHAANKPAEE

SEQ ID NO: 2317 - protein, 417 aa, Arabidopsis thaliana
MISLNLSPSLNPGLLHKTRTCQQPTRLSALLVTNPKPFNHRHPLGLSPIPNLQIRDVSAKPLLSLTNPESSSGFSRKPRSIAAVGSSDSNPDEKSDLGEAEKKEKKAKTLQLGIVFGLWYFQNIVFNIFNKKALNVFPYPWLLASFQLFAGSIWMLVLWSFKLYPCPKISKPFIIALLGPALFHTIGHISACVSFSKVAVSFTHVIKSAEPVFSVIFSSLLGDSYPLAVWLSILPIVMGCSLAAVTEVSFNLGGLSGAMISNVGFVLRNIYSKRSLQSFKEIDGLNLYGCISILSLLYLFPVAIFVEGSHWVPGYHKAIASVGTPSTFYFWVWLSGVFYHLYNQSSYQALDEISPLTFSVGNTMKRVVVIISTVLVFRNPVRPLNALGSAIAICGTFLYSQATAKKKKIEVGGDKKN

SEQ ID NO: 2318 - protein, 529 aa, Nostoc punctiforme
MTKIEERGKVYLVGAGPGDVAYLTVKAYNLLAAAQVLVYDALVDAQLLQCVPPNCLKLDVGKRGGKPSTTQTEINKLLVKYCQQGKQVVRLKSGDPLIFGRCTSEIEALKASGCDFELIPGISSALAAPLFAGIPLTDPVLSRCFAVLTAHEPEVLDWEALSRLETLVILMGGQHLPEIVHQLVQHGRSHLTPIAIIRWAGTPRQKIWTAQLGNILEQTTGLSLSPAVIVVGEVVGLHKYLQPEKIDCQDSTTAQTPMLNNLSASPEPLTGKTILVTRSVGQSSTFSDRLTTLGATVIEMPTLEIGPPSSWEALDDAIAHLSQFDWLILTSSNGIDYFFERLIAQGKDTRALAGVKIAVVGEKTANSLKQYSLQPDFIPPNFVADSLIENFPEKLDGKKVLFPRVESGGREILVKELTLKGAKVIEVAAYQSCCPSSIPSGAELALQNHNVNVITFASSKTVQFFYQLTEKIFSQNSDVSQLLENVCIASIGPQTSKTCHDLFGRVDVEAQEYTLDGLTQALIIWATNY

SEQ ID NO: 2319 - protein, 92 aa, Rhodopseudomonas palustris
MAKEELIQFEGLVTEILPDARYRVQLDTGHEIVAYTAGKMKKNRIKTLAGDRVTVEMSPYDLEKGRLIFRHKDERPGGPPRSGPPRGQFRRR

SEQ ID NO: 2320 - protein, 205 aa, Brassica napus
MNMKLPPRRYTCKKMKDRLGFRFVLCSAVFMILTQHRALANSHGVNSEEEEWEMVQRKGQQFTLNGQPFYVNGFNTYWMMTLAADNSTRGKVTDVFQQASAVGLTVGRTWAFNDGQWRALQKSPSVYDEDVFKALDFVVSEARKYKIRLILSLVNNWNDYGGKAQYVKWGNASGLNLTSDDDFFTNPTLRDFYKSHVRTVLNRVN

SEQ ID NO: 2321 - protein, 446 aa, Dendrobium crumenatum
MILDLNGTSVAKSSFAQKRILQEGSYGGQMVDSGSSNSSVLNADDSSNISEEDESSSHPAFRFGILKDAVELEEEVDEIRVVSESGIVTHQLFPQHPQGFSECHPEGAATASSLSRLPWEDLRIFQSNVQAAGEVKLIHPQQQQLQVKKSRRGPRSRSSLYRGVTFYRRTGRWESHIWDCGKQVYLGGFDTAHDAARAYDRAAVKFRGLDADINFSLSDYEEDLNQMRNLTKEEFVHILRRRSTGFARGSSKYRGVTLHKCGRWEARMGQLLGKKAYDKAAIKCKGKEAVTNFQQSTYDDFLPKDAGEDMGHDIDLNLSISQPSVCSQNRNANLVKEMPAHLLAVAPDHPQAWSNVYPGFFPANEERAMNKKAEAGLTALTSWPAWKIHGFSPLPPPPCAASSGFSTTSTTVSNSSIQPSQFPSATTPHLLQFCTRPPATSHHFNG

SEQ ID NO: 2322 - protein, 112 aa, Mesorhizobium loti
MKKIEAIIKPFKLDEVKEALQEAGLQGITVTEAKGFGRQKGHTELYRGAEYVVDFLPKVKIEVVLGDDAVEGAIEAIRKAAQTGRIGDGKIFVSNIEEVVRIRTGETGMDAV

SEQ ID NO: 2323 - protein, 474 aa, Bacillus cereus
MAQVSNTNNELKRTMKSRHLFMIALGGVIGTGLFNGSGFIISQAGPGGSVLAFIAGGLLMYFVMLCLGELAVAMPVSGSFQEYATKFINPATGFTIGWLYWLSWANTTGLEFTTAGITMQRWFPDIPVWVWCLIFGVTIFTINALSARSYAETEFWFSSIKVSAIIAFILLGGAAMFGFIDLKGDEPAPLLSNFVNHGGLFPNGLAAILLTMVTVNYSFQGTELVGIAAGESEDPAKTLPRSIRNIIWRTMFFFVLAIFVLVALIPWEEAGLTKSPFVAVFDNIGIPYAADIMNFVILTAVLSVANSGLYAATRMLWSLSKNEMAPAFLKKLSSRGIPLNALIMTIAISAFSLLTSVVAAETVYLWLISISGVITIIVWMSICVSQFFFRKHYLADGGKLEDLKFKTPLYPLVPILGFGLYGIILISLIFIPEQRLGIYCTVPFIIFCYTYYHFKVKKRNSTNTHSETKISETS

SEQ ID NO: 2324 - protein, 621 aa, Herminiimonas arsenicoxydans
MPASSFGESSAHIRRRRVAHYLRTESGAAVLLVIVTVVALVWANSPLSNAYFELWHLDVGFNFGPLRLHMDLHHWVNDGLMVVFFFLIGLEVRQEFAHGSLRDRSRARLALIAGVTGVVLPALVYVLIVKLAGSEGLHGWGAVVGTDTAFMLGTLAIVGPRLSGQLRVFLLTLTVVDDFLAVSIIGIVYSEEIRIVPLLIALASLVGLWLLGRTRQWRATPYVLIVIVLWFATVYSGIHASLAGMAAGLLIPAYATQRHGVVAARQLFRDFWQSPSAASARAVDCGLSRGISVNERLHEFLRLPTALLIVPIFALANAGVDVRGGLLAEAFGSPVTWGVIAGLVLGKLLGIGLTTLVAVRLGLGRLPEGVGVGSVFGGAALSGIGFTVSLLIIGLAFGTTSDLGRQATVGVLVSMVFATLLGWLIFKVAAQRWGEKTADLPMVLEPPVDPEIDHIRGPEDAQLTLVEYVDFECAYCAHATGSWDDLRAHFGDDLRYVVRHLPHHPHGPIAARASEAAANQGMFWPWLDFVFTRQHALEREHLIGYAAELGLDVERFIADLDSPAVIERVERDLASAVASGAHATPTFFVEGRRLRGSYDARTVTAVLEASRRGTRTQEVPS

SEQ ID NO: 2325 - protein, 595 aa, Saccharophagus degradans
MTESSPNFAQLGLNEHILKALTDVGYETPSPIQAKSIPELLAGRDILGQAQTGTGKTAAFALPILNNLDLSQKAPQVLVLAPTRELAIQVAEAFQSYAHHLPGFHILPIYGGQGYDQQIRALKRGVHVIVGTPGRVMDHMRKGTLKLDQLKVLVLDEADEMLRMGFIDDVEWVLTQTPPTRQIALFSATMPKEIAKVANKYLNDPALIKIEVKTQTADTIRQRYWGVSGHHKLDATTRILEAEEFDAMIIFVRTKTTTIELAEKLAARGYSSAALNGDISQNLRERTVEKLKKGQIDILVATDVAARGLDVDRISHVLNYDIPYDSEAYVHRIGRTGRAGRSGEAILFVAPREMRMLRTIEKATRKPIELMKMPSTDDINQIRVDRFKQKILDAAKSPGLEFFRKLVTEMQHDNELDTADIAAALALLYQGDQPLLLEDRPQRQQREFKERDGDFDKRGRGDRDGRGREGRDRGKGREKDENMETYRIEVGRKDGVKPGDIVGAIANEANISSKFIGHIKLHDDFSTVDLPSGMPKEVFETLSKTWVCQKQLRITRAEGNAGGGRGRGGDDFKRKKRPANKDGAPRKPRAKKADS

SEQ ID NO: 2326 - protein, 549 aa, Xylella fastidiosa
MVSCMHSIQIVLAMLLVVAASGYLVRIIPFSMPLPLLQIALGAVISGVFDGGYELQPEAFFLLFLPPLLFLDGWRIPKQGLFRDKNVILELALGLVVFTVLGIGFLIHWMIPTMPLPLAFALAAILSPTDPVALSSITSRVPIPKRMMHILEGESLLNDATGLVCFQFAVAAVLTGHFSLATASLTFVWVLVVGLSLGIATTYVLSRVQRWVWRHFGGEPAAAILFNLLTPFAAYLLAESMQASGILAAVAAGITMSYVELSGNAQATIRVQRWAVWETVQFTFNGIIFVLLGEQLPGILDDLVHSAQQAGYMNVGWLLVDVAVISAGLMLLRFLWVWLSLQWNLFKAVCCGKQRISPPWQIVVAMSLSGVRGAVTLAGVLTLPLLMPDGTPLPARQLVIFLAASVILVSLLLASVALPYLLRGLELPEKSSYDKEEDFARRVSAQAALEAVERLRQRLVEDSANAERYNEAAHQVSQLYQRKLGAVDLANVDPQETKVFEQVVRRFRQVGLAAERDELFRLAREHNISDELLQRMVRNLDLIEARRRS

SEQ ID NO: 2327 - protein, 164 aa, Chlamydomonas eugametos
MMRTVQLRTLRPCIRAQQQPVRPSTSATAAAATAPAPARKCPSSLFAKLGGREAVEAAVDKFYNKIVADPTVSTYFSNTDMKVQRSKQFAFLAYALGGASEWKGKDMRTAHKDLVPHLSDVHFQAVARHLSDTLTELGVPPEDITDAMAVVASTRTEVLNMPQQ

SEQ ID NO: 2328 - protein, 321 aa, Carboxydothermus hydrogenoformans
MNSIGVLTSGGDAPGMNAAVRAVVRKALFHGIKVYGIERGYAGLINNEIKEMSLGSVGDIIQRGGTVLKTARSLEFKTYEGRLRAFQNLKNHGIEGLVVIGGDGSFQGALKLYEEFGVKVVGIPATIDNDIYGTDYSIGFDTTVNTVVDAINKIRDTAFSHERTFIVEVMGRNAGFIALEAGIAGGAESIIIPEIPYSIEEICQKLIKSHQRGKLHSIIIIAEGAGSGIKLGEVIKEKTGFETRVTILGHIQRGGSPSAFDRILASRMGAMAVDALREGISQGVMVAFEKGEYVLKPLETAFSGKKQIDLEYYRLADILSI

SEQ ID NO: 2329 - protein, 504 aa, Desulfitobacterium hafniense
MAKGYVYLVGAGPGEPKLLTVKGAECIARADVLIYDRLASPRLLSLAGPDCEMIYVGKSPDRHTLRQDEINQLLVQKSLAGKVVTRLKGGDPFVFGRGGEEAEALLAVGIPFEIVPGITSAIAVPAYAGIPVTHREMTSSFAVITGHEDPGKNDSAIAWEHLVPAHGTLIFLMGMENLSLIAQRLIQHGKNPATPVGIIQWGTRPEQRTLVGRLDTIASLVQEQGFTNPATIIVGEVVSLREKLQWFEKKPLFGSRIVVTRARHQAGVLAQAIEDLGGEPWEFPAIEIREPSDPELLTRAMQDLRRFKWLVFTSANGVERFLSGLKDSGKDIRDLSGMEIVAVGPVTQAALEQRGLCVTCMPEEYRAEGILAELTGRILPGEGVLLARAEEARDVLPQSLQTLGAEVWDVPVYKTVSGSANKGLLKSMLEDKQIQAVTFTSSSTVRNFCRLIDNQTELLDGVKLFSIGPLTSAAARELGLPIHKEAARSTIDGLVAALVEGARG

SEQ ID NO: 2330 - protein, 171 aa, Chlamydomonas eugametos
MMRTVQLRTLRPCIRAQQQPVRAPTSVAAATATTPAPTKKCPFSLFAKLGGREAVEAAVDKFYNKVVADPTVSVFFSKTDMKVQRSKQFAFLAYALGGAAEWKGKDMRTAHKDLVPHLTDVHFQAVVRHLSDTLAELGVTPGDIADAMAVVASTKTEVLNMPRQQGAESNR

SEQ ID NO: 2331 - protein, 260 aa, Borrelia burgdorferi
MAIITMKSLLEAGVHFGHQVKRLDPRMKRFIFSERNEIHILDLQKTLQGIKDSYELVQRVIKDGKKVLFVGTKKQASEIIEQEARRSDMPYVNNRWLGGMLSNFNTIRKSVQKLKKLEKMEVDGTFDMISKKEISQLNREKSKLAKNLTGIKDMETLPGAIFIIDPKREQIAINEARKLKIPIISVVDTNCNPDVIDCPIPGNDDAIRSVALFTKIISDAILESDKEVGIQIIENLNEEDLMKEIEIKNDKSDSIEERGE

SEQ ID NO: 2332 - protein, 609 aa, Oryza glaberrima
MSALTTSQLATSATGFGIADRSAPSSLLRHGFQGLKPRSPAGGDATSLSVTTSARATPKQQRSVQRGSRRFPSVVVYATGAGMNVVFVGAEMAPWSKTGGLGDVLGGLPPAMAANGHRVMVISPRYDQYKDAWDTSVVAEIKVADRYERVRFFHCYKRGVDRVFIDHPSFLEKVWGKTGEKIYGPDTGVDYKDNQMRFSLLCQAALEAPRILNLNNNPYFKGTYGEDVVFVCNDWHTGPLASYLKNNYQPNGIYRNAKVAFCIHNISYQGRFAFEDYPELNLSERFRSSFDFIDGYDTPVEGRKINWMKAGILEADRVLTVSPYYAEELISGIARGCELDNIMRLTGITGIVNGMDVSEWDPSKDKYITAKYDATTAIEAKALNKEALQAEAGLPVDRKIPLIAFIGRLEEQKGPDVMAAAIPELMQEDVQIVLLGTGKKKFEKLLKSMEEKYPGKVRAVVKFNAPLAHLIMAGADVLAVPSRFEPCGLIQLQGMRYGTPCACASTGGLVDTVIEGKTGFHMGRLSVNCKVVEPSDVKKVAATLKRAIKVVGTPAYEEMVRNCMNQDLSWKGPAKNWENVLLGLGVAGSAPGIEGDEIAPLAKENVAAP

SEQ ID NO: 2333 - protein, 159 aa, Clostridium perfringens
MGYIMDLRKELPNPHRPLIMCSAGIIIIDKKGRVLLQKRTDNNKWGLPGGSLELGESFEEAAIREAYEEVGLKVKSLSLFNVYSGKECYNKYPNGDEIYNASSIFISNDYEGEVVLDGEESADAVFFNKIDIPSLEEVNPPDRIVIKDIIEKLNIEKYI

SEQ ID NO: 2334 - protein, 199 aa, Thermococcus kodakarensis
MEKKTGTTTVGIRTKEGVVLAADTQASLDHMVETLNIRKILPITDRIAITTAGSVGDVQALARMLEAEARYYQFTWGRPMTAKAMAHLLSNILNENKWFPYMVQIIIGGYVEEPTLANLDPLGGLIFDDYTATGSGSPFAIAVLEDGFRKDMSLEEAKELAVRAVRTAGKRDVYTGDRKVQVVVISKDGMKEEFVEFKE

SEQ ID NO: 2335 - protein, 375 aa, Oceanobacillus iheyensis
MGKRDYYEILGIDKSASQDEIKKNYRKLARKYHPDVNKEADAAEKFKEVKEAYEVLSDDQKRAQYDQFGHSGPQSQGFGGFGGGAQDFGGFGDIFDMFFGGGGRSRDPNAPQQGNDLQYTMILDFEEAVFGKETDIEIPKEESCDTCNGSGAKPGTKPETCSHCHGSGQLNQEQNTPFGRVVNRRVCNYCQGTGKIIPDKCNTCGGSGTVQKNKKIHISIPAGIDEGQQIRVAGKGESGKNGGPAGDLFVVIKVRPHDFFVREGDHIFCELPLTYAQAALGDELEVPTVHGKVKVKVPAGTQTGKTFRIKGKGAPNVRGRGHGDQHIKIKVMTPTNLSEKQKDLLREFNELGGNESTDEQDDNIFQRFRRAFKGE

SEQ ID NO: 2336 - protein, 608 aa, Sorghum bicolor
MSTLATSQLVATHAGLGVPDASMFRRGGVQGLRAAARASAAAGDALSMRTSACPAPRQQPAARRGGRGGRFPSLVVCATAGMNVVFVGAEMAPWSKTGGLGDVLGGLPPAMAANGHRVMVVSPRYDQYKDAWDTSVVSEIKMGDGYETVRFFHCYKRGVDRVFIDHPLFLERVWGKTEEKIYGPDAGTDYKDNQLRFSLLCQAALEAPRILSLNNNPYFSGPYGEDVVFVCNDWHTGPLSCYLKSNYQSNGIYKDAKTAFCIHNISYQGRFAFSDFPELNLPERFKSSFDFIDGYEKPVEGRKINWMKAGILEADRVLTVSPYYAEELISGIARGCELDNIMRLTGITGIVNGMDVSEWDPSKDKYIAVKYDVSTAVEAKALNKEALQAEVGLPVDRKIPLVAFIGRLEEQKGPDVMAAAIPLLMEEDIQIVLLGTGKKKFERMLMSAEEKYPDKVRAVVKFNAALAHHIMAGADLLAVTSRFEPCGLIQLQGMRYGTPCACASTGGLVDTIIEGKTGFHMGRLSVDCNVVEPADVKKVATTLKRAIKVVGTPAYEEMVKNCMIQDLSWKGPAKNWENVLLSLGVAGGEPGIEGEEIAPLAKENVAAP

SEQ ID NO: 2337 - protein, 825 aa, Selaginella kraussiana
GKYVRYTPEQVEALERVYNECPKPSSIRRQQLLREYPLLANIEPRQIKVWFQNRRCREKQRKETSRLQSVNSSLTAMNKIIMEENERLTKHNTQLALDNQYLRQQLQQQTGASDREPKTTSSRRYNNNEVVAADRSPDSEVTGGMPQQHITATTAAPQIARDSSHAGLLAIAEETLAEFLAKATGTAVDWIHMPGMKPGPDSVGTAAISHGSTSVAARAWGLVGLEPSKVAEILKDRPSWHRECRRLEVLRAFSTPNGGTVELVYTQMYAPTTLAAGRDFWTIRYTSFLEDGLVICERSLNGIHGGPSNKQSGSDFVRAEMLPSGYLIRPYEGGMCSIHIVDHMELESWKVLEVLRPLYESSSVLAQKMTLAALRYLRRLVYESSVERGAQQIAAWRGVSRRIARGFNEAVNCFTDDGWSTLVTDGVEDVTVAINTNPTASSIGGQLASADRLYAVGGGVLCAKASMLLQNVPPATLIRFLREHRSEWADCNITDSSLRHGMARGANAFIGQYPVPLIHSSEEEEFLEVVKLEGHTTGQNGVILPRETVLLQLCSGNDDNAVGACAQLVFAPVDAAVSDDVPLLPSGFHVIPLDSGLDGRTLDLASSLEGGAEGGRFAEEPSCHLRSVLTMAFQFLFEAHNRDDVAASARQYVRNVMVSVQSVALALASFRLGPRVGPRNVEALLLAQQILRSYKANFGLDLTESDPGSTDAFWHHKDATLCCTWKTIPEFIFANRAGLEMLDTTWNDLHGLPWDKTLDDNGRKSSASDFAQIIQQGFAELPAGIRISSKGRPAAYERVIAWKVLDEENNAQFIAYMFMNWSFLG

SEQ ID NO: 2338 - protein, 827 aa, Haemophilus somnus
MNLSRRDFMKANAALAAASVAGLIIPVKNVNAADTSITWDKAVCRFCGTGCAVLVGTKDGRVVASQGDPDAEVNRGLNCIKGYFLPKIMYGKDRLTHPMLRMKNGQYDKEGEFTPVTWDFAFKTMAEKFKSALKAKGPNGVGMFTSGQSTIFEGVAKSKLFKAGLLSNNIDPNARHCMASAAVAFVRTFGIDEPMGCYDDIEHADAFVLWGSNMAEMHPILWSRISDRRLANPDTVSVNVLSTFEHRSFELADLGILLKPQSDLAILNYIANYLIENNAINREFIEKHTKFKRGETDIGYGLRPQDPREQTAKNVKTAGKMYDSSFEEFKKLVAPYTLEKAHEISGVPKEQLEKLAKLYADPNKKVVSYWTMGINQHTRGVWANHLIYNIHLLTGKISLPGCGPFSLTGQPSACGTAREVGTFIHRLPADLVVIKPEHRKIAEKIWKLPEGLISDKLGFHAVAQSRALKDGKMQVLWQMCNNNMQAGPNINEETYPGWRNPDNFIVVSDPYPTVSALSADLILPTAMWVEKEGAYGNAERRTQFWRQQVKAPGEAKSDLWQLVEFSKYFTTDEVWPAEILAKNPAYQGKTLYEVLYLNGQVNQYSNDELKGRLNDEAYHFGFYIQKGLFEEYASFGRGHGHDLADFDTYHKARGLRWPVVDGKETLWRYREGYDPYVKAGEGVSFYGQADKRAVILAVPYEPPAEVPDRKYDLWLTTGRILEHWHTGSMTRRVPELHRSFPNNLVWMNPNDAKKRGLKHGDKIKVISRRGEITSYIDTRGRNKCPEGLIYTTFFDAGQLANKLILDATDPISKETDFKKCAVKVVKA

SEQ ID NO: 2339 - protein, 260 aa, Crocosphaera watsonii
MTENISEICLGKVYLVGAGPGDPGLMTIKGKTLLEHADVVVYDALVSPPILDMIGEKAIKIDAGKRRGRHSKLQAETTQILIEKARQYPVVVRLKGGDPFVFGRGGEEMADLVNAGIPVELVPGITSGIAAPAYAGIPVTHRGYSSSVTFVTGHEAVGKYRPKINWEAIAQGSETIVIYMGVHNLPNIIRKLQKGGLTAATPIALIRWGTRPEQEQLMGTLETIIKQVEETNFEAPAIAIIGKVVDLSVNSYQLSFIEFS

SEQ ID NO: 2340 - protein, 820 aa, Selaginella kraussiana
MRMTKDKGGDLDSGKYIRYTPEQVEALERVYHECPKPSSIRRQQIVRDYPVLANIEPRQIKVWFQNRRCREKQRKETSRLQSVNSSLTAMNKIIMEENERLTKHSSQLSLDNQLLRQQLQQLRNNQDPDRKSSDRLNDQALALADRSPDSEVTGGVPHHHLTMAPQSPRDSSPAGLLSIAEETLNSFLAKATGTLVDWIQIPGMKPGPDSISAAAISHGSAGVAARAVGLVDLEPIRVAEILKDRPSWLWDCRRLEVVGTFPTPNGGTLELIYSQMYAPTTLAPARDFWTLRYTIFLEDRSLVVCEKSLTGAHGKHKGGPDFERAEMLPSGFLIRPYEGGVSSIHIVDHYDLESWRVLEVLRPLYESSVFLAQRVTIAALQHLKRISQESSGEILLRGGQQPAALRAFSHRIARGFNDAVNGFAEDGWVSLVADGIDTVSITINTSVASKALPGNQVWPDRFSNNISGILCAKSSMLLQNVPPATLIRFLREHRSEWVGCNSATSDSVSALRISGYGTSKGDEEPELLEVIKMEGYGSQSVPKDTVLLQLCTGYTDNVSGTCAQLIFAPVDPAVTNDMPLLPSGFRVIPLDSGSALPTKLAPTLDLASTLDTAKFPDDSSSAHCRSVLTMAFQFVFEAHNREEIISSARQYVRNVMVSVQSIAMALASFRMSPQQGPKQPEARIIAEQIVRGFRSSFGVELSDGSTDAFWNEKDAILCCTWKAIPEFIFANRSGLEMMETTWRDLHSLPYERTFDSAGRETAYSDFAQVLHQGYAQLPGGVRISSKGHTVAYDSATAWKVYDEEGNVTCIAFMFTNWTIL

SEQ ID NO: 2341 - protein, 416 aa, Picea glauca
MGVPKDEAAVTMAVAERIKGPWSPEEDATLHRLVEKYGPRNWSQISRGIPGRSGKSCRLRWCNQLSPQVEHRPFSPHEDATIIQAHARHGNKWATIARLLPGRTDNAIKNHWNSTLRRRYHGEKDHSNGLVVNLESAAEDKEAMISLTAPAMVPALVFAAAADSSRKRSNSSCSANDNPGDAEVESRRLKRLNFSESPTSSDNNNNNNEEDTISGHCNSVAPGSSPVQQLHRPVPRQSAFNCYEAVKMHEEASASVSASGSAGAFDPPTSLSLSLPGSGSFSENNSSGECSPIEQSFETKSAKFQAYQQQTGYSFADPFPVSGYLKTEEAMAMMSTAVKIAIGQALPLIFQLSSGNSHGGCSGDSSNFGGSLLSIMREMIAKEVQNYTNGSQCSNQGPGLNSVAPVFREVGLMLKK

SEQ ID NO: 2342 - protein, 855 aa, Selaginella moellendorffii
MAVMKMKDSNKHIMDAGKYIRYTPEQVEALERVYNECPKPSSIRRQQLLREYPVLANIEPRQIKVWFQNRRCREKQRKETSRLQSVNASLTAMNKIIMEENERLTKHSSQLALENQYLRQQLQQQGGSERDLKLSRRYANDAQAALAADRSPDSEVTGGMPQQLVAASTTTTTTAPQIARDSSPAGLLAIAEETLTEFLAKARGTAVDWIQLPGMKPGPDSAGTAAISHGSTGVAARAWGLVGLEPDKVAEILKDRSSWLRDCRRLEVLRAFPTPNGGTVELVYTQMYAPTTLAAARDFWTLRYTTFLDEGDLVVCEKSLSGVHGLPAAKAGNDFVRAEMLASGFLIRPFEGNVCSIYIVDHMDLESWKVHEVLRPLYESSSVLAQRMTLGALRFLRRLIYESPLNENAPRGAQQSAAWRGVSRRIARGFNEAVNSFADDGWMITDAIDGDVTVAINVAPNASSIGGQVMPPDRLYAVGGGVLCAKASMLLQNVPPATLIRFLREHRSEWADCNVVLDTASMRASACGFSRGNVIGQCPVPLVQSAEEEEFLEVVKLEGHASGQNGVVIPRETVLLQLCSGHDDNATGVCAQLVFAPVDAAVSEDVPLLPSGFRVIPLDSGVDSSGLSRTLDLASSLEGGADIGKFPDESGCHLRSVLTLAFQFLFEAHNRDEVATSARQYVRHVMASVQSIAMALASFRLGPRVGPRNVEALLLAHQILRSYRANFASDLTESDPGSTDAFWHHKDAILCCTWKAMIPEFVFANRAGLEMLETTWSELHGIPWDKTLDDNARKASAAEFSQIIQQGYACLPPGIKLSSKGRPAAYDRAVAWKVVDEEDNAQCVAYMFINWSFLG

SEQ ID NO: 2343 - protein, 343 aa, Pseudotsuga menziesii
MSSKFGSLSSSCSSVHGTAFTASARPSPAALRATPAITSLYADRKYDLQSFKFEPIRESIVAREMTRRYMMDMITHAETDVVIVGAGSAGLSCAYELSKNPDVKVAIIEQSVSPGGGAWLGGQLFSAMVVRKPAHLFLDEIGVPYDETEDYVVIKHAALFTSTIMSKVLARPNVKLFNAVAAEDLIIKEGRVSGVVTNWALVSMNHDTQSCMDPNVMESKVVVSSCGHDGPFGATGVKRLKSVGMIDKVPGMKALDMNTAEDAIVRLTREIVPGMIVTGMEVAEIDGSPRMGPTFGAMMVSGQKAAHLALKALGQPNALDGTLKVLPELVLASAENEITTASA

SEQ ID NO: 2344 - protein, 373 aa, Picea glauca
MALSNGRSLEDLDRIKGPWSPEEDASLQRLVQKYGPRNWTQISKGIQGRSGKSCRLRWCNQLSPQVEHRPFTPSEDAAILQAHAQHGNKWATIARSLPGRTDNAIKNHWNSTLRRRCRDSDKGILVHLDDEISSLDAARKRSSDGFSHDGSSALEDNCCSSWEVDSKRLKRLGELGAEQGPDVEVELEVSDRSDSNPGRVLYRPVPVASFFGSFGKTVANLQETASGSVGVDPPTSLSLSPPGLDPAIHSPKPPSQKDFHNNSTDNNKIPTPPVVGYMRADEAVERLSTAVKATVASMLTPVLSSSPRGFNPPAVSSDVLALMRDMVAKEVHKYMSSHQPPGMYTPLSPHPEFLGAAGLVRNVVLGGALHLNK

SEQ ID NO: 2345 - protein, 840 aa, Selaginella moellendorffii
MKVKDKSDFDTGKYIRYTPEQVEALERVYHECPKPSSIRRQQIVRDYPVLGNIEPRQIKVWFQNRRCREKQRKETSRLQSVNSSLTAMNKIIMEENERLTKHSSQLALENQCLRQQLQQIRSGGGAADPDKKSAAAADRFNDQSALALADRSPDSEVTGGVPQHLAITPQSPRDSSPAGLLSIAEETLNSFLAKATGTAVDWIQIPGMKPGPDSIGTAAISHAGAGIAARAWGLVELEPIRVAEILKDRPSWLWDCRRLEVVGSFPTPNGGTLELVYTQMYAPTTLAPARDFWTLRYTIFLEDRSLAVCERSLTGIHNKPAIKNGDFERAEMLPSGFLIRPYEGGVSSIHVVDHWDLESWKVLEVLRPLYESSVILAQRVTLGALHHLKRISQESSGEVLMRGGQQPAALRAFSHRIARGFNDAVNAFAEDGWTSDGGDDVTISINTALGAKAAGAQGGDRFCAFGGILCAKSSMLLQNVPAATLIRFLREHRSEWAGVNIASDSVSTLKIGGYGTSKGNADEECLFPELLEVIKMEGYGNGMLPKDTVLLQLCTGYEDTASGTCAQLVFAPVDPAVSNDIPLLPSGFRVIPLDNGLDASALSRTLDLTSTLEGSADGGKFPDDFSGSGGNMRSVLTMAFQFVFEAHNREEIIASARQYVRNVMVSVQSIAMALASYRLSPPQQGPKQQEAKIFALQIMRSYSLGLQRCRASFNVEFNESQPESTDAFWHDKNAILCCTWKAIPEFIFANRAGLEMMETTWRDLHSLPYERTFDATGRETAYSDFAQVIHQGYAYLHGGIRLSSKGHPVTYDRAMAWKVFDDDGAVVCIAFMFTDWSIVA

SEQ ID NO: 2346 - protein, 350 aa, Picea glauca
MKGKSSGHDEPDRIKGPWSPEEDAALQHFVQKCWPRNWSLISKAIPGRSGKSCRLRWCNQLSPQVEHRPFTPEEDATIIRAHAQHGNKWATIARMLSGRTDNAIKNHWNSTLRRRCQGGGALVIDDEITSGADGFRKRSLSEDADASRKLKKLSLGTTATTTTTEPCSSSASDRSDSSLALGSPPVYRPVPRAAPLSLTNEANLNPSHHEASCSSTDPPTSLCLSLPGTDAPARPTVALSALPLPGSSSPLAPPGYIKAEEAMEWMNSAINTTLTQVLSPFVAPARSHGIMPETLGSSGLLAVMQEMVAKEVRDYMSSMQHRNNNNTEFRGCVASPPPMGMRVSNSNALG

SEQ ID NO: 2347 - protein, 245 aa, Ipomoea nil
MAAASASTNTLTLKAAISSSAKLPSTSPAVLKFQPFKRTNPLISKSLGLTASTAAAASKRSVTVKSQSAPAGKVQELCVYEINERDRGSPAYLRLSQKSVNTLGDLVPFSNKLYTGDLQKRVGITAGLCILIKHEEEKKGDRYEAIYSFYFGDYGHIAVQGQYLTYEDTYLAVTGGSGIFEGVSGQVKLQQLIFPFKLFYTFYLKGIPDLPAELCGAPVPPSPAVEPSPAAKACEPGSTIGNFTD

SEQ ID NO: 2348 - protein, 1106 aa, Robiginitalea biformata
MSKGIKIDDEKHWYKDAIIYELHIKAFFDSNGDGIGDFQGLIQKLDYLEDLGVTAIWVLPFYPSPLRDDGYDIADYYNINPSYGKLRDFKRFIREAHNRGLKVITELVINHTSDQHPWFQRARKAPPGSRHRDYYVWSDDPGKYKDVRIIFTDTEPSNWTWDPEAKAYFWHRFFSHQPDLNFDSPDVQQEVFDIMDFWCELGVDGFRLDAVPYLFEREGTNCENLPQTHEFLKKLRAHIDSKYDNKLFLAEANMWPEDSAAYFGKGDECHMNYHFPIMPRMFMALKMEDRYPIIDIIDQTPEIPPTCQWAIFLRNHDELTLEMVTDEERDYMYKVYTKDPQAKINVGIRHRLAPLLENNRSKIELMNVLLFSLPGTPVIYYGDEIGMGDNFYLGDRDGVRTPMQWTGDRNAGFSTANPHKLYLPTIIDPEYKYEAVNVESQQINSSSLLWWMKRIIGMRKRYKAFGRGNIEFLAPANAKIIAFIRAYEGEQILVLCNLSRFAQAADLELGTFEGHTPVEVFSRNRFPRIGREPYLFTLAPFGYYWLSLEQDERLVEAGPPPRLKADKWSGLMSKPLRKKLQEEVLPRYLDNADWYAGRNRIRQSLEIRNSAALPLRGLPSRWLVVKTSYNDGLPEHYQLLVAWIPEARREALRDLPDAAILAEMQLGSEPGVLIDAIYEEPFRMALLQWVRQGKRFETDGGELHFSRGKRKFPAPSDPMKSRILPSGQTFSSLQYDDRYHLKLYRRLDDTLNPDLELAHFLSEETTYEHVPDYLGAVTFSAAGRTTLALGLAQELDPSQGTAWEYTRDAFHMFFERALAAGEETKFKPPKGGLTDPLRFEDLPELLKDLMGSALPERIVQLGERTAGLHRALASQPGREGFEHEAFSLHYQRSVYSSLQGLTRDAFDKLRKSLKRLPEEIQEEAREVLGLKNDVLQCFKRIFSHKMEAVKIRTHGDFHLDQVLWTGRDFLIRNFEGEPMRPFSERRLKRSPLRDVAAMIRSLHYAVYGALHESDLLGGEGNEIQEYWAQIWNRASTRLYLSGYLKSLDGPGFIPEDPDDYRILLETFLLEKAVYELGYELEHRPDWVLIPLRGIRSVLREAGFLSS

SEQ ID NO: 2349 - protein, 864 aa, Geobacter sulfurreducens
MNRKLRRANLKASEPTPHETGNVINYMRQGRYAEAAHLAKGLTERFPDHGFGWKILGICTLLLGQNGDALPLFLKAAGLLPDDPDIHCNIGIIYYELNQLNEAEYYCRYALKLRPNDAIAHNNLGNILSSLGRLDEAEACFRRAIENNPDLAQAHYNLGSALQALGRLEEAESCYRRATAIRPTYEEAYASLGNVLKEMGRLDEALESWKLSLAHQEDWTNALRRLTNPLLMDGDLTRGPEYPAADAAEGQPRQLSSHPAAASVESLDRKYRVPSHGHDGSAEAGAVAGRDENAPRPLRIVLVYPPLWQIPSADLAVPEGMPFGPPATAGGPVAISRELKTITQGVLSIAAQAKKAGHDVRVYNLFNAPWADIVALIAGTGADVYGVSAYNSNRRGMGALCALIRQYHPHAHITVGGPFATTLPLETLRYYRAIDTVVVGEGEETFMELLDHIRSHRPAVGIPGTAWRNGDEVALGPVRPRIGDLDTLASHFDYYSSNIVMTSRGCPSKCSFCGNPVLWGRKIRFYSTDYCIDMFRKALARLPVPYLMIADDTFTANQQRTLNMCDAIIGNKLDFLWSCSTRVDAMEDKVLHRMRRAGCQEIMIGVESGSPEILERIHKGITPEMVLTVTRAAKKYGMLVHYYMMVINRGETPDTLQASIDLIKAGRPNSYDLTPLMFLPGTEDYGHLCEQQGLTSDIFFRNDFMDISVERKRKKDLDTVMQHLYCSIGTIGGYEYTVAEREAVVEHLPDVPTVHVELANAYLRAGQLDKATAALTRAEELGFPIGNIILNQHACIALARNQIDTSLDFLERACRSFPDVTVKGNYDKLAAWIDSRTSGQVKPCLLCDSVRAQDFVFRADETAP

SEQ ID NO: 2350 - protein, 531 aa, Citrus unshiu
MDSCCVGLRANTHVVKASKYGSKIGDNALWGERIRGSVRNDGCTKQLKKSLKAEKRDEKVKPGVAYAIMTSKHPNEVMTLAPPRLERRRVDPKNVAAIILGGGAGTKLFPLTLRAATPAVPVSGCYRLIDIPINSGINKIFVLTQFNSASLNRHIARTYFGNGTNFGDGFVEVLAATQTPGESGKNWFQGTADAVTRFTWVFEDAKNRNIENVAILCGDHLSILCGDHLYRMDYMDFIQSHVDRDADITISCAAVGESRASDYGLVKIDNMGRIAQFAEKPSGANLKAMQVDTSLLGFSPQEARKSPYVASMGVYVFKKDVLLKLLRWRYPTSNDFGSEIIPAAIMEHDVQAYIFRDYWEDIGTIKSFYEANMALTKESPAFHFYDPKTPFYTSPRFLPPTKIDNCRMKDAIISHGCFLRECTVEHSIVGERSRIDYGVELKDTVMLGADYYQTESEIASLLAEGKVPIGVGRNTKIRNCIIDKNVKIGKDVVIVNKDGVQEADRPELGFYIRSGITIIMEKATIEDGMVI

SEQ ID NO: 2351 - protein, 479 aa, Streptococcus mitis
MDDNGYDIADYQAIAAIFGTMEDMDQLIAEAKKRDIRIIMDLVVNHTSDEHAWFVEACENPDSPERDYYIWRDEPNDLDSIFSGSAWEYDEKSGQYYLHFFSKKQPDLNWENEKLRQKIYEMMNFWIDKGIGGFRMDVIDMIGKIPDEKVVNNGPMLHPYLKEMNQATFGDKNLLTVGETWGATPEIAKLYSDPKGQELSMVFQFEHICLQYQEGQPKWHYQKELNVGKLKEIFNKWQTELGVEDGWNSLFWNNHDLPRIVSIWGNDQEYREKSAQAFAILLHLMRGTPYIYQGEEIGMTNYPFETLDQVEDIESLNYAREALEKGVPIEEIMDSIRVIGRDNARTPMQWDESKNAGFSTGQPWLAVNPNYQEINVQEALANPDSIFYIYQKLVQIRKENSWLIRADFELLDTVDKVFAYIRKDRDRRFLVVANLSNEKQNFSVEGRVKSILIENTTAKEAVEKQTLAPWDAFCVELTD

SEQ ID NO: 2352 - protein, 416 aa, Thermotoga maritima
MPEKSLYEMAVEQFNRAASLMDLESDLAEVLRRPKRVLIVEFPVRMDDGHVEVFTGYRVQHNVARGPAKGGIRYHPDVTLDEVKALAFWMTWKTAVMNLPFGGGKGGVRVDPKKLSRNELERLSRRFFSEIQVIIGPYNDIPAPDVNTNADVMAWYMDTYSMNVGHTVLGIVTGKPVELGGSKGREEATGRGVKVCAGLAMDVLGIDPKKATVAVQGFGNVGQFAALLISQELGSKVVAVSDSRGGIYNPEGFDVEELIRYKKEHGTVVTYPKGERITNEELLELDVDILVPAALEGAIHAGNAERIKAKAVVEGANGPTTPEADEILSRRGILVVPDILANAGGVTVSYFEWVQDLQSFFWDLDQVRNALEKMMKGAFNDVMKVKEKYNVDMRTAAYILAIDRVAYATKKRGIYP

SEQ ID NO: 2353 - protein, 343 aa, Pseudotsuga menziesii
MSSKFGSLSSSCSSVHGTAFTVSARPSSAALRATPAITSLYADRKYDLQSFKFEPIRESIVAREMTRRYMMDMITHAETDVVIVGAGSAGLSCAYELSKNPDVKVAIIEQSVSPGGGAWLGGQLFSAMVVRKPAHLFLDEIGVPYDETEDYVVIKHAALFTSTIMSKVLARPNVKLFNAVAAEDLIIKEDRVSGVVTNWALVSMNHDTQSCMDPNVMESKVVVSSCGHDGPFGATGVKRLKSVGMIDKVPGMKALDMNTAEDAIVRLTREIVPGMIVTGMEVAEIDGSPRMGPTFGAMMVSGQKAAHLALKALGQPNALDGTLKVLPELVLASAENEITTASA

SEQ ID NO: 2354 - protein, 214 aa, Oryza sativa
MIKQPSVSLAPNTSCQPQHALARAAAGSARSRRISCLHLAVLHVGRHHARALCSHESAFSGANNNTNHDVKLRPRKFFEMEMSVRDCELDQYGVVNNVVYGSYVERAREELAEFLGVSASTAACTGNAMAVSEQNFKYFTPLKRGDNFVVKVTIQIKGVRIYADQFIETLPDRKLVLEAKATIVCLDGEYRPTRVFPELSSKVLDFFSHREASD

SEQ ID NO: 2355 - protein, 328 aa, Glycine max
PRNSETSYPPPRPLRSPVPDRSGGNFPPRKLHWRPRGGPKITSHTNTHTVFFYPFSHSFMFQTKMATNSLHYSIQHHHHSLTKRHHPSDTPPHTSLFLKHPTPPIHPNITISHTPSNSHITYSLSQTTSSSTTSPTTPSFDLLRHHLSNKNFELADEETRRLLIVLAGEAAQKRGYVFFSEVKFISEGGLRAIDSLWREYSGGKFGYSVQKKLLEKANGDFTKFFIKVGWMKKLDTEMEQYNYRSFPTEFIWELNDDTPEGHLPLTNALRGTQLLNNVLKHPAFDVVDDKEEKEKDGENKENGGAISATGLKDNGSSSKRIFKTDYSF

SEQ ID NO: 2356 - protein, 618 aa, Desulfovibrio desulfuricans
MCGIFGIISQLVPPSKRELETSCELLAHRGPDGYGYFIKGPVGFAHRRLSIIDIAQGSQPMSTQEGELTITYNGEIYNFRHIKASLVAKGYSFQTNSDTEVILAAYKEWGTECVQHLRGMFAFAIADHIRQTVFLARDPFGIKPLVYRESSLGFAFSSELPALVRLKKWPSVTVSPKAVSLFFRHQYIPAPYTIYNETQKLPPAHAMLVDFNGCIQQKWRYWTPAFHPSVTYSLQDAIKDAHNSVTESIDAHTLSDVPIGVFLSGGIDSTLVAARLAQRHSRSIPAFTIGYKESDFSELPYAQHAADKLGLKLYAQTLDEKALKFAPEILSHYGEPFGDSSVIPTWHVCKLASEHVPVCLSGDGADELFGGYQKYQIWSESTPWRQLQLAGSAIAKRKLRTAWWMLRRASRSFCDDKAFWLDHVQYYPPQGIRQLTHPDMHPYANAFAPAFDEPFLNIDKLGRFEYAQRMDLLSYLPDCLLAKVDLASMAHGLEVRPALLDKYVFQLAATLPTDVKLHPQKGGKVVLKELLLRQGFSEEFVYRPKQGFALPLRHWFISGQPANNMLCELVSSYKRELSEHLTVSDIERMLTAHSPACDYSGPLWLAFAFTCWVANTSK

SEQ ID NO: 2357 - protein, 341 aa, Bifidobacterium longum
MTMFHVKHNVIIIGSGPAGYTAAIYLGRAGLNPVMVTGALSPGGQLVNTTEVENFPGFPEGILGPDLMDRMKEQAKRFGTTYIADDVSSIEACESDSVKPTYRVTLSDDSQLEASSLIIATGSSFRKLGVPGEQELSGHGVSYCATCDGFFFRNKPIVVVGGGDSAFEEALFLTRFGSSVTLIHRRDSFRASQIMVDRAKANPTITLMTNTVVTSITGTSSPTQNTGAPIAIPGLTLKRPAVAPASVSSIAVRNMVTGEESTLDTNAVFVAIGHTPATDFAAGVVDRDDDGYVVVQGASTVTSAPGIFAAGDCVDRTYRQAISAAGMGCRAALDTQAYLTD

SEQ ID NO: 2358 - protein, 517 aa, Oncidium Goldiana
MELCMKSQIALSAAVLQPHAGSGRFSDGETMGQRLDFSSFRRANEQICRRRRASLLRMSFATTELVAEGKLRDLELEGRDPRTVVAVILGGGAGTRLFPLTRQRAKPAVPIGGAYRLIDVPMSNCINSGINKVYILTQFNSASLNRHLLRAYNFSNGIGFGDGFVEVLAATQTPGEAGKKWFQGTADAVRQFHWLFEDAKGKEIEDVLILSGDHLYRMDYMDFVQSHRQSGADITISCVPMDVSRASDFGLMKIDNNGRVLSFSEKPKGQELKAMEVDTSVLGLSREQAKKTPFIASMGVYVFKKEILLNLLRWRFPTANDFGSEIIPASAKELFVKAYLFNDYWEDIGTIKSFCEANLSLTRHPPNFSFYDATKPIYTSRRNLPPTAINNSKIVDSIISHGSLLSNCLIEHSVVGIRSRINDNVHLKDTVMLGADLYETDAEIAALLAEGRVPVGIGENTKIKDCIIDKNARIGKNATISNVDGVQEADRSAEGFYTRSGITVILKNSTIPDGFAI

SEQ ID NO: 2359 - protein, 565 aa, Magnetospirillum magnetotacticum
MTNTATAQAVDDFAALLDETLGVGGSFEGSVITGTIVEIDGDVAVIDVGLKSEGRVPLKEFATAGRATDIKAGDQVDVFVERYEDRNGEVVLSREKAKREEAWTLLEKSFEAQQRVTGVIFGRVKGGFTVDLSGAVAFLPGSQVDIRPVRDITPLLGTPQPFQILKMDRSRGNIVVSRRAVLEETRAEQRSELIENLKEGQILEGVVKNITDYGAFVDLGGVDGLLHVTDIAWKRINHPSEALHIGQTVKVQVIRFNSETQRISLGIKQLDADPWEGVEAKYPVDAKFSGRVTNITDYGAFVELEPGVEGLVHVSEMSWTKKNVHPGKIVSTSQEVEVMVLDVDPQKRRISLGLKQTMNNPWEGFLDRFPQGTLVEGEIKNITEFGLFIGLPGDIDGMVHLSDLDWATPGEQAIQNFKKGDVVKAKVLDVDVEKERISLGIKQLGADPYQDAVASIKKGDVVTCTVTQVTENGLEVTVEGMTGFIRKSELSRERSEQRPERFAVGEKLDAKITAFEKAARKITLSVKAREVEEEKQAMAEYGSSDSGASLGDILGAAMRKAQEKE

SEQ ID NO: 2360 - protein, 164 aa, Brassica napus
  misc_feature (27)..(27): Xaa can be any naturally occurring amino acid
  misc_feature (38)..(38): Xaa can be any naturally occurring amino acid
  misc_feature (51)..(51): Xaa can be any naturally occurring amino acid
  misc_feature (82)..(82): Xaa can be any naturally occurring amino acid
  misc_feature (97)..(97): Xaa can be any naturally occurring amino acid
  misc_feature (105)..(105): Xaa can be any naturally occurring amino acid
  misc_feature (138)..(138): Xaa can be any naturally occurring amino acid
  misc_feature (145)..(145): Xaa can be any naturally occurring amino acid
MASSMLSSAAEATSPAQATMVAPFTGXKTSAAFPVTRXKSNTVITYIASNXDELCCMKVWQPYRKKKFETLYYISDLTDVEXAKEVDYLLHNKWIPXVEFEMKHXFEYREHGITPGYYKGRYWTMRNLSLIRCTDFAXQLNEVQXCNTEYPNAFIRIIEYDNNQ

SEQ ID NO: 2361 - protein, 118 aa, Unknown
  Nostoc sp. MUN8820
MSTLYDNIGGQPAIEQVVDELHKRIATDSLLAPIFAGTDMAKQRNHLVAFLGQIFEGPKQYGGRPMDKTHAGLNLQQPHFDAIAKHLGEAMAVRGVSAEDTKAALDRVTNMKGAILNK

SEQ ID NO: 2362 - protein, 1013 aa, Mannheimia succiniciproducens
MFLPNYFQNPQILHVNATPHHAYFIPHDSVESAVKNPRESSAFFTLLNGEWNFQYFASYYDLTEDFLTRHLPDKIPVPANWQNHGYDHHQYTNVNYPIPFDPPYVPQDNPCGLYQRKFCINLNKAKRYLLNFEGVDSCLFVYINQQFVGYSQISHCTSEFDVTDFLRQGENEIHVLVLKWCDGSYLEDQDKFRMSGIFRDVYLLERESHYLQDFFIRTELAEDLKSAVLKVEPFFVQAGEPAALREMAWQLSDPQGNILLSAVTERGFEYVVNELQLWNAEQPKLYTLLFRYGSEVICQKIGFRKIEVKEGVLHFNHQPIKFKGVNRHDSDPKTGYVISREQALTDLRLIKTHNFNAIRTAHYPNAPWFAELCDELGFYLIAESDIESHGSNAVYVEMPETSILLNVKTDPKTDEIQQKTVDEYCYFARDPNFKQAILDRTYANVQRDKNRASVVIWSLGNESGFGENFEAAAKWVKGFDPSRLVHYENSIYQHSEHTNDLTHIDLYSEMYASTESMQAHFADPNNRKPYLLCEYSHAMGNSCGDAEDYWQIFNQYPQACGGFVWEWCNHSPYLTDGKMGYGGDFGDEPNDGNFCADGLVTADRQVQSSLLEMKNVNRPLRANLTAQGVELTNYLDFTDTEDFIAVHYQFSENGIVVGEGYIDDVKISPKQTALLPLNLPEDNGNLWLLDLTYYQKKETPLVAKNHQLGFDQIALFGQRIVPVARIGRVKSAVKIWQDSAVIKIQTEKAQFVMDKRKGIVQQIMTEQGGLLREPLDFNIWRALADNDNLIKRQWQAAGYDRAITRAYEIQAEDFSYKAVVKAKCGLVALSKARILTLDVVYHIYANGELKIEIDAEKAPQLPFLPRFGFRFVLDEAFQQGEYFGYGETESYADKHHGAKLGLYRTTAQQNHRDYLKPQENGSHWGCSFVKLRSENEEICVTSDKPFSFNLSPYKQESLQKAKHNYDLEDSNSTVLCIDYKMSGIGSNSCGPVLKAIYRLKENKWHCGFRLQIL

SEQ ID NO: 2363 - protein, 414 aa, Bacillus cereus
MVDHLKRQDEKVFAAIEAELGRQRSKIELIASENFVSEAVMEAQGSVLTNKYAEGYPGKRYYGGCEHVDVVEDIARDRVKEIFGAEHVNVQPHSGAQANMAVYFTILEQGDTVLGMNLSHGGHLTHGSPVNFSGVQYNFVEYGVDAESHRINYDDVLAKAKEHKPKLIVAGASAYPRVIDFKRFREIADEVGAYLMVDMAHIAGLVAAGLHPNPVPHAHFVTTTTHKTLRGPRGGMILCEEQFAKQIDKSIFPGIQGGPLMHVIAAKAVAFGEALQDDFKTYAQNIINNANRLAEGLQKEGLTLVSGGTDNHLILIDVRNLEITGKVAEHVLDEVGITVNKNTIPFETASPFVTSGVRIGTAAVTSRGFGLEEMDEIASLIAYTLKNHENEAALEEARKRVEALTSKFPMYTDL

SEQ ID NO: 2364 - protein, 165 aa, Unknown
  Mycobacterium sp. MCS
MTESYLLDIELNTLDGTSTSLRELADGAVLVVNVASKCGLTPQYSALEKLAQDYGDRGLTVIGVPCNQFMGQEPGTAEEIQTFCSTTYGVTFPLLAKTDVNGADRHPLYAELTQTPDAGGEAGDVQWNFEKFLLAPGGEVVNRFRPRTEPDAPEVISAIEAVLPK

SEQ ID NO: 2365 - protein, 448 aa, Sinorhizobium meliloti
MNVDEKLEPILAEVLRRNGGEHEFHQAVREVLESLGRVIAKHPRYAENALIERICEPERQIIFRVPWVDDKGQVQINRGFRVQFNSALGPYKGGIRFHPSVNIGIIKFLGFEQTFKNALTGMPIGGGKGGSDFNPRGRSDGEIMRFCQSLMTELHRHLGEYTDVPAGDIGVGGREIGYMFGQYKRLTNRYEAGVLTGKALFYGGSRARKEATGYGATYFVQRMIATKGLDFEGKRVTVSGSGNVAIYTMEKVIEFGGKIVACSDSNGYVVDEDGIDLELVKEIKEVRRERISEYARLKGAGTHYIEAGSVWDVPCDVAMPSATQNELTGKDARTLVKNGVLAVGEGANMPCTPEAVRIFQEAGVLFAPGKAANAGGVATSALEMQQNASRDSWTFEQTEARLATIMQAIHDRCAETAEEYGTPGDYVLGANIAGFVRVAEAMDALGVI

SEQ ID NO: 2366 - protein, 281 aa, Flaveria bidentis
MKETLNNDYHITEEIGRGRFGTVYRCYSTVSGDSFACKSIDKRLLNDHTDRECLQKEPKILHILGGNPNIVQIYRLYEDDNYVHMIIDLCDSPDLFDRISNRNGVFSETEAATVFTPLMSAISYCHRLGIAHRDLKPDNVLFDSRGGLKLADFGSAEWFAMNDRRTMSGIVGTPYYVAPEVLSGMEYNEKVDVWSAGVILYIMLAGVPPFHGDSPADTFEAVLRGNLRFPTRLFRSVSPEAKDLLRKMLCKDVYRRFSADQVLRHPWVVNGGKTRSMADLT

SEQ ID NO: 2367 - protein, 375 aa, Thermosynechococcus elongatus
MAMARDFYEILGVSRSADAEELKRAYRRLARKYHPDVNKEPGAEEKFKEINRAYEVLSDPQARANYDRFGEAGVSGVGAAGFSDFGIGDMGGFADIFETFFGGFTTSSRRQQGPTRGEDLRYDLKLEFREAVFGGEKEIRINHLETCKTCQGTGAKPGTRPVTCSTCGGVGQVRRSARTPFGSFTQLTTCPTCGGSGVVIEDRCESCGGQGHIQVSKKLKITIPAGVDNGTRLRVSGEGDAGLRGGPPGDLYVYLFVQPDPEFQREGNNILSRIKISYLQAILGCRISVSTVDGEAELKIPAGTQPGTVLVLEGRGVPRVGNPVARGDHLITVDVEIPTHITHEERELLEKLAKIRGERLGKGGLEGFLGSLFGG

SEQ ID NO: 2368 - protein, 252 aa, Pisum sativum
MASMSSLKMISSLKLSHSTSTSPLQTQKQLVSSSLSHSFLTKKFNISTTRQFSTSSKNTTTTAFFFNNQKEHQQSSKPGKVQELFVYEMNERGRGSPAYLKLSQKSMNSLGDLVPFSNKLYSGNLEKRIGITAGLCILIQHVPEKKGDRYEAIYSFYFGDYGHISVQGAYLTYQDTYLAVTGGSGIFEGVHGKVKLQQIVFPFKLFYTFYLKGIPDLPDELLGNPVEPSPNVEPSPAAKATQPHASLSNFTN

SEQ ID NO: 2369 - protein, 179 aa, Carboxydothermus hydrogenoformans
MHQDIAEILISEEEIRAKVKELGQQISRDYAGQDLLLVGILRGAMLFMSDLMREIDIPINIDFMVVSSYGSGTTTSGEVRVLKDLDRGIEGRNVLLIEDIVDTGLTLNYLTKYLANRHPKSLKVCTLLNKPSRRRVEVKVDYNGFIIPDKFVVGYGLDYNEYYRNLPYIGVLKPEIYRE

SEQ ID NO: 2370 - protein, 184 aa, Brassica napus
FCEDDQENLYNMVRRVATAGKQGLGIKDQPKKIAGVRYLGKKTSFDNSDDDDDTDEEEEEEEESEKEDDKDSVIENALPAKRKREESEEEDDKDSVIAKRKRDEITEPKIKLKNLCKQILKKDAGSSGSMKLKQLKSLIDEQAPSVLSKFSSRKDAIAYLKLKLERSGKFIVEGKKISLVSKNK

SEQ ID NO: 2371 - protein, 378 aa, Unknown
  Mycobacterium sp. JLS
MTSDIDEVRQIEADAAPTRFARGWHCLGLTRDFGDGKPHTVNAFGQKLVVFRSGDGRINVLDGYCRHMGGDLSQGEVKGNEIACPFHDWRWGGDGRCKQVPYSKRAPRLARTATWTTLEQDGMLFVWNDPERKPPPDDVTIPRIEGATSDEWTDWHWYTTVVDTNCREVIDNVVDMAHFFYIHGSLPTHFKNIFEGHVATQYMNSAGRADLQPPEGPRMLGITSVASYHGPSFMIDDLTYHYEEADHHTVLINCHYPIDANSFVLQYGIIVKKSEALPDDLAVQTAVSLGDFVKMGFEQDVEIWKNKARIDNPLLCEEDGPVYQLRRWYEQFYVDIADVTPDMVDRFEYEVDTTRPREEWMKIVEANISARASATSAG

SEQ ID NO: 2372 - protein, 880 aa, Physcomitrella patens
MGGRLKESWNEQTMDSSGKYVRYTNEQVEALERVYHECPKPSSIRRHQLIKESPILANIEPKQIKVWFQNRRCREKQRKEASRLVSVNAKLTALNKLLMEENERLAKHTSQLTLENHALRQQLPGLPLTDGRHRLSSQNALKKEGAVNGGDESSTQGGICVRIHGQAGVASTDTSCDSAVTGGLPHRLTPQHSPRDTSPAGLLAIAEETLTDFLAKATGTAVDWIQLPGMKPGPDAIGIIAISHGCVGIAARACGLVALDASKVTEVLKDRPAWQQDCRRMEVLGVLPTANGGTIELLYTQMYAPTTLASARDYCTLRYTTILEDGNLVICERSLIGGQNGPPMPPVQSFVRGEMFPSGYLIRPSDGGGCIIHVVDHYDNERWSVPEVLRPLYESPAVLAQRSTIAALRHLRRLASEESGEGNPRNGQHPVVLRTLSQRLAKGFKNAVNGFGDDGWVSTVSDGLEDVSVMLNATPKSMEGQIASDKLLYSLGGGILCAKASMLLQNVSPSLLIGFLREHRSEWADFDIDANVATSFRSNGNSYARGGGVSHVQLPLPLAHSGEHGEILEVVKLEGHSSVQHMVLSRDSFLLQLCSGIDENAVGASAQLIFAPVDVALAEDIPLLPSGFCVSPIDASVVGGFDLDRTLDLASTLEGGSDLRLNGDTKSNGTSGQMRSVLTIAFQFAYEVHTRETCAVMARQYVRTVVASVQRVAMALAPSRAPAPLRQAPSNPDAISLVRHVLSSYRLHLALDLTRPENRGDEALFKAFWHHTDAIVCCAWKGMPEFVFANRSGLEMFETTTSSLQDLDWDKTLNENECELSYTTFTQVLQQDYCSLPAGVRMSSTGRTTTYERALAWKVLDDNEAVECIAFLFINWSFVT

SEQ ID NO: 2373 - protein, 158 aa, Beta vulgaris
MRVESTWPDEGVVSSDEDYSGGEIDVQDLQPKDEERDLKDQLLRRFGSHISSLKLEFSKKKKKGKLPREARQMLFEWWNAHYKWPYPTLAWTYVSIISQHPAIAVQEADKIALAEMTGLDQRQINNWFINQRKRHWKPSENMQYALMENFSGQYFTDD

SEQ ID NO: 2374 - protein, 844 aa, Physcomitrella patens
MEKVDPDKYKGMDSSGKYVRYTNEQVEALERVYHECPKPSSIRRHQLIKECPILANIEPKQIKVWFQNRRCREKQRKEATRLVSVNAKLTALNKLLMEENERLAKHASQLTLDNHALRQQLPNLPVPDGKCRLSGQAGVASTDTSCDSAVTGGLPQHLTSQHSSPDASPAGLLSMAEETLTDFLAKATGTAVDWIQLPGMKPGPDAIGIIAISHGCVGIAARACGLAALDFSKVAEILKDRPGWSQDCRRMEVLGTLPTGNGGTIELLYTQMYAPTTLAPARDFCTLRYTTLLEDGNLVICERSLTGKHNGPTMPPVQSFIRAEMFPSGYLIRPCEGGGCIIHIVDHVEYEPWSVPEVLRPLYESPAVLAHKSTIAALRYLRRIAAEESGEIIIRNGQHPAVIRTLSQRLTKGFNDAVNGFGDDGWVPMESDGMDDVSVMLNATPKSMEGQIATDKLLFSLGGGILCAKASMLLQNVPPALLIRFLREHRSEWADHEIDANAATAFRGASNGHVSRGRMSHVQLPLPLAQFGEQGEFLEVVKLEGHSAVQHSVLSRDSFLLQLCSGIEEGAVGAGAQLVFAPIDAAVSEDIPLLPSGFRVIPVDSSVVDGIGLNRTLDLASTLEDHEAGLNGESKSNGSSSQVRSVLTIAFQFAYEVHTRETCAVMARQYVRTVVASVQRVAMALAPSRGQPRPALGNSDAISLARHILSSYRVQLGMDLVRPEVGGTEALFKVFWHHSDAIVCCAWKGTPEFVFANRAGLEMFETTSSSLQDLAWDKTLDEDSLKLSYATFTQVLQQGYCCLPSGVRISSTGRTVTYERALAWKVLDDDETTQCIAFLFMNWS

SEQ ID NO: 2375 - protein, 413 aa, Unknown
  Rhodococcus sp. RHA1
MTSDIVVIGGGVAGVTAAQSLRSEGYDGRLVLIGKERELPYDRTALSKAVLAGDLADPPLLFPADWYDEWQIETVLDRTVLQVDVTRREVLLDGGPWLKVDRVLLATGASARVPSFSGSDLPGVATLRTADDVHRMRRDWEPGQRLVVVGGGLIGCEVATTARKLGLEVSILEASDELLQRVLGRRIGGWCRARLMELGISVVLNTGVAEFKGVDRITTVIGTDGRSFVADRAIVCVGAEPETAIAEQSGLACNRGILVNDSGGTAAEGVFAAGDVASWPLLTGGRRSLETYINSQREATAVASAMLGKAVHGPQLPLSWTEMAGHRIQMIGDIEGSGEYVMRGDPDDGPALLFRLSDGRVTAAVSVDAPRDFAMATRLVERGAQVGREVLGDTSMELRELNRAARERALIAE

SEQ ID NO: 2376 - protein, 877 aa, Physcomitrella patens
MTESWKEQTMDSSGKYVRYTNEQVEALERVYHECPKPSSIRRHQLIKESPILANIEPKQIKVWFQNRRCREKQRKEATRLVSVNAKLTALNKLLMEENERLAKHASQLTLENHSLRQQLPSLPLTNGTHRLSSQNLLKKERAVNGGDESSTQGGICVKLHGQAGVASTDTSCDSAVTGGLPHHLTPRHSPRYTSPAGLLATAEETLTEFLAKATGTAVDWIQLPGMKPGPDAIGIIAISHGCVGIAARACGLVALDAGKVTEVLKDRPAWLEDCRRMEVLGALPTGNRGTIELLYTQMYASTTLAPARDYCTLRYTTILEDGNLVICERSLTGGQNGPSMPPVQSFVRGEMFPSGYLIRPCDGGGCIIHVVDHYDNGPWSVPEVLRPLYESPAVLAQRSTIAALRHLRRLAAEESGEGNPRNGQHPAVLRTLGQRLAKGFKNAVNGFADDGWVSTVSDGLDDVSVILNATSQSMEGQIASDKLLYSLGGGILCAKASMLLQNVPPSILIKFLREHRSEWADYDMDANLATSFRSNGNGYAPQGGGVSHVQLPLPLPNSGEHGEILEVVKLEDHSSVQHMVISRDSFLLQLCSGIDENAVGASAQLIFAPVDVALTEDIPLLPSGFCISPVDANVLDEFDLDHTLDLASTLEGGSDLRLNGDSKSNGTSSHMRSVLTIAFQFAYEVHSHEACAVMARQYLRTVVSSVQRVAMALAPSRGSAPPRQMSANPDALSLARHVLRSYRLHLGLDLTRSENGGDETLFKAFWHHTDAILCCAWKGKPEFVFANRSGLEMFETTTSSLQELDWDKTLNESDCKLSYATFTQVLQQGYCSLPAGVRMSSSGRTATYERALVWKVVDDNETVECIAFLFINWSFVV

SEQ ID NO: 2377 - protein, 144 aa, Triticum aestivum
  misc_feature (24)..(24): Xaa can be any naturally occurring amino acid
IQEGQDWGATLLIFKLNRALCVQXWSPKENKFAVGSGAKSACICYYEQENNCRIQFGTTASPMQTTWGSSCQAPRCCFHATAAAATETTTMNPSPCLQCLLSARRGHPAKAMSANPEAGMHTPEGHPHHLLPLPCSPIRRQDIE

SEQ ID NO: 2378 - protein, 1012 aa, Clostridium perfringens
MILKNEYHEDISKLHVNMMPRRSYYVPFVDTDEALNIKDRSKQLNFFSLNGKWEFNYFDSLQKVKEFDDINQISFSDNIDVPSLWQLKGYDYNQYTNVKYPIPFDPPFVPINNPCGIYKRDFEIEILPENYDYNINFEGVDSCFYFWINDNFVGYSQISHSISEFDITEFLVKGKNTITVLVLKWCDGTYFEDQDKFRMSGIFRDVYILRRAKERIVDYKITQSIDFSAKEGKLDLEILSNIGNPKGKYYLLNPNNHMIASGNIDNNKIQINIKNVELWSAEIPNLYTLLIETEHEVIKERIGMREIKIENSILKINNKKIKLRGVNHHDSNPTKGYVMTYDDMILDLKIMKECNVNSIRTAHYPKSPIFYELCDEYGFYVMSEADIEIHGVVELYGLGYLDNYNMIADDKVYEKVIIDRVDSSIVPFKNKSCIFMWSLGNESGFGCNFERGLEYARALDPTRPLHYEGAYYASKERENDFTNIDVISRMYISIEEIKDYFEKGIDKPLILCEYAHAMGNGPGGLQDYDEMIQKYDQFAGAYVWEWCDHAILINENINDKKAYGYGGDFEEENHDGNFCVDGLVYPDRTPHTGLLEYKNINRPIRAIEFDEVKKRVKLKNMFDFRNAGEFLDVTYKVFLDGEIIFGDDIDLESLKAKEEKWYDLSISELPKEIITILFQYKVKNHNHLYEKGEVLGFDNFIIKNGVDNISSVDKIIKGNINEQKFYVEETVNKIKVINNEFIYNYNKNTGSFDFIQALGETFIDDPMKFIIWRAPTDNDRKIKNLWIEAGFNQITTRVYNSKIKEFSNRVEITSDLSLIPPYRERVLDLKVTWSIYSEGLIKCHVKGDKNMKTPYLPRFGVELKLNKSYEEVSYFGFGPYENYVDKNSSCYLGRFNSKVSEMHEDYIRPQENGSHHYCREVAINNEKGKVYVLSENDFAFNVSHFSLNQLTNANHNFDLNEEEATYLIVDYKQSGIGSNSCGPDLDEEYRLNEKEFSYDFYLKFVKDNIKDN

SEQ ID NO: 2379 - protein, 875 aa, Physcomitrella patens
MTETWKEQTMDASGKYVRYTNEQVEALERVYHECPKPSSVRRHQLIKESPILANIEPKQIKVWFQNRRCREKQRKEATRLVSVNAKLTALNKLLMEENERLAKHTSQLTLENHALRQQIPNLPFPDGRHRLPSHSPLKIEGAVNGGDESSTQGGICVKLPGQAGVASTDTSCDSAVTGGLPHRVTPQHSPRDTSPAGLLATAEETLTEFLAKATGTAVDWIQLPGMKPGPDAIGIIAISHGCVGIAARACGLVALDASKVTEVLKDRPAWLQDCRRMEVLGALSTANGGTIELLYTQMYAPTTLAPARDYCTLRYTTILEDGNLVICERSLTGGQGGHTMPPVQSFVRGEMYSSGYLIRPCEGGGCIIHVVDHYDKEPWRVPEVLRPLYESPAVLAQKSTIGALRHLRRLAAEESGEGVPRNGHHPAVLRILGQRLTKGFNDAVNGFGDDGWETTVTDGLDDVSVMVNATPKSMEGQIASDKLLYSLGGGILCAKASMLLQNVPPSLLIRFLREHRSEWADYDMDDMASFRSNGNGYVPRGGGVSHVQLPLPLAQSGECGEILEVVKLEGHSSVQHMVLSRDIFLLQLCSGIDESALGACSQLIFAPVDVALADGIPLLPSGFCVSPIDTNVVDGFGLDRTLDLASTLEGGNDLRLNGDVKSNSSSGQMRSVLTIAFQFAYEVHTRETVAAMARQYVRTVVASVQRVAMALAPSRGAAPPRQAPSNPDALSLACHVLSSYRFHLGIDLVRPENGSDEALFKAFWHHTDAIVCCAWKGMPEFVFANRPGLEMFETATSSLQNLNWEKTLNENDRKLSYATFTQVLQQGYCSLPAGVRMSSTGRTVTYEQALAWKVLDDTKAVECIAFLFINWSLVT

SEQ ID NO: 2380 - protein, 343 aa, Pseudotsuga menziesii
MSSKFGSLSSSCSSVHGTAFTASARPSPAALRPTPAITSLYADRKYDLQSFKFEPIRESIVAREMTRRYMMDMITHAETDVVIVGAGSAGLSCAYELSKNPDVKVAIIEQSVSPGGGAWLGGQLFSAMVVRKPAHLFLDEIGVPYDETEDYVVIKHAALFTSTIMSKVLARPNVKLFNAVAAEDLIIKEGRVSGVVTNWALVSMNHDTQSCMDPNVMESKVVVSSCGHDGPFGATGVKRLKSVGMIDKVPGMKALDMNTAEDAIVRLTREIVPGMIVTGMEVAEIDGSPRMGPTFGAMMVSGQKAAHLALKALGQPNALDGTLKVLPELVLASAENEITTASA

SEQ ID NO: 2381 - protein, 332 aa, Picea glauca
MGRQPCCDKVGLKKGPWTAEEDRKLVNFITMHGHGCWREVPKLAGLLRCGKSCRLRWTNYLRPDLKRGLLSESEEKLIIDLHAAIGNRWSRIAAQLPGRTDNEIKNYWNTRIKKKLRQMGIDPVTHKPLSQMQMQSSPTQSLLLQENDEQQQQQQQQQNEPDQNHSNGSAETLVLTAREPNDDIEPLENFNMEDSMQLFNVCSPTSVISLSGRTEEVDSDDSDQVSKSFGNGGHAQYIGRESSGVKAECGLSVWDQMGGVLGDPLSDYNSQWNVDLESWTAGLDAHAASASAWIQQLPDCQWNDFQGDFEICSKSCPETLQRLGPFLDDDEM

SEQ ID NO: 2382 - protein, 343 aa, Pseudotsuga menziesii
MSSKFGSLSSSCSSVHGTAFTVSARPSPAALRATPAITSLYADRKYDLQSFKFEPIRESIVAREMTRRYMMDMITHAETDVVIVGAGSAGLSCAYELSKNPDVKVAIIEQSVSPGGGAWLGGQLFSAMVVRKPAHLFLDEIGVPYDETEDYVVIKHAALFTSTIMSKVLARPNVKLFNAVAAEDLIIKEGRVSGVVTNWALVSMNHDTQSCMDPNVMESKVVVSSCGHDGPFGATGVKRLKSVGMIDKVPGMKALDMNTAEDAIVRLTREIVPGMIVTGMEVAEIDGSPRMGPTFGAMMVSGQKAAHLALKALGQPNALDGTLKVLPELLLASAENEITTASA

SEQ ID NO: 2383 - protein, 343 aa, Pseudotsuga menziesii
MSSKFGSLSSSCSSVHGTAFTVSARPSPAALRATPAITSLYADRKYDLQSFKFEPIRESIVAREMTRRYMMDMITHAETDVVIVGAGSAGLSCAYELSKNPDVKVAIIEQSVSPGGGAWLGGQLFSAMVVRKPAHLFLDEIGVPYDETEDYVVIKHAALFTSTIMSKVLARPNVKLFNAVAAEDLIIKEGRMSGVVTNWALVSMNHDTQSCMDPNVMESKVVVSSCGHDGPFGATGVKRLKSVGMIDKVPGMKALDMNTAEDAIVRLTREIVPGMIVTGMEVAEIDGSPRMGPTFGAMMVSGQKAAHLALKALGQPNALDGTLKVLPELVLASAENEITTASA

SEQ ID NO: 2384 - protein, 161 aa, Gossypium hirsutum
RIIVQYIDEVWPSAPILPSDPHERATARFWAAYLDDKWFPSLRAIGMAEGEDARKAAIGQVEEGLMLLEEAFGKCSQGQAFFGKDQIGYLDITFGCSLGWLRVTEKMSGIKLLNEINTPALLKWANRFCNDAAVKDVMPETEKLAEFAKMLRGRVRATPTS

SEQ ID NO: 2385 - protein, 439 aa, Unknown
  Candidatus Desulfococcus oleovorans Hxd3
MKKLLLVLPRHEQGFWGHVSKSGKAGMVRLSLSTVAALTPDHWQVEILDSRVTPVNYDAPVDLVGITAFTAEIPSAYKIADGFRQKGTPVVMGGFHVSALPDEALEHADSVVVGEAEPVWKRVLADVEAGHLQPVYKAERVVDMNHMAVPCRHLLSRDMYSTGFYTIQATRGCPYNCEYCAVSAFFGRTYRTRPVDQVIEEIKGFDTKNFFFVDDNITGKVDYAKKLFRALTPLKRTWGGQTAITIAKDEELLSLYAKSGGQYAFIGFESLSEKNLARMNKSWNSPETYVKAIAKIHKKGINILGSFIFGLDDDDPGVFQRTVEFVRKSKIDAAQFHILTPFPGTRLFDKMAADGRITSRDWGRYHTSDVVFSPSAMSAEELQNGYWWAFRKSYSIANTLKRCLRSPRNIKSRVALNLGYRKKAMQMPNPDIHKIFQHS

SEQ ID NO: 2386 - protein, 951 aa, Burkholderia pseudomallei
MTVDTLAQPIAPSTPGAVRETRSTCCYCGVGCGVVIETRRDANGRDTIVGVRGDPDHPANFGRLCSKGSTLHLTATPERYAQTRATHPELRASRDAARTRVSWDDALDHVAQRLARTVERHGPDSVGFYISGQLLTEDYYVFNKLAKGLVGTNNIDSNSRLCMSSAVVGYKKTLGADAPPCSYEDLDHALTVLIAGANPAYAHPILYRRLEAARARNPQMKVIVADPRRTDSASDATLHLALQPGTDTMLFNAMLHVLIWDGALDSAFIAAHTHGFDALRDAVRDATPAAAAQVCGLRADDIVQAARWFGAGPSLSLYCQGLNQSSSGTAKNVALINLHLATGQIGKPGAGPFSLTGQPNAMGGREVGGMATLASAHRDLANPAERAEIARLWGVPDLPAKPGLTAVEMFERLAEGALKAIWIVCTNPAHSIPSQALARAGLERAEFVVLQDAYAHTGTAPYADVLLPAATWGEKEGTVTNSERRISRVRAATQPYGDARADWRIAADVGRRLEARLAPGRPTLFPYEDAEAIWNEHRATTLGRDCDIGGLSWPLLARDGPQQWPFPAGATQGLARLYTDGRFPSADGRARFVPTPYQPVAEAVDARYRFALTTGRLRDQWHGGSRTGSVAKLFAHAPQPCVELNPGDCARLGLGAHDFVHLTSRRGSALMPARADDAVAPGQAFAPMHWGDEYVSGVAGNRAAMGINALTTPARDPHSQQPELKHAAIKLLKADLPWRWLIAARVPPGELLARQRAARAFFARFPYASCVPFGTDAYAGLAWRAAAYEPAPAELQREIEALFELPAQAADVMSYGDARRGTGRRVRIVDGALVVFSVAGAAGATEDSAAVLRDYVDTGASVGALGRLLLFAGRVPLQTAPARGRTICNCVGVSEREIGAVLAADAPSAAPVERLANLQERLKCGTQCGSCIPELRRLIAETATAAAPPPR

SEQ ID NO: 2387 - protein, 814 aa, Burkholderia pseudomallei
MRKMKLVMVGNGMAGVRTLEELFKLAPDLYDVTVFGAEPHPNYNRILLSPVLAGEQTLEQIVLNDYAWYASHGVTLHVGKKIVKIDRMKRVVIADDGTEAAYDRLLLATGSNPFMLPVPGAQLDGVLGYRDIADTQAMIDAAARHTHAVVIGGGLLGLEAANGLKLRGMDVTVVHLAPTLLERQLDAKAGGLLRASLEARGLTFLMPKQTQALVGDEHGRVRAVHFKDGGECKADLVVMAVGIRPNTALAESAGLYCNRGIVVNDTMQTYDPRIYAVGECVSHRGIAYGLVAPLFEQAKVAANHLAQFGIGRYTGSVTSTKLKVTGIDLFSAGDFLGGDDTEDITLSDPIAGVYKKLVIKDDRIVGACLYGDTADGAWYFKLLREGRNIADIRETLMFGETSLGDTGHSGATRAMTMADDAEVCGCNGVCKGTIVSAIKEKGLFTLDDVRKHTKASASCGSCTGLVEQILMSTLGGDYSASPKAKPVCGCTDHTHAEVRAAIREHKLLSVPEAMRFLEWRTPNGCSSCRPALNYYCISTWPHDAKDDPQSRFINERAHANIQKDGTYSVVPRMWGGVTSADELRRIADVVDKYAIPTVKVTGGQRIDLLGVKKEDLPGVWRDLGMPSGHAYAKALRTVKTCVGSEWCRFGTQDSTLMGQQLERALWRMYAPHKVKLAVSGCPRNCAESGIKDVGVIGVDSGWEIYVGGNGGIKTEVAQFFCKVKTHEEVLEYAGAFLQLYREEGWYLERTVHYLERVGLDHVKARVLDDAENRRALWDRLQFALKDEPDPWHDTQDAKVDLRQFIPIAVAPADA

SEQ ID NO: 2388 - protein, 339 aa, Hordeum vulgare
MENILHATPAHVSLPESFVFASDKVPPATKAVVSLPIIDLSCGRDEVRRSILEAGKELGFFQVVNHGVSKQVMRDMEGMCEQFFHLPAADKASLYSEERHKPNRLFSGATYDTGGEKYWRDCLRLACPFPVDDSINEWPDTPKGLRDVIEKFTSQTRDVGKELLRLLCEGMGIQADYFEGDLSGGNVILNINHYPSCPNPDKALGQPPHCDRNLITLLLPGAVNGLEVSYKGDWIKVDPAPNAFVVNFGQQLEVVTNGLLKSIEHRAMTNSALARTSVATFIMPTQECLIGPAKEFLSKENPPCYRTTMFRDFMRIYNVVKLGSSLNLTTNLKNVQKEI

SEQ ID NO: 2389 - protein, 312 aa, Saccharomyces cerevisiae
MSIVETCISFVSTNPFYPFCTGLLLNCVVTPLYFWKTQNGRIVVVSLLQFVVLYATAFISIGTDKSLYRNKWVALPLSKKTRISRNTSLYCFKLKYPFERLHIPMGYHLAVRVTINGERLVRYYTPVNVPNTEGHLELVVKTYKHGVVSKYFDKLKIRQYVEFKGPLGELEYDQDTATELGIIAGGSGITPVLQVLQEIIPSPEDLTHISLIYANETEDDILMKSQLDHMAKEYPHFKVHYVIHKPNGKWNGDVGYVTLEEMKRYLPKQAEDHRLLICGPPKMNEMVLNYAKELGWSNGFHKGNGTDKVFVF

SEQ ID NO: 2390 - protein, 678 aa, Coccidioides immitis
MAMIVVQQHPVQHSSTPPPLPSALSLSGSAPRAQTPIPNKHLPVCPTGPPPASSKVPAPSISTTKPVKTFLYPPTKFPKVYDNPPVYTIDADQLAAALDEASTRALPEPNKVFPWLHGLHPDNQIQLAFFVPRRRTLRRIPKCLRSIVIVKVGGELASSRVKGAVAPGEIINGSTFPDPDPPVGFSVRNFQIQTAKLAPISDIILYGEDGVRPAQVLSLAKEISSAQEAWRHRFDPGEELRLVNTFVLSTPFHHLEQQHPELVAVRSDGQVNDGLMDFFRWERIEMCNMSHPSEISENVYLGFTPELSSNNGLEAGFDLMIEAHDVANIPDPRYLTKVTALLESGPQSIEFPSSGSLIASELSQVEVFDIIDTCRWIYHITHSQGSEQMQDQARVESDGDIQMITLGPRPKKVLIHCADGYTESSLLAIAYFMFAEGVPAHEAWLRLHCEKKRNFFAYPSDVTFLTTIQHQLLRESPAAKAARLINQPDPGWMARLDGSLPSRILPYMYLGNLTHANNPELLKALGIGRILSIGEPVSWPETELMSWGSENLMMIDDVQDNGIDPLTKEFDRCLQFIEKGKLDGTAALVHCRVGVSRSATICIAEVMASLGLSFPRAYCYVRARRLNVIIQPHLRFVYELLKWDEHLQLKRNQPIRRELEWTTIAREIALMNKPYSRQ

SEQ ID NO: 2391 - protein, 523 aa, Hordeum vulgare
MSSMQFSSVLPLEGKACVSPVRREGSACERLKIGDSSSIRHERASRRMCNGGARGPAATGAQCVLTSDASPADTLVLRTSFRRNYADPNEVAAVILGGGTGTQLFPLTSTRATPAVPIGGCYRLIDIPMSNCFNSGINKIFVMTQFNSASLNRHIHRTYLGGGINFTDGSVEVLAATQMPGEAAGWFRGTADAVRKFIWVLEDYYKHKSIEHILILSGDQLYRMDYMELVQKHVDDNADITLSCAPVGESRASEYGLVKFDSSGRVIQFSEKPKGDDLEAMKVDTSFLNFAIDDPAKYPYIASMGVYVFKRDVLLNLLKSRYAELHDFGSEILPRALHDHNVQAYVFTDYWEDIGTIRSFFDANMALCEQPPKFEFYDPKTPFFTSPRYLPPTKSDKCRIKEAIISHGCFLRECKIEHSIIGVRSRLNSGSELKNAMMMGADSYETEDEISRLMSEGKVPIGVGENTKISNCIIDMNARIGRDVVISNKEGVQEADRPEEGYYIRSGIVVIQKNATIKDGTVV

SEQ ID NO: 2392 - protein, 434 aa, Unknown
  Nocardioides sp. JS614
MTGRRPTRPRLFSRGSFLESSRVADILRAETTGGLLLIAAATVAIVWANTPWSASYADLRDLRVGPQAWHLDLTLGAWAADGLLAIFFFVAGLELKREFVAGDLRDPRRAALPVVAAMGGMAVPALVYVLWNLGGDGALQGWAIPTATDIAFAVAILAVISTHLPTGLRTFLLTLAVVDDLLAITIIALFYTDELHLGYLAAAAVPLLVFALLVQRRIHRGWLLIPLAATAWVLVHESGVHATVAGVLLGFAVPVLRSDGQEGPGLAEHLEHLVRPLSAGLAVPVFAFFAAGVTVGGFDGLVDALSDPVALGVVTGLVVGKTVGIAGSTWLLATFTRADLDDQLSWVDVVGLAMLAGIGFTVSLLIGELAFGSGTPRDDHVKVGVLVGSLAATALATGVLRMRNRAYRRLVEIEEQDADADGVPDVYQRDADEG

SEQ ID NO: 2393 - protein, 115 aa, Triticum aestivum
  misc_feature (22)..(23): Xaa can be any naturally occurring amino acid
  misc_feature (33)..(34): Xaa can be any naturally occurring amino acid
  misc_feature (44)..(44): Xaa can be any naturally occurring amino acid
  misc_feature (52)..(52): Xaa can be any naturally occurring amino acid
  misc_feature (78)..(78): Xaa can be any naturally occurring amino acid
  misc_feature (81)..(81): Xaa can be any naturally occurring amino acid
  misc_feature (92)..(92): Xaa can be any naturally occurring amino acid
  misc_feature (94)..(96): Xaa can be any naturally occurring amino acid
RRRNRRLRAAVHNEKDLRGCYXXIKNKPYPKSXXCRGVPDPKIXIYDVGMNXKGVDEFSHCVHLVSWEKENVSSEALXAAXRIACNKYMTNXAXXXDAFHLKGQGSTVPWCSRNK

SEQ ID NO: 2394 - protein, 297 aa, Candida albicans
MAQELTHPAIKDGWFAEISDTMWPGQAMSLKVEKVLHVEKSKYQDVLVFKSTTYGNVLVLDNCIQVTERDEFSYQEMITHLALNSHPNPKKALVIGGGDGGVLREILKHESIEEAWLCDIDETVIEVSKKYLPNMAKSYDDPRTRVHIGDGFKFLEEYKNQFDVIITDSSDPEGPAESLFQKPYFQLLKDALTEKGVITTQAENMWIHMDIISKLKKDCNEIFPVAEYAYTMIPTYPSGSIGFMVCSKDPNANVSKPIRFDWSDEFVAKNLKYYNKKIHEAAFVLPTWADQVLNKKD

SEQ ID NO: 2395 - protein, 483 aa, Methanopyrus kandleri
MIDVLLINPPDVTTKYQRFLGITAPPLGLAYIAAVLEEAGYTVKILDCPPLDMSFEDLRRAVRKLRPRIVSIMATTPIIHQAYQAAKVVKEELEDVIVCLGGYHPTFMDVECLKECPYVDVVVRREGEFTLLDLAKVFIDGVKTLSEVLGITYREKDDIVRAPDRPLIRDLDALPFPARHLLPMDKYTFFGAKTTATTMVSSRGCPVGCDFCASSAMHGHKLRMHSAERVVSEMAHVHENYGSDIIAFVDDTFTYDRRRVEEICRLIVESGLDVTWGCAARVDTIDRELLELMREAGCSVLFFGVESGSQEVLDNVGKGFTVEQTKKAFQLCREFDIVTVASAVIGLPGETHRSARQTIKFLKEIDPDYAVVSVATPYPGTKFYQEAVEKGLIEEKSWDKYTLMDPVVRTTELSPEEVKKYQKRAMIEFYLRPRYLIRRLKEDGIDAVRVTGTMIAEVAFKKMKALLAKIPSPRFSHRKGSDE

SEQ ID NO: 2396 - protein, 680 aa, Unknown
  Nocardioides sp. JS614
MTQTHCPYCSLQCGMRLEGGRRLEVRPWPEFPVNEGALCRKGWTAAGLRGHRERLTTPLIRDRATGELRAAGWDEALDLVASRLCGLRDEHGPDSVAVFGGGGLTNEKAYQLGKLARVALGTSQVDYNGRWCMSSAASAGNRALGIDRGLPFPLADVEHTDVLVLVGSNLAETMPPAARHLDRLRENGGRVVVVDPRRTPTAERADLFLQPVPGTDLPLALGLLHLLDAAGAVAEEYVAARTTGWEEVRRSLAGWWPERVERVAGVQASQLRECADLLAGAERVMVLTARGAEQHAQGTDTVLAWIDLALALGMPGKQYAGYGCLTGQGNGQGGREHGQKADQLPGYRMIDDPLARDHVAEVWGVSTDSLPGPGRSAYELLDSLGTGGGPRALLVVGSNIVVSAPNATHVASRLAALDLLVVADLVLSETAAQADVVLPVAQWAEETGTMTNLEGRVILRERAVAPPEGVRTDLEVIAGLAERLGSPVPFAVDPEEVFAELGRASSGGRADYSGIGYDRIRDEHGVFWPCPSPDHPGTPRLFAESFPTADGRARFVAVEHRGPAEPTDPSYPIHLTTGRVLAQYQSGAQTRRVRELPDEGPFVEMHPMLAARIGAHDGQQVVVTTRRGELRVPARVTATIRPDTVFVPFHWVGANRLTHDALDPASRMPEFKVCAAAVRA

SEQ ID NO: 2397 - protein, 460 aa, Unknown
  Nocardioides sp. JS614
MRVVVVGAGMAAARLADGLHDHDVTLLGDEPHPPYNRILLSAVLEGTHDPTAIAMPLRGDVDLRLGTRVVEIHREDRDVELADRSRVPYDRLVLATGSIPTLPPIRGLVRMDGRLDERVHAFRSLEDCRRLDVAVPAAHRAVVVGGGLLGLQVARALAVRGVATEVVEGGDHLLRSQVGPRAGAILARDLGRLGTRVYTGARAVRLTDEGLRLDNGYTLATDLVVLTAGGRPSTALARRAGLEVRRGIVVDERLRTSDHRIHAIGDCAQHGTQVTGFVPPAWEQAGLLARQLRGEDVTYAGSRSVARLRATGLEVAVLGEPERAEGQVVEVANPVTGTHRKLVVRDGVIVAATLVGDLSRIGLITQHYDRGTVLGASEPGDLLIGDRPAAQVDLPDDAEVCACAGVSAGAIRACASLADARETTRATTGCGGCAAAVRQLLAARLSPGPSLGTTLEGTPR

SEQ ID NO: 2398 - protein, 838 aa, Unknown
  Nocardioides sp. JS614
MSPKHRRTLLVAGHGMVGHRFVQAAIERGLTETHDIVVVGEERRPAYDRVALTSFFEVGADELSFLPSGEYDDPRVRLLLGTSVDGFDPATRTVVLSDGQEIAYDELVLATGAMPFVPPVPGHDLEGCFVYRTIEDLEAIRAAAATAEVGAVVGGGLLGLEAANALAQLGLVTHVVEMAPRLMAVQVDEAGGATLARHIERLGLTVHTGATTQRILGADRVEGLALAGEEPIPADLVVFSAGIRPRDQLARDAGLDVAERGGVLVDERCRTSDPHVWAIGECAAPGGRMYGLVAPGYAMAEVVVDALLGGSGAFTGADLSTKLKLLGVDVASFGDAFAATEGALELVYADAVTGVYKKLVLSADGRQLLGGILVGDASAYGVLRPMVASGIALPDNPEDLILPTGRGVLEIGLPDEAQVCSCNDVTKGDILAAAAAGTSTRAGATCGSCKAQTKRIIEDYYASQGKVVDRSLCEHFALTRQELFDVVAVHGYTRFDDIVAGHGRGRGCDICKPAIASILASQLNGHVLDGPNRTLQDTNDAYLANIQRNGTYSVVPRIPGGEITPEKLIVIGEVAQEFGLYTKITGGQRIDLFGARMEQLPAIWRRLVDSGFESGHAYGKSLRTVKSCVGSTWCRYGVQDSVQLAIDLELRYRGLRSPHKLKGGVSGCARECAEARAKDFGVIATEKGWNLYVGGNGGATPAHARLLAGDLDRETLVRYLDRFLMYYVRTADRLQRTASWIDSIDGGLDRVREIVVDDALGLGSELEAAMARHVAGYFDEWRATLDDPAKLARFVSFVNAPGTPDPHITFRSERDQAVPEESSGPVDLGATIPVGAPR

SEQ ID NO: 2399 - protein, 309 aa, Listeria monocytogenes
MGKALLIVNPSSGKEKGKTYQGKTEEVLKKRYDEVEVRLTEKAGDATEFASWAAEQGFEAVIAMGGDGTLNETINGLAIHEKRPDFGFIPLGTVNDLARSVGIPLKPEKAIQALEKAIAVPMDVGRIGDQYFMNVLAIGMIAQAVDQVSVEQKTKFGSVAYFLEGLKAFNRNELLHFKIEYDEEVWEGEAALVVAGLTKSVGGMESWAPDAKIDDGYLHIIILTKLGLLDAANMIPQLIRGNLKNSDGVVYIKTKKLTIDASGDDLSINVDGDPGPGVPAEIEVLGSHLNILAPKKSSKKRFGPFILKK

SEQ ID NO: 2400 - protein, 773 aa, Ceratopteris richardii
WFQNRRCREKQRKETGRLQHWNSKLNAMNQMLLEENERLQKQAAQLLVENQYLRQQLQLQHPQVDLNQRAVLHTADTSSESVVTSGQHQHSPSHASQEWSVSQWSALAEKILTEFLAKASGGMAGGIPLPGMKPGPDSIEAMVRPSCGGHIAAQACSYVDLGVYKVAEIIKNRHMWSYDCKKQEIMTSFHADHGGFIELVHTQMYAPSKLVAAWDFRTLRYTCLLENGNLVVCEGSLAAGQGAHEIAPLPGFVRAEMLPSGFLIRPCEQGGSIVMVVDDINSMPSTAANSLRPLYDTSTLLAWRLTCKVLNHLRAHPKDKGEAGMLSNPISSVQGFSHRLVRGFNDAVNSSPDDGWVPLSSELSYSNVTIHIKPSHHSIEFGANDTEAATRGGIICAKAFLLLRNLSSAALMSFLRERWVAWMDLDADLSVRDSCKTTGNDNLLKRKFSSVKISESSSEQNEVLEVVRLQKPQPLKGENIPDFESFMLQFSSSMEDTSASAYAQLLFAPIDASVPDDSSLLPSGFRAMHLNVCPERLVSLQTLDLASSLEDQPRLQSQSPHETGCALTIVFQYAYKAENRSVVTIKAQQNLQTIVELLQQAAVSLKSHPAPLISGSQFSTGAVLLVQQMVDSYRNHLGQELLISADGSSEGLFKAFWNFQHAVVCCAWKPLPEFIFANHSALAMLECSLFALKEMSLERMFNDGCSKADNSQPPPFLQEEGFARLPRGVCLSSRGHPVSFERAIGWKVTTVDPTVQVAALMFCNWSFTSVQLQ

SEQ ID NO: 2401 - protein, 803 aa, Ceratopteris richardii
WFQNRRCREKQRKETSRLQTVNSKLTAMNKLLMEENDRLQKQVAQLMYENGYFRQQLQHGGVTTDTSCDSVVTSGLQHLPAPQQQQSPLQDGSYAGVISLAEEALSDFLSKATGTSVNWIQMPGMKPGPDFMSMVNIMPHGATGIGARACGLINLEPSKIVEVFKDKPTWLRECRRMTTMFSTSTTGGGTIEVLYSQMYAPTTLAPAKDFCTLRYTTVSDDGSYVVCERSLNGAQTVPTAPQISAFVRADMFTGGCLIRPCETSGSIVVVVDHMDLESWSIPEVLRPLYESSTILAHKVTIAALKHLRHIAQENALDSPGAGQQPAAVRSLSYRIAKAFNDAVNGFPDDGWVPLTGDGVDDVTVMMKGPVNAGPVDHLSLHQSSSINSSVLCAKASMLLQHVPPALLVQFMREHRSEWADPVCEEAMRMSNPGFSGFHAATSNSQLLQPQVHSIEEDEFLELIKMEGQNSVSIQDQSLMNSQDMFLLQLCSGLEDKSSGACAQMVFAPIDASVSDDIALIPSGFRVIPLDIEPHDQVNAASSGRTLDLASFLEVSNTTSSGGQDELHSRGRGAGGSLRSVLTIAFQFSCIEARMHDSVACIARQYVRSVVSTIQRVAVAFISNPLSLLKFPQPLRAYDSKNPITIQVQSSLARCICQSYKLYMGADLVQVEDGSSEAYLQALNKMEDALLCCSCKPVPVFTFANRAGMDMLEMPSLPGLALHDMPLERTLDEDGNRDICSLLSQVMQKGYACLSGAGVRMSSRGRLARFERAIAWKVAETPSEEEEEIMVKGVAFLYIKWSLV

SEQ ID NO: 2402 - protein, 534 aa, Triticum aestivum
ATGSGGMNLVFVGAEMAPWSKTGGLGDVLGGLPPAMAANGHRVMVISPRYDQYKDAWDTSVVSEIKVVDKYERVRYFHCYKRGVDRVFVDHPCFLEKVRGKTKEKIYGPDAGTDYEDNQQRFSLLCQAALEVPRILNLDNNPYFSGPYGEDVVFVCNDWHTGLLACYLKSNYQSNGIYRAAKVAFCIHNISYQGRFSFDDFAQLNLPDRFKSSFDFIDGYDKPVEGRKINWMKAGILQADKVLTVSPYYAEELISGETRGCELDNIMRLTGITGIVNGMDVSEWDPTKDKFLAVNYDITTALEGKALNKEALQAEVGLPVDRKVPLVAFIGRLEEQKGPDVMIAAIPEILKEEDVQIVLLGTGKKKFERLLKSIEEKFPSKVRAVVRFNAPLAHQMMAGADVLAVTSRFEPCGLIQLQGMRYGTPCACASTGGLVDTIVEGKTGFHMGRLSVDCNVVEPADVKKVVTTLKRAVKVVGTPAYHEMVKNCMIQDLSWKGPAKNWEDVLLELGVEGSEPGVIGEEIAPLAMENVAAP

SEQ ID NO: 2403 - protein, 571 aa, Cucurbita maxima
MGNTCRGSFKGNIFQGYSQPEDSSTLYSKRNNSSSSARSNSDISPTSINTHNLIAQEFSKENKTKSKDNDYNQAFLSPTKKDFTMRKSAENQAYYVLGHKTANIRDLYTLGRKLGQGQFGTTYLCTEITTGIEYACKSISKRKLIAKEDVEDVRREIQIMHHLAGHKNIVTIKGAYEDSLYVHIVMELCSGGELFDRIIHRGHYSERKAAELTRIIVGVVETCHSLGVMHRDLKPENFLLVNKDDDFSLKAIDFGLSVFFKPGQIFTDVVGRPYYVAPEVLLKHYGPAADVWTAGVILYILLSGVPPFWAETQQGIFDAVLKGHIDFDSDPWPLISDSAKDIIRKMLCSRPSDRLTAHEVLCHPWICENGVAPDRALDPAVLSRLKQFSAMNKLKKMALRVIAESLSEEEIAGLREMFTAMDTDNSGAITFDELKAGLRRYGSTLKDIEIRDLMDAADIDNSGTIDYGEFIAATIHLNKLEREEHLVAAFRYFDKDGSGYITVDELQQACAEHNMTDAYLEDVIREVDQDNDGRIDYGEFVAMMQKGNAGVGRRTMRNSLNLSMRDGPGAL

SEQ ID NO: 2404 - protein, 417 aa, Xanthomonas oryzae
MFSRDVRLETYDPELAKAIAAEAGRQEDHVELIASENYCSQLVMEAQGSQLTNKYAEGYPGKRYYGGCAFVDIAEQLAIDRIKQVFDADYANVQPHSGSQANQAVYLALLQPGDTILGMSLAHGGHLTHGAKANVSGKLFNAVQYGVNEQGLIDYDEVQRLATEHTPKMVVAGFSAYSQKIDWARFRAIADSVGAYLFVDMAHIAGLVAAGVYPSPMEHAHVVTSTTHKTLRGPRGGIIVAKGASEELQKKLQSIVFPGIQGGPLMHVIAAKAVAFKEALEPAFKTYQQQVVKNAQAMANTLIARGYKIVSGGTENHLMLVDMIGRDVSGKDAEAALGKAHITVNKNAVPNDPRSPFVTSGLRLGTPAITTRGYKEPDSIDLANWIADVLDAPTDEAVLAKVRDAVTAQCKRYPVYG

SEQ ID NO: 2405 - protein, 207 aa, Beta vulgaris
MDELYGLHPTSGDYSDKALMSPDNLILPSDYHSLIMNSGNTAAVRFGSDELISATCISESASITPDMPPDDNTSTSIKAKIASHPHYPRLLQAYIDCHKVGAPPEIANILEEIKQENDMYRRDFGSLRTCLGTDPELDEFMETYCEILDKYKSDLSRPFDEATNFLNKIETQLRNLCKGAFVKTASAALLVHTNSFNHASQHYDFTP

SEQ ID NO: 2406 - protein, 499 aa, Cryptococcus neoformans
MPRPILAALRTTIRPAFSKQFRMASSIPVPTDFNACLYKPLAEADPEINSLIEKETWRQFSGLELIASENLTSLAVMEANGSMLTNKYSEGLPGARYYGGNEFIDVVENLTRERALKAFNLDPKIWGVNVQPYSGSTANFAAFTALINPQDRVMGLGLPDGGHLTHGYYTAKKKITASSIYFQSFPYRVDPKTGIIDYPQLETNANLYKPRLVVCGGSAYPRDWDYGRLRKIADSQGAYLLSDMAHISGLVAAAEQNSPFEYCDVVTTTTHKTLRGPRAGLIFFRKDKESDLEARVNAAVFPACQGGPHNNTIAGVAVALKQAADPAFKEYAKQVRANAAAMAAVLFKHGYRLQTDGTENHLILWDLRPIGLTGSKVEKICDAAHITLNKNAVAGDTSALVPGGVRIGTSALTSRSMKEQDVEKVAEFLHRVVQIALKTQEEAGSKLLKDFVKTYESGNGEAPKLIAELKEDVMKFATSFPLPGVPDTSKIVRPEGVNL

SEQ ID NO: 2407 - protein, 489 aa, Clostridium perfringens
MSQEQNTNLKRGLKSRHLSMIAMGGAIGTGIFLAMGDTLHQAGVGGAFVAYGIIGVMVYFLCTSLGEMATYMPETGSFGAYATKFVDPALGFALGWNYWYNWAITIAAEMVAGSLLMKFWFPNVPAIVWSALFLVIILTLNLLSAKAYGESEFWFAAVKVATVIIFLIVGVLMIFGILGGDNVGFKNFYENGGPFIGGAKSIFMIFLIAGFSFQGTELVGVAAGESEDPEKNVPKAVNTIFWRILLFYLGTILVIGALVPNAQAGVETSAFTIVFEKLGLAGAASIMNAIILTSVLSAGNSGMYASSRMLYAMAKSGMAPKIFEKTNSRGVPVNAIIITTIIASLCFLTGIYAENTVYVWLVAASGLSGFIAWLGIAICHYRFRKAYVAQGKDMNRLVYKAKLFPLGPIIALILCGIIVLGQGYAYLDVRNGVDWGGLISSYIGLPLFFGLFAYYKIKYKTKIIDLKDVDLSVEHIDTDESIEDEVFSY

SEQ ID NO: 2408 - protein, 558 aa, Cucurbita maxima
MGNTCRGSFKGNIFQGYSQPEESSTPNFKRNINGSSDHSPSSINTNNLISQAFAEENKTKSKDNDCKKDYTMRKSAENQAYYVLGHKTANIRDLYTLGRKLGQGQFGTTYLCTEIMTGIEYACKSISKRKLIAKEDVEDVRREIQIMHHLAGHKNIVTIKGAYEDSLYVHIVMELCSGGELFDRIIQRGHYSERKAAELTRIIVGVVETCHSLGVMHRDLKPENFLLVNKDDDFSLKAIDFGLSVFFKPGQIFTDVVGSPYYVAPEVLLKHYGPAADVWTAGVILYILLSGVPPFWAETQQGIFDAVLKGHIDFDSDPWPLISDSAKDLIRKMLCSRPSDRLTAHEVLCHPWICENGVAPDRALDPAVLSRLKQFSAMNKLKKMALRVIAESLSEEEIAGLREMFTAMDTDNSGAITFDELKAGLRRYGSTLKDTEIRDLMEAADIDNSGTIDYGEFIAATIHLNKLEREEHLVAAFRYFDKDGSGYITVDELQQACAEHNMTDAYLEDIIREVDQDNDGRIDYSEFVAMMQKGNAGIGRRTMRNSLNLSMRDGPGAL

SEQ ID NO: 2409 - protein, 581 aa, Hordeum vulgare
MCGILAVLGCGDESQGKRVHVLELSRRLKHRGPDWSGLHQVADNYLCHQRLAIIDPASGDQPLYNEDKSVAVAVNGEIYNHEELRERLSGHRFRTGSDCEVIAHLYEEHGESFIDMLDGVFSFVLLDARDHSFIAARDAIGVTSLYIGWGIDGSVWISSEMKGLNDDCEHFEIFPPGNLYSSKEKCFKRWYNPPWFSEVIPSVPYDPLRLRSAFEKAVIKRLMTDVPFGVLLSGGLDSSLVAAVAARHFAGTKAAKRWGTRLHSFCVGLEGSPDLKAAKEVADHLGTVHHEFNFTVQVRIDAIEDVIYHIETYDVTTIRASTLMFQMSRKIKALGVKMVISGEGADEIFGGYLYFHKAPNKEEFHQETCRKIKALHQYDCLRANKATSAWGLEVRVPFLDKEFIDEAMSIDPEWKMIRPDLGRIEKWILRKAFDDEEKPFLPKHILYRQKEQFSDGVGYSWIDGLKDHAASNVSDKMMSNAKFIYPHNTPTTKEAYYYRMIFERYFPQSSAILTVPGGPSVACSTAKAIEWDAQWSGNLDPSGRAALGVHLSAYEQDTIAVGGSNKPGPMETVVNGVAIES

SEQ ID NO: 2410 - protein, 911 aa, Brassica napus
MATSVDNRHYPRLSSALNGGVVHSFKPPLVPSPSLDRDQDQSVNVPTEKSVDKTTKEDRFDSSDDEDESHNRYVSYYKEMVLKSNSDLEPTALDSRDESTGDKWIHRNSSMVRLTGKHPFNAEAPLPRLMHHGFITPVPLHYVRNHGGVPKAEWSDWSVEVTGLVKRPAGLTMEQLISEFPSREFPVTLVCAGNRRKEQNMVKQTIGFNWGSAGVSTSLWRGVALSDVLRRCGVYSKRGGALNVCFEGAEDLPGGGGSKYGTSIKKEMAMDPARDIILAYMQNGELLTPDHGFPVRVIIPGFIGGRMVKWLKRIIVTPQESDNYYHYKDNRVLPSYVDAELPNEESWWYRPEYIINELNINSVITTPGHEEILPINAFTTQKPYTLKGYAYSGGGKKVTRVEVTLDGGETWSVCELDHQEKPNKYGKFWCWCFWSLDVEVLDLLSAKEVAVRAWDESLNTQPEKLIWNLMGMMNNCWFRIKTNVCKPHRGEIGIVFEHPTRPGNQSGGWMAKERQIEKSSESHPTLKKSVSTPFMNTASKMYSMSEVRKHNSAESAWIIVHGHIYDCTRFLKDHPGGSDSILINAGTDCTEEFEAIHSDKAKKLLEDYRIGELITTGYDSSPNVSVHGGSSVMSLLAPIRQLAPTKNIALVNPREKVPVKLIEKTSISHDVRRFRFALPSEDQQLGLPVGKHIFLCATINDKLCLRAYTPTSTVDAVGYIDLVIKVYFKNVHPRFPNGGLMSQHPDSLPIGAVLDIKGPLGHIEYQGRGKFMVSGKPKFANKLAMLAGGTGITPIYQVIQSILSDPEDETEMFVVYANRTEDDILVREELEGWASKFPDRLKIWYVVEIAKEGWEYSTGFITEAVLREHVPEGLEGESLALACGPPPMIQFALQPNLEKMGYDIKEDLLIF

SEQ ID NO: 2411 - protein, 313 aa, Oryza sativa
MSSSSSSSASSAAAAAFRPAVVQREQQVVEEKFPAAAAAMREMVLPPVAAAAADSEQEQLCYVHCHYCDTVLVVSVPSSSLFETVTVRCGHCSSLLTVNMRGLLLPTTAAAAPPPPPPPPPPPPPPAAHFPHSLNLAPANPPHHHSLLDEISTANSPTQLLLEQHGLGGLMASAASCRNNNSPAAAAAPPPPTSQGKAAAKEPSPRTNTAVINRPPEKRQRVPSAYNRFIKDEIQRIKAGNPDISHREAFSAAAKNWAHFPHIHFGLMPDHQGLKKTSLLPQDHQRKDGLLKEGLYAAAAAAAAAANMGVAPY

SEQ ID NO: 2412 - protein, 112 aa, Geobacter sulfurreducens
MKKVEAIIKPFKLDEVKEALNEIGIQGITVGEVKGFGRQKGHTELYRGAEYVVDFIPKIKMEIIVADDIVSKVVDTIEQAAKTGRIGDGKIFVTPVEEVIRIRTGERGEDAL

SEQ ID NO: 2413 - protein, 558 aa, Pseudoalteromonas tunicata
MCSIFGVLDIKSDPIQLRSQAIEMSKLLRHRGPDWSGVYSSEKAILVHERLAIVGVTSGAQPLYNPEQTNILAVNGEIYNHKELAKNLKVDFEFQTESDCEVILALYKEKGPEFLDDLNGIFAFCLYDEEQDAYLIGRDHIGIIPLYTGTDEHGNFYVASELKALSPICNHIKEFPPGHYLWSQDGELRPYYQRDWTSFDAVKDNSATAQDVKVALEAAVKRQLMCDVPYGVLLSGGLDSSVISAITQRFAAKRIEDNDNSNAWWPQLHSFSVGLAGSPDLAAAQKVADMIGTVHHPIIFTVQQGIDALKEVIYHLETYDVTTIRASTPMYLMARQIKAMGIKMVLSGEGADELFGGYLYFHKAPDEKEFHEELNRKVSKLHLFDCLRANKSMAAWGVEARVPFLDKEFVDVAMRVNPIAKMCGKNGKIEKHILRQAFEGYLPHEVLWRQKEQFSDGVGYSWIDSLKEYVAEQVTDQMLASAAFKFPINTPDSKEAYFYRCIFAEHFPGDAAALCVPFGKSVACSTPQALAWDASFANNADPSGRAAGVHNDAYNKTK

SEQ ID NO: 2414 - protein, 195 aa, Thermotoga maritima
MTVERLENGVIVQRNTNEIEISITLDTVHGKLEGSTGVNFFDHLLNTFCHYSGLGLRVSTCESKDGILHHLIEDFGISLGLAFRELFDYTKVRRFGEATVPMNEALVGCYVDLSGRPFFQKNFEFSVEKIEDMPVEGFEEFMCGFVNHARITVHFFKFFGKNDHHISESAMKSFGLAIAKALESSEKKTTKGVID

SEQ ID NO: 2415 - protein, 181 aa, Arabidopsis thaliana
MASSMLSSTAVVTSPAQATMVAPFTGLKSSASFPVTRKANNDITSITSNGGRVSCMKVWPPIGKKKFETLSYLPDLSDVELAKEVDYLLRNKWIPCVEFELEHGFVYREHGNTPGYYDGRYWTMWKLPLFGCTDSAQVLKEVEECKKEYPGAFIRIIGFDNTRQVQCISFIAYKPPSFTEA

SEQ ID NO: 2416 - protein, 181 aa, Arabidopsis thaliana
MASSMLSSAAVVTSPAQATMVAPFTGLKSSAAFPVTRKTNKDITSITSNGGRVSCMKVWPPIGKKKFETLSYLPDLSDVELAKEVDYLLRNKWIPCVEFELEHGFVYREHGNTPGYYDGRYWTMWKLPLFGCTDSAQVLKEVEECKKEYPGAFIRIIGFDNTRQVQCISFIAYKPPSFTEA

SEQ ID NO: 2417 - protein, 391 aa, Saccharomyces cerevisiae
MSAAADRLNLTSGHLDAGRKRSSSSVSLKAAEKPFKVTVIGSGNWGTTIAKVVAENCKGYPEVFAPIVQMWVFEEEINGEKLTEIINTRHQNVKYLPGITLPDNLVANPDLIDSVKDVDIIVFNIPHQFLPRICSQLKGHVDAHVRAISCLKGFEVGAKGVQLPSSYITEELGIQCGALSGASIATEVAQEHWSETTVAYHIPKDFRGEGKDVDHKVLKALFHRSYFHVSVIEDVAGISICGALKNVVALGCGFVVGLGWGNNASAAIQRVGLGEIIRFGQMFFPESREETYYQESAGVADLITTCAGGRNVKVARLMATSGKDAWECEKELLNGQSAQGLITCKEVHEWLETCGSVEDFPLFEAVYQIVYNNYPMKNLPDMIEELDLHED

SEQ ID NO: 2418 - protein, 221 aa, Zea mays
  misc_feature (198)..(198): Xaa can be any naturally occurring amino acid
MGTPETSREPCPDRILDDVGGAFGMGAVGGSAFHFIKGIYNSPNGMRMSGGAQAVRMNAPRVGGSFAVWGGLFSTFDCAMVYARQKEDPWNSIIAGAATGGFLSMRQGMGAAGRSALMGGVLLALIEGAGLMLNRVLANPPLPAEDPNLTAAMGDNPFPGLPQAPPVVAPPEVASSSGAGGWFGGLIGRKDEEKKSSXPGKSEILESFDTPSSPIPSFEYK

SEQ ID NO: 2419 - protein, 917 aa, Arabidopsis thaliana
MATSVDNRHYPTMNGVRHAFKPPLVPSPRSFDRHRHQNQTLDVILTETKIVKETEVITTVVDSYDDSSSDDEDESHNRNVPYYKELVKKSNSDLEPSILDPRDESTADSWIQRNSSMLRLTGKHPFNAEAPLPRLMHHGFITPVPLHYVRNHGAVPKANWSDWSIEITGLVKRPAKFTMEELISEFPSREFPVTLVCAGNRRKEQNMVKQTIGFNWGSAGVSTSLWKGIPLSEILRRCGIYSRRGGALNVCFEGAEDLPGGGGSKYGTSIKKEMAMDPARDIILAYMQNGELLTPDHGFPVRVIVPGFIGGRMVKWLKRIIVTPQESDSYYHYKDNRVLPSLVDAELANSEAWWYKPEYIINELNINSVITTPGHAEILPINAFTTQKPYTLKGYAYSGGGKKVTRVEVTLDGGDTWSVCELDHQEKPNKYGKFWCWCFWSLDVEVLDLLSAKDVAVRAWDESFNTQPDKLIWNLMGMMNNCWFRIRTNVCKPHRGEIGIVFEHPTRPGNQSGGWMAKERQLEISSESNNTLKKSVSSPFMNTASKMYSISEVRKHNTADSAWIIVHGHIYDCTRFLKDHPGGTDSILINAGTDCTEEFEAIHSDKAKKLLEDYRIGELITTGYDSSPNVSVHGASNFGPLLAPIKELTPQKNIALVNPREKIPVRLIEKTSISHDVRKFRFALPSEDQQLGLPVGKHVFVCANINDKLCLRAYTPTSAIDAVGHIDLVVKVYFKDVHPRFPNGGLMSQHLDSLPIGSMIDIKGPLGHIEYKGKGNFLVSGKPKFAKKLAMLAGGTGITPIYQIIQSILSDPEDETEMYVVYANRTEDDILVREELEGWASKHKERLKIWYVVEIAKEGWSYSTGFITEAVLREHIPEGLEGESLALACGPPPMIQFALQPNLEKMGYNVKEDLLIF

SEQ ID NO: 2420 - protein, 1017 aa, Geobacter sulfurreducens
MPILITALIYLIFFLSGATALVYEVVWVRKLSLVFGGSHLAVTTVLAVVMGGLALGSWLFGRRVRTTRNLLRLYGALEIGIAFFALLFIALLNLYSLMPAYSFESLTEHSHQLPRVALLTLRIVLAAIALIVPTTLLGGTLPVLAAFMVRGRRAVGRGVAYLYALNTFGAVAGCFGAGFYLLGRFGVSNTMAGAITVNVLLGIACFALQGPAARYLEAGEDEAPAPLSAVTLPEEKARIGLVVWGIGVSGFCALGYEVLWTRVLGIVIGTNVYGFTLMLAAFLTGIAAGSGAYGLWARRLRPPEEGGCPVSKLIGGFGVVQIVIGLSALLVTILIRDLPTRVFFLQDLFLSQSTDLFRARQFANFALVFSYLFIPAFFMGVAFPLAGTLDACRRRKVGHAVGEVLTCNTIGAILGTVVSGFVLIQVFGIERSLYLLATVNAGFGLLILARLLRGTPRRLATAGTVLAVVGVMAVAGTMPRIWDAKYFAIYRTNQPEVFRTPDLIAEAKRHTDVLYYAEGIQSIVSSIRIRGGYQAFLRNGRIEASDHNESLQNQYALGHLPMLLHRNPRKVLVIGAGSGITLGAVSLHPSVSEMTLAEVEPKVLGVTRSFAAYNHGVLGDRRLRVAFSDGRNYLATTGERYDVITADPIHPWLSGAGYNYTREYFELAAEHLRAGGIMCQWLPLYDLSADDLRSVVRTFRQAYRHVLVWMTQGDAMLIGSNAPILLSEDELAARIAVPAVAADLARVQMGSATDLLSYFVMGTAGADRFSRTGRINTDDNLYLEFSVPRSTGKSALPEVNVNALARHRESVLAYLDDSVPPADRLARENRWMRLDRAAALALEARAIFLGGRYDSPRFGLLVSELEGNYAAFAPWRFLRSEYLEEMASSPLPLDQLALALLDESGRRVVVNVAAVMSRVSRELTVVDFVDSDERVIIGQADINGRGRDGSAKRLAAEVMEAVRLAYNEELSGAEARGKPLPDQAEFVRRMREIIATMTGRQHGNPYPAQGRPIKESA

SEQ ID NO: 2421 - protein, 259 aa, Bordetella pertussis
MISLPYLQRFALSGQVALVTGSARGLGLRIAQALAGSGAHVLINGRDAHAVEAAVSDLRQQGLRASAQPFDVSDEQAMEQAFARIDAEHGRLDILVNNVGARNRKPLAETSPAEIRAMMDTNLIAGILLARLAAQRMMRQRYGRLIAITSVAGELARANDAVYPAAKQGLTGMMRALAVEFGGHGITSNAIAPGAFATETNAAIANDPQAGAAMAARNPTGRWGDPEEIAGAAVFLASPAASYVNGHVLVVDGGLSVQF

SEQ ID NO: 2422 - protein, 382 aa, Glycine max
VVVPLICLCIYSRRSKARKSSLVKQHEDDDEIEIAQSLQFNFDTIRVATEDFSDSNKLGQGGFGAVYRGRLSDGQMIAVKRLSRESSQGDTEFKNEVLLVAKLQHRNLVRLLGFCLEGKERLLIYEYVPNKSLDYFISDPTKKAQLNWEMRYKIITGVARGLLYLHEDSHLRIIHRDLKASNILLNEEMNPKIADFGMARLVLMDQTQANTNRIVGTYGYMAPEYAMHGQFSMKSDVFSFGVLVLEIISGHKNSGIRHGENVEDLLSFAWRNWREGTAVKIVDPSLNNNSRNEMLRCIHIGLLCVQENLADRPTMTTIMLMLNSYSLSLPIPSKPAFYVSSRTGSISATQSWGYSSGESRSRELTIKSAQEAENEFTDPYPR

SEQ ID NO: 2423 - protein, 154 aa, Yersinia pestis
MELTTRTIAARKHIALVSHDHCKKSLLAWVMENRDLLAQHELYATGTTGNLVQKATGIDVHCLLSGPMGGDQEVGALISEKKIDILIFFWDPLNAVPHDPDVKALLRLATVWNIPVATNRSTADFLIGSTLFSSEVTIAIPDYDRYMQQRLDLK

SEQ ID NO: 2424 - protein, 169 aa, Triticum aestivum
MGTAVATAYTMARENEEDGSTVFRPGTAASSPVRTVVALALWLGAIHFNLLLVLASVFVFPGRIAALVLGTQLLFMFAPVSNTNGWGRNIARFICKHAADYFPITLHVVDYNAFDPNTAYVFGYEPHCAMPLGLWVLAAPMGFMPLPKMKILASSAAFYTPFQRQIWTW

SEQ ID NO: 2425 - protein, 414 aa, Carboxydothermus hydrogenoformans
MKKFYYLISGGLLLLILALVIVSPVVTTEAAVKKAPPKPTLSQIIAEVSKTFFKNSEMKKEPSKYGGSIPYSHLEESPYLKTLWEGYPFSKDYNEDRGHYYTLEDVKSTKRLSPATPMTCMTCKSSDVPAAMKKYGDAYYTLPMLVYQDEFKHSIGCSDCHDLKTFKLVVTRPAFIEAMKRRGIDVTKASQSQMRTYVCGQCHVEYFFDPQNGKKLTFPWDKGFDPENIYQYYEERAFSDWTNPSTFVKELKAQHPEFEMFQGSTHQQAGATCADCHMPKKTVKSGNLTFTIASHQWTSPLKDMSACKKCHTKDAKYLMERVFYIQDRVKAAIDRAGEANAETLKVIKSVAAGTYDPAILAEAQKLQRESQWYWDYVAAENSTGFHNPAKAFATLNKSIELAYQARLKALEAKK

SEQ ID NO: 2426 - protein, 313 aa, Spiroplasma citri
MKNNTNEIYDILIIGAGPGGMTAAIYAARAMANIAMIEKGAPGGKVTKTSEIENYPGFDSIQGYELAMKMFDQTQKLKITYIADRVTTITKQDNLFKLELFSKKFLLAKAVIVATGTVERKLGVPGELELEGHGVSYCAVCDGALYKGKDVVVVGGGYAALEEALYLARFVNKVYLIHRRAEFRADHNIVNKVKAHPKINFIIDTIVTEIKDVTEKRVTTVVIKNVKTSKIDNLAVSAIFPYIGAIPISDFAKNLGVLDKEGYFIVNNKCLTALPGLYAAGDVTNTTLRQIATAISDGAKAAQFVLEYLDSCH

SEQ ID NO: 2427 - protein, 138 aa, Zea mays
  misc_feature (45)..(45): Xaa can be any naturally occurring amino acid
MQAAATAAGFSAVLPAKGRPAARSRVVARVPATRRSVRVAAVVAXEAAQIDYSSSVSVFPMEACDLLGGDACNGPMFPEAKPASAAAAASRSVVGVDRDYLSYDEPKTVFPGEACDDLGGEFCEAPYQDGVSKELAHA

SEQ ID NO: 2428 - protein, 375 aa, Xanthomonas campestris
MTPILFVDRDGTLITEPADFQIDAYEKLRFVDGVIPAMLKLRDAGYQFVIVSNQDGLGSESYPQASFDGPNNLMLQIFASQGIVFREVLIDCSWPADNAPTRKPGVGLMVPYLQDRTIDWSRSAMVGDRITDIQFAQNLNIRGFQLRTEQFGGDWDWAGIAHELADAPRRAVVQRNTKETRIRVELDLDRVAEPHTATGLPFFDHMLEQIGKHGGFALDIRAEGDLHIDEHHTIEDTGLALGQALREALGDKRGIGRYGFDPDDSPWRVAGDTTQHGFTLPMDETIASAALDFSGRPYFVFDGDFKRERVGDMPTELVPHFFRSVCDASGLNLHLHVRGENDHHKVEGCFKALARALRQAIRREGTALPSTKGAL

SEQ ID NO: 2429 - protein, 458 aa, Listeria monocytogenes
MEEQKEELQRGLKNRHIQLIAIGGAIGTGLFLGAGKSIHLAGPSIMLVYLIIGAILFFVMRALGELLIHNPTTGSFTEFAEQFIGPWAGFITGWTYWFCWIVTGIAEITAVGMYVKFWVPDLPQWIPALACVLILLLFNLATVKAFGEIEFWFAIIKVVVIIALIVIGFVLVFIGYKHGTSTASFSNLVDYGGFFPNGIAGFLLAFQMATFSFVGIELVGVTAGEADDPERTLPKAINNIPIRILIFYIGALLVLMSIYPWSNIDPNTSPFVSVFTMIGIPAAAGIINFVVLTAAMSSCNSGIFSTSRMLYTLSAEGKAPKKMHHLSSNGVPATALITSTACLLIGVFLNYFLPEQVFILVTSIATICFIWVWGVILVAHLRFRHKHPEISEKSKFKMPLSPLMNWVSLIFFGGLLVILGFAADTRIALFVTPVWFLILGIAYQILKASNRKTKIRHN

SEQ ID NO: 2430 - protein, 682 aa, Unknown
  Bradyrhizobium sp. BTAi1
MRSLFVRRNGESREHRPFQHRGRRAGLFRRALRGRCRQIGRRVPSDGRSALGREWRAQDSDRAGLAGLGPQTSVRQGRGQAARGLHRHHRPLGRQDRLHQGALPAATALFHRLSRRHEAEGRLADRLEVLPLRSQGLSPAQRRPADPMEAHFQIFLVLLAVLAGTALIARRANLAPAILMMLAGIALAFVPTMPAFALPPELVLLVVLPPLIYSSSVAMSWREFKRNLRPIVLLAVGCVLFTASAVAIATHYLLGLPWSIGFLLGAIVAPPDVVAPLAIARRLHLPRRVMVILEGEGLANDATALILYRFAVAAITTGTFSLPVAAGEFAAIVVGEIAFGIGVGWLMLRARHYARDPQVEITLSVLTPYLAFWIPEHVGGSGVIATVACGLYMSWNGPLWISSATRLQGVFFWDLMIYLIEGMLFLLTGFQMRLIYEKSKIFSLDEIVIATALVLAIVVIARFAWTFPATILPRLLSSSLRARDPLPPWQQTFIIGFTGVRGTVSLATALALPLTLSTGDAFPYRDQILFIAFGVIFFTLIGLGLTLPTVVQWLGVARTGRAEHAREHEQEIAARREALDSALRSLETMTNDRDLSDEVVRLLRARHEVRANQLPEGLKPDDNDASALGIELTRELITAERKFIHVMLRDGKITDETRRRIERDLDLEEASLANREYEHLPL

SEQ ID NO: 2431 - protein, 146 aa, Triticum aestivum
  misc_feature (140)..(140): Xaa can be any naturally occurring amino acid
MDPCAFVRLTVDQLLLKLPAVPRPSSGAAGVHPSTSPCFCTLHLQDHPSSLSRTAPLPLASACLPGGASGGDPVVLSLDAAAVQKLSGRPVELVVTVHAGQSKGSTSTGCGVGASRALGKVRVAVDVARAAAGETVVARXGWMDVG

SEQ ID NO: 2432 - protein, 210 aa, Triticum aestivum
MGTQRRGREEPLTMSVPEAGQSAGRDEQEMDDYEQHQTRVLMALMQGLCAARYRKADNTPCLVDQGLYLGSVGAALNNEALKSLNITHILVVARSLNPAFPAEFTYKKIEVLDSPDTDLGKHFGECFTFIDEGICTGGNVLVHCFAGRSRSVTVVLAYLMKKHQMSLQSAMSLVRSKRPQIAPNAGFISQLVNFEKSLQVEQGQRTLQSN

SEQ ID NO: 2433 - protein, 704 aa, Xanthomonas oryzae
MAKITKTFQYGKHTVTLETGEIARQAGGAVIVKFDDTVLLVTAVAAKSAREGQDFFPLTVDYQEKFYAGGRIPGGFFKREGRATEKETLISRLIDRPIRPLFPEDYKNEVQIIATVMSMNPDIDGDIAALIGASAALSLAGTPFNGPIAAAKVGYKNGEYILNPTVTDLKDSQLELVVAGTANAVLMVESEAELLSEEVMLGAVTFGHREMQKVINIINELAVEAGTKPSDWVAPAKNDGMIAALKEAVGDQLASAFQVRDKLQRRDAISAIKKDVLGALAPRATIEGWAAGDLAKEFGELEYQTMRGSVLSTKVRIDGRALDTVRPISAKAGVLPRTHGSALFTRGETQAIVITTLGTARDGQVIDAVSGEYKENFLFHYNFPPYSVGECGRFGAPKRREIGHGRLAKRGVLAVMPSLEEFPYTIRVVSEITESNGSSSMASVCGSSLALMDAGVPIKAPVAGIAMGLVKEGNDFVVLSDILGDEDHLGDMDFKVAGTAEGVSALQMDIKIEGITEEIMKQALQQAKAGRLHILGEMAHALTTPRQELSDYAPRLLTIKIHPDKIREVIGKGGSTIQAITKETGTQIDIQDDGTIIIASVNAIAAQAAKSRIEQITSDVEPGRIYEGKVAKIMDFGAFVTILPGKDGLVHVSQISSERVEKVGDKLKEGDLVRVKVLEVDKQGRIRLSIKAVEEGEGVPASAE

SEQ ID NO: 2434 - protein, 414 aa, Bacillus anthracis [sequence omitted]

SEQ ID NO: 2435 - protein, 280 aa, Pseudomonas denitrificans
MIDDLFAGLPALEKGSVWLVGAGPGDPGLLTLHAANALRQADVIVHDALVNEDCLKLARPGAVLEFAGKRGGKPSPKQRDISLRLVELARAGNRVLRLKGGDPFVFGRGGEEALTLVEHQVPFRIVPGITAGIGGLAYAGIPVTHREVNHAVTFLTGHDSSGLVPDRINWQGIASGSPVIVMYMAMKHIGAITANLIAGGRSPDEPVAFVCNAATPQQAVLETTLARAEADVAAAGLEPPAIVVVGEVVRLRAALDWIGALDGRKLAADPFANRILRNPA

SEQ ID NO: 2436 - protein, 555 aa, Pseudoalteromonas tunicata
MSENFAQLFEESLKGFEAQQGSIVQGTVISIENNIVLVDAGLKSESAIPAEQFKNAAGELEVAVGDVVDVALDSMEDGFGETILSREKAKRHEAWIRLEKACEEQVTVIGVINGKVKGGFTVEVDTIRAFLPGSLVDVRPVRDTTHLEGKELEFKVIKLDQKRNNVVVSRRAVIESENSQERDELLANLIEGQEVKGIVKNLTDYGAFVDLGGVDGLLHITDMAWKRVKHPSEIVNVGDEIAVKVLKFDKDKTRVSLGLKQLGEDPWAAIAGRYPEGSKLTGRITNLTDYGCFVEIEEGVEGLVHVSEMDWTNKNIHPSKVVSLGDTVEVMVLEIDEERRRISLGLKQCIANPWQEFARLQNKGDQVTGKIKSITDFGIFIGLDGGIDGLVHLSDISWNAPGEEAVREYKKGDEITAIVLQVDPERERISLGVKQIESDPFNNYLDANKKGAIVKGKVTEVDAKGATIEISEGVEGYIRVADIAQERVEDATTAVSVGDEVEAKYVGVDRKNRTLSLSVKALFEAEEKEVLEKLKKEEPEFENAMAAAFKNAQKD

SEQ ID NO: 2437 - protein, 1035 aa, Solanum tuberosum
MERARKLANRAILKRLVSQSKQSRSNEIPSSSLYRPSRYVSSLSPYTFQARNNAKSFNTQQARSISVEALKPSDTFPRRHNSATPEEQTKMAEFCGFQSLDALIDATVPQSIRSESMKLPKFDSGLTESQMIEHMQNLASKNKVFKSYIGMGYYNTYVPPVILRNLLENPAWYTQYTPYQAEISQGRLESLLNYQTMITDLTGLPMSNASLLDEGTAAAEAMAMCNNILKGKKKTFLIASNCHPQTIDICKTRADGFDLKVVTVDLKDIDYKSGDVCGVLVQYPGTEGEILDYGEFIKNAHAHGVKVVMASDLLALTMLKPPGELGADIVVGSAQRFGVPMGYGGPHAAFLATSQEYKRMMPGRIIGLSVDSTGKPALRMAMQTREQHIRRDKATSNICTAQALLANMAAMYAVYHGPEGLKTIGQRVHGLAGTFSAGLKKLGTVEVQDLPFFDTVKVKCSDAKAIADVANKNDINLRIVDNNTITVSFDETTTLEDVDDLFKVFALGKPVPFTAQSIAQEVENLIPSGLTRETPFLTHQIFNSYHTEHELLRYLHKLQSKDLSLCHSMIPLGSCTMKLNATTEMMPVTWPSFANIHPFAPTEQAAGYQEMFDDLGALLCTITGFDSFSLQPNAGAAGEYAGLMVIRAYHMSRGDHHRNVCIIPVSAHGTNPASAAMCGMKIVAVGTDAKGNINIEELRKAAEANKDNLAALMVTYPSTHGVYEEGIDEICKIIHDNGGQVYMDGANMNAQVGLTSPGFIGADVCHLNLHKTFCIPHGGGGPGMGPIGVKKHLAPYLPSHPVVPTGGIPSPDKSEPLGAISAAPWGSALILPISYTYIAMMGSKGLTDASKIAILSANYMAKRLEKHYPVLFRGVNGTCAHEFIIDLRGFKNTAGIEPEDVAKRLIDYGFHGPTMSWPVPGTLMIEPTESESKAELDRFCDALISIREEIAQIEKGNVDINNNVLKGAPHPPSMLMADAWTKPYSREYAAYPAPWLRSAKFWPTTGRVDNVYGDRNLICTLLPVSEMAEEKAATA

SEQ ID NO: 2438 - protein, 1425 aa, Oryza sativa
MSRGLSGPRVWPVVGSLPGLVQHAENMHEWIAANLRRAGGTYQTCIFAVPGVARRGGLVTVTCDPRNLEHVLKSRFDNYPKGPFWHAVFRDLLGDGIFNSDGETWVAQRKTAALEFTTRTLRTAMSRWVSRSIHHRLLPILDDAAAGKAHVDLQDLLLRLTFDNICGLAFGKDPETLAKGLPENAFASAFDRATEATLNRFIFPEYLWRCKKWLGLGMETTLASSVAHVDQYLAAVIKARKLELAGNGKCDTVAMHDDLLSRFMRKGSYSDESLQHVALNFILAGRDTSSVALSWFFWLVSTHPAVERKVVHELCAVLAASRGAHDPALWLAAPFTFEELDSLVYLKAALSETLRLYPSVPEDSKHVVADDYLPDGTFVPAGSSVTYSIYSAGRMKTVWGEDCLEFRPERWLSADGSKFEPHDSYKFVAFNAGPRICLGKDLAYLQMKNIAGSVLLRHRLAVAQGHRVEQKMSLTLFMKNGLRMEMNPKGKRSSNCYFYLQLPETKDTCVISKFQCVISSVKSCPTCFIFNMPPWWGKSSSKEVKKTAKENLIDTFHRLLSPNEQKGRTKSRGNRRHSKDPTAEKGCWSTAQSRSASPSKEVSRCQSFAAARAHAQPLPLPRSRAMVARTASDITESKVVLEKRGKGQQLPLPTTNWVKERPETTEPVAELSTASISSHGSIDSDDPGDLRLQGPVANDTDNVAKVATTGNSSVVHKECSSAITRKGTKEVTMPTNAFLSNQILSTSPRGTVVADSYQSNLQNSRKVVLDSAPNSVMSSPSRSPRILCPDQIPSSAFWAVKPHTDVTFVGSAQCSSPGSGQTSGHNSVGGDMLAQLFWQPSRGSPECSPIPSPRMTSPGPSSRVHSGSVSPLHPRAGGMAPESPTRRLDEGKRKQTHRLPLPPLSICNNSTFLPNNSTPTSPISHSPGRVENPTSPGSRWKKGKLVGRGTFGHVYIGFNSDKGEMCAMKEVTLFSDDPKSKESAKQLCQEILLLNRLQHPNIVRYYGSEMVDDKLYIYLEYVSGGSIHKLLQEYGQFGEPAIRSYTKQILLGLAYLHAKNTVHRDIKGANILVDPNGRVKLADFGMAKHINGQQCAFSFKGSPYWMAPEVIKNSNGCNLAVDIWSLGCTVLEMATSKPPWSQYEGIAAVFKIGNSKELPPIPDHLSEEGRDFIRQCLQRNPSSRPTAVDLLQHSFIRNASPLEKSLSDPLLQLSTTSCKPDLKVVGHARNMSSLGLEGQSIYQRRAAKFSSVHSDIHVRSYISCPVSPCGSPHLRSRSPQHQNGIMSPSPISSPRTTSGASTPLTGGNGAIPFNHARHLAYNNEGFTITSRCLDEPLPNQPPDPVLGRFVRVKQPSLGFQERAVPEADILSPQFGRMGHVSVWNLHDKPLPSEHASQKGFEDRVKLKPPLDLRSGPPHLGCNHGH

SEQ ID NO: 2439 - protein, 548 aa, Herminiimonas arsenicoxydans
MHTVTIALILLLAVLASGFFARLLPIKVPLPLVQIAVGAGLAYGFGISVPLDPEFFFLFFIPPLLFLDGWRIPKSAFFRDVRPITTLAIGLVLFTVLGMGYFIHWMIPSVPLAAAFALAAILSPTDPVAVSAIASQSPIPPRLMHILEGEALLNDASGLVCFRFALAAVITGTFSLLDASMEFLWAAGGGLLVGALVAWLIGVANKWLVVAVGEDPGSQILISLLLPFAAYLLAEHLQVSGILAAAAAGITTHYTDMVGRRLATTRMQRRAVWDTIQMALNGVIFVILGAQIRTTMDGLPMVASSMGLSSAWWLSLYVIAIGVALTCLRFLWVWSTLRVTLFKKRRDQASDTKPSLRILMLTACSGVRGAITLAGILTLPLLMPDGSAFPARDLLIFLAKGVILLSLLSASVALPLLSKDMKFAPEPALGMDEGHARVAAAEAAIRHIKSLCDAAPENAEDNGQTEAAMRVTELYRRRLDYGLSEGEEAAHIQLLAEKERELRLSAIRAERDELFQMWLHNKLDDTLHQRLLRELDLIEGALTRNVQH

SEQ ID NO: 2440 - protein, 1042 aa, Bordetella pertussis
MKRMLFNATHQEELRVAIVDGQKLIDLDIETAGREQRKGNIYKGVITRIEPGLEACFVNYGEDRHGFLPFKEVARSFFKEGVDVRTARIQDALREGQELIVQVEKEERGNKGAALTTFISLAGRYLVLMPNNPRGGGVSRRVEGEDRQELRDTMEQLDVPQGMSIIARTAGIGRNVDELQWDLSYLLQLWTAIDGAARDNAAPILIYLESSLVIRAIRDYFSPEIGEILIDTDEIADQATAFMSVVIPDNVQRVKRYRDDIPLFSRFQIEHQIETAYSRTVQLPSGGAVVIDHTEALVAVDVNSARSTRGADIEETALRTNLEAAEEVARQLRLRDLGGLIVIDFIDMEDSKNQRAVEQRLRDALHFDRARVQMGKISRFGLMELSRQRLRPALNEGSHITCPRCNGTGVIRDAESSALHVLRLLQEEAMKENTAAVHAQVPVDVATFLLNEKRADITKMEARLKVNLVLIPNKHLETPHHHIERLRHDDPRLEETKTSFELAEAPATDLTWQPREHEIKARPEALVKGITPAQPAPVSTPAPAKAPAAAAAAQGGLGGWFKRLTSWLGGSAEPAKTETKSEDEKRGANRARRAHDGQNRRGERHGSDRNRHRRNEPRGEHAESGDARHHVRGGRRQEERGERGERGQKEARTEREQTQQQQAAGQPRQERPSTAETGEEGGRGRGRGRRGRGRGRREEGQTDTPMTEQENMVAALAETVATALPEKRQAAPAPAAAAAAALTVAEAASSNEQAPVTEDADGIDGIDANADAGAETGTDPERKRRRRRSRRGRRSQEDGSTVNAEGVEGADDEQADAPAGVADIETPAQPAEPETVAAPVAVSVAADEPAATIETAAAEPAAPQATEAPQAEPVVAAADTAPQAVQPVQAELTPVETPQAQAQPAEPAAAAPVETAPVETAPVETAPVETTPVEAPVKPAEQAAAPVEAEAPVAQPEKTPEPAAVRPAAAIVVPAQAAAPATGALHDVLDAAGLTWVETDPERHAQTQMRIAAAATPARLGRERKPVASVSNEPLVQVETRH

SEQ ID NO: 2441 - protein, 448 aa, Arabidopsis thaliana
MESDLGKLFIGGISWDTDEERLRDYFSNYGDVVEAVIMRDRATGRARGFGFIVFADPCVSERVIMDKHIIDGRTVEAKKAVPRDDQQVLKRHASPIHLMSPVHGGGGRTKKIFVGGLPSSITEEEFKNYFDQFGTIADVVVMYDHNTQRPRGFGFITFDSDDAVDRVLHKTFHELNGKLVEVKRAVPKEISPVSNIRSPLASGVNYGGGSNRMPANSYFNNFAPGPGFYNSLGPVGRRFSPVIGSGRNAVSAFGLVLNHDLSLNLNPSCDGTSSTFGYNRIPSNPYFNGASPNRYTSPIGHNRTESPYNSNNRDLWGNRTDTAGPGWNLNVSNGNNRGNWGLPSSSAVSNDNNGFGRNYGTSSGLSSSPFNGFEGSIGELYRGGSVYSDSTWQQQQLPSQSSHELDNLSRAYGYDIDNVGSDPSANDPETYNGSYNVGNRQTNRGIAA

SEQ ID NO: 2442 - protein, 361 aa, Saccharomyces cerevisiae
MTTAVRLLPSLGRTAHKRSLYLFSAAAAAAAAATFAYSQSQKRSSSSPGGGSNHGWNNWGKAAALASTTPLVHVASVEKGRSYEDFQKVYNAIALKLREDDEYDNYIGYGPVLVRLAWHTSGTWDKHDNTGGSYGGTYRFKKEFNDPSNAGLQNGFKFLEPIHKEFPWISSGDLFSLGGVTAVQEMQGPKIPWRCGRVDTPEDTTPDNGRLPDADKDADYVRTFFQRLNMNDREVVALMGAHALGKTHLKNSGYEGPWGAANNVFTNEFYLNLLNEDWKLEKNDANNEQWDSKSGYMMLPTDYSLIQDPKYLSIVKEYANDQDKFFKDFSKAFEKLLENGITFPKDAPSPFIFKTLEEQGL

SEQ ID NO: 2443 - protein, 444 aa, Oryza sativa
MKDLAVLGHLFVAAFMFHFASYMVIPAITDVTMDAVCPGRDECSVAIYLSGFQSAITGMGALVVTPIVGNLSDKYGRKALMTLPLYWPATAPRCTSTCTTSLRSSPASSARAACIASCSPTWPTKSAPGGERRRSGSSPGVSAAGFVSGTLTARFLQTSTTFQVAAAVAAATAIYLRAVVPDSGGANSFVDEACDPFLQGSSCSAATSSSSSSDEEISPRLPPHKGGVPSLSDMVSLLTGSLTLSGAAIVTFFYSLGEHGLQTALLYYLKAQFGYSKDEFANLLLIAGAAGMLSQLTVMPVLARFVGEDILLIIGLLGGCTHVFLYGIAWSYWVPYLSAVFIILSAFVHPSIRTNVSKSVGSNEQGIAQGCISGISSFASILAPLIFTPLTAWVLSETAPFKFKGFSIMCAGFCTLIAFIISMRMRAGQSGASEMLAIVQHEQA

SEQ ID NO: 2444 - protein, 545 aa, Xanthomonas oryzae
MHSIDVVLAMLLAVAASGYLIRILPFSLPLPLVQIALGAVVSGVFDAGHELEPELFFLLFLPPLLFLDGWRIPKQGLFRDKAAILELALGLVIFTVIGAGVFIHWLIPAMPLAVAFALAAIISPTDPVAVSSIASKVPIPKRLMHILEGESLLNDASGLVCFQFAVAAVLTGTFSVAAASLTFLWVALAGLALGVATTFGLSRIQAWIWRHFGEEPGSAILVNLLTPFAAYLLAEAFHASGILAAVAAGITMSYVEMAGNAPGNMRLQRSAVWDTVQFTFNGIIFVLLGEQLPGILDGAVRSVQEAGHLNPWWLAVYVATISASLMALRFVWVFLSLRWNIFKAQRRGEAHVSPPWRIVVAVSLAGVRGAITLAGVLTLPLMLEDGSPFPARQLAIFLAASVILVSLLVASVALPRLLRGLELPEEEDEQLKEDLAAKAASQAALDAVEKLRQRLVDGSKHAERYNAAANQVSQRYQRKLGSVDMAETDPEEAVAYEKALRQFRHAALVAERNELFKLARRREISDELSRRLVRNLDLIESRKRA

SEQ ID NO: 2445 - protein, 491 aa, Mannheimia succiniciproducens
MNSVELLVNVTPNETRIALVDTGILKEVHIERQAKRGIVGNIYKGRVTRVLPGMQSAFVDIGLEKAAFLHASDIVSHTECVDESEQKQFIVKDIAELVREGQDIVVQVVKDPLGTKGARLTTDITLPSRYLVFMPENSHVGVSQRIESEDERARLKALVEPYCDELGGFIIRTAAEGATEDELKQDADFLKRLWRKVMERKAKYPTRSMLYGELALALRVLRDFVGAGIEKIRIDSKLCFTEVNEFCEEFMPELVDKLVLYSGNQPLFDVYGVETAIQIALDKRVNLKSGGYLIIEQTEAMTTIDINTGAFVGHRNLEETIFNTNIEATQAIAQQLQLRNLGGIIIIDFIDMQTDEHRNRVIQSLEEALSKDRVKTNVNGFTQLGLVEMTRKRTRESLEHVLCGECPACQGRGHVKTVETVCYEIMREIIRVHHLFSSEQFVVYASRAVSEYLINEESHGLIAELEVFIGKQVQVKTEVYYNQDQFDVVVM

SEQ ID NO: 2446 - protein, 318 aa, Ehrlichia ruminantium
MTQIYKTQVLILGSGAAGCTAAIYAARANLQPILITGMCPGGQLTITTDVENFPGFAHAVQGPNLMEQMQQQAYNSGAKIISDEIKEIRTDMYPFECIGIFDDHYIANSIIIATGAQAKWLNIESEEAFKGKGVSACATCDGVFFSGSDVAVVGGGNTAVEEALYLTRHATKVFLIHRRDKLRAEPILQKRLFSNDKIQVIWNSSVKEILGNKENGTVEKVILESTNTGNTTTLPVKGVFIAIGHAPNTKILKKPDNTNIVSLDDEGYIITNPNSTVTSCPGIFAAGDVQDKIYRQAVVAAGSGCMAAIEAAKFLSDN

SEQ ID NO: 2447 - protein, 917 aa, Pseudomonas fluorescens
MLRKMGIKGRVLLLTLLPTSLMALLLGGYFTWMQLSELQTQLLQRGEMIAEQLAPLVAPPLSSKNTDLLERIATQSLEQPDVRTVSFLAPDRSSLAHAGPTMLNQPPIGNSSYLLQRTGNDATRYLLPVFGRHRNLAGELIPDESDRLLGWVEVELSHNGMLLRGYRSLFASLLLIAIGLICNAALALRISRTINLPISQIKLAVAQLKDGNLETRLPPLGSQELDQLASGINRMAETLQNAQEELQHSIDQATEDVRQNLETIEIQNIELDLARKEALEASRIKSEFLANMSHEIRTPLNGILGFTHLLQKSEMSPRQLDYLGTIEKSADNLLGIINEILDFSKIEAGKLVLDSVPFNLRDLLQDTLTILAPAAHAKQLELVSLVYRDTPLALVGDPLRLKQILTNLVSNAIKFTREGTIVARAMIEDEQEDSVQLRISVQDTGIGLSNQDVRALFQAFSQADNSLSRQPVGTGLGLVISKRLIEQMGGEIGVDSTPGEGSEFWISLNLPKTRDDVEDLPAAPLLGRRVAVLENHELARQALQHQLEDCGLEVTPFNSLENLTNGITSAHQTEQAIDLAVLGVTANDIPPERLNQHLWDLEHLGCKVLVLCPTTEQMLFNQSVPNPNSQLQAKPACTRQLRRALADLISPRPSRSEPGEPLSSRAPRVLCVDDNPANLLLVQTLLEDMGAKVLAVESGYAAIDAVKQETFDLVLMDVQMPGMDGRQSTEAIRQWESERHGTPLPVVALTAHAMANEKRALLQSGMDDYLTKPISERQLAQVVLKWTGLALRNQGPERAPDGLAPGVRLQVLDHEEGLRLAANKADLAADMLAMLLASLEADRQAITAAREANDNNALIERVHRLHGATRYCGVPQLRAACQRAETLLKQDDAKAMTALDELDMAIARLASEARVSA

SEQ ID NO: 2448 - protein, 296 aa, Listeria monocytogenes
MTTIKIALIQQKAVPNNKEANLKLAIQYIKEAHEKGADLVLFPEMWSNGYAPPFEDAFNHPLATGFGAERFKWLDEAIAADSAYVSTLKKLAKELQIGICATYLSKTEQNSQNTAIIIDRKGEIILDYAKVHTCDFSLEILLQSGEEFKVCEFDGIKLGVMICYDREFPESARILMLKGAEIILVPNACDMNPARLNQLNSRAFENMVGVAMANYPGEKWGRSTAFSPIIFDENGDYRDNTIIETDDFSEGIFIAEFNLDEIRTYRENETWGNAYRKPHTYTDLISLDVKAPFKRN

SEQ ID NO: 2449 - protein, 263 aa, Methanosarcina barkeri
MARDRRDYYYRQAKEEGYRSRASFKLKQINERHHIINRGDSVVDLGAAPGGWLQVAKELSGGKVLGVDLQRIVPIEGVETIQGNINADSTIQKIIKTVGAKGADVVLCDAAPNLSGNWSYDHARSIELATSALECAKKILKPKGNFVVKVFQGDMFNDYMQKVRDNFVRTMAYSPKASRSQSAEIYVIGKKFLTAPLRKGDKFVVDIEKLGSSGDGAVLIEGFVVFVKEVEVGEKVRIKITDVKPNFAFADVAERLGKTEKPE

SEQ ID NO: 2450 - protein, 86 aa, Thermosynechococcus elongatus
MRVLDLPLNAIRRPLVRQTDPAKVAALMASIAEIGQQEPIDVLEVEGHYYGFSGCHRYEACQRLGLPTIRARVRRAPRSVLNLHLA

SEQ ID NO: 2451 - protein, 465 aa, Prochlorococcus marinus
MTSSTDSNLTLIPSPGDKVEITCLDLDRHGNGLARWNNWVVIVNDLLPGESAQIEFVRRHRNQFLARKVQTIETVASRRPPPCKIAKECGGCSIQHLSDHGQTLLKQGHLRQILLRLGQLDHKIEPIMTDYNRALGYRNRALIPLYRNSEGQLHMGYYRRGSHQIIDLNRCPVLDRGIDQYLASIKDDLQQQNWPADSDLSSGEGLRHLGIRIGQKTKQVLITLVSSTTQLSGLHQQAKEWYSRWPEVRGITLNIQRQRNNLVLGQETILLAGDLEIEEHFYNLSLLLSTTTFFQVNTLQAERIVSKLIEWLSTASLDINIIDAYCGIGTISLPIAATGYHVIGLELHAEAITQANKNALRNSLDNVSFLCGDVSLLLAKKLQRNDVLVLDPPRKGLDQMVIKTILSIQPERVAYLSCDPATLARDLKQLIVPNGPYQIDELQPIDFFPQTMHIECLALLTRISS

SEQ ID NO: 2452 - protein, 131 aa, Brassica napus
MASFTSSVTCPTLLLKPSVTASSTETVYGLPSMIRRSSGVKCSMETNQPKKEKNSTPVFSAVGVMLTAVMSSSPAMALVDERMSTEGTGLPFGLSNNLLGWILLGVFGLIWAIYFNYVSSLDEDDDSGLSL

SEQ ID NO: 2453 - protein, 474 aa, Bacillus anthracis
MSQVNNTNNELKRTMKSRHLFMIALGGVIGTELFNGSGFIISQAGPGGSVLAFMAGGLLMYFVMLCLGELAVAMPVSGSFQEYATKFINPATGFTIGWLYWLSWANTTGLEFTTAGITMQRWFPDIPVWVWCLIFGVTIFMINALSARSYAETEFWFSSIKVSAIIAFIILGGAAMFGLIDLKGDEPAPLLSNFVNHGGLFPNGLAAILLTMVTVNYSFQGTELVGIAAGESEDPAKTLPRSIRNIIWRTMFFFVLAIFVLVALIPWEEAGLTKSPFVAVFDNISIPYAADIMNFVILTAVLSVANSGLYAATRMLWSLSKNEMAPAFLKKLSSRGIPLNALILTISISAFSLLTSVVAAETVYLWLISISGVITIIVWMSICVSQFFFRKHYVADGGRLEDLKFKTPLYPLVPILGFGLYGIILVSLIFIPDQRLGIYCTVPFIIFCYTYYHFKVKKRISTNTSSENKISETI

SEQ ID NO: 2454 - protein, 397 aa, Thermococcus kodakarensis
MSIENTDVHPEGYDDYVTFLKRRIRQLELQVRTLEADKERLERELSRLRMEMSRLRQPPAFAGNVIEVLDDERAIVQNYNGPRFVVRIAPWIERDKLKPGARVALDQRTMAIVELLPSEKDPSVLGFEVIERPKVTYNDIGGLEKQLQELREAIELPLKHPELFEQVGIEPPKGVLLYGPPGCGKTLMAKAVANHVNATFIRVVGSELVRKFIGEGARLVHELFELAKEKAPTIIFIDEIDAIGAKRMDETTGGEREVNRTLMQLLAEMDGFDPRGNVKVIAATNRPDILDPALLRPGRFDRLIEVPLPDYQGRLEILKVHTRKMNLKGVDLRVIAEITEGASGADLKAIATEAGMFAIRDRRTYVTQDDFLKAVDKVIGSEKRLAQQIAMHEVMYG

SEQ ID NO: 2455 - protein, 335 aa, Unknown
  Malus x domestica
MADESVAGSADFPVKRPREEEENGSAAAASAVSMEPDGGKEPDSVSAVIPGWFSEISSMWPGEAHSLKIEKILFQGKSDYQNVMVFQSATYGKVLVLDGVIQLTERDECAYQEMITHLPLCSIPNPKKVLVIGGGDGGVLREVARYASVEKIDICEIDKMVIDVSKQFFPEVAIGYEDPRVTLHVGDGVAFLKAVPAGTYDAVIVDSSDPIGPAKELFEKPFFQTVANALRPGGVVCTQAESIWLHMHIIEDIVANCREIFKGSVNYAWTTVPTYPSGVIGFMLCSTEGTAVDFKHPVNSIDESKRPLRFYNSEIHTAAFCLPSFAKKVIDAKAK

SEQ ID NO: 2456 - protein, 335 aa, Unknown
  Malus x domestica
MADEIVVGSADLPLKRPREEEENGAEAAASAVSMETDGGKEPDSVSAVIPGWFSEISPMWPGEAHSLKIEKILFQGKSDYQNVMVFQSATYGKVLVLDGVIQLTERDECAYQEMITHLPLCSIPNPKKVLVIGGGDGGVLREVARYASVEKIDICEIDKMVVDVSKQFFPDVAIGYDDPRVSLHVGDGVAFLKAVPAGTYDAVIVDSSDPIGPAKELFEKPFFQTVANALRPGGVVCTQAESIWLHMDIIEDIVENCREVFKGSVNYAWTTVPTYPSGVIGFMLCSTEGPAVDFKHPVNSIDASKRPLKFYNSEIHTAAFCLPSFAKKVIDAKAK

SEQ ID NO: 2457 - protein, 392 aa, Cycas revoluta
WFQNRRCREKQRKEASRLQTVNRKLTAMNKLLMEENDRLQKQVSQLVYENGYFRQQLQNASIATTDTSCESVVTSGQHHLTPQHPPRDASPAGLLSIAEETLTEFLSKATGTAVEWIQMPGMKPGPDSIGIVAISHGCTGVAARACGLVGLEPTKVAEILKDRPSWFRDCRCVDILTAFSTGNGGTVELLYMQMYAPTTLASARDFWTLRYTSVLEDGSLVVCERSLSGTQGGPSMPPVPHFVRAEMLPSGYLIRPCEGGGSIIHIVDHMDLEPWSVPEVLRPLYESSTVLAQKTTMAALRHLRQIAQEISCDVVLGWGRQPAALRTFGQRLSKGFNEAVNGFTDDGWSLMGSDGMDDVTVLISSSPSKLLGSQLASSDGLPALGGGILCAK

SEQ ID NO: 2458 - protein, 398 aa, Glycine max
MGKNEFLTPKAIANRIKAKGLQKLRWYCQMCQKQCRDENGFKCHCMSEGHQRQMQIFGQNPHRIVEGYSEEFETTFLEHMKRSHRFSRVAATVVYNEYINDRHHVHMNSTQWATLTEFVKYLGRTGKCKVEETPKGWFITYIDRDSETLFKERMKNKRIKADMVDEEKQEKEIRRQIEKAEQMMQPATSEADQPSQVEPLRELNMEDGIKIGFSLGSSLAKPVVKEKHEASRVVFDEGEEEKYNERNPRNNLKRKESGGGKSALDEMMREEEKKKEKINRKDYWLHEGIVVKVMSKVLAEKGYYKQKGVVRKVIDKYVGEIEMLESKHVLRVDQAELETVIPQVGGRVKIVNGAYRGSIAKLLGVDTDNFCAKVHIEKGVYDGRVLKAVEYEDICKVA

SEQ ID NO: 2459 - protein, 292 aa, Unknown
  Malus x domestica
MINFTPLLSYMSSSVGMQGEAHSLKIEKILFQGKSDYQNVMVFQSATYGKVLVLDGVIQLTERDECAYQEMITHLPLCSIPNPKKVLVIGGGDGGVLREVARYASVEKIDICEIDKMVVDVSKQFFPDVAIGYDDPRVSLHVGDGVAFLKAVPAGTYDAVIVDSSDPIGPAKELFEKPFFQTVANALRPGGVVCTQAESIWLHMDIIEDIVENCREVFKGSVNYAWTTVPTYPSGVIGFMLCSTEGPAVDFKHPVNSIDASKRPLKFYNSEIHTAAFCLPSFAKKVIDAKAK

SEQ ID NO: 2460 - protein, 343 aa, Pseudotsuga menziesii
MSSKFGSLSSSCSSVHGTAFTVSARPSPAALRATPAITSLYADRKYDLHSFKFEPIRESIVAREMTRRYMMDMITHAETDVVIVGAGSAGLSCAYELSKNPDVKVAIIEQSVSPGGGAWLGGQLFSAMVVRKPAHLFLDEIGVPYDETEDYVVIKHAALFTSTIMSKVLARPNVKLFNAVAAEDLIIKEGRVSGVVTNWALVSMNHDTQSCMDPNVMESKVVVSSCGHDGPFGATGVKRLKSVGMIDKVPGMKALDMNTAEDAIVRLTREIVPGMIVTGMEVAEIDGSPRMGPTFGAMMVSGQKAAHLALKALGQPNALDGTLKVLPELVLASAENEITTASA

SEQ ID NO: 2461 - protein, 129 aa, Cycas revoluta
WFQNRRCREKQRKEASRLQTVNRKLTAMNKLLMEENDRLQKQVSQLVYDNGCLRQQIQAASMATTDTSCESVVTSGPRQHHLTSQHPPRDASPAGLLSIAEETLAQFLSKATGTAVDWIQMPGMKPGPD

SEQ ID NO: 2462 - protein, 351 aa, Pseudotsuga menziesii
MSSKFGSLSSSCSSVHGTAFTVSARPSPAALRATPAITSLYADRKYDLQSFKFEPIRESIVAREMTRRYMMDMITHAETDVVIVGAGSAGLSCAYELSKNPDVKVAIIEQSVSPGGGAWLGGQLFSAMVVRKPAHLFLDEIGVPYDETEDYVVIKHAALFTSTIMSKVLARPNVKLFNAVAAEDLIIKEGRMLSYCEGLVSGVVTNWALVSMNHDTQSCMDPNVMESKVVVSSCGHDGPFGATGVKRLKSVGMIDKVPGMKALDMNTAEDAIVRLTREIVPGMIVTGMEVAEIDGSPRMGPTFGAMMVSGQKAAHLALKALGQPNALDGTLKVLPELVLASAENEITTASA

SEQ ID NO: 2463 - protein, 360 aa, Zea mays
RGLRALSRAQIDSVLDLARCTIVSELSNKDFDSYVLSESSLFIYPLKIVIKTCGTTKLLLTIPRILELAEELSMPLAAVKYSRGTFIFPGAQPAPHRSFSEEVAALNRYFGGLKSGGNAYVIGDPARPGQKWHVFYATEYPEQPMVNLEMCMTGLDKKKASVFFKTNADGNTTCAKEMTKLSGISEIIPEMEICDFDFEPCGYSMNAIHGSAFSTIHVTPEDGFSYASYEVMGLDATALSYGDLVKRVLRCFGPSEFSVAVTIFGGRGHAGTWGKALGAEVYDCNNMVEQELPGGGLLVYQSFCAAEDAVATSPKSVFHCFDGENVESAPPPMKKDYKLANLLCWEEEADAMEKAGVLDE

SEQ ID NO: 2464 - protein, 743 aa, Saccharomyces cerevisiae
MSAPAADHNAAKPIPHVPQASRRYKNSYNGFVYNIHTWLYDVSVFLFNILFTIFFREIKVRGAYNVPEVGVPTILVCAPHANQFIDPALVMSQTRLLKTSAGKSRSRMPCFVTAESSFKKRFISFFGHAMGGIPVPRIQDNLKPVDENLEIYAPDLKNHPEIIKGRSKNPQTTPVNFTKRFSAKSLLGLPDYLSNAQIKEIPDDETIILSSPFRTSKSKVVELLTNGTNFKYAEKIDNTETFQSVFDHLHTKGCVGIFPEGGSHDRPSLLPIKAGVAIMALGAVAADPTMKVAVVPCGLHYFHRNKFRSRAVLEYGEPIVVDGKYGEMYKDSPRETVSKLLKKITNSLFSVTENAPDYDTLMVIQAARRLYQPVKVRLPLPAIVEINRRLLFGYSKFKDDPRIIHLKKLVYDYNRKLDSVGLKDHQVMQLKTTKLEALRCFVTLIVRLIKFSVFAILSLPGSILFTPIFIICRVYSEKKAKEGLKKSLVKIKGTDLLATWKLIVALILAPILYVTYSILLIILARKQHYCRIWVPSNNAFIQFVYFYALLVFTTYSSLKTGEIGVDLFKSLRPLFVSIVYPGKKIEEIQTTRKNLSLELTAVCNDLGPLVFPDYDKLATEIFSKRDGYDVSSDAESSISRMSVQSRSRSSSIHSIGSLASNALSRVNSRGSLTDIPIFSDAKQGQWKSEGETSEDEDEFDEKNPAIVQTARSSDLNKENSRNTNISSKIASLVRQKREHEKKE

SEQ ID NO: 2465 - protein, 193 aa, Triticum aestivum
AYLGDTIEQVCTKKQAGTGPEFPGYRRPTRPGAGCFWGVELVFQRVPGVTRTEVGYSQGAFHDPTYEDVCTGATGHNEVVRVQYDPAACKYDDLLETFWARHDPTTPNRQGGDVGTQYRSGIYYYTSEQEKAALESMEKQQKVQNRKIVTEILPAKRFYKAEEYHQQYLAKGGRFGFKQSTEKGCNDPIRCYG

SEQ ID NO: 2466 - protein, 593 aa, Saccharomyces cerevisiae
MVRDLVTLPSSLPLITAGFATDQVHLLIGTGSTDSVSVCKNRIHSILNAGGNPIVVNPSSPSHTKQLQLEFGKFAKFEIVEREFRLSDLTTLGRVLVCKVVDRVFVDLPITQSRLCEEIFWQCQKLRIPINTFHKPEFSTFNMIPTWVDPKGSGLQISVTTNGNGYILANRIKRDIISHLPPNISEVVINMGYLKDRIINEDHKALLEEKYYQTDMSLPGFGYGLDEDGWESHKFNKLIREFEMTSREQRLKRTRWLSQIMEYYPMNKLSDIKLEDFETSSSPNKKTKQETVTEGVVPPTDENIENGTKQLQLSEVKKEEGPKKLGKISLVGSGPGSVSMLTIGALQEIKSADIILADKLVPQAILDLIPPKTETFIAKKFPGNAERAQQELLAKGLESLDNGLKVVRLKQGDPYIFGRGGEEFNFFKDHGYIPVVLPGISSSLACTVLAQIPATQRDIADQVLICTGTGRKGALPIIPEFVESRTTVFLMALHRANVLITGLLKHGWDGDVPAAIVERGSCPDQRVTRTLLKWVPEVVEEIGSRPPGVLVVGKAVNALVEKDLINFDESRKFVIDEGFREFEVDVDSLFKLY

SEQ ID NO: 2467 - protein, 235 aa, Capsicum annuum
MGSPQENCSFDMIRQHLDDISLMEYYCPENTLYSQSCESLDQTSVSFETSSNLDDISSFFSSSKTDFGCFEFETKPITSAATSISSNSPKKRSFNERKPSLNIAVPVKPVVVQKVEVVREKKHYRGVRQRPWGKFAAEIRDPNRKGTRVWLGTFDTAVDAAKAYDRAAFKLRGSKAILNFPLEVANFKQQNSTVEVPQQVNSSGSKRAREKEELAINEKKKKKKKNLAAPRPSPI

SEQ ID NO: 2468 - protein, 240 aa, Zea mays
IGPDIDILAPDVYTNEMMMGWMMDQYSIIRRKISPAVVTGKPVTMGGSQGRNTATGTGAFYIMQGMLPKFDQYPENTTVAVQGFGNAGMVVAECLYQDGYKVVAISDSQGGIYNEQGIDIPAVIDYKQRHRTLAGMYCDQAICDLGENQQISNAELLALDVDVLIPAALENQITRDNADQVRARYIFEVANGPTTTAADDILASKGIYVFPDILVNAGGVTVSYFEWVQNRSGLYWSAKE

SEQ ID NO: 2469 - protein, 247 aa, Fusobacterium nucleatum
MSVVSMKQLLEAGVHFGHQAKRWNPKMAKYIFTERNGIHVIDLHKSLKKIEEAYEEMRKIAEDGGKVLFVGTKKQAQEAIKEQAERSGMYYVNSRWLGGMLTNFSTIKKRIERMKELEKLDAEGILDTDYTKKEAAEFRKELSKLSKNLSGIRDMEKVPDAIYVVDVKMEELPVKEAHLLGIPVFAMIDTNVDPDLITYPIPANDDAIRSVKLITSVIANAIVEGNQGIENVEPQSEEVNVEEGSAE

SEQ ID NO: 2470 - protein, 463 aa, Streptomyces venezuelae
MQFHDSMISLVGNTPLVKLNNVTAGIQATVLAKVEYFNPGGSVKDRIAVRMIEAAEQSGELKPGGTIVEPTSGNTGVGLAIVAQQKGYKCIFVCPDKVSLDKINVLRAYGAEVVVCPTAVDPEHPDSYYNVSDRLVRETPGAWKPDQYSNPNNPRSHYETTGPELWEQTDGKITHFVAGVGTGGTISGTGNYLKEASGGSVKIIGADPEGSVYSGGSGRPYLVEGVGEDFWPTAYDRNVTDRIVAVSDKDSFQMTRRLAKEEGLLVGGSCGMAVVAALEVARELGPDDVVVVLLPDSGRGYMSKIFSDEWMAGHGFLEDTSSATVADVLRHKEGGTMPSLVHMHPDETVGQAIEVLREYGVSQMPIVKPGAGHPDVMAAEVVGSVVERDVLDALFTQRASLEDSLESHMSAPLPQVGSGEPVAALMSVLGDAADAAIVLVEGKPTGVVSRQDLLAFLANGGAK

SEQ ID NO: 2471 - protein, 623 aa, Aspergillus oryzae
MANIESKSAALNHDRVQKPVADDFMYDFKYNHHLPTTDILGVDIPADCDAKKEAEGIVARLAKTMSEGDAQAFAGLFLDYGVWRDKLSFTWDFRTFNFRDAILKAATDLFPQTKARSFQFLEPVPTVARPYTDYSYLQFVVSFETELVVASAVINAVLTQDGWRIYTMHTVAEGLKQFPEQPAPDGHMTGITSWASQRSEAINNVDPEILIIGGGQNGLAMAARCKVLGMENLIIERSDEVGDIWKKRYEYLSLHFPHWPDALPYFKYPQHWPTYTPAQKQALYMQWYASALELNVWTKSSVVKAEQDAEGKWTITINKEGKETRTLHPKQVIMATSLCGVPYTPTVPGMDEFRGVIRHSSAHDSAREFVGKKVCVVGTSSSGFDTAFECARLGIDVTLLQRSPTYVMSLTHSVPRMLGSYAPDEHGNLPDLEEQDRLFFSTPVGPGEELSRRTAKVLEDLDRPLLEALNARGLRTWRGQRDTGNSTLGQTRNGGFYFDAGACEEIINGNIKVEPGYCEKFTADKVILNGGREKEFDLVVFATGFSNTIDSIRATLGEKIASQCGPIWGIDEEGEYKTAYRETGVPNLWIMVGFLPMTRYASKLLALRLKALQEGISPPPYKV

SEQ ID NO: 2472 - protein, 468 aa, Escherichia coli
MSKQQIGVVGMAVMGRNLALNIESRGYTVSVFNRSREKTEEVIAENPGKKLVPYYTVQEFVESLETPRRILLMVKAGAGTDSAIDSLKPYLDKGDIIIDGGNTFFQDTIRRNRELSAEGFNFIGTGVSGGEEGALKGPSIMPGGQKEAYELVAPILKQIAAVAEDGEPCVTYIGADGAGHYVKMVHNGIEYGDMQLIAEAYALLKGGLALSNEELAQTFTEWNEGELSSYLIDITKDIFTKKDEEGNYLVDVILDEAANKGTGKWTSQSSLDLGEPLSLITESVFARYISSLKDQRVAASKVLSGPQATPAGDKAEFIEKVRRALYLGKIVSYAQGFSQLRAASDEYNWDLNYGEIAKIFRAGCIIRAQFLQKITDAYSQNAGIANLLLAPYFKQIADDYQQALRDVVAYAVQNGIPVPTFSAAIAYYDSYRSAVLPANLIQAQRDYFGAHTYKRTDKEGVFHTEWLD

SEQ ID NO: 2473 - protein, 356 aa, Vitis vinifera
MALLSDLINLNLSETTEKVIVEYIWVGGSGMDLRSKARTLSGPVSDPAKLPKWNYDGSSTGQAPGEDSEVILYPQAIFKDPFRRGNNILVMCDTYTPAGEPIPTNKRCNAAKIFSHPDVAAEVPWYGIEQEYTLLQKEVKWPIGWPVGGFPGPQGPYYCGIGADKAWGRDIVDAHYKACLYAGINISGINGEVMPGQWEYQVGPSVGISAGDELWVSRYILERITEIAGVVLSFDPKPIQGDWNGAGAHTNYSTKSMRNDGGFEVIKKAIEKLGLRHKEHIAAYGEGNERRLTGRHETADINTFLWGVANRGASIRVGRDTEKAGKGYFEDRRPASNMDPYVVTSMIAETTILWKP

SEQ ID NO: 2474 - protein, 486 aa, Listeria monocytogenes
MKKETHGEIRRDLKTRHLSMIAIGGSIGTGLFLASGNAIHTAGPGGALVAYVAIGIMVYFLMTSLGEMATYMPVSGSFSTYASRFVDPAFGFALGWNYWFNWAITLAVDISTAAIIVQFWLPNTPAWLWSAIFLILIFGLNALSVKAYGESEYWFSIIKVATVIIFLIVGVLTIVGILGGEVIGFSNFTAGDAPFKGGFFAILGTFLIAGFSFQGTEMVGIAAGESATPETSVPKAIKQVFWRILLFYIFAIFIIGMIIPYTNPNLLSAEATDVAISPFTLVFEKAGLAFAASVMNAVILTSVLSAGNSGLYASTRMLWAMARDKKAPKFLGKVNRRGIPMAALIVTTIVGAMTFITTLTENGTVIYTWLLSASGLTGFIAWVGIAISHYRFRKAFIKQGHDLSELKYKAKFFPFGPILALVLCILVIVGQDYAAFLKPEFTNPAWWQKIGISYIGLPIFLVFWLSFKFTNKTKVIPLEDCKFDQK

SEQ ID NO: 2475 - protein, 256 aa, Escherichia coli
AEGFNFIGTGVSGGEEGALKGPSIMPGGQKEAYELVAPILTKIAAVAEDGEPCVTYIGSDGAGHYVKMVHNGIEYGDMQLIAEAYSLLKGGLNLTNEELAQTFTEWNNGELSSYLIDITKDIFTKKDEDGNYLVDVILDEAANKGTGKWTSQSALDLGEPLSLITESVFARYISSLKDQRVAASKVLSGPQAQPAGDKAEFIEKVRRALYLGKIVSYAQGFSQLRAASEEYNWDLNYGEIAKIFRAGCIIRAQFLQ

SEQ ID NO: 2476 - protein, 789 aa, Ehrlichia ruminantium
MFNLIRKSTEWGGKTLVLESGKIARQANGAVVVTYGGTTVLSTVVAGKAKEPVDFLPLTVQFVAKSYAVGKIPGGFLKREGKPSDRETLISRLIDRSIRPLFPSGFYDEVSIVCNLLSYDTVTPPEVTALIGATAALAISGVPFNGMVVGARVGYLLSEDKYLLNASADEMLSSSLDLFLSGNKDSVLMVESEASELSESQMLGAISFGHQNCQEVIKLIEEFREESGILPFGFIPHDITSLVDDIASSYTESFSIAYSNIVKKERVLELEKLRDQVLSDMLAKYEQPNGNLQCQYSSQDIISALKSFERSLVRSKIIETSSRIDGRAFNGIRDIEIEIDVLPKTHGSALFTRGNTQALVVTALGTPQDEQIVDDLDGDRRENFLLHYNFPPYAVGESAALRAPGRREIGHGKLAWKAIRYVLPEKSDFPYTIRVVSEITESDGSSSMATVCGASLALMDTGVPIKAPVAGIAMGLIKEGEKFIILSDILGDEDHLGDMDFKVAGTSSGITALQMDMKISGISIEVIEKSLLQAKDGRMHILDKMNLVIQESRECIKNHAPRIESIFINKDKIRNVIGSGGKNIREICEKTGARVEIMQDGTVMIYAINNDAVEYAKNMIMDIVSEPEIGKVFDGTVIEIVKFGAFVSFLGGKRGLIHISEIKNEHINAVGSVISVNDKVKVLVIGIDREYVQLSMRRVDQETGEPIDGELYNIRKTNSDSDDSFLSSGSVNNRHGSEKKRRGSGRSRRSSGGSSYHRDDLHNNGFGNGNRSFNDNRNGNEVPRKPRFF

SEQ ID NO: 2477 - protein, 483 aa, Lactobacillus plantarum
GQRIIIQFQGVEEALYVWLNGHFIGYAEDSFTPSEFDLTPYIQDQGNVLAVRVYKRSTAAFIEDQDMFRFSGIFRDVNILAEPASHITDLDIRPVPNANLKSGELNITTKVTGEPATLALTVKDHDGRVLTSQTQTGSGSVTFDTMLFDQLHLWSPQTPYLYQLTIEVYDADHQLLEVVPYQFGFRTVELRDDKVIYVNNKRLVINGVNRHEWNAHTGRVISMADMRADIQTMLANNINADRTCHYPDQLPWYQLCDEAGIYLMAENNLESHGSWQKMGAIEPSYNVPGDNPHWLAAVIDRARSNYEWFKNHPSIIFWSLGNESYAGEDIAAMQAFYKEHDDSRLVHYEGVVHTPELKDRISDVESRMYEKPQNIVAYLEDNPTKPFLDCEYMHDMGNSLGGMQSYNDLIDKYPMYQGGFIWDFIDQALFVHDPITDQDVLRYGGDFDERHSDYEFSGDGLMFADRTPKPAMQEVKYYYGLHK

SEQ ID NO: 2478 - protein, 122 aa, Methanobacterium ivanovii
MKEIIAIIRPNKINRTKEVLDALGFSSMTANAVFGRGRQKAIVGEVTFAIQNKDLREEEGSMRYIPKRMISLVVPDEDASLVVESIMKVNKTGQIGDGKIFVCPIEDAVRVRTKESGEDAIL

SEQ ID NO: 2479 - protein, 256 aa, Escherichia coli
AEGFNFIGTGVSGGEEGALKGPSIMPGGQKEAYELVAPILTKIAAVAEDGEPCVTYIGADGAGHYVKMVHNGIEYGDMQLIAEAYSLLKGGLNLTNEELTQTFTEWNNGELSSYLIDITKDIFTKKDEDGNYLVDVILDEAANKGTGKWTSQSALDLGEPLSLITESVFARYISSLKDQRVAASKVLSGPQAQPAGNKAEFIEKVRRALYLGKIVSYAQGFSQLRAASEEYNWDLNYGEIAKIFRAGCIIRAQFLQ

SEQ ID NO: 2480 - protein, 559 aa, Unknown
  Mycobacterium sp. MCS
MRKIETGDLWWKNAVFYCADIETFYDWNGDGTVDIRGMTERIEYLFDLGVTCLWLMPFYPTARKDDGYDIIDFFGVDQRLGNLGDFVELVRTARSKGIRVIVDFVMNHTSDAHPWFKSARRSKDDPYRDYYVWSETEPKSSPADVVFPDQEDSIWEQEPKTGEWYLHHFYKHQPDLNIANPKVQEEISRTLGFWLQLGVSGFRVDAVPFLFARDGVPGDPGVFDPYEYLGDVRNFVNRRVGDAVLLGEVNVPYDDQKSFFGGPDGDGLNMQFDFIGMQNMYLSLARGDAGPIAAALRERPPLDETSQWANFVRNHDELTLDKLGDAERQEIFDAFGPERDMQLYGRGLRRRLPAMLGGDERRMRMVYSLAFSLPGTPVLYYGEEIGMAENLDIPGRFAVRVPMQWTSDDNGGFSRAAARRLPRPITDGLYGPDRVNVADQRHDHQSFWWFIRDLIYTYRQQPEIGWSTAEVLDQPNPAVLAHCCREKSGWTMVGLHNFGADRCMVPIQIEDAPEGSTLVDLLDGLSVHELDAKGRLEIGLDGYGYRWLRLVRPGDDPII

SEQ ID NO: 2481 - protein, 356 aa, Vitis vinifera
MALLSDLINLNLSDVTEKIIAEYIWIGGSGMDLRSKARTLSGPVSDPHKLPKWNYDGSSTGQAPGEDSEVILYPQAIFKDPFRRGNNILVMCDTYTPAGEPIPTNKRHNAAKIFSHPEVLAEETWYGIEQEYTLLQNSVKWPIGWPVGGYPGPQGPYYCGIGADKAFGRDIVDSHYKACLYAGINISGINGEVMPGQWEFQVGPAVGISAGDELWVARYILERITEIAGVVVSFDPKPIQGDWNGAGAHTNYSTKSMRNDGGYEIIKKAIEKLGLRHKEHIAAYGEGNERRLTGRHETADINTFLWGVANRGASIRVGRDTEKEGKGYFEDRRPASNMDPYVVTSMIAESTILWKP

SEQ ID NO: 2482 - protein, 468 aa, Escherichia coli
MSKQQIGVVGMAVMGRNLALNIESRGYTVSIFNRSREKTEEVIAENPGKKLVPYYTVKEFVESLETPRRILLMVKAGAGTDAAIDSLKPYLDKGDIIIDGGNTFFQDTIRRNRELSAEGFNFIGTGVSGGEEGALKGPSIMPGGQKEAYELVAPILTKIAAVAEDGEPCVTYIGADGAGHYVKMVHNGIEYGDMQLIAEAYSLLKGGLNLSNEELAQTFTEWNNGELSSYLIDITKDIFTKKDEDGNYLVDVILDEAANKGTGKWTSQSALDLGEPLSLITESVFARYISSLKDQRVAASKVLSGPQAQPAGDKAEFIEKVRRAQYLGKIVSYAQGFSQLRAASEEYNWALNYGEIAKIFRAGCIIRAQFLQKITDAYAENPQIANLLLAPYFKQIADDYQQALRDVVAYAVQNGIPVPTFAAAVAYYDSYRAAVLPANLIQAQRDYFGAHTYKRIDKEGVFHTEWLD

SEQ ID NO: 2483 - protein, 721 aa, Unknown
  Mycobacterium sp. MCS
MPSTTVHTFCHYCLASCGVEVTVEDNRVRKISADRLNPHSWHDFCAKGRTAAELVDHPRRIRAPMRRVGDRYVEATWDEAITDIAARMNAAIEADGPDAVGAYYGNPTGFSGSNVIFMNAWLDAVGTHNRYFVGSVDQNAMHVVAEAMYGSMLMAPVSDIDNCDYFLLVGTNPAVSAWNWLETVPGGWRRALERQKRGATLVVVDPVRTESADHADVHLAIRPGQDWALLLAMVKVVLDEGLEHRGDCTDLAVGVPELRSLVAEADLDDLAQRCGVDRATIERVARDFAAARGAMVVTRTGVSLHAAGTVAEWLGHVLNVITGRMDRPGGRRFEPGYVDALRLAALAKGKPHVSRVAGREMVSGAHALAELPDEITTPGPGQIKAILINCGNPVVSGPDGAKLDRALATLDLLVVIDLVQRESHRHAHWLLPAAHWLERDDLLAFTSSMHDEPFVQYGRRAVEPPPGAREEWQIFTDLALAMGLPLFGVRGMNGFVRATRRAAALTRRPALAFGPQWLNRILVATSRKVNGRKLRWRDVANSPHGLVLGPREFGHFRDALRTPDKKVHAAPPEFVTRTRELLAAPHPSAPAGYPFQLGNRRHRHSMNSWLNDLPGLHPGGKRNEVVIHPEDAAALGVADGDRVRVFSPVGAVEVHATVSDQPRRGLVVLDHGWGSRVFDPRGDAEPQSYGVNRNLLVDGTGLDPLSQTSTLSEAWVGVQKV

SEQ ID NO: 2484 - protein, 537 aa, Corynebacterium diphtheriae
MTTTIIVGGVAGGMSTAARLRRRDEDMTILVFEASNHVSFANCGLPYHVSGVIPERSSLLLQTPESLAARFNIDVRVDHLVTAINREAGSVSVKNLATGEVSEHHYDHLVLSPGARPILPPLPGIEKALTLRTVEDVDTIIERVAGASSSAIIGGGFIGIELAENLAHRGIATTIIERGPQILGPLDIEMAAFVEQRLRDNGISVRTNANAAAISDTGVELADGSVTADVVVAAVGVAPASDLARAAGLAVGERGGIVVDDQLRTNDPQIFALGDAAEKRDAISGADTLVPLAQTANRHGRLVADIITGRDVKRTSTLGTAIVGVFGLAAASVGWSEKRAVAAGKNIRVIHTHPASHAGYYPGAAQLHLKLVVDADTDAILGAQAVGEDGADKRIDVIATAMRAGLSATDLADLELAYSPQYGSAKDPVNLIGMVNDNIRSGERSVQWHELDAQIADGWTLVDVRTAGEFAAGNIPGAINIPVDELREHLDELQGKNVLVHCQVGLRGHVAATLLTNSGINAANLDGGYLTWKTATS

SEQ ID NO: 2485 - protein, 682 aa, Listeria monocytogenes
MEIFLYVLALLVAIFISNLLNRFVPFVSVPLIQIGLGVLIAIMPITFNLQLNPELFLVMFIAPLLFNDGRQTDKAALWGMRMPILVLALGLVFATVVVIGYFVHWMIPTIPLAAAFALAAALAPTDAVAVSSLSGRINLPKRIMNLLEGEALINDASGLVAFQFAIAAMVTGVFSLMDASISFFVIAIGGILVGLILSWLKFRLLKWVRGLGMEDVTFHMLIQILTPFIIYLAAEEIHVSGILAVVAAGIMHSMEQKKMDPQLVKLNVVSQSTWSVIIFVLNGLVFLLLGTQLPAITEVVWNDSGSSNLQVMAYILSITAALILLRFIWVYISWSIGAKQRQKQNKKTQLPKFRPVVLTSLSGVRGAVTLASALAIPFFLDDGSLFPQRSLIIFIASGVILCTLVIATFILPLLAKSEEVTTEDERAEIATRIRILRNVIRELKEQTLPETKAATDEVIEDYRKRIYDLQQNNSSNRGMDERERAKRLEIIQWERENTQKMTDEGRIVATDSYRYQHYLNMMEQAIKQRFRTKVKTAWMFLYRLIMLVIHPKKWGRITHKVKKGISKDSERFQAIRQLREDNEILIISKLKEQLTKENVDIIGPLITEHTIFLERVRKEHSPRGKRAKFEQKKREVQVVAFQLERDIIQNMFEKGGISRELARDLRQNLNMIETYLYDDFLE

SEQ ID NO: 2486 - protein, 468 aa, Escherichia coli
MLKQQIGVVGMAVMGRNLALNIESRGYTVSIYNRSREKTEEVIAENPGKKLVPYYTVKEFVESLETPRRILLMVKAGAGTDAAIDSLKPYLDKGDIIIDGGNTFFQDTIRRNRELSSEGFNFIGTGVSGGEEGALKGPSIMPGGQKEAYELVAPILTKIAAVAEDGEPCVTYIGADGAGHYVKMVHNGIEYGDMQLIAEAYSLLKGGLNLTNEELAQTFTEWNNGELSSYLIDITKDIFTKKDEDGNYLVDVILDEAANKGTGKWTSQSALDLGEPLSLITESVFARYISSLKEQRVAASKVLSGPQAQPAGDKGEFIEKVRRALYLGKIVSYAQGFSQLRAASEEYNWDLNYGEIAKIFRAGCIIRAQFLQKITDAYAENPQIANLLLAPYFKQIADDYQQALRDVVAYAVQNGIPVPTFAAAVAYYDSYRAAVLPANLIQAQRDYFGAHTYKRIDKEGVFHTEWLD

SEQ ID NO: 2487 - protein, 715 aa, Medicago truncatula
MANADPCRDFVKDVKRIIIKVGTAVVTRQDGRLAVGKLGALCEQIKELNILGYEVILVSSGAVGLGRQRLRYRKLIQSSFADLQKPQVELDGKACAAVGQSSLMATYDDLFSQLDVTSAQLLVTDNDFRDQDFRNQLSETVKSLLALKVIPIFNENDAVSTRKAPYEDSSGIFWDNDSLSALLALELKADLLILLSDVDGLYNGPPSDPLSKLIHTYIKEKHQNEITFGDKSRVGRGGMTAKVKASVHAADAGIPVIITSGNAAENLTKILQGQRIGTLFHKDAHKWVPSKEVDVREMAVAARDCSRRLQAVSSEERKQILLNIADALQSREKEIRIENEADVVAAQEAGYEKSLVARLVLKSEKIVGLANNIRIIANMEDPIGRVLKRTELAEGLILEKTSSPLGVLLIIFESRPDALVQIASLAIRSGNGLLLKGGKEANRSNAILHKVITEAIPDTVGSKLIGLVTSRAEIPELLKLDDVIDLVIPRGSNKLVSDIKSSTKIPVLGHADGICHVYVDKSANLEMAKQIVLDAKTDYPSGCNAMETLLVHKDLVEKGWLNSISVNLRSEGVTLYGGPKASSLLNVPLARSLHHEYCSLACTVEIVDDVYAAIDHINRYGSAHTDSIVTEDHEVANVFLRQVDSAAVFHNASTRFSDGARFGLGAEVGISTSRIHARGPVGVDGLLTTRWLLKGNGQVVDGDKKVTYTHRDITT

SEQ ID NO: 2488 - protein, 181 aa, Austrobaileya scandens
GKYVRYTAEQVEALERVYTECPKPSSMRRQQLVRECSILANIEPKQIKVWFQNRRCRVKQRKEASRLQTVNRKLTAMNKLLMEENDRLQKQVSQLLYENGYMRQQLQNASVATTDTSCESVLTSGQHQQNPVQHPLPKDANNPAGLLSIAEETLAEFLSKATGTAVDWVQMPGMKPGPDAI

SEQ ID NO: 2489 - protein, 625 aa, Bradyrhizobium japonicum
MCGIFGWVLAAAKHQNRDTLIGLTDLMSHRGPDASGYWLHQTSDERYQIGFGHRRLSIIDIGGGAQPMATEDGRFNLVFNGEIYNYLELRKELVALGHHFRTDSDTEVLIEAYRAWQLDAVRRLRGMFAFALWDDAEQRLVLARDAFGKKPLFLAEAQGAVLFGSEIEPLVQFPGFSRALDSDAIGHYLLNRYVPGPSTFFQSVKKLQPGHCAVWQNGMLKSTRYYTPPFATTVPDVKDFNSAIRLFEGAFDEAVRIRMRSDAPYGAYLSGGIDSSAVVATMVKHSTEPVRTFSVGFRETGYSELDHARVIAGQFGTIHNDLIVEPSAFMDHWSTAALRRGAPVSEASDIPIFMLSEMASRSVKMVLTGEGADELMGGYPKYRAERWIGLYQWLIPHLLHERLIHPLVRSLPYGMRRAKIVALAAGERDLANRMRVWFGGLSVGESEAMLGRLLSATPPDLFPYSSQIGSSLRRTLFFDQTSWLPDNLLERGDRMMMAGSIEGRMPFMDTVLAGVVARFPDDFLTGGKGGKRVLRAAMDKILPSEIIRRKKIGFRVPIGEWFRGPYREFLRDMLVSETSAVAQMVRGDRLRQLVTEHLDARQNHERLLWSFVNLEIFVRAFRVAS

SEQ ID NO: 2490 - protein, 129 aa, Austrobaileya scandens
WFQNRRCREKQRKEASRLQAVNRKLTAMNKLLMEENDRLQKQVSQLVYENGYFRQQTQNTAITTTDTSCESVVTSGQHHLTPQHPPRDASPAGLLSIAEETLTEFLSKATGTAVEWIQMPGMKPGPDSI

SEQ ID NO: 2491 - protein, 257 aa, Medicago truncatula
GSKLIGFVTSREAIPDLLKLDDVIDLVVPRGSNKLVSQIKDSTKIPVLGHADGICHVYIDKAANINVAKKIVKDAKTDYPAACNAMETLLVHKDLAGNGGLNELAAELQKQGVQLYGGPKASVLLKISEAKSFHLEYSSLACTIEIVDDVFAAIDHIHEYGSSHTDCIVTEDSKVAETFLHQVDSAAVFHNASTRFCDGARFGLGAEVGISTSRIHARGPVGVEGLLTNRWVLRGNGQVVDGDRSMIYTHKDLQVKA

SEQ ID NO: 2492 - protein, 129 aa, Austrobaileya scandens
WFQNRRCREKQRKEASRLQAVNRKLTAMNKLLMEENDRLQKQVSQLVYENGYFRQQTQNTAITTTDASCESVVTSGQHHLTPQHLPRDASPAGLLSIAEETLTEFLSKATGTAVEWIQMPGMKPGPDSI

SEQ ID NO: 2493 - protein, 338 aa, Pseudomonas syringae
MNLSKFKRYPLTFGPSPITPLKRLSEHLGGKVDLYAKREDCNSGLAFGGNKTRKLEYLVPEAIEGGYDTLVSIGGIQSNQTRQVAAVAAHLGMKCVLVQENWVNYSDALYDRVGNIEMSRIMGADVRLDSAGFDIGIRPSWEKAMADVVESGGKPFPIPAGCSEHPYGGLGFVRFADEVRQQEEELGFKFDYIVVCSVTGSTHAGMLVGFAADGRAQRVIGIDASAKPDKTREQVLRIAQNTAKLVDLGREITAEDVVLDTRYAYPEYGLPNDGTLEAIRLCARLEGVLTDPVYEGKSMHGMIDMVRNGEFPEGSKVLYAHLGGVPALNAYSFLFKDG

SEQ ID NO: 2494 - protein, 954 aa, Vibrio vulnificus
MTELLQSLNTQHEFVGRHNGPNHADQQKMLSTINAESLDALIAQTVPAQIRLEKPMQLAEAQSEADMLASIKKFADLNQVKRTFIGQGYYNTFTPNVILRNVLENPGWYTAYTPYQPEISQGRLESLLNYQQMVMDLTGMDIANASLLDEATAAAEAMTLCQRAGKSKSKVFFVADDVHPQTIEVIKTRAKYFGFDVVIGNVDALPQTEAFGALLQYPSTTGEVRDLTDVIAQAQANKTLVSVATDLLASALVKPAGEMGADVVIGSAQRFGVPMGYGGPHAAFMATREQHKRTMPGRVIGVSIDAKGNQALRMAMQTREQHIRREKATSNICTAQALLANMASFFAVYHGEEGIRTIARRTHHMTAILAAGLTKSGYELAHNAFFDTITINTGDKTQALYAKAQAADINLRLLDGQIGISFDETTTVADIDALFAIFDVKESVNALSTDIAGNEFAAIPEACRRTSRFLSHPVFNTHHSETQMMRYLKQLENKDFSLTHGMIPLGSCTMKLNAAAEMIPVTWPEFGALHPFAPIEQAAGYTALAEDLKAKLCEITGYDAFSLQPNSGASGEYAGLIAIQRYHESRGEGHRNVCLIPSSAHGTNPATAAMVSMKVVVVKCDENGNIDLVDLAAKIEKHQENLSSIMITYPSTHGVYEEQVKEVCEMVHAAGGQVYLDGANMNAQVGLTSPGFIGSDVSHLNLHKTFCIPHGGGGPGMGPIGVKSHLAPFLPGHIENGVEGKEFAVSAADLGSASILPISWAYIAMMGADGLTEATKVAILNANYVMERLRPHYPVLYRGTNGRVAHECIIDIRPLKEETGISEEDIAKRLMDYGFHAPTMSFPVAGTLMVEPTESEDLEELDRFCDAMIAIREEMTKVKNGEWPLENNPLVNAPHTQVDLMEEQWDRPYPREIACFPSAATKRSKYWPTVNRVDNVYGDRNLVCSCPGIENYEE

SEQ ID NO: 2495 - protein, 119 aa, Methanocaldococcus jannaschii
GSMKKVEAIIRPEKLEIVKKALSDAGYVGMTVSEVKGRGVQGGIVERYRGREYIVDLIPKVKIELVVKEEDVDNVIDIICENARTGNPGDGKIFVIPVERVVRVRTKEEGKEALLEHHH

SEQ ID NO: 2496 - protein, 438 aa, Vibrio vulnificus
MIERLSTMNSHYQNHSLENFFSTNLSATDDAVFAGIQAEFTRQNEQIELIASENIVSKAVMQAQGTCLTNKYAEGYPGRRYYGGCEHVDTVEAIAIERAKKLFNCEYANVQPHSGAQANGAVKLALLQPGDTIMGMSLDAGGHLTHGARPALSGKWFNAVQYGVDKETLEINYDDVRALAVEHKPKMIIAGGSAIPRVIDFAKFREIADEVGAILMVDMAHIAGLIATGAHPSPLPHAHVVTTTTHKTLRGPRGGMILTNHEEIIKKINSAVFPGLQGGPLMHVIAAKAVAFGEALGPEFKTYIDSVINNAKVLAEVLQTRGCDIVTGGTDTHLMLVDLRPKGLKGNKAEEALERAGITCNKNGIPFDTEKPMITSGVRLGTPAGTSRGFGAEEFKLIGHWIGDVLDGLVENPEGNAEVEQRVRKEVKALCSRFPLYQ

SEQ ID NO: 2497 - protein, 240 aa, Triticum aestivum
  misc_feature (140)..(140): Xaa can be any naturally occurring amino acid
  misc_feature (182)..(182): Xaa can be any naturally occurring amino acid
  misc_feature (184)..(184): Xaa can be any naturally occurring amino acid
MSFARAVQRIKSIQNFLTRPTVPHISAAAAGQSRLINMASTTETNNYKFNHSMIRVKDPKASTKFYEFLGMSLVKKLEFPDNKFDLYFFGYDSPNALSHNKSTFDRQGLIELTHNYGTENDPEYKVNNGNQDPHRGFGHXCIAVDNIQAACQRIEDAGYKFQKKLTDGRMRNIAFVLDPDGXWXVEVVARNDYKETENVKETDVSTYTMNHTMLRVKDAEKSPEYYPRSLGMSRLRTLRN

SEQ ID NO: 2498 - protein, 1037 aa, Arabidopsis thaliana; identical to SEQ ID NO: 592

SEQ ID NO: 2499 - protein, 346 aa, Unknown
  Burkholderia sp. 383
MTASRSPRIVRRALPRPPRPPFTDSHMSTPKHAKVLILGSGPAGYTAAVYAARANLSPVLITGIAQGGQLMTTTDVENWPADAKGVQGPELMARFLEHAERFNTEIIFDHIHTAKLHEQPIRLIGDSGEYTCDSLIIATGASAQYLGLPSEELFMGKGVSACATCDGFFYRGQEVAVIGGGNTAVEEALYLTGIAKKVTVIHRRDKFRAEPILIDRLLEKEKEGAVVIKWDHVLDEVTGEDSGVTGLRIKNVKTGATEDLAVQGVFVAIGHKPNTDLFQGQLEMKDGYILTKSGLHGNATSTSVAGVFAAGDVQDNVYRQAITSAGTGCMAALDAQRYLESLHDKK

SEQ ID NO: 2500 - protein, 502 aa, Mycobacterium bovis
MDITIVGKYLSTLPEDDDHPYRTGPWRPQTTEWDADDLTTVTGEVPADLDGIYLRNTENPLHPAFATYHPFDGDGMIHVVGFRDGKAFYRNRFIRTDGFLAENEAGGPLWPGLAEPVQLAKREHGWGARGLMKDASSTDVIVHRGIALTSFYQCGDLYRIDPYSANTLGKESWHGRFPFDWGVSAHPKVDNKTGELLFFNYSKQEPYMRYGVVDQNNELVHYVDVPLPGPRLLHDMAFTENYVILNDFPLFWDPRLLERDVHLPRFYPEIPSRFAVVARRGNDIRWFEADPTFVLHFTNAYEQGDEIVLDGFYEGDPQPLDTGGTKWEKLFRFLALDRLQSRLHRWRLNMVTGAVHEEQLSESITEFGTINADYAASSYRYTYAATGKPSWFLFDGLVKHDLLTGNHECYSFGDGVYGSETAMAPRVGSSAEDDGYLVTLTTDMNDDASYCLVFDAARPGDGPICKLALPERISSGTHSAWVPGAELRRWDHAESPAAAVGL

SEQ ID NO: 2501 - protein, 165 aa, Zea mays
MALAEADDGAVVFGEEQEALVLKSWAVMKKDAANLGLRFFLKVFEIAPSAEQMFSFLRDSDVPLEKNPKLKTHAMSVFVMTCEAAAQLRKAGKVTVRETTLKRLGATHLRYGVADGHFEVTGFALLETIKEALPADMWSLEMKKAWAEAYSQLVAAIKREMKPDA

SEQ ID NO: 2502 - protein, 457 aa, Pseudoalteromonas tunicata
MQVALIGLGVMGKNLALNLIEKGISLVAYDKNPDAGEDLLSIAKSDGLAERLHIVSDLTDMIKRLETPRSILLLVPAGELVDRVCQELIEAGVDANDLIVDCGNSNYKDGIARKLKYQNKFEFATMGISGGAEGARHGPAMMASGSEGGWERVELALEKVAANYKGESCFARVGQSASGHFVKMVHNGIEYSLMQLIAEVYQLLRLGCGKSPQEIATIFDAWSETELNSYLLSISSHILKLEGHNNEPLVDLIDNKVGAKGTGLWTAQNALELGIAVPSLVAAVEARHLTNTYSTHAAKEMTYQTRPTLVAQLDLDELKQAFHFASLLCYRQGLALIKGASRTHQWKVDLAKTLQTWRAGCIIRADYLHQVAQGNEFIDALESEVTALRNVTGIAITTGLAFPVLAASQTYYATLSTPSNGHLVQAQRDYFGEHGLLTHAGELCHLTDLADIDAKVR

SEQ ID NO: 2503 - protein, 165 aa, Zea mays
MALAEADDGAVVFGEEQEALVLKSWAVMKKDAANLGLRFFLKVFEIAPSAKQMFSFLRDSDVPLEKNPKLKTHAMSVFVMTCEAAAQLRKAGKVTVRETTLKRLGATHLRYGVADGHFEVTGFALLETIKEALPADMWSLEMKKAWAEAYSQLVAAIKREMKPDA

SEQ ID NO: 2504 - protein, 388 aa, Robiginitalea biformata
MNRGNMNHGKMKKRLLIIDRDGTLIREPEDEQIDAFDKLEFLPGVFRYLGAIARETDFVLVLVTNQDGLGTDAYPEDTFWPVQEFMMNALKNEGIEFASVHIDRTFPEQGAETRKPGTGMLKDYMSPEWDLAGSFVIGDRLTDMKLAENLGARGIFLNSHPELGASELTDSVDSLGEIIAWEGSDWKGIYEFLKMGRREAVVKRKTAETDIDIRLVLDGTGKSDIHTGLAFFDHMLDQLARHGQMDLEIRTRGDLEVDEHHTIEDTAIALGSAFSEALGGKLGIERYGFCLPMDDCLAQVAVDFGGRNWLVWDAAFQREKIGDMPTEMFMHFFKSFSDSARANLNIKAEGGNEHHKIEAIFKAFAKSVKMAVRRDPDRMVLPSTKGML

SEQ ID NO: 2505 - protein, 335 aa, Pseudoalteromonas tunicata
MTTVNLFRLGVLTSGGDAPGMNAAIRAITLKGLSAGFEIVGINAGYNGIFNLDTQILSAQSVDNIIQRGGTLLKTARCSQLREEDGPRLAAEKLTQLKLDALIIIGGDGSFRGAVKLAEFWPKPIIGIPGTIDNDINGTDQTIGFWTAIDTALDSIDKIRDTADAFERIFVVEVMGRDCGFIAMESGIACGAEQIICHELIEDEETYLAQLYNAILHAVTWRQTQSYVIVIAEHSLSICSAELAKRIADFTGVDTKSAILGYIQRGGAPVAMDRVLATQLGISAVKAVCEGKTGLMIGMKNNEMVEIPFAQTGLKNTHNQDLIKRLKHFNFDLTD

SEQ ID NO: 2506 - protein, 973 aa, Herminiimonas arsenicoxydans
MKRMLFNATQQEELRVAIVDGQKLIDIDIETTGREQRKSNIYKGVITRIEPSLEACFVSYGEDRHGFLPFKEVARTYFKEGVDVRNASIKDALREGQEIMVQVEKEERGNKGAALTSFVSLAGRYLVLMPNNPRGGGVSRRVEGEDRQELRETMDKLDLPQGMSVIARTAGIGRNVDELQWDLNYLMQLWRAIEGAGQSGAGAFLIYQESSLVIRAIRDYFQPDIGEILIDTDDIYEQAQQFMSHVMPDMVHRVKRYRDDVPLFSRFQIEHQIETAYSRTVPLPSGGAIVIDHTEALVSVDVNSARATRGSDIETTAFHTNCEAAEEVARQLRLRDLGGLIVIDFIDMENSKNQREVETRLKDALHYDRARVQMGKISRFGLMELSRQRLRPSLSEGSHVTCPRCNGTGHIRDTESSALQVLRIIQEEAMKENSASIHVQAPVDVAAFLLNEKRGEILKIETRHRVSVILIPNKHLETPHYKLERIKHDDPRLEEVQASYAMTEQADTDISYDKRLKVEAKPRQEAMVKGITPDHAPVVERKPVEMATAAAPAEKGFFQKLMAFFSGSPEQPKAAPAQAVQEDKNQRNQRGERKDGGRNQRNRSRGGRGGRERGEEREETATKPAPAASETQNARPPRPPREPREPREPRDGNEGRRERTPRPPREERKEVVAEDASLLPVDAVVATTAAARTTPPAAEANGNVAVVLDENGIPVEAVEGEEQPRRRRRRGGRNRNRRDRDNTESGTENESNEDGVVALQDDSLQDEAAQTPATAHVSATEMASTVASTVRQETVAHVTEASIASEAPVSALTSAIAAPLIPQEVMPQAEPEVAAPVVAVPAAPAPEPEPVVAAPAFVAVEAAPVVEAVPAIEPAPVAAVTPAPMPQPAPVIAPVPAPVATVSAAPAASTSKVDDLSEVLQSAGLVLASTDPEKLRAAQEEAAKFVPPPRVPRERKPLPPQSTEPLVQMETKR

SEQ ID NO: 2507 - protein, 125 aa, Methanosarcina barkeri
MKEITAIIRMNKAQRTKDVLLECGFPSFTIRRVMGRGKQRGLCHEFNPPLPDPEKEAETCIRFIPKRMFTIVVDDENVSEVVQKIIEVNQTGNAGDGKIFVSDVTEAIRIRTGESGEATVNKELV

SEQ ID NO: 2508 - protein, 323 aa, Aspergillus oryzae
MAAFIGANLNPCNYIGGVSFNPERDIPDLSGKVALVTGGNAGLGKETILQLAKHRPQRIYLAARSETKAQAAISSLKGSLSNNVEITWLPLDLMSIKSIQTAAQTFNAESSRLDILILNAGVMSLPPGETEMGHEIQLGTNHTGHFLLTKLLLPTLLKTAEEPNSDVRVVSLSSIGHNLAPSFETILDQDRLKKVNTNTRYGASKAANILFAAELARRYPSITSVSVHPGIILTDLYSSVSDRSALAALGSKTLGLFGTQVPQGAYNELWAAAGAKKHDLVNGSYYIPVGHLKPYNQYARSEDMGRRLWDWTESELRKFNALP

SEQ ID NO: 2509 - protein, 353 aa, Lupinus luteus
MSVLSDLINLNLSDTTEKIIAEYIWVGGSGVDLRSKARTLSGPVNDPSKLPKWNYDGSSTGQAPGKDSEVILWPQAIFKDPFRRGNNILVMCDTYTPAGEPIPTNKRHAAAKIFSHPDVVAEEPWFGIEQEYTLLQKDIHWPIGWPLGGFPGPQGPYYCGTGAEKAFGRDIVDSHYKACLYAGINISGINAEVMPGQWEFQVGPSVGISAGDELWVARYILERITEIAGVVLSLDPKPIPGDWNGAGAHTNYSTKSMRNDGGYEVIKKAIEKLGKRHNEHIAAYGEGNERRLTGRHETADISTFFWGVANRGASIRVGRDTEKEGKGYFEDRRPASNMDPYVVTSMIAETTLL

SEQ ID NO: 2510 - protein, 133 aa, Herminiimonas arsenicoxydans
MTTEENQQHTLYELLDGASGLRALVDRFYDLMDLEPAFAGIRGMHPTTLDGSRDKLFWFLSGWTGGPNLFVERFGHPRLRARHLPYAIATDERDQWLRCMEMAMQDVGIVPSLQEHLQKAFAETADWMRNTHG

SEQ ID NO: 2511 - protein, 357 aa, Pinus sylvestris
MSSVLTDLLNLDLSDVTEKVIAEYIWIGGSGMDMRSKARSLSGPVSSVKELPKWNYDGSSTGQAQGHDSEVILYPQAIFRDPFRRGKHILVICDAYSPNGTAIPSNKRAAAAKIFNEKAVSDEETWYGLEQEYTLLQKDVKWPLGWPIGGYPGPQGPYYCGVGADKAWGRDIVDAHYKACLYSGINISGINGEVMPGQWEFQVGPSVGISAADELWCARFIMERITEKAGVVLSFDPKPIEGDWNGAGCHTNYSTKSMRKEGGFEVIKKAIEKLKLRHKEHISAYGEGNERRLTGRHETADMNTFSWGVANRGASVRVGRDTEKEGKGYFEDRRPASNMDPYIVTSMIAETTILWKP

SEQ ID NO: 2512 - protein, 468 aa, Escherichia coli
MSKQQIGVVGMAVMGRNLALNIESRGYTVSIFNRSREKTEEVIAENPGKKLVPYYTVKEFVESLETPRRILLMVKAGAGTDAAIDSLKPYLDKGDIIIDGGNTFFQDTIRRNRELSAEGFNFIGTGVSGGEEGALKGPSIMPGGQKEAYELVAPILTKIAAVAEDGEPCVTYIGADGAGHYVKMVHNGIEYGDMQLIAEAYSLLKGGLSLTNEELAQTFTEWNNGELSSYLIDITKDIFTKKDEDGNYLVDVILDEAANKGTGKWTSQSALDLGEPLSLITESVFARYISSLKDQRVAASKVLSGPQGQPAGDKAEFIEKVRRALYLGKIVSYAQGFSQLRAASEEYNWDLNYGEIAKIFRAGCIIRAQFLQKITDAYAENPQIANLLLAPYFKQIADDYQQALRDVVAYAVQNGIPVPTFAAAVAYYDSYRAAVLPANLIQAQRDYFGAHTYKRIDKEGVFHTEWLD

SEQ ID NO: 2513 - protein, 468 aa, Escherichia coli
MSKQQIGVVGMAVMGRNLALNIESRGYTVSIFNRSREKTEEVIAENPGKKLVPYYTVKEFVESLETPRRILLMVKAGAGTDAAIDSLKPYLDKGDIIIDGGKTFFQDTIRRNRELSAEGFNFIGTGVSGGEEGALKGPSIMPGGQKEAYELVAPILTKIAAVAEDGEPCVTYIGADGAGHYVKMVHNGIEYGDMQLIAEAYSLLKGGLNLTNEELAQTFTEWNNGELSSYLIDITKDIFTKKDEDGNYLVDVILDEAANKGTGKWTSQSALDLGEPLSLITESVFARYISSLKDQRVAASKVLSGPQAQPAGDKAEFIEKVRRALYLGKIVSYAQGFSQLRAASEEYNWDLNYGEIAKIFRAGCIIRAQFLQKITDAYAENPQIANLLLAPYFKQIADDYQQALRDVVAYAVQNGIPVPTFAAAVAYYDSYRAAVLPANLIQAQRDYFGAHTYKRIDKEGVFHTEWLD

SEQ ID NO: 2514 - protein, 640 aa, Corynebacterium glutamicum
MCGLLGILTANGNAEAFVPALERALPCMRHRGPDDAGTWHDADAAFGFNRLSIIDIAHSHQPLRWGPADEPDRYAMTFNGEIYNYVELRKELSDLGYAFNTSGDGEPIVVGFHHWGESVVEHLRGMFGIAIWDTKEKSLFLARDQFGIKPLFYATTEHGTVFSSEKKTILEMAEEMNLDLGLDKRTIEHYVDLQYVPEPDTLHAQISRLESGCTATVRPGGKLEQKRYFKPQFPVQKVVKGKEQDLFDRIAQVLEDSVEKHMRADVTVGSFLSGGIDSTAIAALAKRHNPDLLTFTTGFEREGYSEVDVAAESAAAIGAEHIVKIVSPEEYANAIPKIMWYLDDPVADPSLVPLYFVAAEARKHVKVVLSGEGADELFGGYTIYKEPLSLAPFEKIPSPLRKGLGKLSKVLPDGMKGKSLLERGSMTMEERYYGNARSFNFEQMQRVIPWAKREWDHREVTAPIYAQSRNFDPVARMQHLDLFTWMRGDILVKADKINMANSLELRVPFLDKEVFKVAETIPYDLKIANGTTKYALRRALEQIVPPHVLHRKKLGFPVPMRHWLAGDELFGWAQDTIKESGTEDIFNKQAVLDMLNEHRDGVSDHSRRLWTVLSFMVWHGIFVENRIDPQIEDRSYPVEL

SEQ ID NO: 2515 - protein, 563 aa, Kluyveromyces lactis
MSEITLGRYLFERLKQVEVQTIFGLPGDFNLSLLDNIYEVPGMRWAGNANELNAAYAADGYARLKGMSCIITTFGVGELSALNGIAGSYAEHVGVLHVVGVPSVSSQAKQLLLHHTLGNGDFTVFHRMCSNISETTAMITDINTAPAEIDRCIRTTYVSQRPVYLGLPANLVDLTVPASLLDTPIDLSLKPNDPEAEEEVIENVLQLIKEAKNPVILADACCSRHDAKAETKKLIDLTQFPAFVTPMGKGSIDEKHPRFGGVYVGTLSSPAVKEAVESAHLVLSVGALLSDFNTGSFSYSYKTKNIVEFHSDYTKIRRPTFPGVQMKFALQKLLTKVADAAKGYKPVPVPSEPEHNEDVADSTPLKQEWVWTQVGEFLREGDVVITETGTSAFGINQTHFPNNTYGISQVLWGSIGFTTGATLGAAFAAEEIDPKKRVILFIGDGSLQLTVQEISTMIRWGLKPYLFVLNNDGYTIERLIHGETAQYNCIQNWQHLELLPTFGAKDYEAVRVSTTGEWNKLTTDEKFQDNTRIRLIEVMLPTMDAPSNLVKQAQLTAASNAKN

SEQ ID NO: 2516 - protein, 333 aa, Onobrychis viciifolia
WFYNGDIKTRKTVQTMETKADKIGLQRSEQLKELYKFLVLGEAEPNAKRPSASLSPEDLSDSEWYYLACMSFVFYLNQSLPGKALEVGETIWLCNAQHADSKVFSRSLLAKSASIQTVVCFPYLGGVIEIGTTELVSEDPNLIQHVKSCFLEFSKPICSDKSFSDHYKPHDEKYPTCTKGDTMALENTCSLVEEIKLDQYPLEESNFDMDDDSPDGCNSMVVRTIGLMEESMIEGINVELPSQVQCVNDNGSPDSLSSCDCMSEASETRGKASKDVIQIQDCNIGAADESGLYYTRTLCAVLGNSATFGQSPYASNSNRKSSFMKWKNGGVSE

SEQ ID NO: 2517 - protein, 376 aa, Escherichia coli
MAKQDYYEILGVSKTAEEREIKKAYKRLAMKYHPDRNQGDKEAEAKFKEIKEAYEVLTDSQKRAAYDQYGHAAFEQGGMGGGGFGGGADFSDIFGDVFGDIFGGGRGRQRAARGADLRYNMELTLEEAVRGVTKEIRIPTLEECDVCHGSGAKPGTQPQTCPTCHGSGQVQMRQGFFAVQQTCPHCQGRGTLIKDPCNKCHGHGRVERSKTLSVKIPAGVDTGDRIRLAGEGEAGEHGAPAGDLYVQVQVKQHPIFEREGNNLYCEVPINFAMAALGGEIEVPTLDGRVKLKVPGETQTGKLFRMRGKGVKSVRGGAQGDLLCRVVVETPVGLNEKQKQLLQELQESFGGPTGEHNSPRSKSFFDGVKKFFDDLTR

SEQ ID NO: 2518 - protein, 1037 aa, Arabidopsis thaliana
MERARRLAYRGIVKRLVNDTKRHRNAETPHLVPHAPARYVSSLSPFISTPRSVNHTAAFGRHQQTRSISVDAVKPSDTFPRRHNSATPDEQTHMAKFCGFDHIDSLIDATVPKSIRLDSMKFSKFDAGLTESQMIQHMVDLASKNKVFKSFIGMGYYNTHVPTVILRNIMENPAWYTQYTPYQAEISQGRLESLLNFQTVITDLTGLPMSNASLLDEGTAAAEAMAMCNNILKGKKKTFVIASNCHPQTIDVCKTRADGFDLKVVTSDLKDIDYSSGDVCGVLVQYPGTEGEVLDYAEFVKNAHANGVKVVMATDLLALTVLKPPGEFGADIVVGSAQRFGVPMGYGGPHAAFLATSQEYKRMMPGRIIGISVDSSGKQALRMAMQTREQHIRRDKATSNICTAQALLANMAAMYAVYHGPAGLKSIAQRVHGLAGIFSLGLNKLGVAEVQELPFFDTVKIKCSDAHAIADAASKSEINLRVVDSTTITASFDETTTLDDVDKLFKVFASGKPVPFTAESLAPEVQNSIPSSLTRESPYLTHPIFNMYHTEHELLRYIHKLQSKDLSLCHSMIPLGSCTMKLNATTEMMPVTWPSFTDIHPFAPVEQAQGYQEMFENLGDLLCTITGFDSFSLQPNAGAAGEYAGLMVIRAYHMSRGDHHRNVCIIPVSAHGTNPASAAMCGMKIITVGTDAKGNINIEEVRKAAEANKDNLAALMVTYPSTHGVYEEGIDEICNIIHENGGQVYMDGANMNAQVGLTSPGFIGADVCHLNLHKTFCIPHGGGGPGMGPIGVKNHLAPFLPSHPVIPTGGIPQPEKTAPLGAISAAPWGSALILPISYTYIAMMGSGGLTDASKIAILNANYMAKRLEKHYPVLFRGVNGTVAHEFIIDLRGFKNTAGIEPEDVAKRLMDYGFHGPTMSWPVPGTLMIEPTESESKAELDRFCDALISIREEIAQIEKGNADVQNNVLKGAPHPPSLLMADTWKKPYSREYAAFPAPWLRSSKFWPTTGRVDNVYGDRKLVCTLLPEEEQVTAAVSA

SEQ ID NO: 2519 - protein, 235 aa, Acorus americanus
MTKRYWNINLEEMMEAGVHFGHGTRKWNPRMAPYISAKRKGIHITNLTRTARFLSEACDLLFDAASGGKHFLIVGTKKKAADSVASAAIRARCHYVNKKWLGGMSTNWSTTETRLQNFRDLRAEQKAGKIDRLPKRDAAMLKRQLSTLQTYLGGIKYMTGLPDIVIIVDQQEDYTALRECVILGIPTICLIDTNSDPDLADISIPANDDAIASIRLILNKLVFAICEGRSSYIRN

SEQ ID NO: 2520 - protein, 388 aa, Escherichia coli
MKHLHRFFSSDASGGIILIIAAILAMMMANSGATSGWYHDFLETPVQLRVGSLEINKNMLLWINDALMAVFFLLVGLEVKRELMQGSLASLRQAAFPVIAAIGGMIVPALLYLAFNYADPITREGWAIPAATDIAFALGVLALLGSRVPLALKIFLMALAIIDDLGAIIIIALFYTNDLSMASLGVAAVAIAVLAVLNLCGVRRTGVYILVGVVLWTAVLKSGVHATLAGVIVGFFIPLKEKHGRSPAKRLEHVLHPWVAYLILPLFAFANAGVSLQGVTLDGLTSILPLGIIAGLLIGKPLGISLFCWLALRLKLAHLPEGTTYQQIMAVGILCGIGFTMSIFIASLAFGSVDPELINWAKLGILVGSISSAVIGYSWLRVRLRPSV

SEQ ID NO: 2521 - protein, 158 aa, Nitrosomonas europaea
MNIYDCGIKTMDGQDKLLGDYKGKVLLIVNTASKCGFTPQYQGLEDLYRRYKDRGFVVLAFPCNQFGHQEPGSESEIQQFCTTRYDVSFPVFAKIEVNGANTHPLYRYLKNEKSGVLGTKAIKWNFTKFLVDRSGHVVRRYAPADKPESLTGDIEQLL

SEQ ID NO: 2522 - protein, 339 aa, Brassica napus
MERKPFEVETTKTDEDQKPYSAVDGGGSDSVVSFDEDQKKLVYRGWKVMPFIIGNETFEKIGIIGTLSNLLVYLTQVFNLKKSAAATIINAFSGTINFGTFLAAFLCDTYLGRYKTLSVAVVAGFLGSLAILLTAAVPGLHPTPCGTKSSCEGPGAGQILFLMLGLALLVVGAGGIRPCNLAFGADQFNPKSESGKKGINSFFNWYFFTFTFAQIISLTLVVYIQSNVSWTIGLSIPVGLMFLACVIFFAGHKLYVKVKASGSPLAGIARVIAAAISKRGLKPVKQPWVDLYNHIPRNYANLTLKYTDQFRFLDKAAIMTPEDKLSSDGTASDPWKLCT

SEQ ID NO: 2523 - protein, 147 aa, Vicia faba
MGFTDKQEALVNSSWESFKQNLSGNSIFFYTIILEKAPAAKGLFSFLKDTAGVEDSPKLQAHAEQVFGLVRDSAAQLRAKGEVVLGNATLGAIHVQKGVTDPHFVVVKEALLQTIKKASGSNWSVELSTAWEVAYDGLASAIKKAMN

SEQ ID NO: 2524 - protein, 187 aa, Phelipanche tunetana
LGHHSRKWNPKMKPYISAERKHRHTIDLTKTARFLYEACNLLFYAASKGKQFLIVGTNKMRDDLVEQAAIKAQCHFVNKKWTCGTLTNWSITEARLQKFRNLIIEQKAGRLDCLPKKDAAVVKRQLSRFEKNLGGIKYMRGLPDIVIILDQDEDFTALAECLSLEIPTICLIDTNADPDLAHISIPA

SEQ ID NO: 2525 - protein, 314 aa, Mycobacterium smegmatis
MPRKPIDVTLPDLSGRRAVVTGASDGIGLGIAARLAAAGADVILPVRNEIKGKAAIAAVRQTNAAAKVSLRELDLSSLASVAALGKSLLEEAQPIHLLINNAGVMTPPERRTTTDGFESQFGTNHLGHFALVAHLLPLLRAGGARVTSQVSVAANQHAINWDDLNWERSYDGAKAYSQSKIAFGLFGLELDRRSHAHGWGITSNLSHPGLAPTNLLAARPDTGRAQDDWKLRLIRTLSSRGILFGTVHTAQLPALYAAASPHAKRGGFYGPRGPGHLGGPPGEQRLYSRLRNNDEAQRIWEISEKLTDMSFPTA

SEQ ID NO: 2526 - protein, 146 aa, Vicia faba
MGFTEKQEALVNSSWELFKQNPGNSVLFYTIILKKAPTAKGMFSFLKDSAGVVDSPKLQAHAEKVFGMVRDSAVQLRASGEIVLGDATLGAIHIQKGVLDPHFVVVKEALLETIKEISGDKWSEELSAAWEVAYEGLAVAIKKAMS

SEQ ID NO: 2527 - protein, 187 aa, Phelipanche tunetana
LGHHSRKWNPKMKPYISAERKHRHIINLTKTARFLYEACNLVFYAASKGKQFLIVGTNKMRDDLVEQAAIKAQCHFVNKKWTCGTLTNWSITEARLQKFRNLIIEQKAGRLDCLPKKDAAVVKRQLSRFEKNLGGIKYMRGLPDIVIILDQDEDFTALAECLSLEIPTICLIDTNADPDLAHISIPA

SEQ ID NO: 2528 - protein, 395 aa, Mycobacterium smegmatis
MTTSAHSAGIVIVGGGLAATRTAEQLRRSEYAGPITIVSDEDHLPYDRPPLSKEVLRAENDDVTLKPAEFYEENNITLRLGSGAQSVDTAAQTVRLADGSELPYDELVIATGLVPKRIGSFPDLQGIRVLRTYDESMALREDARKASRAVVIGAGFIGCEVAASLRKLGVDVVLVEPQPTPLASVLGEKIGALVTRLHRAEGVDVRCGVGVTEVRGTQNVETVVLADGTELEADLVIVGIGSRPSVDWLKGSGIEVDNGVVCDEVGRTSAPHVWAIGDVASWRDHVGGQVRVEHWSNVADQARAMVPALLGQEASAVVSVPYFWSDQYDVKIQCLGEPESDDTVHIVEDDGRKFLAYYERDGVLVGVVGGGMPGKVMKTRGKIAAGAPIAEVLGG

SEQ ID NO: 2529 - protein, 119 aa, Methanocaldococcus jannaschii
GSMKKVEAIIRPEKLEIVKKALSDAGYVGMTVSEVKGRGVQGGIVERYRGREYIVDLIPKVKIELVVKEEDVDNVIDIICENARTGNPGDGKIFVIPVERVVRVRTKEEGKEALEEHHH

SEQ ID NO: 2530 - protein, 187 aa, Phelipanche tunetana
FGHHSRKWNPKMKPYISAERKHRHIINLTKTARFLYEACNLVFYAASRGRQFLIVGTNKMRDDLVEQAAIKAQCHFVNKKWTCGTLTNWSITEARLQKFRNLIIEQKAERLDCLPKKDAAVVKRQLSRFQKNLGGIKYMRGLPDIVIIRDQDEDFTALHECLNLGIPTICLIDTNSDPDLADISIPA

SEQ ID NO: 2531 - protein, 159 aa, Gossypium hirsutum
MGFTEKQEGLVKESWEVLKQDIPHSSLRFFSLILEIAPGAKNMFSFLRESEEIPQNNPKLKAHAVKVFKMTCESAIQLREKGEVVVADTTLKYLGTVHVKSGVKDPHFEVVKEALLRTIEEAIGEEKWNEEMKNAWGEAYDQLAEAIKAEMKNHHDETA

SEQ ID NO: 2532 - protein, 156 aa, Solanum lycopersicum
MGFTDKQEALVRDSWEFMKQDIPQLSLRFFSLILEIAPVAKNMFSFLKDSDELPENNPKLRAHAVKVFKMTCESAIQLREKGEVVVGETTLKYLGSIHLQKRVADPHFEVVKEALLRTVKEATGNKWKDEMKEAWSEAYDQLASAIKAEMHAEAAA

SEQ ID NO: 2533 - protein, 161 aa, Brassica napus
MGEIVFTEKQEALVKESWEILKQDIPKYSLHFFSQILEIAPAAKDMFSFLRDTDEVPHNNPKLKAHAVKVFKMTCETAIQLREKGKVVVADTTLQYLGSVHFKSGVLDPHFEVVKEALVRTLKEGLGEKYNEEVEGAWSKAYDHLALAIKAEMKQEDSQKP

SEQ ID NO: 2534 - protein, 163 aa, Gossypium hirsutum
MATYEGKVFTEEQEALVVKSWTVMKKKTAELGLKFFLKIFEIAPSAKKLFSFLRDSNVPLEQNTKLKPHAMSVFVMTCESAVQLRKAGKVTVRESNLKKLGATHFKYGVVDEHFEVTKFALLETIKEAVPDMWSDEMKNAWGEAYDRLVAAIKIEMKACSQAA

SEQ ID NO: 2535 - protein, 299 aa, Legionella pneumophila
MWNLSSRVHALNHFPKQGIECYVKRDDELGCGISGTKIRKYSSLIPFLKINGIRHLIIIAGAQSNNLLAALQVARECQLKVTAFLVKPKHLKIQGNFKLSLLFLHENEIIWINREEWYRVNEFAEQYLEGLRETAYILSEGASVKESMKGAMSLASDIKENEKILGFAFDHIFVDAGTGFSAIALIKGFYELQHKGFIHVLLLADSEEVFKKKLMHWAGVNPDNYACFYPTTAKSFGSVNQTIKQEIKRLAYEEGILADPIYSAKLFYEARKYIETYQLKGRALIIHSGGVLTVPGFDF

SEQ ID NO: 2536 - protein, 412 aa, Rhodococcus aetherivorans
MTSDIVVIGGGVAGVSAVQSLRSEGYDGRLFLIGKERELPYDRTSLSKAVLAGDLADPPPLSPADWYDELQVETVLDRTVLQVDVTRKEVLLDGGRSLEVDRVLLATGASARVPSFSGADLPGVTTLRTVDDAQRLRQDWEPGQRLVVVGGGLIGCEVATTARKLGLEVSILEASDELLQRVLGRRIGGWCRARLEELGISVMVNTGVAEFDGVDRITAVIGTDGRRFPADSAIVCVGAEPETAIAEQAGLACSRGIIVNDSGGTAAEGVFAAGDAASWPLRTGGRRSLETYINSQKEATAVASAMLGKAVHAPQLPLSWTEIAGHRIQMIGDIEGSGEYVMRGAPDDGPALLFRLTDGKLTAALSVDAPREFAMATRLVESGAQVGRDVLADTSVELRELNRAARERTTAA

SEQ ID NO: 2537 - protein, 160 aa, Medicago sativa
MGTLDTKGFTEEQEALVVKSWNAMKKNSAELGLKLFLKIFEIAPSAQKLFSFLKDSKVPLEQNTKLKPHAMSVFLMTCESAVQLRKSGKVTVRESSLKKLGANHFKYGVVDEHFEVTKFALLETIKEAVPEMWSPAMKNAWGEAYDQLVNAIKSEMKPSS

SEQ ID NO: 2538 - protein, 361 aa, Oryza sativa
MEEISHHFGVVGASGVHGGHQHQHHHHPWGSSLSAIVAPPPPPQLQQQQTQAGGMAHTPLTLNTAAAAVGNPVLQLANGSLLDACGKAKEASASASYAADVEAIKAKIISHPHYSSLLAAYLDCQKVGAPPEVAARLTAVAQDLELRQRTALGVLGAATEPELDQFMEAYHEMLVKYREELTRPLQEAMEFLRRVETQLNTLSISGRSLRNILSSGSSEEDQEGSGGETELPEIDAHGVDQELKHHLLKKYSGYLSSLKQELSKKKKKGKLPKDARQQLLNWWELHYKWPYPSESQKVALAESTGLDLKQINNWFINQRKRHWKPSDEMQFVMMDGYHPTNAAAFYMDGHFINDGGLYRLG

SEQ ID NO: 2539 - protein, 465 aa, Magnetospirillum magnetotacticum
LALVLMDAGYSTSLRDLMRNWRPIAGLAVGAVAATTAAVADIALWLVPDMPLSAAIVLGAVVAPPDAVAALSVLAHVSLPHRLATILRGESLLNDAASLLIYRLGVAAAVTGHFSAAEVAPAFLIGVVGSLVAGPLAALVYLRILRRVEEPMSTIVLQFSAAFGLWIVAEAVELSGVLTVVSFAITVARRAPGQTAPRLRVVSKAVWETAIFVLNVLAFVLIGEQIGPILARMSPEQETAYISVAGAVVATVILIRIAWVLPASALRRLGFEGGEAAGDPRQARDLGLGAGFALAWSGMRGLVTIAAALALPEGGPGGGAFPYRDLIVLTAFCVVIGTLVVQGLTLRPILGRLGLRDSDPVGFEVGRARAEAYGAAVEALRDDHSEAADALRREFHAALAEAEAHEEGLAPEGLPTDEPRRRAVRAARDRLLALRRSGSIGDDAYFVLEEELDWAELNATPRAEA

SEQ ID NO: 2540 - protein, 67 aa, Oryza sativa
  misc_feature (31)..(31): Xaa can be any naturally occurring amino acid
  misc_feature (51)..(51): Xaa can be any naturally occurring amino acid
  misc_feature (59)..(59): Xaa can be any naturally occurring amino acid
ARASALVGLDATSLNAGYAADGYARARGVGXCAVTFTVGGMSVLNAIGGAXSENLPLIXCIVGGPNS

SEQ ID NO: 2541 - protein, 183 aa, Leifsonia xyli
MELTDVHDDLTEILITEEQIRSRIAELSREIERDYAGKDVLLIGVLKGAVMVMADLSRELSVPVTMDWMAVSSYGSGTVSSGVVRILKDLDTDLSGKTVLIVEDIIDSGLTLSWLLANLHSRGPESIEIFALLRKPEAARVEIDVRYVGFDIPNKFVVGYGLDYAERYRTLRGVGILAPAVYS

SEQ ID NO: 2542 - protein, 232 aa, Ginkgo biloba
MTKGYWNINLEEMMEAGVHFGHQARKWNPRMSPYISTERRGIHIINLAKTARSLSEACDFVFDAAGKGKQFPIVGTKYQAADLVASAAIGARCHYVNKKWLGGMLTNWSTTETRPQKFKDLKKERDTGRFNRPPKKETAMLKGQLSQLQKYPGGIKYMTSLPDIVIIVDQQEEYTAIGECIILGIPTICLVDTDCDPDLIDVPIPANDDARASIRLILNKLTSAICEGRHSV

SEQ ID NO: 2543 - protein, 988 aa, Herminiimonas arsenicoxydans
MLLTRKSNAAERSPARFTSSLADSLSRALPTMDRRGFLKRSGIGIGAGIAVAQLSLIQKARAAEGGKAAAAGSKIEVKRTVCTHCSVGCASDAIVENGVWVRQEPVFDSPINLGAHCAKGASLREHGHGEYRLKYPMKLVNGKYQRISWDQAMNEITAKMLDIKKASGPDSVFFVGSSKHNNEQAALLRKFVSFFGTNNTDHQARICHSTTVAGVANTWGYGAMTNSYNDMQNSKAALYIGSNAAEAHPVSMLHMLHAKENGTKMIVVDPRFTRTAAKADQYVRIRSGTDIPFLYGLLYHIFKNGWEDKKYINDRVYGMEKVKAEVMTWTPEKVEEACGVTEAEMYRAAETMAKNRPSTLVWCMGQTQHSIGNAMVRASCIVQLALGNIGVSGGGANIFRGHDNVQGATDVGPNPDSLPGYYGLATGSWKHWCAVWGVDYEWVKKQYVSQAMMEKSGTTVSRWVDAVLEKSENIDQDNTVKGVLFWGHAPNSQTRGLDMKKAFDKLDLLVVIDPYPSATAAMAAMKVDGQELNPNRAVYLLPAATQFETSGSVTASNRSLQWREKVIEPLFESRTDHMIMYQMAQKLGFGKELVAKIKLVPGKGGMMEPEPESMLEEINRGSWTIGYTGQSPMRLKAHMRNMHLFDVKTLKCSAGKDAATGYDISGDYFGLPWPCYGTPELKHPGTPNLYDTSKSMMEGGGNFRANFGVEKDGVNLLAEDGSHSKGADITTGYPEFDHILLKKLGWWDDLTDAEKKAAEGKNWKTDLSGGIQRVTMKVHGVHPWGNAKARAVVWNFPDAVPLHREPIYGTRPDLVAKYPTHDDKKGFWRMPTLFKSLQDKNVETKMYEKFPIILTSGRLVEYEGGGEETRSNPWLAELQQDAFVEINPKAAAARGIRNGEYVIVSTPTGARIKVKALVTMRVGEDTAFIPFHFSGWWQGKDLLEYYPEGAHPIVRGEAVNTATTYGYDSVTMMQETKTTICNIEKAAA

SEQ ID NO: 2544 - protein, 316 aa, Kineococcus radiotolerans
MPRTPQLSLPDLSGRRALVTGASDGIGFGIARRLAGAGAEVLLPVRNRTKGEAALARIREQHPTAKVTLHDLDLSSLSSVAALGDELRAEGSPIHLLINNAGVMTPPQRQTTVDGLELQLGTNHLGHVALVAHLLPLLRAGRARVTSQISVAARSGAVHWEDLNWEDSYHGMRAYSSSKIALGLFGLELDRRSRAEGWGITSNLSHPGVAPTSLLAARPELQRERNTPQIAVIRRLSRAGILVGTVDSAQLPALHAATAPQAQGGRLYGPTGPGNLGGGPGEQPLYRPLRDQTEADRVWTVSQALAGVSFTTTARI

SEQ ID NO: 2545 - protein, 563 aa, Gluconobacter oxydans
MTYTVGHYLAERLTQIGLKHHFAVAGDYNLVLLDQLIEQGGTKQIYDCNELNCSFAAEGYARANGAAAAVITFSVGAISAMNGLGGAYAENLPILVISGAPNSNDHGSGHVLHHTIGTTDYSYQMEMAKHVTCAAESITSAETAPAKIDHVIRTMLREKKPAYLEIACNISAAPCVRPGPVSSLHAHPRPDEASLKAALDESLSFLSKANKVAILVGTKLRAAEALKETVELADKLGCPVTVMAAAKSYFPETHPGFRGVYWGDVSSPGAQEIIEGADAVICLAPVWNDYSSGGWKSVVRGEKVLEVDPNRVTVNGKTFEGFRLKEFVKALTEKAPKKSAALTGEYKPVMLPKADPSKPLSNDEMTRQINELVDGNTTLFAETGDSWFNAVRMHLPEGAKVETEMQWGHIGWSVPSMFGNATASPERKHVLMVGDGSFQLTAQEVAQMVRYELPVIIFLVNNHGYVIEIAIHDGPYNYIQNWDYAALMQCFNQGVPGEESGKYGLGLHATTGAELADAIAKAKKNTRGPTLIECKLDRTDCTKTLVEWGKAVAAANSRKPQSV

SEQ ID NO: 2546 - protein, 1008 aa, Mannheimia succiniciproducens
MFIHRYFEDPQALHINTTPHHAYFIPQKCGQKWENFEPEQSLFYLSLNGYWDFRYYLSPQELPESPNEVNFEAKIPVPSNWQTQGYDRHHYTNINYPFPFDPPYVPQNNPCGIYRRTFELNKKENKHYLLNFEGVDSCLYVYINQTFVGYGQISHSTNEFDITDFVQAGNNEIFVVVLKWCDGSYLEDQDKFRMSGIFRDVYILEREANYLQDFFIRTDLSPNLNNAQIKVETKFLENNQNIDYALYDPSGKLLIQQQTDKFEISFDNPETWNAENPRLYTLIMSYGQEQIVQRLGFRRIQIENGILLFNGQPIKFRGVNRHDSDPVTGYHISRTQAVRDLQLMKAHNINAIRTAHYPNAPWFSELCDRYGFYLIGESDIESHGSSMLAVRQTEPSIFLNVKNSYEHERIRQDNIDNLCYFARDPQFKEALLDRTYANVERDKNRTSVIIWSLGNESGYGENFEACAAWVKSRDPGRLVHYESSIYQHSAHRNDLSNLDFYSEMYAATEDLDAYFANPANLKPFMLCEYSHAMGNSNGDAEDYFQAFHRHPGSCGGFVWEWCDHAPYRDDKPEHFGYGGDFGESPHDGNFCVDGLVSPDRIPHTNLLELKNVNRPVRAWLEQGKVYIKNYLDFTNLKEILTIRYSFSENGKVINQSELQIDCAPHQIQVLDIALPADNGNLCWLNLDYVLTQPTDLLSKNHLLGFDQLIIFKQGALPAQIFKNKTGHFKIQDTAQTLKICQGDFSYELDKNKGIFSRITYREQNLIEQPLDFNIWRAPLDNDRLIRQSWQQAGYDKTYSRAYQINWIEKNEGILIQANLALLAVSQGRILNLAVNYLLGADGQMKISLRATRPEHLPYLPRFGLRFFLPKGQTQGQYFGYGPQESYVDKHHLAKLGIYPLNATDNYVDYLKPQENGSHYGSRYITLNSLHVSADQPFSFNLLPYSQEELTTKAHNYELKESPWDILCLDYKMSGIGSNSCGPNLKEQYRLSETDFNWGVFLQWSNPAR

SEQ ID NO: 2547 - protein, 488 aa, Unknown
  Nostoc sp. PCC 7120
MQIQTPNWVKNAVFYQIFPDRFARSKQPHKRLLRDARWEDWDAMPTLQGYKGGDLWGIMEQLDYIQDLGIDAIYFTPIFQSASNHRYHTHDYYQVDPMLGGNAAFKELLDASHERNIKVVLDGVFNHSSRGFFFFHDVLENGPHSPWVNWFKIEGWPLAPYTGELPANYVGWADNRALPVFNHDNPEVREYIMEIAEYWIKFGIDGWRLDVPFEIKTPGFWQEFRDRVKAINPEAYIVGEVWGDSSEWLDGTQFDGVMNYLFAGPTIAFAAGDRVVLEQVQSRDYQPYPPLFAAEYATKIQEVLQLYPWDIQLTQLNLLASHDTARLLTIAGGDQASIQLATLLLLTFPGAPSIYYGDEVGLPGGIDPDSRRGFPLEANWDREIYQTHRQLIALRRTYPALRTGDYQVIWAQGALYIFARTLGKEELIIAVNVGTATAQANVDVASLQTQPNKILYGQAEFHWHNTEETKQLFLSLPPRSGCILGLGD

SEQ ID NO: 2548 - protein, 480 aa, Magnetospirillum magnetotacticum
MKKSLFLNPPSFDGYDGGAGARFQAKREIKSNWYPTWLAQPAAMVPGSKLVDAPASGKTLDDCLKLAKDYELLVIYAGAATYASECKVAEAFKAANPNIMIGMVGAHVATVPEVSLMASEAVDFVARHEFDYTIVEVAEGKPFAEIDGLTFRGEDGKPVHTKDRTLIHDMDALPYVGPVYRRDLNPEDYFIGYIRHPYMAFYTGRGCKSKCSFCLWPQTIGGRVYRARSAASVIEEVKLARQMFPEVREFFFDDDTFTDDLERVEEIARGIGHLGVPWSCNAKANIPRKTLEVLKANGLRVLVVGYESGVQEILNNIRKGLRIDIIKRFSQDCHELGIVLHGTFILGLPGETKETIKQTLAFAKEVNPRTLQVSMAAPYPGTELYEQAIANGWFKQDKELLMKETGGGGYQVAALSYPDLTSEEIFKGVAEFYKAFYFRPAKIGEIVWEMLQDWDMMKRRLREGVEFFQFLRTRNKPMEC

SEQ ID NO: 2549 - protein, 381 aa, Bifidobacterium longum
MADYYETLGVERGASDDEIKKAYRKLSRKYHPDIAGPEFEDKFKEVNNAYDVLSNPDKRRMYDSGVDPNNPNAGAGGFSGAGFGDMSDVFSTFFGSAFGGGSQGPVPRTQPGRDALASASIDLKTAVFGGTAHVKINTFSLCQECGGSGAQGGAQPVTCPDCHGQGFMQKVVRTMLGQMMTSAPCERCEGHGTIIQNPCPSCMGHGRVRTTRTVGVTVPAGINDNARLRLANQGEVGEGGGAAGDLYIDIRIKADKQFTRDGDDLHCWIQVPMSWAVLGHDLSIDTFDGEKTVSIPAGCQTEDTVTLKGLGVTNIRNKDERGNLIAHVNVLIPTKLNETERGLIEQFAASHDSGATHVSQASRPQAGQKKGFFSKLKDALS

SEQ ID NO: 2550 - protein, 235 aa, Typha latifolia
MTRRYWNINLEEMMEAGVHFGHGTKKWNPRMAPYISAKRKGIHITNLARTARFLSEACDLVFDAASRGKSFLIVGTKNKAADLVASAAIRARCHYVNKKWLGGMLTNWSTTETRLSKFRDLRAEEKMGKLNRLPKRDAAMLKRKLYTLQTYLGGIKYMTGLPDIVIIVDQQEEYTALRECAILGIPTICLIDTNCDPDLADISIPANDDAIASIRLILNKLVSAICEGRSSYIRN

SEQ ID NO: 2551 - protein, 276 aa, Chlamydophila caviae
MEEQPLCTLSVKDLMEAGAHFGHQTRRWNPKMKLYIFEEKNGLYIINLAKTLYQLRNALPHVCKVIKENKPILFVGTKKQAKCVIKEAAIEAGEYFVAERWLGGMLTNMATIRNSIKTLDKIEKDLTQNSSCLTKKEIALLAKRHQKLLKNLEGIRYLRKIPGLVIVVDPSYEKIAVAEAKKLGIPVLALVDTNCDPTPIDYVVPCNDDSLKSIRLIISAIKDNIINTKKKLGVEIVSPIKTLSTEDGSEEIDIAAGDDNRKEDLLAKKYDSNEAN

SEQ ID NO: 2552 - protein, 206 aa, Nitrosomonas europaea
MKSARTSRAWIKAHINDNFVRKANHEGYRSRAAYKLREIAEHDALFVPGMTVVDLGAVPGSWSQVALESVGPTGKVFALDMLDMQPLPGMTFIQGDFRENEVLAMLEAALGGKRADLVISDMSPNLTGIRVSDQAQGMYLAELALIFCREHLNPGKNFLVKVFQGSDFEAFRQMMQTDFSKVVIRKPKASRDRSKELYLLGLEKII

SEQ ID NO: 2553 - protein, 244 aa, Exiguobacterium sibiricum
MAVISMKQLLEAGVHFGHQTRRWNPKMAKYIFTERNGIYIIDLQKTVKKVDEAYNFIREVASEGGNVLFVGTKKQAQDTVKEEAIRAGQYFINERWLGGTLTNFSTIKKRINRLKQLEKMEENGTFEVLPKKEVIILKKEMTRLEKFLGGIKDMPGVPDALFIVDPRKERIAIAEAHKLNIPIVAIVDTNCDPDEIDYVIPANDDAIRAVKLLTGKMADAILEVKQGEDNVAPETTEEVVADAE

SEQ ID NO: 2554 - protein, 501 aa, Nitrosomonas europaea
MRSLHHSGNIFNGSNDSLLVKFRCLYMDYLPVFLNIKQRDCLVVGGGEIAVRKIRLLLRAHARIHVVSPAISEELSNLLLQSPVITHTAESFRPDHLQDRALAIAATNDHEVNRAVSAAARKAGIPVNVVDNPDLCTFIMPSILDRSPIIVAVSSGGTSPILARLLRSRLEALIPSAYGRLAEYAARFRDKVRQRFIHQENRRFFWERMLQGPFAEMVFAGRDQAAQDYLSEALENSTDQFPTGEVYLVGAGPGDPDLLTFRAMRLMQQADVVIYDRLVSPAILDMVRQDATRIYVGKVRNQHTLPQTSINELLVKLAQEGKHVLRLKGGDPFIFGRGGEEIETLSQHHIPFQVVPGITAASGVASYAGIPLTHRDHAQSCVFVTGHLKDNTIQLDWPALARPNQTIVVYMGLLGVTELCRQLIAHGLQATTPAAIVQQGTTPNQRVLTGTLETLPDIIQQNPLKPPTLIIVGNVVKLHQKLAWFNSTSEPMGTSSGPGYP

SEQ ID NO: 2555 - protein, 665 aa, Beta vulgaris
MTYINSFIWDCLFSQDSPVFNYISNLSPIQPVKAGPVSQGFPELASPPLVFTSPRITSLHSFGNSVYLFASEKFSQDHDNCQRNERDLGHSMKVVPEFRSPLVPSDQKTCNTEKLVSVAHCSPSGCFDDYLGDPGQSANFTHKMQSDNAPPSAKGGCLKKIGVVDGRDMGPFCSASQKGRDSAQPRSRISVKLVKNESRHMTSLSECSGALPRLLTDHISQSGDSFSEGFCLEHSKRRDSDKGEGIEEMLCLFRGMRIRGGIGIKASQLERGTLRRCLFDESQRKNSADQFGFSNPIVNAQIQESANMSYGKSGNRHMINLSKPAIDASVSPGNYPVVISKSLGIGLHLNSVVYSGSTDSAIGSQQSSMVSVEGNSSPQITNNQSDGKINASNIVGISSASREEIDQHQAHLVPAYDTTIAPDLDEQFNTAIDAKLDPCSTITNDKRKSSPDLDENDSSLGSPKKTRQASNCLTKKASTSTDDDTTKRCNCKKTKCLKLYCDCFAAGFYCGESCACQGCFNRPEYEDTVLETRQQIESRNPLAFAPKVMQTVTASPTTGKVVEKLSTPSSARHKRGCNCKKSMCLKKYCECYQANVGCSEGCRCEGCKNIYGVREGAYTYISKSETCTFSTNYMHIQFKSWKTTLDNLSFRNWSTVGCSRPGGVY

SEQ ID NO: 2556 - protein, 640 aa, Spinacia oleracea
RDIILAYMQNGEKLSPDHGYPVRMIIPGFIGGRMVKWLKRIIVTTTESDNYYHYKDNRVLPSHVDAELANSEAWWYKQEYIINELNVNSVITSPCHEEILPINAWTTQRPYTMRGYAYSGGGRKVTRVEVTMDGGDTWDICELDHQERGSKYGKFWCWCFWSLEVEVLDLLGAKEIGVRAWDESLNTQPEKLIWNVMGMMNNCWFRVKTNVCKPHKGEIGIVFEHPTQPGNKSGGWMARERHLEISDSGPTLKRTASTPFMNTTSKMYSMSEVKKHNTADSAWIVVHGNVYNATRFLKDHPGGSDSILINAGTDCTEEFDAIHSDKAKRLLEDFRIGELISTGYTSDSSSPGNSVHGGSVYSGLAGLAPITEAVPLRNVALNPRVKIPCKLIEKVSLSHDVRRFRFGLPSEDQVLGLPVGKHIFLCANVDDKLCMRAYTPSSTIDVVGYFDLVVKVYFKDVHPRFPNGGVMSQHLDSLSLGSIVDVKGPLGHIEYLGKGNFTVHGKPKFAKKLAMISGGTGITPIYQVMQAILKDPEDKTEMHVVYANRTEEDILLREELDKWADEFRDRVKVWYVVEKAEEGWKYDTGFISEKILRDHVPAVGDDVLALTCGPPPMIQFAVQPNLDKMGFDIKEQLLIF

SEQ ID NO: 2557 - protein, 362 aa, Unknown
  Burkholderia sp. 383
MATPQFHPLRIRDVRPETADAVTVSFDVPPELRDAYRFTQGQFVTLKTHIDGEETRRSYSICVGTTDYDRDGELRIGIKRVRGGRFSNFAFDSLQPGHTIDVMTPDGRFFTHLNADHGKQYVAFSGGSGITPVLAIVKTTLELEPRSTFTLIYGNRSVDAIMFAEELEDLKNRYMNRFVLYHVLSDDQQDVELFNGVLDQTKCAEFLGTLTPADAIDEAFICGPAPMMDAAEAALKAAGVPQAKVHVERFGTPLPQAGAPVVEITDQTPAADLEIVLDGKKRKLRLPYEGVSLLDVGLRAGLALPYACKGGVCCTCRAKVLEGEVRMEKNYTLEEHEVKDGFVLTCQCHPISDKVVVSYDER

SEQ ID NO: 2558 - protein, 370 aa, Medicago sativa
MPSFFAPTRRFSLASPLLLLGLFTINLIPTADAQIGVCYGMMGNNLPPANEVIDLYKANNIKRMRLYDPNQAALNALRNSGIELILGVPNSDLQSLATNSDNARQWVQRNVLNFWPSVKIKYIAVGNEVSPVGGSSWLAQYVLPATQNIYQAIRAKNLHDQIKVSTAIDMTLIGNSFPPSKGSFRNDVRAYLDPFIGYLVYAGAPLLVNVYPYFSHVGNPRDISLPYALFTSPGVMVQDGPNGYQNLFDAMLDSVHAALDNTGIGWVNVVVSESGWPSDGGAATSYDNARIYLDNLIRHVGKGTPRRPWATETYIFAMFDENQKSPELEKHFGVFYPNKQKKYPFGFGGERNGEIVNGDFNATISLKSDM

SEQ ID NO: 2559 - protein, 112 aa, Herbaspirillum seropedicae
MKQVTAIIKPFKLDEVRESLAEVGVTGLTVTEVKGFGRQKGHTELYRGAEYVVDFLPKVKIEVVVDDKVVEQAVDAIIKAARTGKIGDGKIFVQEVEQVIRIRTGETGPDAV

SEQ ID NO: 2560 - protein, 670 aa, Vibrio vulnificus
METELRKITMTTSLARPYPLGATLHDKGCNFAVHSPDCASIRLALFDDNNEFKTFELCEEYAGIRYTFVENVQHGQKYGYIIDTDNGPLLLSDPYAKALDGPLHYQTPYSAEKSFSMPKCVVYQDDFDWQGTESPRIPREEMVLFETHVKGLSKLNPEVPPAAQGRYLGLVSDAMLAFYRQQNINTLQLLPVAACMHEPHLLDMGKVNYWGYNPYLFMVPDPRYADKDAILELKTAIRELHRNGIQVILDVVYNHTAEGGAGPTVFNLKGLDSRCYFKHGSHFANFTGCGNTVDLTYQPALNLVMDTLRYWVSEFKVDGFRFDLAATLGRQGDDYSRDAAFFKAVAQDPVLKETKLIAEPWDIGPNGYQVGNFPFGWNECNDKLRDITRSFWRGDQGYLKEFATRLMGSRDIYSAANWPYKLTVNYITYHDGFTMQDLVSYKHKHNEDNGEQNRDGHGDNRSENYGAEGPTENLMIIATREKQKRNFMASLLFAFGIPHILTADVLSHSQKGNNNAYCQDNETSWLNWEHSERKHDFRHWLAQMVENRQRYMVPFIRAFSGPSRNLNRIYWRRVDGVHMEHDDWNRLSAVSLHIGIGEKGDEMVYLINQTSAPARFTLPDDNQQQWTYICDTNVRNVSPELAQGEVLLSPVSMAILHYHPQESTPPTAAV

SEQ ID NO: 2561 - protein, 165 aa, Phelipanche nana
KWNPKMALYISANRNGIHITNLIKTARFLSEACNLVFDAASRGKQFLIVGTKKKTANSVACAAIKARCHCVNKKWLGGTLTNWSTTERRLHQFRDLRIEQKIGRFKRLPKRDAAVSKRQLSRLQTYMGGIKYMTGLPDIVIIIDQHEEYTALRECITLGIPTICL

SEQ ID NO: 2562 - protein, 396 aa, Coprinopsis cinerea
MAQAEQVCITEVLDGRIYLGNLAAARDVERRNQLGITRVLSVCPDYPSEGGDHHEVIDVEDDEYQDILVHLPGACAFIQRAVDRREKVLVHCKMGISRSATVVAAYQRHQIHPNYGFIKQLEAFEKCKDEESLGPLNPVYKSWKRRHRQDVTCYLNRLEDVALIIPDRLMLMSHFPEDEQQGRSLLANIGITHLVTLSPAGSKLLPRDALKDAHHIEVPEEDPDSVMDLLLGAVTFIQRAAEQEGRVMIYSENEPRACMTACAYLVATGRATNSEEARAVVQEAVLLGEPPEAWQRRLKLLDEPSFKQSLEDALSAATVSTASDVSGSSPGSSSGPGTPRDGVTEPLYLPNPAVITGKPFKMEGVMDALSAIQEATKKEFASSPVVAPRITASVVA

SEQ ID NO: 2563 - protein, 527 aa, Oryza sativa
MTFSGMDIALKASTHSSTSQQHWLHSTRYRCQYGLGSTHLNGRKRSPMVLSVRAVSGKSDLDFSDPSWKEKYQEDWNRRFSLPHITDIYDLKPRLTTFSLKKNRTDGGSLSADKWNGYVNKDDRALLKVIKYASPTSAGAECVDPDCSWVEHWIHRAGPRKEIYYEPAEVKAAIVTCGGLCPGLNDVIRQIVFTLEIYGVKNIVGIQFGYRGFFEKGLKEMPLSRKVVENINLSGGSFLGVSRGGAKTSEIVDSIQARRIDMLFVIGGNGSHAGANAIHEECRKRKLKVSVVAVPKTIDNDILFMDKTFGFDTAVEEAQRAINSAYIEARSAYHGIGLVKLMGRSSGFIAMQASLSSGQIDVCLIPEVSFTLDGEHGVMRHLEHLLEKKGFCVVCVAEGAGQDLLQKSNATDASGNVILSDFGVHMQQKIKSHFKDIGVPADVKYIDPTYMVRACRANASDAILCTVLGQNAVHGAFAGFSGITSGICNTHYAFLPITEVITKPKRVNPNSRMWHRCLTSTGQPDFH

SEQ ID NO: 2564 - protein, 298 aa, Pseudoalteromonas tunicata
MNIVLPESPLQKITHPLLSHHNISLTVKRDDLLHPIISGNKWRKLKYNLIHAQQNKINHLISFGGPFSNHIHALAAAGRIFGFKTSAYIRGPELDNQNPTLRFAKSCDMQLIAVDRITYRQKDDLGYLASLSAKHPNCLIIPEGGTNSAAILGVIELAQTLHQADVLVTPVGSAGTLAGLIEGAHTEQKIIGIAVLKQAEYLIEKMNQLSPKSNQYNNWQLMTQFHGGGYGKFNRELWHFCQSMQAYHLPLEPIYSGKMFFALFELIKQGYFQSGTKISAIHTGGLQGIAGLKYCGRI

SEQ ID NO: 2565 - protein, 276 aa, Capsicum annuum
MDTSSLDLIRQHLLDDDVVFMENYCTSSETTSTLYSQSSSSSESLESFVSELKTESNFSFYPESSNLEFCSFFNNNSKMEFNPSEFQVKPQKKKSFNERKPLLNISIPSVKKTDESKTGENSEKKRYRGVRQRPWGKFAAEIRDPNRKGTRVWLGTFDTAVDAAMAYDRAAFKLRGSKAILNFPLEVSNFRQENNEIEKKVNLNSCGKRAREEIENEDQVVMKKEVKREQMVATPLTPSSWAPIWDCGNAKGIFEVPPLSPLSPHPSFGFSQLLVS

SEQ ID NO: 2566 - protein, 96 aa, Saccharomyces cerevisiae
MFNAKYVAEATGNFITVMDALKLNYNAKDQLHPLLAELLISINRVTRDDFENRSKLIDWIVRINKLSIGDTLTETQIRELLFDLELAYKSFYALLD

SEQ ID NO: 2567 - protein, 525 aa, Sandersonia aurantiaca
MCGILAVLGCSDDSQAKRVRVLELSRRLKHRGPDWSGLDHHGDCYLAHQRLAIIDPASGDQPLYNEDKTIIVTVNGEIYNHEELRKGLPGHTFRTGSDCEVIAHLYEEHGESFIHMLDGIFSFVLLDSRNNSFVAARDAIGVTPLYIGWGLDGSVWISSEMKGLNDDCEHFKFFPPGHLYSSKEGSFKRWYNPPWFSEVIPSVPFDPLALRKAFEDAVIKRLMTDVPFGVLLSGGLDSSLVASVTARYLEGTKAAELWGTQLHSFCVGLEGSPDLKAAKEVANFLGTIHHEFHFTVQDGIDAIEDVIYHVETYDVTTIRASTPMFLMSRKIKSLGVKMVISGEGSDEIFGGYLYFHKAPNKEELHLETCHKIKALHQYDCLRANKATSAWGLEARVPFLDKEFVNVAMSIDPEWKMIKPDIGRIEKWILRRAFDDEENPYLPKHILYRQKEQFSDGVGYSWIDGLKAHSALHVTDKMMLNAAHIYPHNTPTTKEAYYYRMIFERFFPQIDSPWRSKCGLQHSKSY

SEQ ID NO: 2568 - protein, 147 aa, Pisum sativum
MGFTDKQEALVNSSWESFKQNLSGNSILFYTIILEKAPAAKGLFSFLKDTAGVEDSPKLQAHAEQVFGLVRDSAAQLRTKGEVVLGNATLGAIHVQRGVTDPHFVVVKEALLQTIKKASGNNWSEELNTAWEVAYDGLATAIKKAMT

SEQ ID NO: 2569 - protein, 185 aa, Brassica juncea
MASEAKESPANNPGLSTVRDEATKGYIMQQTMFRVKDPKASLDFYSRVLGMSLLKRLDFSEMKFSLYFLGYEDTSTAPTDPTERTVWTFGRPATIELTHNWGTESDPEFKGYHNGNSEPRGFGHIGVTVDDVHKACERFEQLGVEFVKKPHDGKMKNIAFIKDPDGYWIEIFDLKTIGTTAGNAA

SEQ ID NO: 2570 - protein, 186 aa, Cicer arietinum
MAASESKESPANNPGLHTTIDEATKGYFMQQTMFRIKDPKVSLDFYSRVLGMSLLKRLDFPEMKFSLYFMGYEDTTEAPSNPVDRTVWTFAQKATIELTHNWGTESDPEFKGYHNGNSDPRGFGHIGITVDDTYKACERFQNLGVEFVKKPDDGKMKGIAFIKDPDGYWIELFDRKTIGNVTEGNA

SEQ ID NO: 2571 - protein, 303 aa, Burkholderia mallei
MTFMAYKTIEDTIGNTPLVQLVRLPDDEIRARNNVILAKLEGNNPAGSVKDRPALSMIRKAEERGTIKPGDTLIEATSGNTGIALAMAAAIRGYKMVLIMPEDLSIERRQSMAAYGAEIVLTPVKGGMEFARDLADQMQREGKGVILDQFANPDNPLAHYEGTGPEIWRETEGRVTHFVSAMGTTGTIMGTSQYLKERNPTVEIVGAQPEEGSRIPGIRKWPEAYLPKIFDRSRIDRVENVSQAASEAMARKLAAVEGIFCGISSGGACEVALRVARQVENATIVFVVCDRGDRYLSTGVFPA

SEQ ID NO: 2572 - protein, 143 aa, Zea mays
RKIMKADEDVRMISAEAPVVFAKACEIFILELTLRSWMHTEENKRRTLQKNDIAAAITRTDIYDFLVDIVPRDEMKEDGIGLPRAGLPPMGAPADAYPYYYMPQQQVPGSGMVYGAQQGHPVTYLWQEPQQQQEQAPEEQQSA

SEQ ID NO: 2573 - protein, 290 aa, Gluconobacter oxydans
MAETWLNETLYPDWGQRFLVTRELARVKSDFQDVVVFESSSHGRVLVLDGVIQITERDEFVYQEMLTHVPLLAHPCAKRVLIIGAGDGGVLRRVLQHDTVEKAVMVEIDGAVIELSKQYLPDIAGDAWNDPRAEVIVGDGIDYVAKAADGSFDVIIVDSTDPIGVGEVLFTDEFYSNCARILSAEGLIVNQCGVPFMQADELYETSLRRAKFFPHVGAYVAAVPTYVGGFMTLGVASKGQAPNTQTVEQIRTRAEAAKILGTTRYWTPEIHVGSFNLPPYIAEHLPKTGK

SEQ ID NO: 2574 - protein, 262 aa, Nicotiana tabacum
  misc_feature (218)..(218): Xaa can be any naturally occurring amino acid
MDTSHWPQGIGLVKAVEPSKPVPTERKPRPQKEQAINCPRCNSTNTKFCYYNNYSLSQPRYFCKTCRRYWTEGGSLRNVPVGGGSRKNKRSSSSSNNSSSSTSSSYKKIPDLTIPTSSQNPKIINEPHDLNLAFNPSATSNFSNISEFMALPLMNPNSTTSFMSSIMPQLSDSNNIMYSSSSTGLPNLHDLKPTLNFSLDGFDNNNGYGSLQGETAGXKLFFPLDDLKNVSTPNDDHEFDEQNRGQAAESHGFWNGMLGGGS

SEQ ID NO: 2575 - protein, 255 aa, Unknown
  Bradyrhizobium sp. BTAi1
MTGRFDLRGKVAIVTGGNGGIGLGMARGLADSGADIAVVGRNAAKSKTAVADLAGRGVRAIAVTADVSNQYDVAAMVAQVSRELGRIDILINNAGMSIRKPPHLLELEEWREVIDTNLTSAFLCSKAAYPALKANGGGKIINIGSMLSIFGASFAPAYAASKGGIVQYTRACACAWAPDNIQVNAILPGWIDTDLTRAARQQIDGLHDRVLARTPAGRWGDIDDFAGIATFLSSPASDFVTGTAIPVDGGYSISA

SEQ ID NO: 2576 - protein, 289 aa, Datisca glomerata
DGSSTGQAPGEDSEVILYPQAIFKDPFRRGNNILVICDAYTPAGEPIPTNKRHAAAKTFSHPDVVAEVPWYGIEQEYTLLQKDIKWPIGWPVGGYPGPQGPYYCGAGADKAFGRDIVDAHYKACLYAGINISGINGEVMPGQWEFQVGPAVGISAGDELWVARYILETITEIAGVVVSFDPKPIQGDWNGAGAHTNYSTKSMREDGGYEKIKAAIEKLGKRHKEHIPAYGEGNERRLTGKHETADINTFLWGVANRGASIRVGRDTEKAGKGYFEDRRPASNMDPYVVL

SEQ ID NO: 2577 - protein, 612 aa, Leifsonia xyli
MCGIVGWVSFDRDLTEHRESVDAMTATMACRGPDAEGVWLDRHGALGHRRLAIIDVEGGSQPMSAHTDDGAVTLTYSGEVYNFSELRGELMRRGHRFETRSDTEVVLHGYLEWDEAVAERLNGMYAFAIWDARAEKLVMIRDRMGVKPLYFFTTDDGVLFGSEPKAILAHPLADRAVDLDGLREVVSFAQTPGSAVWCGMREIVPGGVVTVCRAGLREYRYWTLTTRPHTDDLPTTIARVRSLLEDTVGRQLVSDVPRCTLLSGGLDSSAITAFSAAQLAGHGEKVRSFAVDFVGREDDFVADDLRSTPDAPYAREVASHVGSQHETIVLDNDAIADPAVRRAVIAARDNPLSLGDLDASLYLLFQAIRAHSTVALSGESADEVFGGYRWFHQPEVQAAPTFPWMALPVSGSPTRVRDRFTAKITAALDLPAYLRERYTSAIAEVQPLENESAHERRMREICYLHLTRLVRMLLDRKDRISMAVGLEVRVPFCDHRLVEYVYNVPWAMKTFDGREKSLLRAATADLLPESVLQRTKAPYPTTSDPGYARTLIQQSRDLLSADDRVFGLVDRGRLEEITRQDPATMTLDVRNGMETALDLSTWLEIYQPELRM

SEQ ID NO: 2578 - protein, 655 aa, Bacteroides thetaiotaomicron
MRELKNHPSPDQLDSYDKYPCYYENDLELVYTPQQSIFTLWAPSADNVRLNLYSSGEAGDPEEQLEMDIADNGTWCIHIDRDLKGSFYTFQIEKDGKWLDETPGIWAKAVGINGNRAAVIDWNETNPEGWESDQSPELKMYSDIILYELHHRDFSIDPNSGIEHKGKFLALTETGTKTPEGESSGLDHLKELGVTHIHILPSFDFATIDERKLEKNKYNWGYDPKNYNVPDGSYSTDPVTPTTRIREFKEMVKSLHQNGFRIVLDVVYNHTASTEHSNFDLTVPGYFYRQNPDGSYSNASGCGNETASEREMVRHYIIESVKFWAKEYHIDGFRFDLMGIHDIDTMNQLREELLKIDPTIFVYGEGWVAADSPLPFEQRAVKENVRKMKGISVFNDEFRDGLKGSTFDEQEPGYASGNINGHFEPVKYGIVGGTQHPQVDYSGLLYCDGPYAAAPSQMINFVSCHDGYTLVDKLKLSVQGEHSEEELVPIDKLIHTVLLTSQGIPFIRGGEEIMQDKQGEPNSYKSSDAVNQIDWALKAKNRDIFNYIRTLIALRKKHPAFRIPTAEGLEKWLHFLDTGDSGVIAYTLGEYANGDEWKEILVAYNGNRNQADINIPEQDWIIVCHNGQIDLDSQEHLSGGDISITASSALILYRQ

SEQ ID NO: 2579 - protein, 430 aa, Corynebacterium diphtheriae
MLMNNADVRSQERKQVMVCARAAHRVAPIVAQLTSADKNAVLLDAAAALEAAGAEIIAANQRDIDQGRARGLSEALIDRLSLDSARIAGIAGGLRQVAALSDPVGEVVGGSVMPNGMQMRKVRVPLGVMGMVYEARPNVTIDAFGLALKSGNVALLRGSKSAQHSNAALVAVVHRVLESHGLPHEVVQLLPCETHESVQDLITARGLVDVVIPRGGAGLIEAVVTNATVPTIETGTGNCHFYIDRDVSDLDQAIAMLLNGKTRRCSVCNATETVLIDSALDSAYQLAIITALQEAGVTVHGDVAQLEAVGASGIVPADEHDWAEEYLSLDIACALVDGVDAAMEHIRTYSTKHTEAIATGNIVTAQRFADRVDAAAVMINASTAFTDGEQFGMGAEIGISTQKLHARGPMALPELTTTKWIVQGTGQTRP

SEQ ID NO: 2580 - protein, 951 aa, Gluconobacter oxydans
MPENLPVTTLWPAQTEDFSSRHIGPRPSEIGEMLRVVGASSLDDLIDKTIPAAILDRGDHGIGAALTEQDALARLRQIASRNQVLTSMIGQGYYDTVLPPVIQRNILENPAWYTAYTPYQPEISQGRLEALLNFQTLVADLTGLDIANASLLDEGTACAEAMALAQRVGKSKATAFFVDADTHPQTIAVIRTRAEPLGWDVVVGDPETDLDASSVFGALLSYPGSSGQVRDPRKVIAALHEKGAIAALACDPLALVLLESPGALGADIAIGSMQRYGVPMGAGGPHAAFMATRDAFKRHMPGRLVGVSRDSAGKPAYRLALQTREQHIRREKATSNICTAQALLAIIASMYAVYHGPEGLKAIAARTHRMAAILSAGLKTLGATVETDVFFDTITVQAGASAPQVLARAVASGINLRDAGDGRIGMSCDETTTPETIRAVWAAFAGEGADLSAIEQALDVADALPEGLSRTAPLLTHPVFHAHRSETDLLRYMRALADKDLALDRTMIPLGSCTMKLNATAEMIPITWPEFARIHPFAPADQVQGYTELFAYLERTLCAISGYDAVSLQPNSGAQGEYAGLLAIRGYHRARGDENRDVCLIPASAHGTNPASAQMAGMRVVVVACDENGNVDVEDLKAKIAQHDGRVAAIMITYPSTHGVFEERIVEICELVHAAGGQVYLDGANLNAQVGLARPGLYGADVSHFNLHKTFCIPHGGGGPGMGPIGVGKHLAPYLPGRHGIAVSAAPFGSASILPISAAYIMMMGDEGLRQATTMAILNANYIASRLEGHYPVLYRGTNGFTAHECIVDLRSLKDAVGVTVDDIAKRLIDHGFHAPTVSFPVAGTFMIEPTESEGKGELDRFCDAMIAIRAEIAEVEAGRVGMEDSPLRFAPHTTADLAGDWERSYSREAGCFPGGVDTAKYWSPVGRLDNAWGDRNLVCSCPDISTYVEG

SEQ ID NO: 2581 - protein, 376 aa, Corynebacterium diphtheriae
MNAQHSSADLRDVIRNAKRIVVKIGSSSLTGENFEVSPGRIDRIVEALEDRMHRGSDVIVVSSGAVAAGMAPLGLTSRPKDLATKQAAASVGQVHLANAWGNSFARYNRTIGQVLLTASDAGQRDRARNAQRTIDRLRLLHAVPIINENDTVATSEMHFGDNDRLAAIVSHLVSADALVLLSDVDGLYDKNPADPSARFVSEVRDGNDLKGVIAGDGGAVGTGGMASKVSAARLASRSGVPVLLTSADYVAEALGDAEVGTVFYPKDDRLSAWKFWALYAADTGGALRIDAGAVAAVTAGGNSLLAVGITEVIGDFHAGEIVEILGPEGEIIGRGEVAYDSAVLITMLGKQTAQLPEGLQRPVVHADYLSDYASRA

SEQ ID NO: 2582 - protein, 932 aa, Unknown
  Acinetobacter sp. ADP1
MNTIPAVQLQSTTDNQLEYSVQTTNTTCPYCGVGCGVSATVEKTVSGQRISVTGDQEHPSNFGRLCIKGSRLADTLGLETRLLQPMIGRGDLRKVTTWDDVTEQIATRFQQCIDTYGAESIAFYVSGQLLTEDYYVVNKFVKGYLGTANIDTNSRLCMSSAVAAHKRSFGEDLVPASYKDFEHTDMVVLVGSNTAWCHPVLYQRIMQAKTERDLTVVVIDPRFTATCEQADLHLPILPGQDVTLFNGLLQYLYQQGYTDHSFVTAYTENLDSALLASDAEADIKVVSEKTGIALEKLQQFYQMFAQTDKVMSLFSMGVNQSSQGVNKANAIINCHLLTGKIGQLGAAPFSMTGQPNAMGGREVGGLANMLAAHMELDQPLHQEIVQSFWHSPRIASKAGLKAVDLFQAVETGKIKAVWIMATNPLVSLPDADQVKRALNKCEFVVVSDICQDTDTTAFADVLLPALGWGEKDGTVTNSERRISRQRAFLDTPEHTKADWWAVCQVAKKMGFSGFEFEHAHQIFQEHAELSSYQNAAMSHRDEAKAFRYFNLSGLTQISQSDYDQLKPIQWPVLKSIDELNDTDSERLFVQGQYSHSSKKAKFIATDAIAPVHATTHQYPLILNTGRIRDQWHTMTRTGLSSNLTTHRAEPYCEIHPQDALKYGVREHGLVEVTSNWGKCVLRVHLSEGIRRGQVFAPIHWNDQFASDARIGKVVNPVVDSISGEPEFKHTPVMLNPFYVHWQGVLYIREGMEQLIQTCLKNVVWWTKVKMTKVNRFEIAGRNKLDEVQYALKDFLPFDDASFEWMNLSDTSMQMSHSIILKDGILIASLYIAPAEMLPDRDWVATLFKRERLSALHRKALLAGMPMSMSSHDGPLVCSCFKVGKNKIIETIKTQNITHEKQVTACLKAGGNCGSCLPEIRGLIKACQQEIDA

SEQ ID NO: 2583 - protein, 545 aa, Unknown
  Acinetobacter sp. ADP1
MSNLKQLNQIAENEWIDVCALSDITPNTGVTALIDDQQIALFRVGHEQRIYALSNQDPFSGANVMSRGIMGDLQGERVIASPIYKQHFSLATGRCLEDKEQKLLVFPCKVQSGRVWVSPVPQKTYITNNGLAQDKLKLVLVGNGLAGMRCLEDLLDMNPERYEITVIGEEPWGNYNRIMLSPVLSGEKTIEDIMLHPHQWYQDKAIRFVAGDPAIKIDRNRKQVHTQNGECVEYDRLILATGSKPFIPPIQGADLKGVISFRDIYDVNTMVDYASQKKHAVVIGGGLLGLEAAYGLKQRGMNVTVLHLMDRIMDRQLDAQASVMLRHSIEQKGIEIITEANTEALLGNDQGHVTHLRLKDGRVLDADLVVFAVGIRPNIRLAQSAGLRCNRGVLVNDTMQTFDPSIYAVGECIEHRGQTFGLVEPLWGQAFICASHLAEHGSLTFKAPTVPTQLKVSGVDVFSAGQIDIDVRQSEDGYEDIIMNDEKRQIYKRIIIQHDRVIGAVLFGDTEDGTWYAELIADQTPISSIRSKLLFGRDFALRKAG

SEQ ID NO: 2584 - protein, 2405 aa, Streptococcus pneumoniae
MNKRLFDKRCHYSIRKFAIGAASVMIGASICGISTVQAEEVASSNTQTEETIVHQAQPLDKLPDDVAAAIAKADENGGREFVKPKADSTEDKVTKDTEPTRPANEGSHELARPKVETPNKEEGNKAENKQKPEETNPKPIESAATAGTELKEDSKKTSGNDQVKADTERKPSSEKLQALSGESNKAEVEKEKQLLSERKQDFNKDWYFKLNAQGDFSKKDVDVHDWSKLNLPHDWSIYFDFDHKSPARNEGGQLNGGTAWYRKTFILNEADKNKDVRINFDGVYMDSKVYVNGKFVGHYPSGYNHFSYDITEFLNKDGSENSITVQVTNKQPSSRWYSGSGIYRDVTLSYRDKVHVAENGNHITTPKLAEQKEGNVETQVQSKIKNTDKKAAKVFVEQQIFTKEGKVVSELVRSETKNLAENEVADFRQTILVNKPTLWTTKSYHPQLYVLKTKVYKEGQLVDVTEDTFGYRYFNWTAKDGFSLNGERMKFHGVSIHHDNGALGAEENYKATYRKLKLLKDMGVNSIRTTHNPASPQLLDAAASLGLLVQEEAFDTWYGGKKTYDYGRFFDQDATHPEAKKGEKWSDFDLRTMVERDKNNPSIVMWSLGNEVEEANGSPRSIETAKRLKAVIKAIDTERYVTMGENKFSRAATGDFLKLAEIMDAVGMNYGERFYDAVRSAHPDWLIYGSETSSATRTRDSYYNPTQILGHDNRLNRHYEQSDYGNDRVGWGRTATESWTFDRDRAGYAGQFIWTGIDYIGEPTPWHNQDNTPVKSSYFGIIDTAGLPKNDFYLYRSEWYSAKEKPTVRILPHWNWTEETLKDRKMRVDGKVPVRTFSNAASVELFLNGESLGKKEFTKKTTEDGRPYHEGAKPSELYLEWLVKYQPGTLTAIARDEKGNEIARDSVTTAGEPARVRLTKEEHVITADGKDLSYIHYEIVDSEGNVVPTANNLVHFNLHGQGQIVGVDNGEQASRERYKAQADGTWQRRAFNGKGVVIVKSTEKEGKFTLYADSAGLTSDSATVATVSGKKENRHFVAFAPVKATTDVTTNPELPQTVTAIYSDGSVEEKTVTWDVPADLLTSAGEKKVSGRVEGLETKAEALVKVIALDRWLPKVATVPVGTTAADLDKTVTAVLTDGSLIDTDVVSWTLKDPAALTKEGGRTEATGKLVDDDREVTATFIASSKETTSSITGLTVGDKALENFESGKTYYRVSLPYTGTIPSVGAQTTGYQVTVQQASADNGYQASVFLSDQKGDLVQTYLIQFVKEAPALKRLEVVVEGKETATEDQVLTYRVIGSYEDGSQTEFSASDIHLEAKSSDGGHLEVNGQNLLLYTKGRVALTPRIDNQTEKTESVTTEVVIKENKVSKKIVKLHPVSVSIDINQQPNLPKEVGAEFDKGLPRKVSVTWDKVDEKELGHYHSFTLKGRVEGTDIEAQATVTVEGLQVAEEISLTLPKGETVQLPANVRAYHSNGTTVYKDVVWDQVPANFSQTEGVYEINGRLIGSNLTTKAHVRVSSQVVAGNNISKQWTGSQLPAAIVSNTGGDDSANTLNDLTVSRTPTDAKNRWTTWRTNTDNDWASILFGNSGDLTKRFVNNLSVDFYTDGAIGLPKEYVVEYYVGKEIPDLPSDVSNAQRDSNHPFNNPENWKAVENLHAPSQLSATQTNHFTFDKVETYAVRIRMKKADGTSGVGLTELTVLGNKVVSSTSSEISIRVDGKDLEHFNPSKTDYYIPQSSKQITATASNNGLVTVVPATSPKGATRLILKAEDGTVLKEYRIFRNDERETSQPLAAENGAKILNVGDNLQLPSEVDVYYPTSTTWTTEKLAVKWDAIPEHATEHEGTFEVTGHVIGTNLTTKMQVTVVSKGNQVISENPNNNETDSKAFASITNDTQAASHDRIFYINDGKYNEDGRWTNWTRTPKNQETSVGLLFKKDGKITSQSIGKVAIQFFKDSGTDAPEKMVLERYIGPAFTEPSTISRYEENADHPFNKAENWAPIPYKSSGELVAGKPIEFNFDPVQTTAIRARMTRKATTNGLALVEFTAYSAGKGAEVETPSATISIDGKALENFDPNVTEYTLTTMGSKPKVTATTSGHGVVTVVDHGNTNLPTLVRLISKDGNLVKEYRLHFKSTFQTTPTEGVKNLVAEAPSLEIEKTPLPFKEVVRETPALAQGKRRVVSEGQDGEKVDYIQVSGTTRTLVHTEQRKAQDRIIEVGVKPSISNSKGEEPAPVNEVPEFKGGVNFVEAAVNEVPEYTGILATVGDQAAPTVEKPEFKGGVNSVMALKHELPEYTGPVSTVGDQPAPTVEKPEFKGGVNAVMALEHKLPEYRGVLATVGNQPAPTVEKPEFKLSSVEKSQNPEAPVQVAKEGKRLPETGEKQSETAIFLASVTLALSAALLTAKRKED

SEQ ID NO: 2585 - protein, 436 aa, Prochlorococcus marinus
MTVESPIEKAIRPSVGLLGWYSVCASKLLKENELYHLSMFNEPLVIYRDKNNKPRCIKDSCPHRSASFRGGENENGEIVCPYHGGRFTTSCNQDGSDRITCKHIIDSHYDNFANHLHLRQYPCVEQGDYIYIYYTGEAQPSPNDFQIKSHLENSLPEAYGFDLKDYEYEEVFIDFKCDWSRIIENHLDILHIFWLHGNTLPGNDVNRKTIKSFNQSINKDQYHLRSVYHEKENNKEEFISQIFIPPGRVIIFKGATEQARYVQVLDHIPLSHNRARIIVRHYRKFLRNKLLCKLLLFKQRQQKVFYKIFSEDYLVLQTQTFNEQMGYLNQGQTKLLAEDKMINLFWDWHQHSLEKEHPWDIHPTTAHTNTIHQDMLMLYPPANPQLSHDIKRIIDRKVAVRLFSIILIILALIFAPDLVQQIKSGNVSMPMVGTQE

SEQ ID NO: 2586 - protein, 165 aa, Phelipanche nana
KWNPKMALYISANRNGIHITNLIKTARFLSEACNLVFDAASRGKQFLIVGTKKKTANSVACAAIKARCHCVNKKWLGGTLTNWSTTERRLHQFRDLRIEQKIGGFKRLPKRDAAVSKRQLSRLQTYMGGIKYMTGLPDIVIIIDQHEEYTALRECITLGIPTICL

SEQ ID NO: 2587 - protein, 199 aa, Zea mays
  misc_feature (43)..(43): Xaa can be any naturally occurring amino acid
  misc_feature (54)..(54): Xaa can be any naturally occurring amino acid
  misc_feature (79)..(79): Xaa can be any naturally occurring amino acid
  misc_feature (100)..(100): Xaa can be any naturally occurring amino acid
  misc_feature (106)..(106): Xaa can be any naturally occurring amino acid
  misc_feature (142)..(142): Xaa can be any naturally occurring amino acid
  misc_feature (154)..(154): Xaa can be any naturally occurring amino acid
  misc_feature (160)..(160): Xaa can be any naturally occurring amino acid
LGTSPAGSRFLLSSTSSPALCCRRLPRTPDRCYRQIPNNLFPXPGYCRYAPDPXFRYYDVGFYKKPVDEFPYCVFLVSXHIENVSSDDLDAVRIVCCKYXMTMSEXPYAITHFQSPFIPFHDLLIREMLSCVVTDRLQTVLXSTCVKISVTCSXLDIDAXLLSVRCEDNCASLACSLLRMAKLQLPAQLKIIENRKWMF

SEQ ID NO: 2588 - protein, 496 aa, Glycine max
MGKVAVGTAVVCAAAACVAAALVVRHRTRSSGKWGRATAIAKELEEQCWTFFSKLRQVADALDVEMHAGLASEGGCKLKMLITYVDNLPSGDEKGLFYALDLGGTNFRTLRVHLGGKEKGVVKIESEEVSIPPHLMTGSSQELFDFIASKLAKFVSSEPEELHPPPGRQRELGFTFSFPVKQTSIASGTLIKWTKGFNIEDAVGEDVVGELTKSMEKIGLDMRVAALVNDTVGTVARARFSNQDVIAGVILGTGTNAAYVECAHAIPKWHGLLPKSGEMVINMEWGNFRSSHLPLTEYDHALDAESLNPGEQIFEKIISGMYLGEIVRRVLLKLAEEVDFFGDTVPPKLRIPFVLRTPDMSAIHQDTSSDLKVVGNKLKDILEINNTSLKMRKIVVELCDIVANRGARLSAAGIFGILKKIGRDTVKDGKKSVVALDGGLFEHYTKFRSSLESTLKELLGDEAAETIGIEQSNDGSGIGAALLAASHSQYLEVQES

SEQ ID NO: 2589 - protein, 165 aa, Phelipanche nana
KWNPKMALYISANRNGIHITNLIKTARFLSEACNLGFDAASRGKQFLIVGTKKKTANSVACAAIKARCHCVNKKWLGGTLTNWSTTERRLHQFRDLRIEQKIGRFKRLPKRDAAVSKRQLSRLQTYMGGIKYMTGLPDIVIIIDQHEEYTALRECITLGIPTICL

SEQ ID NO: 2590 - protein, 272 aa, Capsicum annuum
MGSPQENCSFDMIRQHLDDISLMEYYCPENTLYSQSCESLDQTSVSFETSSNLDDISSFFSSSKTDFGCFEFETKPITSAATSISSNSPKKRSFNERKPSLNIAVPVKPVVVQKVEVVREKKHYRGVRQRPWGKFAAEIRDPNRKGTRVWLGTFDTAVDAAKAYDRAAFKLRGSKAILNFPLEVANFKQQNSTVEVPQQVNSSGSKRAREKEELAINKEMKIEEEERVAQTAPLTPSNWSTIWDSGNGKGIFEVPPLSPLSPHMSYSQLVMI

SEQ ID NO: 2591 - protein, 99 aa, Saccharomyces cerevisiae
HHHMFNAKYVAEATGNFITVMDALKLNYNAKDQLHPLLAELLISINRVTRDDFENRSKLIDWIVRINKLSIGDTLTETQIRELLFDLELAYKSFYALLD

SEQ ID NO: 2592 - protein, 404 aa, Vibrio vulnificus
MQDILTVILAGGMGSRLSPLTDDRAKPAVPFGGKYRIIDFTLTNCLHSGLRKILVLTQYKSHSLQKHLRDGWSIFNPELGEYITSVPPQMRKGGKWYEGTADAIYHNLWLLERSEAKYVMVLSGDHIYRMDYAPMLEEHIANNAALTVACMDVNCKEAKAFGVMGIDEHHRVHSFVEKPQNPPHLPNDPERSLVSMGIYIFSMEVLQQALIEDADNDASSHDFGKDIIPKLIDTGSVFAYKFCGSKGRVDKDCYWRDVGTIDSFYQANMDLLEPIPPMNLYQKDWGIRTYEPQYPPARTVSSGSGNEGIFINSMISNGVINSGGSVQHSIVSSNVRINDSATIVDSIIFDDVEIGEGCQLVNCIIDKHVKVPPYTQIGLNRLEDAQRFKISENGIVVVPESYQF

SEQ ID NO: 2593 - protein, 186 aa, Oryza sativa
MAACVAGERAEQQPVRDGDGEDEISTANSPTQLLLEQHGLGGLMASAASCRNNNSPAAAAAPPPQTSQGKAAAKEPSPRTNTAVINRPPEKRQRVPSAYNRFIKDEIQRIKAGNPDISHREAFSAAAKNWAHFPHIHFGLMPDHQGLKKTSLLPQDHQRKDGLLKEGLYAAAAAAAAAANMGVAPY

SEQ ID NO: 2594 - protein, 434 aa, Methylobacterium extorquens
MSAGTATDTTDLDSFFSAHLAETDPEIAKAISQELGRQQHEIELIASENIVSRAVLEAQGSVLTNKYAEGYPGRRYYGGCQFVDIAEELAIDRAKRLFGCGFANVQPNSGSQANQGVFMALMQPGDTFLGLDLAAGGHLTHGAPPNVSGKWFKPVSYTVRREDQRIDMEQVERLAQEHKPKVIIAGGSGYPRHWDFAKFREIADSVGAYFFVDMAHFAGLVAAGLHPSPFPHAHVATTTTHKTLRGPRGGMILTNDEALAKKFNSAIFPGLQGGPLMHVIAAKAAAFGEALKPEFKIYAKQVIDNARALADTIISGGYDITSGGTDNHLMLVDLQKKGLTGKAAEAALSRADITCNKNGVPFDPQKPTITSGIRLGTPASTTRGFGVAEFKQVGSLIVQVLDGIAEKGDGGDAAVEAAVKEKVHALTDRFPIYA

SEQ ID NO: 2595 - protein, 855 aa, Unknown
  Acinetobacter sp. ADP1
MHDLRRNPMKLVMIGHGMVGHKFIESLLEKADDELEVTIIAEEPRIAYDRVHLTEYFSGKTAKDLSLARADFADAYGIDLRLNTKAIAIDPILKTVTTSAGDVIGYDKLVLATGSYAFVPPISGNDRNNCFVYRTLEDLDAIRAASKNAKSGVVIGGGLLGLEAAKALRDLNLETHVVEFAPRLMAVQIDDLGGKVLRRKIEDLGVKVHTQKATQCIEDGSTHHHIMKFADGSVLETDIVLFSAGIRPRDELAKISGLATGERGGIVINDYCQTSQPDVYAIGECALWNNKIYGLVAPGYDMARIAAKHILEEETHCFTGADMSTKLKLMGVDVASIGDAHAMTPNALSYFYADEDALIYKKIVVNAEKTQLLGAVLVGDAKEYSDLLQMMLNGMALPEQPESLIMPGFSEAGAAKSGGSGVDLLPDSATICSCNNVSKADICQAIEDGSTSLGALKKCTKAATACGGCAPLVTQVLKSELQRQGVTVNNHLCEHFAYSRQELYHLVRVNEIKTFDDLIEQHGHGLGCDICKPTVANILASCWNDFVLKPSHAGLQDSNDYYLGNIQKDGSYSVVPRMAGGEVTPDGLIAVGQIAKKYNLYTKITGGQRVDMFGAQLHELPLIWEELIAAGFESGHAYGKSLRTVKSCVGSTWCRYGVDDSVGLAIFLENRYKGLRSPHKLKMAVSGCTRECAEAQGKDVGVIATEKGWNLYVCGNGGMKPRHAELLASDLDTNTLIRYIDRFFMFYIQTADRLQRTSVWRDNMEGGLDYLKAVIVEDSLGLAHELERRMSHVVNTYQDEWRTAVEDPDVRKRFQTFINQKEQRDPHIQFTEERGQIRPLKASERDESRIPLVEA

SEQ ID NO: 2596 - protein, 103 aa, Triticum aestivum
ARRAGGLRQLLTAAVTAGAAEARAAIFGHAVNPLGKRAATKLLRKKLIGEHVAQWYPDDIKRDDPEVMAREEKERLAKLEMLKRRGKGPPKKGQGRRAIKRNK

SEQ ID NO: 2597 - protein, 448 aa, Unknown
  Acinetobacter sp. ADP1
MSSNLDLTAKKATKINLFNFSVPAMRAFHMSWLAFFVCFFAWFACAPLMPVIAGEFHLTKDQIANINIAAVAITIVVRLIVGPLCDKYGPRKTYTALLLIGSLPVFGVAAANSYESFLFFRLLIGAIGASFVITQYHTSIMFAPNVVGTANAASAGWGNAGGGATQALMPLLLSALVMFGVEQAMGWRVALLVPGAMMVIVGLLYWKYTQDCPQGNFKELRAQGIQVGSDKKGGMAILMHAARNYRVWILFGAYAACFGIEIFIHNIVAMYYVNHFNFGLKEAGLAAGIFGLLALFARALGGIISDKVAIKKGLDGRTKVLFAMIVGEGLFLIIFSQMNSAMLAIMIMTLFALFTHMACGATYALVPFIDRDALGGVAGIIGAGGNVGAVAAGFLLKGMMDIQTCLMVLGGLVIIAGGFVMLIRFSAEHKVKEQRLFEQAVLERNNLA

SEQ ID NO: 2598 - protein, 962 aa, Corynebacterium diphtheriae
MAEKSKKTTKNQAVSSPIGQAIAALDRSIIGEKIRVHILAKQLGVASKELIAQLATMGLKKVAQSTLSNQEANQLLDSFVPAQPEVDEKLRHRVEKNVENEIAQIEAKVNRDLEEAAANEHRVVDSEEEKLRYRVEKNVDNEVEQIKRQVERELSQRSVEVEDLHEVIELEKEAEPLEDVEPESAPAPASVSYSVPLFIAPTVVDDELEEVEDDEDGEDDTDDDSTHAKRRRRGRRGAGRGKGADDSTETVEAEEITEPVGIKGSTRLEAQRRRRAELREESKKKRHIVSEAEFLARRESVTRTMVVRERDRVDHHGMVTQVGVLEDGMLVEHFVTSEAQASMIGNIYLGRVQNVLPSMEAAFIDIGKGRNGVLYAGEVDWRAAGLGGRGRRIEQALKSGDQVLVQVAKDPIGHKGARLTTQISFAGRYLVYVPGGRTAGISRKLPAPERKRLKEILKEVVPHDGGAIIRTAAENVSAEAIGADVNRLHKLWDKIQQRTEEEKASKGAKPVTMYEEPNMLVKVVRDLFNEDFTSLVIDGDRAWNTVHAYVQSVAPDLLGRLVRFDRSEHEGRDAFEVHRVNEQIKKALSRKVWLPSGGTLVIDRTEAMTVIDVNTGKFTGAGGNLEETVTKNNLEAAEEIVRQMRLRDLGGMIVVDFIDMVLPENQDLVLRRLTEALGRDRTRHQVSEVTSLGLVQMTRKRLGTGLLETFATECPHCEGRGVIIHDDPVEQRDADVAMEKSHRARNERKKNKNHTPSEHPAAAAMHEEKKKVSIEDLVAAVVIEDDPQPEPDVVPTPADDDVMDIVSAALDRAYEEDPDEPSGSDYLPLEEKPQTYAEAVEEFERSPRRKRKTRGNSVSDVPPRKADFEKPEPQPEPEVVVEKVSSRGRRRAVRRTVVEATPEVVAPTETVESSRGRRRAVRKKMAPQPVQTEAVVEDKHEVSAPSQGGRGRRRASRRAPRR

SEQ ID NO: 2599 - protein, 406 aa, Listeria monocytogenes
MFQSKSRTSLTNKKTLLFGLISVFLCGMGFSIIMPVVPFLVTPYVTNASDQALMVTLLTSVYAFCVFFAAPGLGALSDRFGRRPVLLICFIGSAIGYFIFGLGGALWVLFLGRIIEGITGGSISTLFAFFADITPQEERTKYFGWVSAAAGAGAALGPAFGGLLAHFGYAMPFFFGATITFINFLFGYFYMPESLDDANRLKRIPLMRLNPFSQLLNILTIKNLGRLLIAAFFIWVPNGSLQAVMSQFAIDSFSWKPALIGMMFSIMGIQDILSQAFVMPKLLIRLTDKQIAVLGMIAEIIGYSLIATSSIFTLAPLLVIGMFVFGFGDSIFGPSFNGMVSKAASASEQGRIQGGSQAIQSLARIIGPIIGGQIYITLGHAAPAIMGVLLITVAIFILYKKTSLAK

SEQ ID NO: 2600 - protein, 518 aa, Solanum tuberosum
MAMAIALRRLSATVDKPVKSLYNGGSLYYMSSLPNEAVYDKEKSGVAWPKQLNAPLEVVDPEIADIIEHEKARQWKGLELIPSENFTSVSVMQAVGSVMTNKYSEGYPGARYYGGNEYIDMAETLCQKRALEAFRLDPAKWGVNVQPLSGSPANFQVYTALLKPHERIMALDLPHGGHLSHGYQTDTKKISAVSIFFETMPYRLDESTGYIDYDQLEKSATLFRPKLIVAGASAYARLYDYDRIRKVCNKQKAILLADMAHISGLVAAGVIPSPFDYADVVTTTTHKSLRGPRGAMIFYRKGVKEVNKQGKEVFYDYEDKINQAVFPGLQGGPHNHTITGLAVALKQATTPEYRAYQEQVLSNSSKFAQALGEKGYELVSGGTDNHLVLVNMKNKGIDGSRVEKVLEAVHIAANKNTVPGDVSAMVPGGIRMGTPALTSRGFLEEDFVKVADFFDAAVKIAVKVKAETQGTKLKDFVATLESSAPIKSEIAKLRHDVEEYAKQFPTIGFEKETMKYKN

SEQ ID NO: 2601 - protein, 402 aa, Arabidopsis thaliana
MNGEKPLRERKKKMPYPSPVTEEPISIMSLPYDLLLNCFSLVSRLYYPTLSLVSKTFRSIITSRELYEIRSRLNRTDKCLYLCFPYDMNTHWFTLCREPNRNVAENSSGYLLVQVPSPNGLLPVHSSSVIAVGSNIYKIGGTKSYRHKLWKRTRYSSSVSVLDCRSHRWRQAPGMRVARGCSSTVCEVDGKIYIAGGCKEDIGSLYWIEVFDPKTQTWGTLKNPCIEYQHDIGYRCEVKSLGLDGKIYMFGSEFVVYNFEEDRWKCIGRDKYNLYHAVDPMSRINSSSCVVDNVLFILDKGTRVFKWYDFKVSLWKELNGVEGLPDLSDRGYVKMVDLGGKIAVLWQECLTNKKIKRIWCAEISLERRDRDEIWGKVEWFDIVLSVHSSFSLLCADTISVVV

SEQ ID NO: 2602 - protein, 326 aa, Corynebacterium diphtheriae
MTESVKKIAVTGAAGQIAYSLLWRIANGDVYGKNTPVELQLLEIPQAIGGAEGVAMELLDSAFPLLKNIVVTDKAEVAFDGTNAAFLVGAKPRGKGEERADLLTANGKIFGPQGKALNDNAADDIRVLVVGNPANTNALIAQHAAKDIPADRFNAMMRLDHNRGIAQLSEKLGRDKNDIEKFVVWGNHSAGQFPDITYATIGGEAISGLVDHDWYTGEFIPRVAKRGAEIIEVRGKSSAASAASSAIDHMHDWINGTDGQWRTAAIPSDGSYGVPEGLIFGFPTISEDGQWKIVQDLELSDFQKDGIARNVTELEEEREAVKDLLG

SEQ ID NO: 2603 - protein, 132 aa, Kluyveromyces lactis
MAPKAEKKPASKAPAEKKPAAKKTSSSVDPSKKRTKARKETYSSYIYKVLKQTHPDTGISQKSMSILNSFVNDIFERIATESSKLAAYNKKSTISAREIQTAVRLILPGELAKHAVSEGTRAVTKYSSSTQA

SEQ ID NO: 2604 - protein, 165 aa, Phelipanche nana
KWNPKMGLYISAKRNGIHITNLIKTARFLSEACNLVFDAASGGKQFLIVGTKQKTADSVACAAIKARCHCVNKKWLGPTLTNWSTTERRLHQFRDLRIEQKIGRFKRLPKRDAAVSKRQLSRLQTYMGGIKYMTGLPDIVIIIDQHEEYTALRECITLGIPTICL

SEQ ID NO: 2605 - protein, 187 aa, Orobanche ramosa
LGHDIRKWNPKMALYISANRNGIHITNLIKTARFLSEACNLVFDAASRGKQFLIVGTKKKTANSVACAAIKARCHCVNKKWLGGTLTNWSTTERRLHQFRDLRIEQKIGRFKHLPKRDAAVSKRQLSRLQTYMGGIKYMTGLPDIVIIIDQHEEYTALRECITLGIPTICLIDTNCDPDLADLSIPA

SEQ ID NO: 2606 - protein, 313 aa, Chaenomeles speciosa
GGLGDVLGGLPPAMAANGHRVMTVSPRYDQYKDAWDTGVPVEIEVGGRVETVRFFHCYKRGVDRVFVDHPSFLERVWGKTGSKIYGPSAGEDYKDNQFRFSLLCQAALEAPKVLNLNSNKYFSGPYGDEVVFIANDWHTALLPCYLKAIYKPKGIYENAKVVFCIHNIAYQGRFPISDLSVLNLPENLRGSLDFIDGYSKPVKGRKINWMKAGILESDRVVTVSPFYAQELVSGEDKGVELDNIIRKTSITGIVNGMDVQEWNPATDKYLDTKYDNTTVLDAKPLVKEALQAEVGLPVDRNIPVIGFIGRLEE

SEQ ID NO: 2607 - protein, 350 aa, Deinococcus radiodurans
MVVMSYLSELRAVWGHRALPAAGVSVLLQDETGRVLLQRRGDDGQWGILGGGLEPGEDFLIAAHRELLEETGLRCPNLRPLPLSEGLVSGPQFWHRYPNGDEVYLVGLRTEGTVPAAALTDACPDDGGETLELRWFALDDLPPLNTNINRVSMNVLRARRGLPPLPLLDVPSPPPPGDWLRDLRALVGSRPLIAPGANVAVTNERGEVLLLKHAGTGNTVTGKWTLPGGSLEPGESFAECAARELHEETGLRASRLVPVELFAGAEYRFTSLNGDVIDNISVLFRAEDVQGELALDTAESHGAAWFAPDALPPADELSGPLIRAKVRRWQELEPSPNEGACPGAAPHRLC

SEQ ID NO: 2608 - protein, 266 aa, Cicer arietinum
AEEKGLITPGQSVLIEPTSGNTGIGLAFMAAAKGYKLIITMPASMSLERRIILLAFGAELVLTDPAKGMKGAVQKAEEILAKTPNAYILQQFENPANPKVHYETTGPEIWKGTEGKVDAFVSGIGTGGTITGAGKYLKEQNPNIKLVGVEPVESPVLSGGKPGPHKIQGIGAGFVPGVLEVNLIDEVIQISSDEAIETAKLLALKEGLFVGISSGAAAAAAIKIAKRPENAGKLIVVVFPSFGERYLSSVLFESVRRQAETMTFEP

SEQ ID NO: 2609 - protein, 492 aa, Ashbya gossypii
MYDNRHHVIDLVGNTPLVELSKLPKALGIKPQVYAKLELYNPGGSIKDRIAKTMIERAEESGIIHPSRSTLIEPTSGNTGIGLALIGAIKGYRTIITLPEKMSNEKVSVLKALGAEIIRTPTAAAWDSPESHIGVARKLEKEIPGAIILDQYNNEMNPYAHYFGTGREIHHQLRNLGKFDQLHGLVAGAGTGGTISGTAKYLKEQKPDVKVVGADPMGSILAQPASLNDTDISEYKVEGIGYDFIPEVLDRSLVDQWIKTEDKASFKYARQLISNEGTLVGGSSGSAFAALVEYCNAHPELTEDDVLVVIFPDSIRSYLTKFVDNEWLKSNNLWDDEIVAPLAKNEEDAFNGATVKDLQLRPVVAVSETAAVSEVVKILKDNGFDQLPVLAENSKKLGGLVTLSQLLKKLSSGAEVSSIKSLFLDFRKLNNFDDISSYNDNKTGKKKFVTFTVDSKLSELNRFFEKNSSAIITDGFTPVHVVTKVDLLSYLA

SEQ ID NO: 2610 - protein, 165 aa, Orobanche ramosa
KWNPKMALYISANRNGIHITNLIKTARFLSEACNLVFDAASRGKQFLIVGTKKKTANSAACAAIKARCHCVNKKWLGGTLTNWSTTERRLHQFRDLRIEQKIGRFKRLPKRDAAVSKRQLSRLQTYMGGIKYMTGLPDIVIIIDQHEEYTALRECITLGIPTICL

SEQ ID NO: 2611 - protein, 426 aa, Ralstonia solanacearum [sequence omitted]

SEQ ID NO: 2612 - protein, 313 aa, Chaenomeles speciosa
GGLGDVLGGLPPAMAANGHRVMTISPRYDQYKDAWDTEVSVELKVGDKTETVRFFHCYKRGVDRVFVDHPLFLERVWGKTASKVYGPVTGVDFKDNQLRFSPLCQAALEAPRVLNLNSSKYFSGPYGEEVVFIANDWHSALLPCYLKAVYKPRGIYSTAKVTFCIHNIAYQGRFASADFALLNLPDEFKSSFDFIDGYEKPEKGRKINWMKAGILESDKLLTVSPYYAEELVSAVEKGVELDNIIRKTGIFGIVNGMDVQEWNPLTDKYTTIKYDASTVADAKPLLKETLQAEVGLPVDRDIPVIGFIGRLEE

SEQ ID NO: 2613 - protein, 174 aa, Borrelia hermsii
MDEEISTLFTEEKIKSKIKELAQKIRNYYKDKSNVVFISLLKGSFMFFADITREMGLNVKIDFLQVSSYKNKTHSSLNVLIKKDIDIDIKDSYVIIFDDIIDTGLTYDKIITYLKTKNPKEIKICTLFNKPSRRLIELKIDYAGFEIENDFIVGYGIDFNEKHRTLKDVAKINK

SEQ ID NO: 2614 - protein, 207 aa, Brassica napus
  misc_feature (167)..(167): Xaa can be any naturally occurring amino acid
  misc_feature (179)..(179): Xaa can be any naturally occurring amino acid
  misc_feature (197)..(197): Xaa can be any naturally occurring amino acid
MFEHTLLSLLLLPSLLSLLLFLILLKRRSRHRFNLPPGKSGWPFIGETIGYLKPYTATTLGDFMQQHISKHGKIYRSNLFGEPTIVSADAGLNRFILQNEGRLFECSYPRSIGGILGKWSMLVLVGDMHRDMRSISLNFLSHARLKTILLKDVERHTLFVLDSWQHXSVFSAQDEAKKXTFNLMAKHIMSMDPGEEXTEQLRRVVTS

SEQ ID NO: 2615 - protein, 165 aa, Orobanche ramosa
KWNPKMALYISANRNGIHITNLIKTARFLSEACNLVFDAASRGKQFLIVGTKKKTANSVACAAIKARCHCVNKKWLGGTLTNWSTTERRLHQFRDLRIEQKIGRFKRLPKRDAAVSKRQFSRLQTYMGGIKYMTGLPDIVIIIDQHEEYTALRECITLGIPTICL

SEQ ID NO: 2616 - protein, 313 aa, Chaenomeles speciosa
GGLGDVLGGLPPAMAANGHRVMTISPRYDQYKDAWDTEVTVELKVGDKTETVRFFHCYKRGVDRVFVDHPLFLEKVWGKTASKIYGPTAGVDFKDNQLRFSLLCQAALVAPRVLNLNSSKYFSGPYGEEVVFIANDWHTALLPCYLKAIYKPKGIYKTAKVAFCIHNIAYQGRFAFADFALLNLPNEFKSSFDFIDGYDKPVKGRKINWMKAGILESDKVLTVSPYYAKELVSSVDKGVELDDIIRKTRIQGIVNGMDVQEWNPLTDKYTTVKYDASTVADAKPLLKEALQAEVGLPVDRDIPVIGFIGRLEE

SEQ ID NO: 2617 - protein, 134 aa, Ralstonia solanacearum
MTDAASGQETLAFDLLGGEARVRELADRFYDLMDLEPAFAELRALHPPSLDGSRDKLFWFLCGWLGGPSHYIERFGHPRLRARHLPFEIGTRERDQWMRCMALAMQDLGIDDALQMRLMQAFWQTADWMRNVPR

SEQ ID NO: 2618 - protein, 313 aa, Kageneckia oblonga
GGLGDVLGGLPPAMAANGHRVMTISPRYDQYKDAWDTEVTVELKVGDKTETVRFFHCYKRGVDRVFVDHPMFLEKVWGKTASKIYGPVAGVDFKDNQLRFSLLCQAALEAPRVLNLNSSKYFSGPYGEEVVFIANDWHTALLPCYLKAIYKRQGLYKTAKVAFCIHNIAYQGRFAFADFALLNLPDEFKSSFDFIDGYDKPVKGRKINWMKAGILESDKILTVSPYYAQELVSGVGKGVELDNIIRKTGIFGIVNGMDVQEWNPLTDKYTTVKYDASTVADAKPLLKEALQAEVGLPVDRDIPVIGFIGRLEE

SEQ ID NO: 2619 - protein, 313 aa, Kageneckia oblonga
GGLGDVLGGLPPAMAANGHRVMTVSPRYDQYKDAWDASVLVEIEVGGRVETVRFFHCYKRGVDRVFVDHPLFLERVWGKTGSKIYGPRTGVDYMDNQFRFSLLCQAALEAPRVLNLSSNKYFSGPYGDDVVFIANDWHTALLPCYLKTIYKPKGIYKNAKVAFGIHNIAYQGRFPFSDFSLLDLPDNLKVLSTFIDGYKKPVKGRKINWMKAGILESDRVVTVSPYYAKELVSGEDKGVELDNIIRKTGITGIVNGMDVQEWNPAADKYLDIKYDNTTVLDAKPLLKEALQAEVGLPVDRNIPMIGFIGRLEE

SEQ ID NO: 2620 - protein, 220 aa, Capsicum annuum
MGDVKLLGLWYSPFVHRVEWALKIKGVEYEFIEENLQNKSPLLLESNPIHKKIPVFFHNGKPICESMVIVEYIDEAFEGPSILPKDPYDRAIARFWAKFLDDKLQAIGKTFFFKGEEQEKAKGEAYETLKVLDNEVKDKKFFVADKFGFADIAANFVGLWLGVFEEATGIVLVTREKFPNFCAWRDEYINCTQNKEYLPPRDELLAHFQARFQAAAAASK

SEQ ID NO: 2621 - protein, 399 aa, Aspergillus nidulans
MIFSTLLSLALLATTATARKGFVTTKGDKFQLDGKDFYFAGSNAYYFPFNNNQTDVELGLSAAKKAGLLVFRTWGFNDKNVTYIEDGLPQYGGEGAGTTEVVFQWWQNGTSTIDLEPFDKVVNAAAKTGIKLIVTLVNNWADYGGMDVYTVNLGGQYHDDFYRLPQIKKAYKRYVKEMVTRYRNSPAIMAWELANEPRCGADGVRNLPASDECTPELLTSWIDEMSTYVKRLDPHHLVTWGGEGGFNYDSDDWAYNGSDGGDFEAELKLKNIDFGVFHSYPDWWSKTVEWTNKWIVDHARAARRVGKPVVHEEYGWLTPQGRLDNLGTVSNITRLEAVGGWQSISLREKMSDMFWQFGYSGYSYGRNHDDGFTIYLDDAEAQELVYKHAKEVNKLNRRR

SEQ ID NO: 2622 - protein, 321 aa, Bacillus cereus
MAVNEKVELATFAGGCFWCMVSPFEEMEGIIKVVSGYTGGHKENPTYKEVCSETTGHYEAVQITFDANKMPYEELLNIYWRQIDPTDVGGQFHDRGQSYETVIFYHNEEQHKKAEASKEGLARSGRFSKPIATKILPAATFYPAEEYHQGYHKKNEFRYELYRKGSGRDAFIKQHWPKDNAHLKEKLNEMQFYVTQENGTEPPFRNEYWNHKEEGLYVDIVSGEPLFTSLDKFDSGCGWPSFTKPVMSASVKEKMDVSHNMTRTEVRSKEGDSHLGHVFPDGPGPNGLRYCINSAALRFIPKEELEKEGYGDFLILFGNKK

SEQ ID NO: 2623 - protein, 498 aa, Francisella tularensis
MSFNTEIFLNINKYEQRIAIKENNILKEILIERDNQKRIVGNIYKGKIIRVLPGMQAAFVDIGLEKAGFLHLSEVIPLEKEDDDSDENFKLKKLNTKDINKWLREGQEVLVQVVKESIGNKGVKLTSHLSVSSRFLVFLPDLDHIGVSLKITNEQEKQRLLESIKKITQSENPRGYILRTAAEGASYEELENDIKFLNNLWQDILDISSTIIKPGVVYEDFSLIIKTINIFANDNLDKILVDNIDSYKEICHFADKYIPGLREKIELYQKHNIFEEYDIENEINKALDKMVYLKSGGYLVIEQTEAMITIDINTGGFIGTKNLEETIFKTNLEATKEIARQLRLRNLGGIIIIDFIDMMDQSHRIQVLEALKKELELDKAKTSVSDISELGLVEMTRKRVHESLLRTLCQPCEHCSGKGSVKTLQTICYDIFREIKSESKNYPSYNDFLLISSEKIIDYIEKEESIWLAELELEIQKNIHLKVENSHIYNQYDIIPLN

SEQ ID NO: 2624 - protein, 491 aa, Debaryomyces hansenii
MPVPPIAEDALDLIGNTPLIKLNRIPQSFGIKAKVYAKVELFNAGGSIKDRISKNMVLEAEKQGRIKPGYTLIEPTSGNTGIGLALVGAVRGYRTIITLPEKMSNEKVSVLKALGAEIIRTPTEAAWDAPESHIGVARKLEKEIPNSVILDQYSNEANPNAHYYGTGYEIWEQTNGKVTHLIAGAGTGGTITGISKYLKEKNSNIKIIGADPKGSILAVPESLNDTSEGYLVEGIGYDFIPDVLKRDRVDSWIKTDDSESFKLARRIIREEGILVGGSSGSALQAALEVAKDLTEDDTVVVVFPDSIRSYLTKFADDEWMTTNGFPIEENESASHKSDEVLNTTTIKDLVSGKAPVVTVTLSDTVGKTFDLLQTNGFDQLPVLNNSGKLVGLITLSKILKSLSTKKVQITNSISSIIIDFRKLADFEKSFTITKKSGFTKRSYEPITMDTSLALLNKFFETNSNAIVTDADYKPVQIVTKVDLISYLTKIL

SEQ ID NO: 2625 - protein, 411 aa, Unknown
  Vibrio sp. Ex25
MGKAAKDAAFELATASTAQKNQALAIIADELEANSVAILAANAKDIELGREAGLTDALLDRLLLNEERLTAIANDVRNVISLNDPVGSEIDSKVLENGMSLSRRRVPLGVVGVIYEARPNVTIDIAALCLKTGNASILRGGKETFFSNMELVKVIQSALAKANLPAASVQYIEKPDRELVSQLLKLDDYVDMIIPRGGAGLHKMCKENSTIPVIIGGFGISHIFVDESADLEKSLNVVENSKVQRPSACNSLDTLLVHEKIAAQFLPMIVERMNDKVTFVTEPKAKELMEQAKQVRDAIEGDFDTEWLSYTLGVKVVSDVKDAIDHMRVHNASHSDAIMTNSLENSELFINSVGSAAVYVNASTRFTDGAQFGLGAEVAVSTQKLHARGPMGLEELTSYKWVGKANYLARS

SEQ ID NO: 2626 - protein, 231 aa, Arabidopsis thaliana
MDQQDHGQSGAMNYGTNPYQTNPMSTTAATVAGGAAQPGQLAFHQIHQQQQQQQLAQQLQAFWENQFKEIEKTTDFKNHSLPLARIKKIMKADEDVRMISAEAPVVFARACEMFILELTLRSWNHTEENKRRTLQKNDIAAAVTRTDIFDFLVDIVPREDLRDEVLGSIPRGTVPEAAAAGYPYGYLPAGTAPIGNPGMVMGNPGGAYPPNPYMGQPMWQQQAPDQPDQEN

SEQ ID NO: 2627 - protein, 322 aa, Musa acuminata
LVAVPTRVQSIGVCYGMLGNNLPPPSEVVSLYKSNNIARMRLYDPNQAALQALRNSNIQVLLDVPRSDVQSLASNPSAAGDWIRRNVVAYWPSVSFRYIAVGNELIPGSDLAQYILPAMRNIYNALSSAGLQNQIKVSTAVDTGVLGTSYPPSAGAFSSAAQAYLSPIVQFLASNGAPLLVNVYPYFSYTGNPGQISLPYALFTASGVVVQDGRFSYQNLFDAIVDAVFAALERVGGANVAVVVSESGWPSAGGGAEASTSNAQTYNQNLIRHVGGGTPRRPGKEIEAYIFEMFNENQKAGGIEQNFGLFYPNKQPVYQISF

SEQ ID NO: 2628 - protein, 267 aa, Anabaena variabilis
MEDFVTPPAFGEKVRERWTLAGRKALITGATKGIGLAIAQEFLALGAEVIIVARNAEAIEQQINAWDSAGKVHGVTADVSTSEGRQIIHEYVSKTVGELDILVNNVGTNIRKKATDYTEEEFAGIFQINLTSIFELSRLFYPLLKTSKNSSIVNIASVAGLISVRTGAPYGMTKAALVQLTRSLAVEWADDGIRVNAIAPWFIQTPLTEPLLNNPETLSAVLSRTPMKRVGQPEEVASLTAFLCMPTASYITGQCIAVDGGFLAFGF

SEQ ID NO: 2629 - protein, 240 aa, Ashbya gossypii
MSDRAPVNYYGSKNSTRSFNNALFEEVPLFDASTTPQQREVTETLSEIYSIIVALEQVEKAYLKDGISSDDYTVSVNKLIAQYKTYLANNSDVQAVFGDLQQFRQRWNINASNAIARLERGMPVTVEHGIQGSSGDNPASSSGTQFNAKAVAEATGNFITVMDALKLRLKAKDQLHPLMSELLLSINRVGPQDFEKRSKLVEWIVQINKMKANESLGDDEARELLFDLDSAYKAFYTLLG

SEQ ID NO: 2630 - protein, 839 aa, Pseudomonas fluorescens
MPEFAPATHPAPDSATPLEAIIIGSGFGGLGMAIALRKAGVHRFVILEKGQDVGGVWRDNSYPGAACDVPSHLYSFSFEPNPHWSRVFAPQAEIHGYLQHCAGVYELKPHIRFGAEVRHAEFDTANACWHVTCADGQRHAARLLISATGQLSRPALPDLPGMASFRGRVFHSAHWDHDYPLAGKRVAVIGTGASAIQFVPEVARQVAELKVFQRSPAYIMPKADRPYSAEEKQRFLRQPWKMKLVRAAHYLHFESRALGFTRLQGLTKWVVGGPFKKLLHTSVASPELRRQMTPDYPIGCKRILLSNDYLKTFDQPHVHLLTRGIRQITEHGIETLDGEEHAVDAIIYGTGFAATEFLSPMRITGRDGLDLNQAWQGGAAAYLGISVPGFPNFFMLYGPNTNLGHNSIIHMLESQISHVMQARQALLDSGASHVEVDEQRHQRFQLGIQRRLATSVWSGCKSWYVDERGHNSTNWPGFTWSYRWLARYAGLAAYRLSSPLDTQSPACDGQRIAAPRDWLERANAAFLRVFLRVSFRALIGPPRPLASQRKIVDRLSWLMPGCLGVNRRSMQLDGLSLQIVEPGTRAPKGVILYLHGGAFCLGSPRSHYSVTSRLARDSGCAVWVPDYRLAPEHPYPAALEDCLACYDAIRAQLCPADKLLIAGDSAGGALVLALALSLKERGDEIAAGLMLLSPVTDPDLGGASMQSRQEADPMIRRDWLEQALKAYAAPVQALSHRPLEADLRGLPPMLIQVGDQELLLSDSTRLAERARQSGVACQLEIHQGRWHVFQLQAFYLRSARNALLGLARFARQCLETAGQTPQAADSPRTTQPATDPQPS

SEQ ID NO: 2631 - protein, 235 aa, Adiantum capillus-veneris
  misc_feature (144)..(144): Xaa can be any naturally occurring amino acid
  misc_feature (173)..(173): Xaa can be any naturally occurring amino acid
MQQKNRTIDLEGMMAAGIHFGHQTQRWNPKMSPYIFTERKGVHILDLTQTARLLSEACDSVFDAAVEGKEFPMVGTKNQVTDLIVSAALKSQCHYVNEKWLAGTLTNWVTTETRLRRFQHLQTGGDLGEFDRLPKREAAILKGXLVRLKKCLGGIQYMSDSPDIAIITDQHEXSIALKECSIPGIPTICIVDTDCDPDLVDVPIPGNDDARSSIRWILDKPALAISEGRSNIKVT

SEQ ID NO: 2632 - protein, 289 aa, Pseudomonas aeruginosa
MSDTPYIFDVTGANFEQLVIENSFHKPVLVDFWADWCAPCKALMPLLAQIAESYQGELLLAKVNCDVEQDIVMRFGIRSLPTVVLFKDGQPVDGFAGAQPESQIRALLEPHVKAPALPDEDPLEVAQALFAEGRIGDAEATLKALLAENNDNPAALILYARCLAERGELEEAQAILDAVKSDEHKQALAGARAQLTFLRQAADLPDSAELKSRLAADAGDDEAAYQLAVQQLARQQYEAALDGLLKLFLRNRGYQDDLPRKTLVQVFDLLGNDHPLVTTYRRKLYQALY

SEQ ID NO: 2633 - protein, 190 aa, Yarrowia lipolytica
MGKAASKLSKDELTELKKATYFDRKELQQWYKGFLKDCPSGQLNKEEFQKIYRQFFPFGDPSMFSEYVFNVFDKDKSGTVDYKEFICAISVTSRGTLEEKLEWAFQLYDINGDGKISYDEMLAIVTAIYKMVGSMVKLPEDESTPEKRVDKIFRQMDKDRNGELTLEEFREGSKVDPTIVSALNLYDGLV

SEQ ID NO: 2634 - protein, 136 aa, Unknown
  Rosa hybrid cultivar
MMEVCRAQGFVYGIIPEKGKPVSGASDNLREWWKDKVRFDRNGPAAISKYQADNSIPGLMEDCISVASTPHTLQELQDTTLGSLLSALMQHCDPPQRRFPLEKGVSPPWWPTGNEEWWPQLNLANQGPPPYKKPHG

SEQ ID NO: 2635 - protein, 500 aa, Oryza sativa
  misc_feature (48)..(48): Xaa can be any naturally occurring amino acid
HASAGAVAHLQSADRDKGDVYHVPATASRLPSPLLLLPPPRRRSSVVXRLLPLLVVSAAERTNVASLPGLDGALPSRFETGYVTVDEENGGELFYYFIESEGDPGADPVLLWINGGNRCSVLSALFFEIGPVKLAIEPYDGGVPRLRYNPYTWTKVASVLFVDSPVGAGFSFSRDPRGYDVGDVSSTLQLTKFVNKWFSQHREFLSNPLYVGGESYAGKLVPFLLQKISEDVEAGVKPVLNLKGYLVGNPGTGESIDYESKVPYAHGVGIISDQLYETILEHCGREDYANPKNATCAQALNRFSELMGEVSEAHILYKKCIYVSPKPDDGTIGRKILEEIVVGNHRPPRPPMDCSTYPNYLSYFWANSNNTRENLGIKKGTVDEWVRCHDDGLPYSQDIESSIKYHQNLTSRGYRVLVYSGDHDSVVPFLGTQAWVRSLNYPIVDDWRAWHIDGQSAGFTITYANDLTFATVKGGGHTAPEYQPERCLAMFGRWISEKSL

SEQ ID NO: 2636 - protein, 168 aa, Mannheimia succiniciproducens
MPLSAKKPRILIQGGYMETTFRHVAAQKHIALVAHDHCKEDLINWCQKNVHHLQNHQLYATGTTGHLIEKATELKINSLLSGPMGGDQQLGALIAENKIDVMIFFWDPMNAVPHDPDVKALLRIAAVWNIPHAMNIASADLLINSPLINREIELRIPDYQTYLQKRLK

SEQ ID NO: 2637 - protein, 758 aa, Desulfitobacterium hafniense
MEFSRRNFLKTCAISAAMMTVGCTSQTKTIQVDPPEPAPSAPKQIDVDQWVKSVCRYCGTGCGVLIGVKDGKVAAVKGDPDNEGNKGLLCAKGYYLPQVITHSERVTKPLIRKNGKLEPCTWDEAMELVTAKFKESIANNGPDSVAFYGSGQQLAEEGYVANKLFKGAIGTNNIDGNPRLCMASAVGGFTTTFGADEPMGCLEDFEHANVFFIIGSNIAEAHPVLFGRLTDKKKKDPDTKIIIADPRRHRSHEIADISLQFVPGTDMALLHAMAYVIIEEGMADEEFIAKHTSFSNGKEAITFAAYKEFLKEFTPEKAEKVTGLPAAQIQEVARLFGEKGKNTMSMWTMGINQRVAGVWANNLIHNLHLLTGKICKPGSTPFSLTGQPSACGSVRETGALSHLLPGHRVIANEKHRKEVAELWGVPADRISPQAGLHTMELFKACGDGRVKCLYVMCTNPAHSLPNVNAYQEGFEKVFLVVAEAFHPTATTKYADVVLPAAFWCEKEGVYGNTDRRTQHLAKAINPPGEAKPDLDILLDLAQRLGYGELFPFKTPEDVWNEYLKCTTGTHMELATYPALREAHGIQWPVKDHQGNKGAVRRYVAPEDPYVKEGIDFYSAKDHKAVIFARPYLGPAEVVDEEYPYYLTTGRILEHWHTLTMTGKCPTLMRAVPKQYVELNPQDAAELGIKEGDTVRLVSRRGKVEIPVRVGKPGEPRPGLLFALWFEPDPLVNAVTIDAVDAASKEPEFKICAVKIEKV

SEQ ID NO: 2638 - protein, 445 aa, Glycine max
  misc_feature (203)..(203): Xaa can be any naturally occurring amino acid
  misc_feature (354)..(354): Xaa can be any naturally occurring amino acid
MAVVAVQQFLCFTELNWRNITRPCIPPHSSILLRSRKKIQYSLISCSSSQTPEADTQTAESCVNLGLELFSKGRVKDALAQFEAALSLNPNPVEAQAAYYNKACCHAYRGEGKKAADCLRTALREYDLKFGTILNDPDLASFRALPEFKELQEEARLGGEDIGYSFRRGSKNLLVKSKHHFFLGGVPGVRRFFYVAFTAAAGXISLFFTLPRLLRAINGGDGAPDLLATAGNAAINIGGIVVLVALFFWDNKKEEEQLAQISRDETLSRLPLCLSTNRVVELVQLRDTVRPVILAGKKETVSLAMQRAERFRTELLRRGVLLVPVIWGEGQETKLEKKGFGLKPKAAEALSSIXGEDFEKRAQSITAKSKLKSEIRFKAEVVSPVEWERWIRDQQKSEGVSLGEDVYIILRLDGRVRRSGKGMPDWQQIVKELPPMEAFLSKIER

SEQ ID NO: 2639 - protein, 589 aa, Ustilago maydis
MATLPAMDKRTFWFRDAIVYQIWPASYKDSNNDGIGDIQGIISTLDYVESLGVNTIWLSPMYESPQVDMGYDISDYQNVYAPYGTLQDMDELIRECHAREIKLILDLVINHTSDQHAWFQESKKSKVSPKRDWYIWRPAKYDARTGERRPPNNWRGALNQSAWTWDEATQEYYLHLFTPQQPDLNWSNVECRRTLYSDTIEFWLKRGINGFRVDTVNLYSKPMDFPDAPITDPNAEWQMGDTVFCNGPRMHEYLQEMGVIFAKYDAMTVGELPSTPKIEDVLRYISAERNELSQVFQFDISTLGRDENDFYATHPFSLQELKEVVEKWQRYVEGTDAWPTVFLENHDLPRAISKYASDRPEFIAASGKMLALMEIGLTGTLYIYQGQEIGMTNVPKAWAHEEYKDVIAVNYYRDAVTRSGGDEKVLKKTLEDINKQGRDSARTPVQWSSEPNGGFSTDPNTVPWMRTNDNYTSINVAAQEKDDQSVLAFYRKGLALRKEYACLLARGEFRLLDRENQQVLKYLKIPEGGQEDDNGQRVFVVLNFSNCPQEYTVPEEAGGNKASMLVETLEKGEPGKLRPWEGRMYLYRP

SEQ ID NO: 2640 - protein, 193 aa, Triticum aestivum
  misc_feature (117)..(117): Xaa can be any naturally occurring amino acid
MAPTVMASSATSVAPFQGLKSTAGLPVSRRSNGASLGSVSNGGRIRCMQVWPIEGIKKFETLSYLPPLSTEALLKQVDYLIRSKWVPCLRFKQVGSSSREHNASLGYYDGRYWDMWXLPISGAPTHTSVNEVEESRRIPDAYSASSDRHIASACVSSCLNHGLKIRKANSYHTGIINAFSLHPKCLVPLLLMS

SEQ ID NO: 2641 - protein, 573 aa, Saccharomyces bayanus
MLSKSEKHIDLLAGNMSNLSFDGPGTPSSTGLFNVNQNNTNRRMRPTGFNDSPSPIKSSLFPHEDSSNMDIDEVSQSDMDITNSPKKLPPKFYERATSNKTQRVVSVCKMYFLEYYCDMFDYVISRRQRTKQVLEYLQQQSQLPTADQAKLNEEWSSYLQKEHQVLRKRRLKPKNRDFEVITQVGQGGYGQVYLARKKDTKEVCALKILNKKLLFKLNETKHVLTERDILTTTRSEWLVKLLYAFQDLQSLYLAMEFVPGGDFRTLLINTRCLKSGHARFYISEMFCAVNALHDLGYTHRDLKPENFLIDAKGHIKLTDFGLAAGTISNERIESMKIRLEKIKDLEFPAFTEKSIEDRRKMYNQLREKEVNYANSMVGSPDYMALEVLEGKKYDFTVDYWSLGCMLFESLVGYTPFSGSSTNETYDNLRRWKQTLRRPRQSDGRAAFSDRTWDLITRLIADPINRLRSFEHVKRMSYFADINFSTLRSMIPPFTPQLDSETDAGYFDDFTSEADMAKYADVFKRQDKLTAMVDDSAVSSKLVGFTFRHRNGKQGSSGILFNGSEHSDPFATFY

SEQ ID NO: 2642 - protein, 136 aa, Corynebacterium efficiens
MTSTENFYDSVGGEETFNLIVHRFYEQVRTDDILGPMYPQDDWEGAEARLRMFLVQYWGGPKDYSEQRGHPRLRMRHAHFPIGVTAAERWLELMTRALDSLEEGTLTDDQRAAIWDHMVRAADMLINSNPDPHQRD

SEQ ID NO: 2643 - protein, 102 aa, Chlamydophila caviae
MVKVVSAENFNSFIATGLVLIDFFAEWCGPCKMLTPVLESLEAEVSSVLIGKVNIDDHPAPAEQYGVSSIPTLILFKDGKEVDRVVGLKDKDSLIRLINQHS

SEQ ID NO: 2644 - protein, 369 aa, Prochlorococcus marinus
MSENPASKIEEKNPEKETSIPEETVSNSTSAEFEENSISELKEDDIPKNIPAADDSSSRINKSDLESAGFTLDEFASLLSKYDYNFKPGDIVNGTVFALESKGAMIDIGAKTAAFMPMQEVSINRVEGLSDVLQPSEIREFFIMTEENEDGQLSLSIRRIEYQRAWERVRQLQKEDATIYSEVFATNRGGALVRVEGLRGFIPGSHISTRKAKEELVADFLPLKFLEVDEERNRLVLSHRRALVERKMNRLEVGEVVVGAVRGIKPYGAFIDIGGVSGLLHISEISHEHIETPHSVLNVNDQMKVMIIDLDAERGRISLSTKALEPEPGDMLTDPQKVFDKAEEMAARYKQMLLEQAEEGEDPIAVMTI

SEQ ID NO: 2645 - protein, 550 aa, Streptomyces hygroscopicus
MKHCIVVGYHETDMSGEELQLALEHGGDDLPAPIRSMLRTKITFGGSHYSYMDALSLVRNEGPGTDHAYTVSELPSLGTLYLVNYLEEHGHPADFVNSFSFEQDQLVKLLADNPASVAITTTFYMMPAPVIEIIRFIRRHNANVPIIVGGPLVDNQCREGRGDKLNRFFDRVGADYYVWESQGEAALAAVVGAIVNGDAPTEVPNVFLRSAATGEWRLTRKRPEANDLNAFSVRWNRFDPTVLGPTLSTRTARSCAFSCAFCDYPERAGALTLADLSTVERELEELADLGVKRVAFIDDTFNVPMRRFKDLCRMLVRRDFGIEWFSYFRCGHARDPDVYDLMYDSGCRGVLLGIESGDDQVLLNMDKRATTAHYQNGIEQLKARGIFTHASFVVGFPGESPQTVRNTIDFINSAGPDTFAVNHWYYMQSTPIHVRAPQFDLTGNGHTWSHRTMNSHQALEAADEIFDSVVNAAWMPVNGLDFWGVPYLLGKGMSHAEIVRFLDLAKPLTVANVSRGSAEEAATAERRFRDFVTGLDLAPARYRTAGSEFR

SEQ ID NO: 2646 - protein, 299 aa, Triticum aestivum
PGMSSSSSSGASAAFTPVSQQQQQMAPENLSSELQPPAPMQPEAPSEQLCYVHCHFCDTVLVVSVPSSSLFKTVTVRCGHCSSLLTVDMRGLLFPTTTTTVAAESAASAVTTTTSPPPAAAAHHGQFHYPSSLNLAPGNPPRHSLLDEISSANPSLQLLEQHGLGGLIAAAGGRNAAAPAPLPPPPVAGGKGGKEPSPRTNPVVNRPPEKRQRVPSAYNRFIKDEIQRIKAGNPDISHREAFSAAAKNWAHFPHIHFGLMPDHQGLRKTSLLPQDHQRKDGHGLLKEGLYAANMGIAPY

SEQ ID NO: 2647 - protein, 187 aa, Phelipanche bungeana
LGHDIRKWNLKMAPYISANRNGIHITNLIKTARFLSEACNLVFDAASRGKQFLIVGTKKKTANSVACAAIKARCHCVNKKWLGGTLTNWSTTERRLHQFRDLRIEQKMGRFKRLPKRDAAVSKRQLSRLQTYMGGIKYMTGLPDIVIIIDQHEEYTALRECITLGIPTICLIDTNCDPDLADLSIPA

SEQ ID NO: 2648 - protein, 313 aa, Kageneckia oblonga
GGLGDVLGGLPPAVAANGHRVMTVSPRYDQYKDAWDTSVLVEIEVGGRVETVRFFHCYKRGVDRVFVDHPLFLERVWGKTESKIYGPRAGVDYKDNQFRFSLLCQAALEAPRVLNLNSNKYFSGPYGDDVVFIANDWHTALLPCYLKTIYKPKGIYKKAKVAFCIHNIAQPGRFPLSDFSLLDLPNNLEGSFDFFDGYNKPVKGRKINWMKAGILESDRVVTVSPYYAQELISGEDKGVELDNIIRKTGITGIVNGMDVQEWNPATDKYLDIKYDNTTVLDAKPLLKEALQAEVGLPVDRNIPVIGFIGRLEE

SEQ ID NO: 2649 - protein, 142 aa, Listeria innocua
MSIEVGNKLQGKVTGITNFGAFVELEGGKTGLVHISEVADNYVKDINDILTVGDEVTVKVMNIGDDGKIGLSIRKAVDRPDRPEKSYDRKPKYSKKPAGNYVKPAESFEDIMSKFLKDSDERLTTIKRQTESKRGGRGAKRG

SEQ ID NO: 2650 - protein, 648 aa, Listeria innocua
MDDTKKRIHKYIEKHDLIRSDDKLLVAVSGGPDSFALLHFLWSANLVPKEAIAVAHLNHHLRENAEKEQLAVQTFCEERDIPFFIEEVDVKKRAEKLQKGIEETARIVRYDFFEKVMAENNINKLVLAHHADDQIETILMRLVRGSSSIGWSGIQPKREVRGGYAIRPFLPITKAEIIEYATKHALPYEIDESNTSQEYTRNRYRTQLLPFLSKENPAVYEHFKRFSEETSEDFQFLEELASNLLKKNLIQNGKQSTLLLSDFKNEANPLQRRAIHLLLMYLYNDDGRVITVNHIYQIIQMIQSENPSSSIDLPKKLTVIRSYNELHFQFGERHAPPEFYHQLELNDRIELDNKASIRLKLKSSVVQTNGLNGMLLDAEDITLPLIVRNRVNGDRMTMKGQAGSKKLKDIFIDAKIPRQERDNLPVITDYTGKILWVPGVKKSAYDREFSRSKKQYIIRYTRNIGGNESMHNDIQKVLISEDELQEKIRELGRELTAEYEGRNPLVVGVLKGATPFMTDLLKRIDTYLEMDFMDVSSYGNGTVSSGEVKIIKDLNASVEGRDVLIIEDIIDSGRTLSYLVDLIKYRKAKSVKLVTLLDKPAGRNVAIEADYVGFVVPNEFVVGYGLDYAERYRNLPYIGILKPEIYSE

SEQ ID NO: 2651 - protein, 187 aa, Phelipanche oxyloba
LGHDIRKWNPKMAPYISANRKGIHITNLIKTARFLSEACNLVFDAASRGKQFLIVGTKKKTANSVACAAIKARCHCVNKKWLGGTLTNWSTTERRLHQFRDLRIEQKMGRFKRLPKRDAAVSKRQLSRLQTYMGGIKYMTGLPDIVIIVDQHEEYTALRECITLGIPTICLIDTNCDPDLADLSIPA

SEQ ID NO: 2652 - protein, 313 aa, Malus sargentii
GGLGDVLGGLPPAMAANGHRVMTISPRYDQYKDAWDTEVTVELKVGDKTETVRFFHCYKRGVDRVFVDHPLFLEKVWGKAASKIYGPVAGVDFKDNQLRFSLLCQAALVAPRVLNLNSSKYFSGPYGEEVVFIANDWHTALLPCYLKAIYKPKGIYKTAKVAFCIHNIAYQGRFAFADFALLNLPNEFKSSFDFIDGYDKPAKGRKINWMKAGILESDKVLTVSPYYAEELVSSVEKGVELDNILRKSGIQGIVNGMDVQEWNPVTDKYTTVKYDASTVADAKPLLKEALQAEVGLPVDRDIPVIGFIGRLEE

SEQ ID NO: 2653 - protein, 962 aa, Unknown
  Shewanella sp. MR-7
MTKQTLTQLEQHDLFLRRHIGPDSSQQQEMLNYVGAESLDDLTAQIVPESIRLNQELSIGDSCGEAEGIAYIRGLAKQNQVFKSYIGMGYYGTQVPNVILRNVFENPGWYTAYTPYQPEIAQGRLEAILNFQQVSMDLTGLDLASASLLDEATAAAEAMALAKRVSKAKKANIFFVADDVFPQTLDVVKTRAECFGFEVVVGPAHEAVNHELFGALFQYSNRFGQITDFTDLFAELRAKNVVVTVAADIMSLVLLKSPGAMGADVVFGSAQRFGVPMGFGGPHAAFFVARDEHKRSMPGRIIGVSKDTRGNRALRMAMQTREQHIRREKANSNICTAQILLANMASFYAVFHGPQGLKTIASRINRFTDILAAGLQAKGVSLVNNTWFDTISIKGLDVAAVNARALAAEMNLRFDADGIVGVSLDETTLRTDIEALFDVILGAGHGLDVAALDAQIVAQGSQSIPEALVRQDAILSHPTFNRYQSETEMMRYIKRLESKDLALNYSMISLGSCTMKLNAAVEMLPVSWPEFANMHPFCPLDQAKGYTQLIEELSSWLVNVTGYDAVCIQPNSGAQGEYAGLLAIRKYHESRGEAHRNICLIPQSAHGTNPASAQLAGMQVVVTACDKQGNVDLEDLKAKAAEVAENLSCIMITYPSTHGVYEESIREICNIVHQHGGQVYLDGANMNAQVGLTSPGFIGADVSHLNLHKTFAIPHGGGGPGMGPIGVKAHLAPFVAGHVVVKPGRESDNNGAVSAAPYGSAGILPISWMYIKLLGSNGLKKSTQTALLNANYVMKKLSEHYPVLFRGRNDRVAHECIIDLRPIKEASGVTEMDIAKRLNDYGFHAPTMSFPVAGTLMIEPTESESKVELDRFIDAMVSIRAEIAKVEAGEWPADNNPLHNAPHTMADIMDPAFDSRPYSREVAVFPSAAVRTNKFWPTVNRIDDVYGDRNLFCACVPLSDYE

SEQ ID NO: 2654 - protein, 213 aa, Glycine max
LFAYRFASLATRMEQYVAGQSRDLVDQAYTKFVSIMFVTLEKNAQTDPKYADIFLIENYAAFQNSLYDLANVVPTLAKFYHQASEAYEQACTRHISVIIYYQFERLFQFARKIEDLILNNVAPEEIPFQVGLSKADLRKTLKSSLSGVDKSIAAMYKKLHKNLTSEELLPSLWNKCKNDFLDKYETFVQLVARIYPAESVPSVAELRDLLASM

SEQ ID NO: 2655 - protein, 577 aa, Arabidopsis thaliana
MCGILAVLGCVDNSQAKRSRIIELSRRLRHRGPDWSGLHCYEDCYLAHERLAIVDPTSGDQPLYNEDKTIAVTVNGEIYNHKALRENLKSHQFRTGSDCEVIAHLVKHGEEFVDMLDGMFAFVLLDTRDKSFIAARDAIGITPLYIGWGLDGSVWFASEMKALSDDCEQFMCFPPGHIYSSKQGGLRRWYNPPWFSEVVPSTPYDPLVVRNTFEKAVIKRLMTDVPFGVLLSGGLDSSLVASVALRHLEKSEAACQWGSKLHTFCIGLKGSPDLKAGREVADYLGTRHHELHFTVQDGIDAIEEVIYHVETYDVTTIRASTPMFLMSRKIKSLGVKMVLSGEGSDEIFGGYLYFHKAPNKKEFHEETCRKIKALHQYDCLRANKSTSAWGVEARVPFLDKEFINVAMSIDPEWKMIRPDLGRIEKWVLRNAFDDEKNPYLPKHILYRQKEQFSDGVGYSWIDGLKDHANKHVSETMLMNASFVFPDNTPLTKEAYYYRTIFEKFFPKSAARATVPGGPSVACSTAKAVEWDAAWSQNLDPSGRAALGVHVSAYGEDKTEDSRPEKLQKLAEKTPAIV

SEQ ID NO: 2656 - protein, 313 aa, Malus sargentii
GGLGDVLGGLPPAMAANGHRVMTVSPRYDQYKDAWDTGVPVEIEVGGRVETVRFFHCYKRGVDRVFVDHPSFLERVWGKTGSKIYGPSAGEDYKDNQFRFSLLCQAALEAPRVLNLNSNKYFSGPYGDDVVFIANDWHTALLPCYLKAIYKPKGIYENAKVVFCIHNIAYQGRFPISDFSVLNLPENLKGSFDFIDGYNKPVKGRKINWMKAGILESDRVVTVSPFYAQELVSGEDKGVELDNIIRKTGITGIVNGMDVQEWNLATDKYLDTKYDNTTVLDAKPLVKEALQAEVGLPVDRNIPVIGFIGRLEE

SEQ ID NO: 2657 - protein, 313 aa, Oemleria cerasiformis
GGLGDVLGGLPPAMAANGHRVMTVSPRYDQYKDAWDTSVLVELEVDGRIETVRFFHCYQRGVHRVFVDPPSFLERVWGKTGSKIYGPRAGVDYRDNQLRFSLLCQAALEAPRVLNLNSNEYFSGPYGEDVVFIANDWHTALLPCYLKTIYKPEGIYQTAKVAFCIHNIAYQGRFPFSDFSLLDLPDQLKGSFDFIDGYNKPVKGRKVNWMKAGILESDRVVTVSPYYAQELVSGEDKGVELDNIIRKTGITGIVNGMDVQEWNPTRDKYLDVKYDETTVLDAKPLLKEVLQAEVGLPVDRNIPVIGFIGRLEE

SEQ ID NO: 2658 - protein, 521 aa, Pseudoalteromonas tunicata
MLDAKIKTQLQAHLNNITKPIQLVINLDESKKSIELQSLANELSELNSLVSVSTTQNTAIRAPQLSVLGEQSEINFAGVPMGHEFTSLILALLHTGGHATKASAEEIEQISTLTAPLNFEIYISLSCQTCPAVVQALNLMAAINPAIKTTMIDGALFQNEVQQRNILSVPAVYLNGQPFSHGAISLADILAKLDKNHAGKVAKQLNEKEQYDVLIVGGGPAGAAAAVYAARKGLRTGLVAERFGGQVSDTLGIENFLSVKSTQGPQLVAQLEEHVKEYDVDLITAQKAKQLNTENGFAIELESGAQLQAKSVILATGARWREMNVPGEQQYRGKGVAYCPHCDGPLFKNKKVAVIGGGNSGIEAAIDLANIVEHVTVLEFAQSLRADAVLIKKARSMGNITIITQAQTTEVVGDGNKVIGLNYRDHANNEEHHLALAGIFVQIGLLPNTDWLKGTVELSQRGEIITNSHGATSIAGVFAAGDVTNTPYKQIIIAIGSGATASLGAFDYLIRHDQAQTEFAA

SEQ ID NO: 2659 - protein, 855 aa, Aspergillus nidulans
MAKNKTKTSVLFLANSEHGQTNIVLAIIHELLVRGGIDIHLASFPVLEKRLNKLLHDNETAYDAEYSTRIHFHPVRGPSNTEIFIRTGKRGAFHPPGYTGSVLGFKSLCEDIWGWTEEEYVDIYESCVEIINAIKPSLCAIDFFFLQGRDAAYNAGQTTVLLNTTSLSHIVLGLQKNAKWAWKYPMPGTGFPYPLPPHLIPLNTMAVLKTAKMYHGSGRRREIRDWRIKHKIHGRFPFADSWMPNRLHLSPALKELDWPFDVPDNVVPCGPILLPVAPVKTQDPEMFAWLHRGPTVLINLGTLYAPNPSVVLEIATGVKTFLASCSDRKIQVLWKLPKHPHDQEEIYTQSVTPLQKEMEADQVRIRSWFEVEPLAMLQTGQIVCSVHHGGANSWYEAIQNGVPHVVLPAWQDCYENAARAEWLGIGAYGNKSRAPDIGGKELSKALIKVLGNKSYLEKASKLQKLCQKKEGRLEAADRIADLAARPDKSMIAVPEVDENDPRVVTVTNGKGETLQTVNSVDEGAVNKSILRRLLEIITVAFISNTWFLLPLLGYSLLLVPHNGFRILVLSYILHIKFFSNAHKTSAPKPSKWLRSSLMWKLHASYFPIRLYRSASLSPRRKYVIGAHPHGIACHGIAGAFTADATGFETLFPGIVNRFLVKDGMFTAPLLREYLFARGQSGVSKDSCIQHLTRGGYDLRGMGKAITISVGGSREYNIARPGTMGIVVKLRKGFIRLAVETGADLVPVLVFGENDLFAPIQFSRYSIKGLIAWAWEKAAGHKVAFSLGRFCMFIPFRRPLHVVVGRPISVKQQRFDVSEKYVEELQGQYIDELNRIWADWRNVFEEDASVKFEIVE

SEQ ID NO: 2660 - protein, 421 aa, Glycine max
  misc_feature (42)..(42): Xaa can be any naturally occurring amino acid
MDGTFDDESEPAVTIGEYLEEVEERELEADLVLGGDDGKECXTYNKGYMKRQAIFSCLTCTPDGNAGVCTACSLSCHDGHQIVELWTKRNFRCDCGNSKFGEFYCKIFPNKDVENVENSYNHNFKGSYCSCGRPYPDLDAEEQVEMIQCCLCEDWFHEEHLGLESSAEIPKDDEGEPTYEEFICKACSHVCFFLKLYPEKIWAAGKQPDATVQISKDKGVLEDMPSTCGSEKPTCNTSCSSPKVDDAQATVDSKSISDGKSLSQGENCNGSMASNQCTKSIDLHVNCLLGVNIITVNPVLPGKPMFLSKNWRDALCKCNNCLEFYKQKQIAFLLDKEDSIAEYEQMAKQKREEKLQQQEGAELSFFNKLGHVEKVEILKGIEEMKDGLRAFLESADSSKPITAADVHQFFDDIKNKRRRVQ

SEQ ID NO: 2661 - protein, 1229 aa, Aspergillus oryzae
MDDLQSLELFSLVSRITSELQNHLGINDKTLAEFVIDQHLKCGSFSKFKETLDEMGAEFPQSLMESIDRLVLTMHPKYKTKKTDDADKAEGGDDMDVLDALEKKARVFKGLAVPDKAPQWDEDDYTDRKNSDEGDAKADAMDDTFAMLEGLAGKAREEKGHTTGEDRSSRKRSRSPGYDDYDRGRRRKDKYRSQSRSHSPRYRKRDDDVDEFGRTRSKYSSRDEHRDGRSERRQRRHDRSQDDHFRKPPPVELDDAPILYKVYDGRVTGVKDFGAFVNLSGVKGKVDGLVHVSAMQEGARVNHPSDLVSRGQPVKVKVISIQGSRIGLSMKEVDQVTGLDLIPQRRLASGANMERLDGTSANDRYGNLSSDVPVIEDSNGRPMKNRKRLTSPERWEIRQLIASGVASAADYPDLDEEYHATLTGEGTFEEEEDIDIEVRDEEPPFLAGQTKMSLELSPIRVVKAPDGSMNRAAMAGTNLAKERRDLRQQEAQDKAAEQAAGVDLNAQWQDPMAAPEDRKFAADLRTAQQPKPDDAVPEWKRVTMGKNQSLGKRTSMSIKQQRESLPVFKFRKQLLDAVRDNQLLIVVGDTGSGKTTQLTQYLAEAGYGNNGIIGCTQPRRVAAMSVAKRVAEEVGCKLGAEVGYTIRFEDCTSPETRIKYMTDGMLQREVLLDPDLKRYSVIMLDEAHERTIATDVLFGLLKKTIKRRPDLRLIVTSATLDAEKFSEYFNGCPIFSIPGRTFPVEIMYSKEPESDYLDAALITVMQIHLTEPSGDILVFLTGQEEIDTSCEILYERMKALGSSVPELVILPVYSALPSEMQSRIFEPAPPGGRKVIIATNIAETSITIDNIYYVIDPGFVKQNAYDPKLGMDSLVVTPISQAQAKQRAGRAGRTGPGKCFRLYTEAAYQSEMLPTTIPEIQRQNLSHTILMLKAMGINDLLHFDFMDPPPTNTMLTALEELYALSALDDEGLLTRLGRKMADFPMEPALAKVLIASVDMGCSEEVLTIVAMLSIQSVFYRPKEKQQQADQKKAKFHDPQGDHLTLLNVYNGWKNSKFNNAWCFENFIQARQIRRAQDVRQQLLGIMDRYHHRIVSCGRNTTKVRQALCTGFFRNAARKDPQEGYKTLVEGTPVYMHPSSALFGKPAEHVIYHTLVLTTKEYMHCTTAIEPKWLVEAAPTFFKVAPTDRLSKRKKAERIQPLHNRFAGEDDWRLSAQRRQGRGGGGGTWG

SEQ ID NO: 2662 - protein, 267 aa, Methanopyrus kandleri
MPRKLRDLPEEGEIVMATVERVEDHGAFVTLDEYPGVDGYIHISEVASGWVKNIRDYVKEGQKVVAKVIRVNPKRKYANLSLRKVTDHQRKEKLKEWKREQRAEKLLEMAAEELGKDLDEAYEEAGYKLIEEYGSLYDALERAAAEEGPEPLLKAGVPEEWAEKLAELAIENIEPGRVKIEAYVDLTCPAPNGVEIIREALEKIEEFQQGDVKMEVQYVGAPRYRITVDAPDYRTAEKMVRKAAQAAIDHVEEHGGEGEFHREIEEG

SEQ ID NO: 2663 - protein, 194 aa, Sulfolobus tokodaii
MSTRSVRKIRETKETKIELYLDIDKKGEVKVSTPVNFLNHMLSTLFYYMNSTATLIAEDKQNFDDHHVVEDTAIVIGEAFKEALGDKKGIRRFSHQIIPMDDALVLVAVDISGRGVSNIELNLERDEIGGLATENIIHFFQTFSYNSGVNMHIIQLRGWNTHHVIEASFKGLGFSLYEASRIVYEETYSLKGSL

SEQ ID NO: 2664 - protein, 438 aa, Oryza sativa
MDPWSEIEGKRAHDPIFQNYFSQNCRQSVDGFCKKRSADAAVARAERCIRVLGPIIVGAGPSGLAVAACLKEKGVDSLVLERSNCIASLWQLKTYDRLSLHLPRQFCELPLMPFPAYYPIYPSKQQFVAYLESYAARFGICPTYNRTVVCAEYDEQLQLWRVRTRATGIMGEEVEYVSRWLVVATGENAEVVLPEIDGLDDFKGTVMHTSSYKSGGAFAGKRVLVVGSGNSGMEVCLDLCNHNANPHIVVHILPREMLGQSTFGLSMWLLKWLPVHVVDRILLLIAQTMLGDTAQLGLKRPTIGPLELKSLSGKTPVLDVGTFAKIKSGDIKVRPAIKQISGRQVEFMDTRLEEFDVIVLATGYKSNVPFWLKDRELFSEKDGLPRKAFPNGWKGENGLYSVGFTRRGLMGTSVDARRIAHDIEQQWKARGKHPGVLL

SEQ ID NO: 2665 - protein, 130 aa, Corynebacterium diphtheriae
MNTPASFYESVGGEETFHLIVHRFYERMRNDDLIGPMYPDDDWEGAEDRLRWFLAQYWGGPQTFSENRGHPRLRMRHAHFPIGMNEAQRWLDIMSDTLDSIDEATLPPAHRAAMWDHMQRVAQMLINQAP

SEQ ID NO: 2666 - protein, 124 aa, Calonectria ilicicola
QTARRSTGGKAPRKQLASKAARKSAPSTGGVKKPHRYKPGTVALREIRRYQKSTELLIRKLPFQRLVREIAQDFKSDLRFQSSAIGALQESVESYLVSLFEDTNLCAIHAKRVTIQSKDIQLAR

SEQ ID NO: 2667 - protein, 381 aa, Saccharomyces cerevisiae
MQIFVKTLTGKTITLEVESSDTIDNVKSKIQDKEGIPPDQQRLIFAGKQLEDGRTLSDYNIQKESTLHLVLRLRGGMQIFVKTLTGKTITLEVESSDTIDNVKSKIQDKEGIPPDQQRLIFAGKQLEDGRTLSDYNIQKESTLHLVLRLRGGMQIFVKTLTGKTITLEVESSDTIDNVKSKIQDKEGIPPDQQRLIFAGKQLEDGRTLSDYNIQKESTLHLVLRLRGGMQIFVKTLTGKTITLEVESSDTIDNVKSKIQDKEGIPPDQQRLIFAGKQLEDGRTLSDYNIQKESTLHLVLRLRGGMQIFVKTLTGKTITLEVESSDTIDNVKSKIQDKEGIPPDQQRLIFAGKQLEDGRTLSDYNIQKESTLHLVLRLRGGN

SEQ ID NO: 2668 - protein, 325 aa, Zea mays
MGEASPSIAKDVTELIGNTPLVYLNKVTDGCVGRVAAKLESMEPCSSVKDRIGYSMITDAEEKGLITPGVSVLIEPTSGNTGIGLAFMAAAKGYKLTLTMPASMSMERRIILKAFGAELVLTDPLLGMKGAVKKAEEIQAKTPNSYILQQFENPANPKIHYETTGPEIWKATAGKIDGLVSGIGTGGTITGTGRYLREQNPNVKLYGVEPVESAVLNGGKPGPHKIQGIGAGFIPGVLDVDLLDETLQVSSDEAIETAKALALKEGLLVGISSGAAAAAAVRLAKRPENAGKLFVVVFPSFGERYLSSVLFQSIKKEAESMVVEP

SEQ ID NO: 2669 - protein, 1024 aa, Unknown
  Arthrobacter sp. C2-2
HMTTADVSYLTDQGPGSGRRVPARSWLHSDAPALSLNGDWRFRLLPAAPGTAGAGSVLPSGETVEGVAAESYDDAAWDTLPVPSHWVMGQDGKYGRPIYTNVQYPFPIDPPHVPDANPTGDFRRRFDVPAQWFESTTAALTLRFDGVESRYKVWVNGQEIGVGSGSRLAQEFDVSDALRAGSNLLVVRVHQWSAASYLEDQDQWWLPGIFRDVTLQARPAGGITDAWLRTGWSARSGAGTGTIDPEITADATAFPVTLSVPELGVNVTWKSAEEVAPLALENVEPWSAEVPRLYEASVSSAAESISVRLGFRTVRIVGDQFLVNGRRVVFHGVNRHETHPDRGRVFDEAGAREDLALMKRFNVNAIRTSHYPPHPRLLDLADEMGFWVILECDLETHGFEAGGWVENPSDVPAWRDALVDRMERTVERDKNHPSIVMWSLGNESGTGSNLAAMAAWAHARDSSRPVHYEGDYTGAYTDVYSRMYSSIPETDSIGRNDSHALLLGCDSAESARQRTKPFILCEYVHAMGNGPGAMDQYEALVDKYPRLHGGFVWEWRDHGIRTRTAEGMEFFAYGGDFGEVVHDSNFVMDGMVLSDSTPTPGLYEFKQIVSPIRLGLSLPAGGKPTLAVANLRHTADASDVVLRWRVEHDGAVAASGEVAAEGSDGPLRAGESATIALPAMPAAPLGETWLTVEAVLRDATGWAPAGHPLGAVQLDLSAPAVPTRSPRPATPLDGALPVSLGPATFDAGTLVSLAGQPVSGPRLELWRAPTDNDRGAGFGAYGPGDPWLNSGRGVPAPSSEAVWKQAGLDRLTRRVEDVAALPDGIRVRTRYAAADSTHSVAVEENWQLDGGELCLRIDITPSAGWNLVWPRIGVRWDLPTDVDGAAWFGAGPRESYPDSMHATMVARHAASLEELNVPYARPQETGHRSDVRWLELDRAGAPWLRIDAEPDAAGRRPGFSLARHTAQEIAAAGHPHELPTPSHSYLYVDAAQHGLGSRACGPDVWPDFALRPEARTLKLRISPA

SEQ ID NO: 2670 - protein, 404 aa, Unknown
  Mycobacterium sp. MCS
MRELPHVLGIVLAGGEGKRLYPLTADRAKPAVPFGGAYRLIDFVLSNLVNARYLRICVLTQYKSHSLDRHISQNWRLSGLAGEYITPVPAQQRLGPRWYTGSADAIYQSMNLIYDEDPDYIVVFGADHVYRMDPEQMVQFHIESGAGATVAGIRVPRAEATAFGVIDADESGRIRSFVEKPADPPGTPDNPDEAFVSMGNYIFTTKVLIDAIRADADDDDSDHDMGGDIIPRLVSDGMAAVYDFSNNEVPGATERDHGYWRDVGTLDAFYDAHMDLVSVHPIFNLYNKRWPIRGESENLAPAKFVNGGSAQESVVGAGSIISAASVRNSVLSSNVYIDDGAIVEGSVIMPGTRIGRGAVVRHAILDKNVVVGPGEMVGVDLEKDRERFSVSAGGVVAVGKGIWI

SEQ ID NO: 2671 - protein, 308 aa, Listeria innocua
MTIVNSITDLIGKTPIVKLNRLPEAGSADVYVKLEFQNPGGSVKDRIANAMIESAEKSGALKPGDTIIEPTSGNTGIGLAMVAAAKGYQAIFVMPETMSIERRKLLQAYGAKLVLTPGPDGMKGAIAKAEELAKENNYFVPQQFHNPANPAVHEETTGPEIVEAFGKDGLDAFIAGVGTGGTVTGVGHVLKKNYPDVKIYALEPEESPVLSGGSPSPHKIQGIGAGFVPDTLDTKVYDGILKVSSEDALETAREVAKKEGILVGISSGATIKAALDLAKELGAGKKVLAIVASNGERYLSTPLYNFED

SEQ ID NO: 2672 - protein, 569 aa, Fulvimarina pelagi
MSNLNPSRDDFASMLEASFHEQDVAEGTVVKGTVVAIEKDMAVVDVGLKVEGRVALKEFGAKGRDGDLSVGDEVEVYVERIENALGEAVLSRDKARREESWIRLEAKFNENEKVEGQIFNQVKGGFTVDLDGAVAFLPRSQVDIRPIRDVTPLMNTPQPFQILKMDKRRGNIVVSRRTVLEESRAEQRSEIVQNLEEGQVVDGIVKNITDYGAFVDLGGIDGLLHVTDMAWRRVNHPTEILQIGQTVKVQIIRINQETHRISLGMKQLEADPWDGIGVKYPMGVKVTGRVTNITDYGAFVELEPGIEGLIHVSEMSWTKKNVHPGKILATSQEVEVVVLEVDPNKRRISLGLKQTLQNPWDAFAEKFPTGAIVEGEVKNKTEFGLFIGLEGDVDGMVHLSDLDWNRPGEQVIEEFNKGDLVKAQVLDVDVEKERISLGMKQVGGDPFVEAAEAGDVRRGSVVSCEVTQVTDGGIEVKIVETDLTSFIRRSDLARDRDEQRPERFSVGQTIDARVTQFDKKARKVGLSIKALQIAEEKEAVAQYGSQDSGASLGDILGAALKSGSKSDEE

SEQ ID NO: 2673 - protein, 197 aa, Zea mays
EQRAPVAPNKQISKMVEEAARLSKLFCDRNLPIFAFLDTHYPDKPEPPYPPHCIIGTGEENFVPDLEWLEKEPNVTIKRKSCIDGYISCIEEDGSSVFVDWVGKYQIKTVLVLGICTDICVLDFASSTLAARNIDRVPPLRDVVIYSEGCATYDLPVEIAMNIKGALAHPQDLMHHIGLYMAKGRGAKVVDRVVIEP

SEQ ID NO: 2674 - protein, 579 aa, Arabidopsis thaliana
MCGILAVLGCIDNSQAKRSRIIELSRRLRHRGPDWSGLHCYEDCYLAHERLAIIDPTSGDQPLYNEDKTVAVTVNGEIYNHKILREKLKSHQFRTGSDCEVIAHLYEEHGEEFIDMLDGMFAFVLLDTRDKSFIAARDAIGITPLYIGWGLDGSVWFASEMKALSDDCEQFMSFPPGHIYSSKQGGLRRWYNPPWYNEQVPSTPYDPLVLRNAFEKAVIKRLMTDVPFGVLLSGGLDSSLVAAVALRHLEKSEAARQWGSQLHTFCIGLQGSPDLKAGREVADYLGTRHHEFQFTVQDGIDAIEEVIYHIETYDVTTIRASTPMFLMSRKIKSLGVKMVLSGEGSDEILGGYLYFHKAPNKKEFHEETCRKIKALHQFDCLRANKSTSAWGVEARVPFLDKEFLNVAMSIDPEWKLIKPDLGRIEKWVLRNAFDDEERPYLPKHILYRQKEQFSDGVGYSWIDGLKDHANKHVSDTMLSNASFVFPDNTPLTKEAYYYRTIFEKFFPKQSAARATVPGGPSIACSTAKAVEWDATWSKNLDPSGRAALGVHVAAYEEDKAAAAAKAGSDLVDPLPKNGT

SEQ ID NO: 2675 - protein, 313 aa, Osteomeles anthyllidifolia
GGLGDVLGGLPPAMAANGHRVMTVSPRYDQYKDAWDTGVAVEIEVGGRVETVRFFHCYKRGVDRVFVDRPSFLERVWGKTGSKIYGPSAGEDYKDNQFRFSLLCQAALEAPRVLNLNSNKYFSGPYGDDVLFIANDWHTALLPCYLKAIYKPKGIYKNAKVVFCIHNIAYQGRFPISDFSVLDLPENLKGSFDFIDGYNKPVKGRKINWMKAGILESDRVVTVSPYYAQELVSGEDKGVELDNIIRKTGITGIVNGMDVREWNPATDKYLDTKYDNTTVLDAKPLVKEALQAEVGLPVDGNIPVIGFIGRLEE

SEQ ID NO: 2676 - protein, 313 aa, Osteomeles anthyllidifolia
GGLGDVLGGLPPAMAANGHRVMTISPRYDQYKDAWDTEVTVELKVGVKTETVRFFHCYKRGVDRVFVDHPLFLEKVWGKTASKIYGPTAGVDFNDNQLRFSLLCQAALVAPRVLNLNSSKYFSGPYGEEVVFIANDWHTALLPCYLKAIYKPKGIYKTAKVAFCIHNIAYQGRFAFADFALLNLPSEFKSSFDFIDGYDKPVKGRKINWMKAGILESDKVLTVSPYYAEELVSSVEKGVELDNIIRKTGIQGIVNGMDVQEWNPLTDKYTTVKYDASTVADAKPLLKEALQAEVGLPVDRDIPVIGFIGRLEE

SEQ ID NO: 2677 - protein, 313 aa, Physocarpus opulifolius
GGLGDVLGGLPPAMAANGHRVMTISPRYDQYKDAWDTEVTVELNVGEKTETVRFFHCYKRGVDRVFVDHPLFLEKVWGKTASKVYGPIAGEDYKDNQLRFSLLCQAALEAPRVLNLNSSKYFSGPYGEEVVFIANDWHTALVPCYLKAMYKPKGIYKSAKVAFCIHNIAYQGRFAFADFTLLNLPDEFRSSFDFIDGYNKPVKGRKINWMKAGILESDKVLTVSPYYAEELVSGVGKGVELDNIIRKTGIRGIVNGMDVQEWNPLTDKYTIVKYDASTVTDAKPLLKEASQAEVGLPVDRDIPVIGFIGRLEE

SEQ ID NO: 2678 - protein, 125 aa, Zea mays
  misc_feature (106)..(106): Xaa can be any naturally occurring amino acid
MATSSRAHEAPANNPDLPTEDDPYTTGYFLPPTMLREKDPQESLDYYSRERGMSLLHRLDYEEMTFWVVSYEVTSVRCYCSDDHIKLTVRTIREKATHAIAHYRRXHSDPALKGYYNGNSDPRES

SEQ ID NO: 2679 - protein, 313 aa, Prinsepia sinensis
GGLGDVLGGLPPAMAANGHRVMTISPRYDQYKDAWDTEVTVELKVGEKIEPVRFFHCYKRGVDRVFVDHPLFLEKVWGKTASKIYGPIAGEDFKDNQLRFSLLCQAALEAPRVLNLNSSKYFSGPYGEEVVFVANDWHTALLPCYLKSIYQPKGIYKSAKVAFCIHNIAYQGRFAFADFALLNLSDQFKSSFDFIDGYDKPVKGRKTNWMKAGILESDKVLTVSPYYAEELVSTVAKGVELDNIIRKTGILGIVNGMDVQEWNPLTDKYTAVKYDASTVTDAKPLLKEALQAEVGLPVDKDIPVIGFIGRLEE

SEQ ID NO: 2680 - protein, 236 aa, Nymphaea alba
MTRRYWNINLEEMMEAGVHFGHGTRKWDPRMAPYISAKRKGIHITNLTRTARFLSEACDLVFDAASRGKHFLIVGTKDKAADSVASAAIRARCHYVNKKWLGGMSTNWSTTETRLQKFRDLRVRAEMGQFSRLPKRDAAILKRQLSHFQTYLGGIKYMTGLPDIVIIIDQQEEYTALRECVTLGIPTICLIDTNCDPDLADIPIPANDDAIASIRLILNKLVSAICQGRSSYIRSR

SEQ ID NO: 2681 - protein, 313 aa, Prunus virginiana
GGLGDVLGGLPPALAANGHRVMTVSPRYDQYKDAWDTNVLVEIEVGGKIETVRFFHCYKRGVDRVFVDHPLFLERVWGKTGSKIYGPKTGEDYRDNQLRFSLLCQAALEAPRVLNLNSNKYFSGPYGEDVVFVANDWHTALIPCYLKTIYKPRGLYKNAKVVFCIHNIAYQGRFSFSDFSLLDLPDQLRSSFDFIDGYDKPVKGRKINWMKAGILESDRVVTVSPYYAQELISGEDKGVELDSIIRKTGITGIINGMDVQEWNPARDKYLDVNYDNTTVLDAKPLLKEALQAEVGLPVDRDIPVIGFIGRLEE

SEQ ID NO: 2682 - protein, 425 aa, Xylella fastidiosa
MSHIRHLAQQCRDAARILATLSTDAKRRLLETMATALNTDAATILAANAADLDAARTQQVGTAMLDRLALDPQRLAAMADALRDIAALPDPVGQVTRDDRRPNGIHIQKIRVPLGVIAMIYEARPNVTADAAALCIKAGNGIILRGGSEAIRSNIAIATALQRALRLASLPETALILVQDMARHTMLELLQLSDLIDLVIPRGGEGLIRFVAEHARIPVIKHYKGVCHQFVDASADIEMAIRLLIDGKTTRPAACNALETLLVHTDIAPRFLPAAAAALRPYGVQLRGDHATCTLLPDVLLATDADYAAEYLDLILAIRIVPNLDAALEHIRRYGSDHTEVIVTADPAHADTFVQQLPSAVVMVNASSRFSDGGALGLGAEIGISTTRLHAYGPMGLDALTVERFVVRGQGQVRHCPPYPPAPRR

SEQ ID NO: 2683 - protein, 458 aa, Unknown
  Streptomyces sp. FR-008
MPSTCPAPTSIGFRGCPHRRKGRTSRGRRIAVPTRPCGKVRKGHQHAKKWRVSMRGGSVAVVGGSIAGCAAALAASRGGAERITVFERADARLRDRGVGIGVHDARYAELRDAGYMADEMPWAPLNRRVWSVRDGDAEHGRAIGTQPFPFRAYNWGSLWSELRRRVPETATYRAGAKVEAVEQDADGVTVRLADGEPERFDLVIGADGYRSVVREAMYPGTGAAYAGYIGWRGTSPDVSGLPSDGLDAHNITFPGGHCMAYRIPDGSGGHRLNWVLYTAPPRIDGLHPDLRTPTSLPPGRLNAELTEHLRALVAEHFPPFWAAKLLSTPAETTFIQPIYDLDVPHYATDRMVLIGDAASVARPHLGAGSVKALQDATALEAAWVAGESWKEILEGYHAARGPVGTAMVGLARRMGSAQVEETPDWSAMGQAEFDAWWQEQNNGSDRRSGFGGHSLKSR

SEQ ID NO: 2684 - protein, 634 aa, Ustilago maydis
MCGILGCIHHPDAPAYRGKMLNMSRCIRHRGPDWSGCVVTQEEGSKGSILCHERLAIVGISTGAQPLVSTDGKLILAVNGEIYNHRQLRKNLKDQNAEFKTESDCEVILHLYREHGSDFVKMLDGMFSFILLDTTTTPHRVIAARDPIGITTLYQGASYKYPGAIYFSSELKAIHEECDRIRSFPPGHFYDSSLPEGKETVRYYTPSWLDGDAEGATIPTNPTDLKQIREALEKAVRKRLMSEVPYGVLLSGGLDSSLIASIAARETDKMADLQRKQWEERQARRSRGLTTPAGDANGAKLPVGLDEDADNEVENLAAWPRLHSFSIGLPGSPDLIAARKAAQFLGTVHHEYTFTVQEGLDAIADVIFHLETYDVTTVRASTPMYLLSRKIKAMGVKMVLSGEGSDEIFGGYLYFHAAPDKTSFHQECVRRVKNLHTADCLRANKSTMAWGLEARVPFLDKAFLDVAMNTDAADKMFSKGSLQQVDADGRPRMEKYILRKAFDVIPDDIEAGGDGSGSMLSASAPRKPYLPEDILWRQKEQFSDGVGYSWIDGIKDHAEKTVSDEKFQERAKRYPNDTPDTKEAYMIREIFESWFPSEAAASTAVRWIPRADWGCAADPSGRAVNIHESAYSTE

SEQ ID NO: 2685 - protein, 125 aa, Calonectria ilicicola
KQTARRSTGGKAPRKQLASKAARKSAPSTGGVKKPHRYKPGTVALREIRRYQKSTELLIRKLPFQRLVREIAQDFKSDLRFQSSAIGALQESVESYLVSLFEDTNLCAIHAKRVTIQSKDIQLAR

SEQ ID NO: 2686 - protein, 331 aa, Corynebacterium diphtheriae
MKIGVMGAGSWGTTLAKVFSDAGCDVTLWARREEVAREINTEHTNSTYLRGIALPHTLTATTQPTQALCDADVVVLAVPSQTLRGNLAEWCADIPQDALLLSLAKGIEKETFLRMSEVIAEVTGAQPDKVAVLSGPNLAREIAEEQPAATVIACTNEKNAQRIQHALAAPYFRPYTNTDVIGCEIGGACKNVIALACGMASGRGLGENTLATLMTRGLAEISRLGVAMGADPRTLSGLAGLGDLVATCSSPLSRNRTFGARLGEGKTLDEARAATNGQVAEGVISSQSIARLADSLGVDMPITRAVFGVCHRDQNVADMVAALMGRTKKSE

SEQ ID NO: 2687 - protein, 417 aa, Bacillus clausii
MEHLKTQDPAVFEAIRQELGRQRDKIELIASENFVSEAVMEAQGSVLTNKYAEGYPGRRYYGGCEYVDIAEDVARDRAKQLFGAAYVNVQPHSGAQANMGVYFTILEHGDTVLGMNLSHGGHLTHGSPVNFSGIQYRFVEYGVREDDKRIDYEAVREAAKTHQPKLIVAGASAYPREIDFKKFREIADEVGAYLMVDMAHIAGLVAAGLHQNPVPYAHFVTTTTHKTLRGPRGGMILCNEETAEEFGKKLDKSIFPGIQGGPLMHVIAAKAVAFGEALSDEFKTYAKQIIANAKRLGEKLQAEGVDIVSGGTDNHLLLLDLRSLQLTGKVAEKALDAVGITTNKNAIPFDPEKPFVTSGIRIGTAAVTSRGFGENEMDEIGELIALTLKNIDNEEALNSVRSRVAALTKTFPMYPNL

SEQ ID NO: 2688 - protein, 519 aa, Unknown
  Acinetobacter sp. ADP1
MLDQNIKTQLKAYLERLESPIELVAALDDSDKAAKIKELVTEIAELSNQVTARFDGQNTRRPSFGIAKAGEQPRVFFAGLPMGHEFTSLILALLQTSGYAPKVSDEILNQIKGLNLKADFDVFVSLSCHNCPDVVQALNLIAIYNPNSTATMIDGAFFQDEVEERKIMAVPMVFQNGNHIGQGRMTLEEIVAKLDSNAAEKDAAAINAKDVFDVLVVGAGPAGGTAAIYAARKGIRTGMIAERFGGQVMDTMDIENFTSVQKTVGPKFAADMEAHVREYDVDIMNLQRVSKIVGADQTASGLVEVELENGAKVESKTVILSTGARWRKMGVPGEQEYATRGVAYCPHCDGPLFKGKKVAVIGGGNSGVEAAIDLAGIVEHVTLVEFDTKLRADQVLQDKLNSLPNATIITNALSTEVIGDGAQVTGLKYKDRATDTEHTIELAGIFVQIGLLPNTDFLKGSVELSPRGEIIINERNETNVKGVFAAGDCTTVPYKQIIIATGEGAKASLSAFDYIIRHG

SEQ ID NO: 2689 - protein, 401 aa, Streptomyces coelicolor
MADSTASAEPQRPTHPAGRPVYVIGAGPGGLAVAHALRARGLRAVVLERADHVGSSWRRHYDRLRLHTTRRLSALPGLPIPRRFGRWVARDDVVRYLEKYAEYHQLEIVTGVEVFRVERAPDGTGWLLHAAGGRELTGAAVVVATGYNHTPRVPDWPGRDTYTGEFRHAADYRTPAPYAGRDVLVVGVGNTGAEIAVDLVEGGAARVRLAVRTAPHIVRRSTAGWAAQYTGVLCRRLPVALVDRLARPLARISVPDLSAQGLPRPGTGLYSRVAEGAIPVQDVGLIDAVRSGRVEVVAAMDGFEDGKVLLADGTRIAPDAVIAATGYRRGLEGLVGHLGVLDGTGRPVVQGGRTPAAAPGLYFTGFTNPISGMLRELAIDAERIAGAVAKRGAGGVSRLPG

SEQ ID NO: 2690 - protein, 382 aa, Unknown
  Vibrio sp. Ex25
MSKRDFYEVLGVSRDASERDIKKAYKRLAMKFHPDRNQGDESAADKFKEVKEAYEVLTDPQKKAAYDQYGHAAFEQGGGGFGGGGFGGGGADFGDIFGDVFGDIFGGGRRGGGGHRAQRGADLRYNMELTLEEAVRGVTKEIEVPTLVHCDTCDGSGAKKGSSAETCGTCHGHGQVQMRQGFFAVQQTCPTCHGKGKIIKDPCNECHGQGRKQKTKTLNVKIPAGVDTGDRIRLSGEGEAGEMGAPAGDLYVQVHVKEHHIFERDGNNLYCEVPVSFAMAALGGEVEVPTLDGRVSLKVPSETQTGRMFRMRGKGVKGVRGGGIGDLIVKLVVETPVNLSSRQKELLKEFEESCGGEAATKHKPKSEGFFNGVKKFFDDLTS

SEQ ID NO: 2691 - protein, 574 aa, Aspergillus oryzae
MSPAPVGEKWWKNSIIYQIYPASFKDSNNDGIGDIPGIISSLDYITSLGVDVIWISPMYDSPQYDMGYDVSDYESVYPPYGTVQDMEVLIDECHRRGLRIILDLVVNHTSHEHKWFKESRSSKASPKRDWYIWKPAKYDANGNRKPPNNWRSIFGGSAWEWDEGSEEYYLHLFCKEQPDLNWENQETRRAIYDSAMEFWLQKGVDGFRVDTVNMYSKHPEYPDAPVIDPKSETQMSPALFCNGPRIHEYLSEMNEVLAKYDAMTVGELPNTHTVDGILRYVSAAQNQLNMVFQFDIVDLGQGKDYKFLTTLPGWTLPELKTAVKGTQVIMKGTDGWSTVFTENHDQGRSVSRFGSEKTPELRVTSAKMLAMMQGTLSGTQFIYQGQEIGMVNAPESWTIDEYKDVDSTNYYQMVQKISNNDPLELETAMKSLQRFARDHARLPMQWSSETHGGFSSSEKTWMRVHDNYPEINVKVQEKDDSSVLSFWKQVIQLRKEYADLFVFGDFEILDEANEKVFTYIKRGQKQSALIVLNFSDDTLKFKQPAGVQDAKVLLRNVEGDLNELQPFEGRVLLF

SEQ ID NO: 2692 - protein, 124 aa, Calonectria ilicicola
QTARRSSGGKAPRKQLASKAARKSAPSTGGVKKPHRYKPGTVALREIRRYQKSTELLIRKLPFQRLVREIAQDFKSDLRFQSSAIGALQESVESYLVSLFEDTNLCAIHAKRVTIQSKDIQLAR

SEQ ID NO: 2693 - protein, 337 aa, Glycine max
MAKETSVVYLYPSKSQVWGENFDHKKLVITTLAANGKKEESNGAPNDTYPAFPGWYADVSWPGEAHTYKIEKILFHGKSEFQELLVFESSRQGKVAILDGHIQLTENDEFAYQEMLTHLALCSIPDPKKVLLIGGGDGGILREISRHSSVEHIDICELDQMVIDVYSEFFPDIAVGYEDPRVHVHISDGVAFINSVPEGTYDVIISDAFPAMGHSADVLADECFLESVAKALRPGGVFSAPADSLWHKNFVVADTIANCKKIFKGSVNYAWTTVPTYASGVIGFMLCSTEGPPVNFKHPINKLNPEKNGVAKGPTKFYNPEIHAAAFCLPSFVDKVD

SEQ ID NO: 2694 - protein, 245 aa, Methanopyrus kandleri
MEREITPIVLREGYEFINDCSESDVIVVGAGPAGLTCAYELAKSDVDVTIVERKLYVGGGMTGGGMLFPAGVIMEETAEVLEEVGVELRPAEAGLLAFNPVEAAIKLANAALEAGARILVGIEVEDVIERRGRVCGVVVNWTAVKAANMHVDPLALEAEYTVDATGHEAAVCKLAGIEVKGEGPMWAERGEELVVKHTQEVKPGLFVAGMAASAVKGAYRMGPIFGGMLESGKKAAEEILERLTE

SEQ ID NO: 2695 - protein, 123 aa, Unknown
  Synechocystis sp. PCC 6803
STLYEKLGGTTAVDLAVDKFYERVLQDDRIKHFFADVDMAKQRAHQKAFLTYAFGGTDKYDGRYMREAHKELVENHGLNGEHFDAVAEDLLATLKEMGVPEDLIAEVAAVAGAPAAKRDVLNQ

SEQ ID NO: 2696 - protein, 613 aa, Oryza sativa
MPTTFTPNSPASSCSIHHRASPSRGARNSVRFTRPRAAAAATNSVLSAPSSVPPAYVPPPPPPPTKMFPEAGDAAAAKAAARRGGKKKDGLNFFQRAAAVALDAFEEGFITNVLERPHALPRTADPAVQIAGNFAPVGEQPPVRSLPVSGRIPPFINGVYARNGANPHFEPTAGHHLFDGDGMVHAVRIRNGAAESYACRFTETARLGQERALGRAVFPKAIGELHGHSGIARLALFYARGLCGLVDPSHGTGVANAGLAYFNGRLLAMSEDDLPYQVRVTADGDLETVGRYDFDGQLGCAMIAHPKLDPVSGELFALSYDVIKKPYLKYFYFDADGTKSPDVEIELEQPTMIHDFAITENFVVVPDHQVVFKLGEMFRGGSPVVLDREKTSRFGVLPKHATSSLEMVWVDVPDCFCFHLWNAWEEAESGEVVVVGSCMTPADSIFNESDEHLESVLTEIRLNTRTGESTRRAVLPPAAQVNLEVGMVNRAMLGRKTRYAYLAVAEPWPKVSGFAKVDLATGELTKFEYGEGRFGGEPCFVPMGGAGAAASPARGEDDGYILSFVRDEAAGTSELLVVNAADMRLEATVQLPSRVPYGFHGTFINAGELATQA

SEQ ID NO: 2697 - protein, 116 aa, Cylindrocladium pseudonaviculatum
TGGKAPRKQLASKAARKSAPSTGGVKKPHRYKPGTVALREIRRYQKSTELLIRKLPFQRLVREIAQDFKSDLRFQSSAIGALQESVESYLVSLFEDTNLCAIHAKRVTIQSKDIQL

SEQ ID NO: 2698 - protein, 135 aa, Capsicum annuum
EQCPEEGRLPDAGPPSPAAHLRDVFYRMGLNDKEIVALSGAHTLGRSRPERSGWGKPETKYTKDGPGAPGGQSWTVQWLKFDNSYFKDIKERRDNDLLVLPTDAVLFEDPSFKEYAEKYAVDQDPFFKDYAEAHA

SEQ ID NO: 2699 - protein, 405 aa, Populus nigra
MGFLCCSGKPSKRLESSSINENNSNIKRKDQTHVTSGSLKMKPYVNNLSKEGESKDDQLSLDVKSLNMKDEISKDRRSNGKQAQTFTFEELAAATSNFRSDCFLGEGGFGKVYKGYLDKINQAVAIKQLDRNGVQGIREFVVEVVTLSLADHPNLVKLIGFCAEGDQRLLVYEYMPLGSLENHLHDIPPNRQPLDWNTRMKIAAGAAKGLEYLHNEMKPPVIYRDLKCSNILLGEGYHPKLSDFGLAKVGPSGDKTHVSTRVMGTYGYCAPDYAMTGQLTFKSDIYSFGVVLLELITGRKAIDQRKERGEQNLVAWARPMFKDRRNFSCMVDPLLQGQYPIRGLYQALAIAAMCVQEQPNMRPAVSDLVMALNYLASHKYDPQVHSVQDSRRSPSRPGLDKDRGQ

SEQ ID NO: 2700 - protein, 660 aa, Thermosynechococcus elongatus
MCGLTGFWQPCGCPTDEVSATIQRMADTLVHRGPDDVGVWVDTEVGIALGHRRLAILDLSPAGHQPMVSATGRYVIAFNGEIYNHLELREELSKVGAGGTAPVWRGHSDTETLLAAFAALGIEKTLKRVVGMFAIALWDRETRTLTLARDRMGEKPLYYGWVRDALVFGSELKALRAYPGFDNAIERRSLALFMRYDYIPAPWSIYENIWKLPPGCFVQFRAASHGGEPLAVGSRGNIKPYWSVRDVAERGLANPFTGREADAVEELERLLRQSIAGQMMADVPLGAFLSGGIDSSTVVALMQAQSSRAVKTFTIGFHEQDYNEAKHAKAVACHLRTNHTELYVTPQEAMAVIPKLPSLYDEPFADSSQIPTFLLAQLARQQVTVSLSGDGGDELFGGYTRYFLTHSLWQRLAWIPLPMRKLAEQGVLAISPQTWNRVFALLAPVLPERLRFRLPGDKLHKAAALFVTRRPEDIYLRFVSHWHDPTSLVIGTEEPRTALTEPATVLEGADFEARMMYLDSITYLPDDILVKVDRAAMGVSLETRVPLLDHRIVEFAWQLPHYFKIRRGQSKWLLRQVLYRYVPKELIERPKMGFGIPLDQWLRGPLREWAEDLLSEERLKREAFLNPELVRQKWQEHLLGRRNWAYHLWNVLMWEAWLAA

SEQ ID NO: 2701 - protein, 103 aa, Kluyveromyces lactis
MSGRGKGGKGLGKGGAKRHRKILRDNIQGITKPAIRRLARRGGVKRISGLIYEEVRNVLKTFLESVIRDAVTYTEHAKRKTVTSLDVVYALKRQGRTLYGFGG

SEQ ID NO: 2702 - protein, 406 aa, Populus nigra
MGFLCFSGKSSKRSENSSIDENNSNIKRKDQTQLTSGSMKVKPYVNDSREEGASKDDQLSLDVKSLNLKDEISKDIRNNGNPAQTFTFEELVAATDNFRSDCFLGEGGFGKVYKGYLEKINQVVAIKQLDQNGLQGIREFVVEVLTLSLADNPNLVKLIGFCAEGDQRLLVYEYMPLGSLENHLHDIPPNRQPLDWNARMKIAAGAAKGLEYLHNEMAPPVIYRDLKCSNILLGEGYHPKLSDFGLAKVGPSGDHTHVSTRVMGTYGYCAPDYAMTGQLTFKSDVYSFGVVLLELITGRKAIDQTKERSEQNLVAWARPMFKDRRNFSGMVDPFLQGQYPIKGLYQALAIAAMCVQEQPNMRPAVSDVVLALNYLASHKYDPQIHPFKDPRRRPSHPGLDKDNGRT

SEQ ID NO: 2703 - protein, 284 aa, Mycoplasma genitalium
MSDTNTEKPELVSLNKLSEMRTNIGMVKRYWNPKMGFFIEPERKHNNDLLKLDLQYQALKTAYNFIKDVVKNHGQILFVGTKNDYVKKLVIDIAKRVNVAYITQRWLGGTLTNFKTLSISINKLNKLVEQQKQNANDLTKKENLLLSREIERLEKFFGGVKNLKRLPNLIVIDDPVYEKNAVLEANSLKIPVVALCNTNTNPELVDFIIPANNHQPQSTCLLMNLLADAIAEAKGFETLYAYKPDEQIQIEIPPKQERQVINRSNTRNITNQRLNINRQQQETL

SEQ ID NO: 2704 - protein, 306 aa, Ashbya gossypii
MGKSSKDKRDLYYRKAKEQGFRARSAFKLLQLNDEFHFLDGVQRVVDLCAAPGSWSQVLSRELFPDGKNTKKRIVAVDLQPMSRIEHVTTLQADITHPRTLTKIIELFKGEKADFVCSDGAPDVTGLHDLDEYVQQQLILSALKLTVSLLAPGGCFVAKIFRGRDIDMLYSQLGLLFDKVTCAKPRSSRGTSLESFIVCQGYTPPLSWAPNIEKNVSVEEFFEEFFQNWSIQQPLTPGRPLPMYSEGHRGIAPFISCGGLDSFDSDATYHDLPKSATALDPVQSPTNPPYKRALELKRSGKLGRSV

SEQ ID NO: 2705 - protein, 479 aa, Yarrowia lipolytica
MTITLSQKVGEFASEFAIDGSYVQQGVKHFVDQTAQALSANMERAMPMIPSFVTRIPTGKEKGVQLAVDLGGTNFRVSSVHLNGDHTHKTVASKVAVSDDLMTGTQADFFGFLAQQVKDFLTEHHSEHFSQTEPLRMGVTFSFPVNQVALDKGYLLRWTKGYDIKDAVGKDVVELFQIQLDALDLNVKIVALVNDTVGTLLARAYASKSDDGKHKQTLIGAIFGTGTNGAYSERLKRVPKFTAANYPEVFKRYSPEHIANQTMIINTEWGSYDNDIDVLPNTKWDIDLDENTHNKSFHMFEKRISGMFLGELLRLCLLDLKSEGLLLQSTKLEGNPVWKGFGMDTSVLSFIEAATEAQIETGKGDYEKIIKAMGLAAKDITPEQVAALKPLVTAIGRRSAYLSAIPLAAITLHTHALEKFDVVDIGVDGSVFQFYPKFADMVKEAMGYVEGISVDRIDIGHAEDGSGVGAALAAYPDDS

SEQ ID NO: 2706 - protein, 158 aa, Lilium longiflorum
MPPRRKKKAAAAAAAAAAAAAAAGKAAAGKDGKAGIMTPKKPKKGKKKIPLMKYRVYIRRVLTQVRPELGISSKSMLIMNNFVVHNFQNIAKEASILAQYSKKKTITVKELKAAVKLVLPHQLLEYADRDGDRAVHNFESETSKKNSQGRKRGRGQQT

SEQ ID NO: 2707 - protein, 592 aa, Oryza sativa
  misc_feature (270)..(270): Xaa can be any naturally occurring amino acid
MALLQFGGTLAPKLGEKPQVLPRSPALTRVIYADPRFLVSKSGSRGRLKHLVSPTASLQSRTSSRLFNHAPSPRFRHRRSSRFIVRADADFYSTLGVSRNASKSEIKSAYRKLARSYHPDVNKDPGAEQKFKDISNAYEVLSDDEKRSIYDKYGEAGLKGAGMGTGEIDIVQNIGRQAAAAVAGGVGEKARWWWLCRRRGVAATGWAVVHGRISGWLMAVATLFAGDGPGGGGLHEGRRMMILDNFETSGRRAGESGKSPIFKQIKLLFXTGFDEAELRSYTSVIHATSIRQLKYAILERILYEGAKELSQVESDSSKYVISPDNQEIGEKLSDIDGRLDYPLLNKELVLDVKRLWQDPAIQETYLRGSILQLPDCAQYFMENLDRLAEAGYVPTKEDVLYARVRTNGVVQIQFSPVGENKRGGEVYRLYDVGGQRNERRKWIHLFEGVNAVIFCAAISEYDQMLFEDETKNRMMETKELFDWVLKQRCFEKTSFILFLNKFDIFEKKIQKVPLSVCEWFKDYQPIAPGKQEVEHAYEFVKKKFEELYFQSSKPDRVDRVFKIYRTTALDQKLVKKTFKLIDESMRRSREGT

SEQ ID NO: 2708 - protein, 305 aa, Mycoplasma hyopneumoniae
MENYDVIIIGAGPAGLTTALYASRGNLKVLILEKGAPGGKLVSQSKIENWPGDEIIDGATLALRMYKHPLKFGAKHRFCDVDFIETENEFDHKVYCKDGKIFQGRAVVVASGMVERKPLDIKYYLEYEGRGVSYCVVCDGPFYANQPAIVIGGGNSAVEEGSFLASIASKVYILVRDSQFNAEPMLIEDLKKNKNVEIWFNAKVLELRGKDQLESALIDHNGEKKVLEIKSLFPYIGFLPATKFLEKNHRQALNQINFIDVDSYGQTKIPGIYAVGDVVSKEIRQIVTAASDGAIVGKILTNRIK

SEQ ID NO: 2709 - protein, 187 aa, Orobanche ramosa
FGHHSRKWNPKMKPYISAERKHRHIINLAKTARFLYEACNLVFYAASRGKQFLIVGTNKMRDDLVEQAAIKAQCHFVNKKWTGGTLTNWSITEARLQKFRNLIIEQKAGRLDCLPKKDAAVVKRQLSRFQKNLGGIKYMRGLPDIVIILDQNEDFKALQECINLGIPTISLIDTNSDPDLADISIPA

SEQ ID NO: 2710 - protein, 332 aa, Solanum tuberosum
MAKDPVRVLVTGAAGQIGYALVPMIARGVMLGADQPVILHMLDIPPAAEALNGVKMELVDAAFPLLKGVVATTDAVEACTGVNVAVMVGGFPRKEGMERKDVMSKNVSIYKSQASALEKHAAPNCKVLVVANPANTNALILKEFAPSIPEKNITCLTRLDHNRALGQISERLSVQVSDVKNVIIWGNHSSSQYPDVNHATVTTPAGDKPVRELVADDAWLNGEFISTVQQRGAAIIKARKLSSALSAASSACDHIRDWVLGTPEGTFVSMGVYSDGSYNVPAGLIYSFPVTCKNGEWSIVQDLPIDEFSRKKLDLTAEELSEEKALAYSCLT

SEQ ID NO: 2711 - protein, 150 aa, Unknown
  Bradyrhizobium sp. BTAi1
MRYLHTMLRVRNLDAALKFYSDALGLKEVRRIDNDKGRFTLVFLCAPEDEHLLKSLPPTRGAPLVELTYNWDEESYGEDRFFGHLAYEVDDIYATCDRLMKLGITINRPPRDGNMAFVRSPDLHSIELLQKGEPKAPAEPWLSMPNTGHW

SEQ ID NO: 2712 - protein, 957 aa, Gluconobacter oxydans
MADTISNTGLNEVGSVLRDLEKYGQSPWLDFIQRSFTEDGSLSKLVEEDGLRGVTSNPAIFEKAIGHGTEYDPQIRKLLEGEGLSPGELYEHLAIDDIRSACAVLDPVFEKTKGLDGYVSLEVSPYLAFDAHGTITEARRLWKAVGRPNLMIKIPGTVEGTGAIREAIADGINVNVTLLFSLDAYKAVLEAYISGLEARVARGEEISRISSVASFFVSRIDAKIDAEIDRRVAAGDPEAEALKAIRGKVAIANAKMAYQYYLEVRNSPRWKALAEKGANPQRLLWASTGTKDKAYSDVLYVEELIGPETVNTIPPATFDAYRDHGKSRASLTENVDQARHVMAEAERLGLGLDGITAKLVKDGCAAFSVSFDTLLTAVATKREAVLGDRLLRVSADLPPDLRDDVAAAEKDWSHSGGLRRIWKKDPSVWTNGPEAGWLNWLTVVQDRLWHIEELEVLARDVRSRGFKDILLLGMGGSSLGPEVLAETFGKREGWPKLHVLDSTDPQQVTAFEKAIDPKNTLFIVASKSGGTLEPNILFAHFWQVAGQALGKKPGDSFIAITDPGSHMQKVAEENGFWRIFYGDPKIGGRYSVLSNFGLVPAAASGIDVRKLLTVTRLMVESCDGSAPPSANPGAVLGLILGHAAHCFNRDKVTILASEGIASLGAWLEQLIAESTGKKGLGLIPIDEEELGTPDVYGTDRVFVDLLLGDDVPDSRLGALRAAGAPVVTIRLADKAQIGQAFFLFEFATAVAGAVLGIDPFDQPDVEFSKLETRKLTSAYAETGSLPPETPFAKDGPLSFYADAKNTEASGNKGDAVSILKALFDRVKPGDYVGLLAYIRRDQQTRDWAQSVRMELRDALKVATAAEFGPRFLHSTGQAYKGGPDSGVFLQVTATDAADVPVPGHGFSFSVVKAAQARGDFEVLAARGRRALRVHIDGPLEDGLKALETAIHKALAGA

SEQ ID NO: 2713 - protein, 187 aa, Orobanche ramosa
FGHHSRKWNPKMKPYISAERKHRHIINLTKTARFLYEACNLVFYAASRGKQFLIVGTNKMRDDLVEQAAIKAQCHFVNKKWTGGTLTNWSVTEARLQKFRNLIIEQKAGRLDCLPKKDAAVVKRQLSRFQKNLGGIKYMRGLPDIVIILDQNEDFKALQECINLGIPTISLIDTNSDPDLADISIPA

SEQ ID NO: 2714 - protein, 313 aa, Rhamnus cathartica
GGLGDVLGGLPPAMAANGHRVMTVSPRYDQYKDAWDTEVTIELKVGEKLEKVRFFHCYKRGVDRVCVDHPLFLEKVWGKTKSKIYGPIAGEDYQDNQLRFSLLCQAALEAPRVLNLTSSKYFCGPYGDDVVFVANDWHTAPIPCYLKSLYKARGIYKSARVAFCIHNIAYQGRFAFADFSLLNLPDEFKSSFDFIDGYDKPVKGRKINWLKAGVLESDKVLTVSPYYAKELVSSVEKGVELDIILRKTGITGIVNGMDVQEWNPLTDKYTSVKYDASTVLDAKPILKEALQAEVGLPVDRKIPVVGFIGRLEE

SEQ ID NO: 2715 - protein, 332 aa, Gluconobacter oxydans
MRIGIIGLGRMGGNIAVRLTRHGHDVVVHDRTSEVTTSVVGRCEAGRATPADTLADMAKLLEGDEHRVVWVMLPAGAITEDCVQQLGGLLGRGDIIIDGGNTYYKDDVRRSAELAEKGISYVDVGTSGGVWGLERGYCMMFGGTKETAEYIDPILSALAPGIGDVPRTPGRDEAGHDPRAEQGYLHCGPAGSGHFVKMVHNGIEYGMMQAFAEGFDIMKSKNSPILAEKDRFELNMGDIAEVWRRGSVVSSWLLDLTAEALTRSETLNEFSGEVADSGEGRWTIEAAIEEDVPAPVMTAALFTRFRSRSGNNFAEKILSAQRFGFGGHVEKK

SEQ ID NO: 2716 - protein, 187 aa, Orobanche ramosa
FGHHSRKWNPKMKPYISAERKHRHIINLTKTARFLYEACNLVFYAASRGKQFLIVGTNKMRDDLVEQAAIKAQCHFVNKKWTGGTLTNWSITEARLQKFRNLIIEQKAGRLDCLPKKDAAVVKRQLSRFQKNLGGIKYMRGLPDIVIILDQNEDFKALQECINLGIPTISLIDTNSDPDLADISIPA

SEQ ID NO: 2717 - protein, 436 aa, Deinococcus radiodurans
MPGVAVSRGPFFLDTPQSAGGRRLYHLFMTTADQPQAVRDDAVFDLIAQEAERQRTGLELIASENFTSAAVREAQGSVLTNKYAEGYPGKRWYGGCEVVDQVEQLAIDRVKQLFNAEWANVQPHSGSSANLAVYNALIQPGDTVLGMDLSHGGHLTHGNKANFSGMRYQMVAYQLDRETERIDMEEVRRLAHEHKPKMIIAGASAYSRVIDFAAFREIADEVGALLFADIAHIAGLIAAGEHPNALPHAHVVASTTHKTLRGPRGGIILANDPEIAKQLDRTVFPGYQGGPLEHVIAAKAVAFGEALRPEFKDYARQIIKNAQALAGEFQQKGYRVVSGGTDNHLFLLDLRPQGLNGTKATRLLDANHITISKSTLPYDTEKILHGGGIRIGTPAVTTRGMTEAHMTQVADLIDRALKGEDVQAKVHDFAGGFPLP

SEQ ID NO: 2718 - protein, 313 aa, Rosa multiflora
GGLGDVLGGLPPAMAANGHRVMTVSPRYDQYKDAWDTEVTVELKVGQKIETVRFFHCHKRGVDRVFVDHPLFLEKVWGKTASKIYGPSAGEDYTDNQLRFSLLCQAALEAPRVLNLTSNQYFSGPYGEDVVFIANDWHTALLSCYLKAIYQPKGIYKSAKVAFCIHNIAYQGRFAFADFSLLNLPAAFKSSFDFIDGYDKPVKGRKINWMKAGILESDKVLTVSPYYAKELLSSIEKGVELDNIIRKTGILGIVNGMDVQEWNPLTDKYTDVKYDATTVTDAKPILKEALQAEVGLPVDKNIPVIGFIGRLEE

SEQ ID NO: 2719 - protein, 312 aa, Rubus odoratus
GGLGDVLGGLPPTMAAIGHRVMTISPRYDQYKDAWDTEVTVELQVGQKSETVRFFHCYKRGVDRVFVDHPLFLEKVWGKTASKIYGPMAGEDYKDNQLRFSLLCQAALEAPRVLNLTNNFFCGPYGEDVVFIANDWHTALIPCYLKARYQPNGIYKSAKVAFCIHNIAYQGRFAFADFALLNLPNKFKSSFDFIDGYDKPVKGRKINWMKAGILESDKVLTVSPYYAKELVSGDDKGVELHNIIRKPGIVGIVNGMDVQEWNPLTDKYTDVKYDATTVMDAKPILKEALQAEVGLPVDKNIPVIGFIGWLEE

SEQ ID NO: 2720 - protein, 129 aa, Triticum aestivum
  misc_feature (4)..(4): Xaa can be any naturally occurring amino acid
  misc_feature (12)..(14): Xaa can be any naturally occurring amino acid
  misc_feature (28)..(30): Xaa can be any naturally occurring amino acid
  misc_feature (38)..(38): Xaa can be any naturally occurring amino acid
  misc_feature (44)..(45): Xaa can be any naturally occurring amino acid
  misc_feature (47)..(47): Xaa can be any naturally occurring amino acid
  misc_feature (49)..(49): Xaa can be any naturally occurring amino acid
  misc_feature (52)..(53): Xaa can be any naturally occurring amino acid
  misc_feature (55)..(55): Xaa can be any naturally occurring amino acid
  misc_feature (59)..(59): Xaa can be any naturally occurring amino acid
  misc_feature (63)..(63): Xaa can be any naturally occurring amino acid
  misc_feature (73)..(73): Xaa can be any naturally occurring amino acid
  misc_feature (79)..(79): Xaa can be any naturally occurring amino acid
  misc_feature (83)..(83): Xaa can be any naturally occurring amino acid
  misc_feature (86)..(86): Xaa can be any naturally occurring amino acid
  misc_feature (89)..(89): Xaa can be any naturally occurring amino acid
  misc_feature (97)..(97): Xaa can be any naturally occurring amino acid
  misc_feature (103)..(103): Xaa can be any naturally occurring amino acid
  misc_feature (106)..(106): Xaa can be any naturally occurring amino acid
  misc_feature (109)..(109): Xaa can be any naturally occurring amino acid
  misc_feature (116)..(116): Xaa can be any naturally occurring amino acid
  misc_feature (120)..(121): Xaa can be any naturally occurring amino acid
MEAXTAAKRARXXXVPAAADGAGEQAGXXXVIPGWFSXINPMWXXEXHXLKXXKXLFQXKFGXKKLWVFNPPXNGKGSXLIGXFKXNRXGTIAPNKXMFTNFXLVXLKXPKKALSXGGGXXGGFGEGPR

SEQ ID NO: 2721 - protein, 313 aa, Vauquelinia californica
GGLGDVLGGLPPAMAANGHRVMTISPRYDQYKDAWDTEVTVELKVGDKIETVRFFHCYKRGVDRVFVDHPLFLEKVWGKTASKIYGPITGVDFKDNQLRFSLLCQAALEAPRVLNLNSSKYFSGPYGEEVVFVANDWHTALLPCYLKAIYKPKGMYKTAKVAFCIHNIAYQGRFAFADFALLNLPDKFKSSFDFIDGYDKPVKGRKINWMKAGILESDKVLTVSPYYAEELVSSVEKGVELDNIIRKTGIQGIVNGMDVQEWNPLTDKYTTVKYDASTVADAKPLLKEALQAEVGLPVDRDIPVIGFIGRLEE

SEQ ID NO: 2722 - protein, 65 aa, Zea mays
  misc_feature (23)..(23): Xaa can be any naturally occurring amino acid
MGRRPAICYRQIKNMPYPTYRYXRGVPDHKIRIYDIGMKRKVVDKFPYCVHLVYGNKKMASRKPL

SEQ ID NO: 2723 - protein, 313 aa, Vauquelinia californica
GGLGDVLGGLPPAMAANGHRVMTISPRYDQYKDAWDTEVTVELKVGDKTETVRFFHCYKRGVDRVFVDHPLFLGKVWGKTASKVYGPVAGVDFKDNQLRFSLLCQAALKAPRVLNLNSSKYFSGPYGEEVVFIANDWHTALLPCYLKAIYKPKGIYYTAKVAFCIHNTAYQGRFAFADFALLNLPDDFKSPFDFIDGYDKPVKGRKINWMKAGILESDKVLTVSPYYAEELVSAVEKGVELDNIIRQTGIFGIVNGMDVQEWNPLTDKYTTVKYDASTVADAKLLLKEALQAEVGLPVDKDIPVIGCIGRLEE

SEQ ID NO: 2724 - protein, 378 aa, Pisum sativum
TMSHLAVSQMAVTVPVSSDFSVRRSAFKSSNLNFRDKSWAPVFTLGMKAKNCGWRNHNVICMSVQQASVPKVTVSPLELENPSEPPLNLHKPKEPYTATIVSVERLVGPKAPGETCHIVINHDGNVPYWEGQSYGVIPPGENPKKPGSPHNVRLYSIASTRYGDNFDGKTASLCVRRAVYYDPVTGKEDPSKNGVCSNFLCDSKPGDKIKIAGPSGKIMLLPEDDPNATHIMIATGTGVAPYRGYLRRMFMESVPTFKFGGLAWLFLGVANVDSLLYDDEFTKYLKDYPDNFRYNRALSREEKNKNGGKMYVQDKIEEYSDEIFKLLDNGAHIYFCGLRGMMPGIQETLKRVAEKRGESWEEKLSQLKKNKQWHVEVY

SEQ ID NO: 2725 - protein, 222 aa, Zea mays
  misc_feature (7)..(7): Xaa can be any naturally occurring amino acid
  misc_feature (187)..(187): Xaa can be any naturally occurring amino acid
MGRRPAXRCYRQIKNKPCPKSRYCRGVPDPKIRIYDVGMKRKGVDEFPYCVHLVSWERENVSSEALEAARIVCNKYMTKSAGKDAFHLRVRVHPFHVLRINKMLSCAGADRLQTGMRGAFGKPQGTCARVDIGQVLLSVRCKDNNAAHASEALRRAKFKFPARQKIIESRKWGFTKFSRADYLKYKXARGRIVPDGVNAKLLANHGRLEKRAPGKAFLDAVA

SEQ ID NO: 2726 - protein, 1102 aa, Rhodobacter sphaeroides
MNQNVSPSTVAVRRTDGIDRSQTDWYKDAIIYQLHIKAFQDANGDGIGDFAGLMQRLDYVQALGVTAIWLLPFYPSPLRDDGYDISDYRSINPSYGAMRDFKLFVQEAHKRGLRVITELVINHTSDQHPWFQRARRAKKGSAARDWYVWSDTDQKFPETRIIFLDTEKSNWTWDPVAGAYYWHRFYSHQPDLNFDNPRVLEEVLKIMRMWLEMGVDGLRLDAIPYLVEREGTNNENLPETHDVLKKIRANLDQHFPDRMLLAEANQWPEDTRPYFGEGDECHMGFHFPLMPRMYMALAQADRHPITDIIRQTPEIPEGCQWGIFLRNHDELTLEMVTAEERDYMWRFYAEDSRARINLGIRRRLAPLMKNDRRKIELLNQMLMSMPGTPIVYYGDEIGMGDNYYLGDRDGVRTPMQWSADRNGGFSRCNPQQLYLPTILDPVYGHQAINVEAQAADPSSLLNWTRRLIAVRKQHPAFGRGSMSLLYPRNRKVLAYVRSHEGTDILCVANLSDTAQAVELDLGRFRGAVPVELTGRSEFPPVGDLPYMLTLPPYGFYWFILSDQQALPSWHQPMPETLPDFITLTTRDGRAETALTGRETRQLEADVLPNWLPLQRWFGAKEEKISAVKLAVLGSLSADHALVRLEADVGGEVQQYFLPASALWGEEQLRAGAPKLSFTLAKVRRGPQVGALIDGAYDEQMAQAMLEALRDGRRLSGAGGEVVFEPGSGLAEIADPGEPRYLGAEQSNISIAFGDRLILKLYRRLRAGEQPDVEVARFLTEVAGYTHTPRYLGVVSLRPAEGEATVLAAAFAFVANMGDAWRGLFDALVRDLGEFGGWSTAEAPEVEKDGFSFPLTIPGLLGQRTAELHQAFATETDEAAFRMEPLTAQHLTGWAEGARREAEAMLSVLERQRTHLPDEVLPLAEALLARREDLLARLDRVTGFEPSGALTRIHGDYHLGQVLLAQDDVAIIDFEGEPRRTLAERREKSSPLRDVAGMLRSFDYAAAAALARHEESFGPASERAVERAEAWRQQAVADFLAAYEGASAGTASLPSDPALKEALLDLFLVQKAVYETSYELGSRPAWVGIPLRGLLELLDRKPA

SEQ ID NO: 2727 - protein, 307 aa, Aspergillus oryzae
MPGLAFNPDNDIPDLSGKVIFITGGTAGLGAQSVAQMAKHSPARIYISGRNATSAEKIIKEIAETGSNTPVSFVECDLTSLDSVKRAADEIIAKESRLDVLMCNAGIMALPPGLTKDGYEVQFGTNHLGHALLIQKLLPLLQRTAERGADVRVIILTSKGYQLHPYGGIIFDDLKTTQDYGFLGSWRRYGQSKLANILYTRELARRYPAITVVSVHPGVITTGLVENLGWAHRWFIYATTYNQMVTLEEGAYNQLWAATTSKDGLETGQYYIPVGVASNDKLTKTGRDDVLAGQLWEWTDKALEDYL

SEQ ID NO: 2728 - protein, 261 aa, Unknown
  Nostoc sp. PCC 7120
MQNHVNSLASAVYIVGAGPGDPDLLTIKAQKLLSVADVILFADSLIPEELLQFCRKDAEIIQTANKTLEEIIPLMIARVRSQKSVVRLHSGDPSLYSAINEQMQLLAAANIPFEVIPGISVFQAAAAKLKVELTVPGLVQTIILTRISGRTQVPHTEELASLAAHQASLCLYLSARHVENAQAKLLEHYPPDTPVAICFRIGWPDEKIRVVPLQEMADCTQRENLIRTTLYVISPALSHTTGRSRLYHPEHSHLFRTAGDS

SEQ ID NO: 2729 - protein, 688 aa, Rhodobacter sphaeroides
MSFALREGRPFPLGATWDGSGTNFAIFSAHARKVELCLFDARGRREIARVALPEYTHEVWHGYLPEVRPGQLYGYRVHGPYEPQAGLRFNPNKLLIDPYALMLQGEVVWHDAVFGYRMGNARADLSFDRRDSAFVMPKCVVVDPAVTWGPDYPPNIPWPETIIYEAHVKGMTAQNAAIPDRVRGSFAALADPRAIEHLVTLGVTAIELMPTQAFFDDRYLIEKGLTNYWGYNTIGFFAPATRYISPGGGVHEFKLMVRRLHEAGIEVILDVVYNHTAEGNHLGPTLSFKGIDNASYYMLGDDPRYYYDTTGCGNTVNLGHQRVLQMVMDSLRYWVEACHVDGFRFDLATSLGRDRQGFNANAVFLDAVRQDPVLSRVKLIAEPWDTGHEGYQLGNFPPGWAEWNDQYRDTVRSYWKGDAGELPGLASQLLGSAGHFDRRGRRPWASVNFITAHDGFTLADTVSYNDKHNAANEEGNRDGHSDNRSWNCGEEGPTEDAEVLDLRDRMRRAMMGTLLISQGTPMLLMGDEVGRSQGGNNNAYCQDNAMNWLKLEGLEPRDAAFLDFTRRLIALRRSRPLLRHPSFLHKAAVGEEPVEVRWLRPDGEEMEPDDWHNPAARTLGLLIRNKPALLALFNSHFEEVPFSLPVRGRGWGLLLDTAAGRVPERPVPQRAAGFVVPPRTLLVLEETE

SEQ ID NO: 2730 - protein, 592 aa, Rhodobacter sphaeroides
MNDWAWGPRIEDGLGRFRLWAPSQERLVLRLDGTDHPMTRSDDAWFEVQVPAEAGMDYGFVLESGQVVPDPAARAQAGDVHGLSRLVAPSFDWRHDWTGRPWAETVVMELHIGTFTEEGTFRAAIEHLPHLAEIGITMIELMPVAQFGGNRGWGYDGVLLYAPHPAYGTPEDLKALVDAAHGLGMSVVLDVVYNHFGPDGNYLGAYAADFFDPERHTPWGSAIAYHLPPVRRFFLDNALYWLTEFRFDGLRIDAADHIRDPDSDPEVLVDLARAIRKRIPDRPIHLTTEDNRNITRLHERGPEGEVVLHTAEWNDDLHNVAHVLLTGETEGYYCDFVKDHWRKYARALAEGFVYQGEHSEHEGAPRGTPSGHLPPLAFVDFLQNHDQIGNRAFGERLTTLAPEARLRAMMAVLLLSPHVPLLFMGEEWGETRPFTFFTDFHGELADAVRNGRRKEFAHFSAFQGLDLDRTVPDPNAEGTFLSSKLDWLHRETERGRSWMAFVKDLLAARAREIAPRLERAPGNGGRIVAVSDDLVAVDWQLDGAVLRLRVNFDDRPQDLPEAGGRVIHASPGTEAGGPLPPCSVLVTLEETA

SEQ ID NO: 2731 - protein, 649 aa, Zea mays
  misc_feature (232)..(232): Xaa can be any naturally occurring amino acid
  misc_feature (354)..(354): Xaa can be any naturally occurring amino acid
MMGGGLMMDQSVVFPGVHNFVDLLQQNGDKNLGFASLMPQTSSGDQCVMGEGDLVDPPPDSFPDAVEDDSDDDVEDIEELERRMWRDRMKLKRLRELQQSRGKDPMASGGGLADGSSKPRQSQEQARRKKMSRAQDGILKYMLKMMEVCRAQGFVYGIIPEKGKPVSGASDNLRAWWKEKVRFDRNGPAAIAKYQADNAVPGAENELASGAASPHSLQELQDTTLGSLLSAXMQHCDPPQRRYPLEKGVPPPWWPTGDEEWWPELGIPKDQGPPPYKKPHDLKKAWKVSVLTAVIKHMSPDIEKIRRLVRQSKCLQDKMTAKEISTWLAVVKQEEELYLKMHPGARPPASAGGXIASAISFNTTSSEYDVDIVDECKGDEAGNQKTAVTDPTSFNLGAAILSDKFLMPTPMKEETADVEFIQKRNAPAPAEPELMLNNRVYTCNNVQCPHSDYSYGFLDRNARNSHQYTCKYNDPITQSAENKPLPAPPQPQAFQPAFSQANQAVNNLDFSLPMDGQRSIAELMNMYDTNFMTSKTMSSSDSVTIMERPNAMPQRIQMDEGFFGQGNGVFDDVNSMMQQQQQQAPPVVQQQQQQQQQFFIRDDTPFMSQMGDITSTAEFRFGSGFNMSSTAAADYPGAAQKNDGANWFY

SEQ ID NO: 2732 - protein, 291 aa, Oryza sativa
GGSSSAAAAAQVIGQDEAVEWVKKDRRRMLHVVYRVGDLDKTIKFYTECLGMKLLRKRDIPEERYTNAFLGYGPEDSHFVVELTYNYGVESYDIGTAFGHFGIAVEDVAKTVDLIKAKGGTVTREPGPVKGGKSVIAFIEDPDGYKFELIERGPTPEPLCQVMLRVGDLDHAINFYEKAFGMELLRKRDNPQYKYTIAMMGYGPEDKNAVLELTYNYGVKEYDKGNAYAQIAISTDDVYKTAEVIRQNGGQITREPGPLPGINTKITACTDPDGWKTVFVDNVDFLKELEE

SEQ ID NO: 2733 - protein, 405 aa, Mycobacterium tuberculosis
MTENPYLVGLRLAGKKVVVVGGGTVAQRRLPLLIASGADVHVIAPSVTPAVEAMDQITLSVRDYRDGDLDGAWYAIAATDDARVNVAVVAEAERRRIFCVRADIAVEGTAVTPASFSYAGLSVGVLAGGEHRRSAAIRSAIREALQQGVITAQSSDVLSGGVALVGGGPGDPELITVRGRRLLAQADVVVADRLAPPELLAELPPHVEVIDAAKIPYGRAMAQDAINAVLIERARSGNFVVRLKGGDPFVFARGYEEVLACAHAGIPVTVVPGVTSAIAVPAMAGVPVTHRAMTHEFVVVSGHLAPGHPESLVNWDALAALTGTIVLLMAVERIELFVDVLLKGGRTADTPVLVVQHGTTAAQQTLRATLADTPEKVRAAGIRPPAIIVIGAVVGLSGVRGLNNS

SEQ ID NO: 2734 - protein, 220 aa, Zea mays
MISPDAARNVVGIIGNVISFGLFLSPVLTFWRIYKAKDVEEFKPDPYLATLLNCMLWVSYGIPVVHPNSILVVTINGIGLVIEAVYLTIFFLYSDSQKRKKAFAILAVEILFMVAVVLGVILGAHTHEKRSMIVGILCVIFGSMMYASPLTIMSRVIKTKSVEYMPFLLSLVSFLNGCCRRPSPRTRTPSTASSASTTSGRRSASASSPTSPPAASRDRG

SEQ ID NO: 2735 - protein, 486 aa, Corynebacterium diphtheriae
MPTNNVPQVAINDIGTAEDFLAAVDATIKYFNDGDIVEGTVVKVDHDEVLLDIGYKTEGVIPSRELSIKHDVDPDEVVEVGDQIDALVLTKEDKEGRLILSKKRAQYERAWGAIEELKEKDEPVTGTVIEVVKGGLILDIGLRGFLPASLVEMRRVRDLDPYIGQQIEAKIIELDKQRNNVVLSRRAWLEQTQSEVRSEFLHQLQKGQVRKGVVSSIVNFGAFVDLGGVDGLVHVSELSWKHIDHPSEVVTVGDEVTVEVLDVDLDRERVSLSLKATQEDPWRVFARTHAVGQIVPGRVTKLVPFGAFVRVEEGIEGLVHISELAQRHVEVPDQVVNVGDEAMVKVIDIDLERRRISLSLKQADEDYTEEFDPSKYGMADSYDEQGNYIFPEGFDPETNEWLEGFDEQRQAWEARYAESERRFQLHTVQIEKNRVAAAEAAAAGEATNYSSESAEAAPAAANTEAEGGSLASDEQLAALREKLAGN

SEQ ID NO: 2736 - protein, 403 aa, Methanosarcina barkeri
MNTKEEISGVVELSRGVYWVGAIDWNGRDFHGFTTPGGTTYNSYLVIGKKTALIDTVKAPFAEEMLGRISKIIDPSKLDYIVVNHMEPDHSGSLAELKKQTNAKIIITKKGLDILNGYFREAGSEKWDIETVKTGDQLDLGGKTLIFLEATMLHWPDSMETFLKEDRILFSNDGFGQHIATSKRYDFEVGNVLPEAAEYYANILMPFHIALLRYFKLIEEMKIEPLQIAPSHGIIWKQDLEKILAEYKAWANGEVKEKVLVIYDTMWNSTEIMAKEITEAIWATGVKVKMLNLRKNARSLIMKEMLDAAAFAVGSPTLNNGVFPTVGDFLIYTKGLRPQKKKAIAFGSYGWGGGAVKIIEQELKNTGVDVLEPGLQVRYRPSEEDLEKCREIGKRLADVAKKQ

SEQ ID NO: 2737 - protein, 489 aa, Saccharomyces bayanus
MSADFGLIGLAVMGQNLILNAADHGFTVCAYNRTQSKVDHFLANEAKGKSIIGATSIQDFISKLKRPRKVMLLVKAGAPVDALIKEIVPLLEKGDIIIDGGNSHFPDSNRRYEELKKHGILFVGSGVSGGEDGARYGPSLMPGGSEEAWPHIKNIFQSISAKSDGEPCCEWVGPAGAGHYVKMVHNGIEYGDMQLICEAYDIMKRLGGFTDKEISEVFTTWNKGVLDSFLIEITRDILKFDDVDGKPLVEKIMDTAGQKGTGKWTAINALDLGMPVTLIGEAVFARCLSALKNERVRASKVLPGPQVPKDAVKDRKQFVDDLEQALYASKIISYAQGFMLIREAAATYGWKLNNPAIALMWRGGCIIRSVFLAEITKAYRQEPDLENLLFNKFFADAVTKAQSGWRKSIALATTYGIPTPAFSTALTFYDGYRSERLPANLLQAQRDYFGAHTFRVLPECASENLPEDKDIHINWTGHGGNVSSSTYQA

SEQ ID NO: 2738 - protein, 626 aa, Leuconostoc lactis
MQANLQWLDDPEVFRVNQLPAHSDHHYYHDTAEFKTGSRFIKSLNGAWRFNFAKTPAERPVDFYQPDFDATDFDTIQVPGHIELAGYGQIQYINTLYPWEGKIYRRPPYTLNQDQLTPGLFSDAADNTVGSYLKTFDLDDVFKGQRIIIQFQGVEEALYVWLNGHFIGYSEDSFTPSEFDLTPYIQDQGNVLAVRVYKHSTAAFIEDQDMFRFSGIFRDVNILAEPASHITDLDIRPVPNANLKSGELNITTKVTGEPATLALTVKDHDGRVLTSQTQTGSGSVTFDTMLFDQLHLWSPQTPYLYQLTIEVYDADHQLLEVVPYQFGFRTVELRDDKVIYVNNKRLVINGVNRHEWNAHTGRVISMADMRADIQTMLANNINADRTCHYPDQLPWYQLCDEAGIYLMAETNLESHGSWQKMGAIEPSYNVPGDNPHWPAAVIDRARSNYEWFKNHPSIIFWSLGNESYAGEDIAAMQAFYKEHDDSRLVHYEGVFYTPELKDRISDVESRMYEKPQNIVAYLEDNPTKPFLNCEYMHDMGNSLGGMQSYNDLIDKYPMYQGGFIWDFIDQALFVHDPITDQDVLRYGGDFDERHSDYAFSGNGLMFADRTPKPAMQEVKYYYGLHK

SEQ ID NO: 2739 - protein, 187 aa, Phelipanche oxyloba
LGHHSRKWNPKMKPYISAERKHRHIINLTQTARFLYEACNLVFHAASRGKQFLIVGTNKMRDDLVEQAAIKAQCHFVNKKWTGGTLTNWSITEARLQKFRNLIIEQKARRLDCLPKKDAAVVKRQLSRFQKNLGGIKYMRGLPDIVIILDQDEDFTALLECLNLGIPTICLIDTNSDPDLANISIPA

SEQ ID NO: 2740 - protein, 261 aa, Saccharomyces bayanus
MSKAVGDLGLVGLAVMGQNLILNAADHGFTVVAYNRTQSKVDRFLANEAKGKSIIGATSIEDLVAKLKRPRKIMLLIKAGAPVDILIKELVPHLDKGDIIIDGGNSHFPDSNRRYEELTKQGILFVGSGVSGGEEGARFGPSLMPGGSKEAWPHIKNIFQSIAAKSDGEPCCEWVGPAGSGHYVKMVHNGIEYGDMQLICEAYDIMKRLGGFTDKEISEVFTKWNTGVLDSFLIEITRDILKFDDVDGKPLVEKIMDTAGQ

SEQ ID NO: 2741 - protein, 459 aa, Corynebacterium efficiens
MLAPQLTPTRTVISLDGMWRFRVDWNNDGIDPGWQNSRLDTRHEMAVPASVNDVFADEAVRNHVGCYFYQRDVQIPVEWVDRQIVVRFGSVTPHAVVFAGGTEIARFKGGYMPFEADLTAHATPGGTVRLTVVVDNRLDYTCIPPGRINVLGDGRREQEYLHDFYNYSGIHRSVHLISRPRTHVSDVTITTDFTANDAGTTGSVNWDITTEGEPADCSVTIIDQRTDEPVASGSGRVGSATIPDVNLWTPGVGGLYDLEIRLTGPDGTLIDLYRQHFGVRTVEVAHNQFLINGHPFYFTGFGMHEDHETVGKGHVDAHVLQDMELLSWIGANSLRTSHYPYSEQWMDYCDRQGIVVIDETPAVGLNLGVAGGILGGTEVPSTFGPDTLNHETQAQHKLEIERLISRDKNRPSVVLWSIANEPESQTDASRDYFAPLAQAARDADPTRPVGFVNVMLAPL

SEQ ID NO: 2742 - protein, 187 aa, Phelipanche oxyloba
LGHHSRKWNPKMKPYISAERKHRHIINLTQTARFLYEACNLVFHAASRGKQFLIVGTNKMRDDLVEQAAIKAQCHFVNKKWTGGTLTNWSITEARLQKFRNLIIEQKAGRLDCLPKKDAAVVKRQLSRFQKNLGGIKYMRGLPDIVIILDQDEDFTALLECLNLGIPTICLIDTNSDPDLANISIPA

SEQ ID NO: 2743 - protein, 165 aa, Saccharomyces bayanus
SLYASKIISYAQRFMLIREAAATYGWKLNNPAIALMWRGGCIIRSVFLAEITKAYRDDADLENLLFNDFFASAATKAQSGWRRSIALDATYGIPTPAFSTALAFYDGYRSERLPANLLQAQRDYFGAHTFRVLPECASANLPVDRDIHINWTGHGGNISSSTYQA

SEQ ID NO: 2744 - protein, 142 aa, Corynebacterium efficiens
MLNRYYGWYFQTGDLANAEREMRAEVEGWITTHPGKPIIFTEFGADTVAGLHSIYDQPWTEDFQVAYHRMNPRVFDAYDEIIGEQMWNFADFQTKFGIVRVDGNKKGAFTRDRRPKAVARYLRERWTNLDAAAYGRREPKQN

SEQ ID NO: 2745 - protein, 357 aa, Pisum sativum
MSSLSDLINFNLSDSTEKIIAEYIWVGGSGIDIRSKARTLPGPVSDPAKLPKWNYDGSSTDQAPGKDSEVILYPQAIFKDPFRRGNNILVICDVYTPAGEPLPTNKRYNAAKIFSHPDVAAEVPWYGIEQEYTLLQKDINWPLGWPIGGYPGKQGPYYCGIGADKAYGRDIVDAHYKACLFAGINISGINGEVMPGQWEFQVGPSVGISAGDEIWAARYILERITEISGVVVSFDPKPIPGDWNGAGAHANFSTKSMRENGGYEVIKKAIEKLGLRHKEHIAAYGEGNERRLTGKHETADINVFSWGVANRGSSIRVGRDTEKDGKGYFEDRRPASNMDPYVVTSMIAETTILWKKS

SEQ ID NO: 2746 - protein, 187 aa, Phelipanche bungeana
FGHHSRKWNPKMKPYVSAERKHRHIINLTKTARFLYEACNLVFYAASRGKQFLIVGTNKMRDDLVEQAAIKAQCHFVNKKWTGGTLTNWSITEARLQKFRNLIIEQKAGRLDCLPKKDAAVVKRQLSRFQKNLGGIKYMRGLPDIVIILDQNEDFTALLECLHLGIPTISLIDTNSDPDLADISIPA

SEQ ID NO: 2747 - protein, 313 aa, Vauquelinia californica
GGLGDVLGGLPPALAANGHRVMTVSPRYDQYKDAWDTGVLVEIEVGGRVETVRLFHCYKREVDRVFVDHPLFLERVWGKTGSKIYGPRAGVDYKDNQFRFSLLCQAALEAPRVLNLNSNKYFSGPYGDDVVFIANDWHTALLPCYLKTIYKPKGIYKNAKVVFCIHNIAYQGRFPFSDFSLLDLPDNLKGSFDFIDGYNKPVKGRKINWMKAGILESDRVVTVSPYYAQELVSGEDKGVELDNIIRKTVITGIMNGMDVQEWNPATDKYLDIKYDSTIVLDAKPLSKEALQAEVGLPIDRNIPVIGFIGRLEE

SEQ ID NO: 2748 - protein, 214 aa, Medicago truncatula
MDAAGEIFRSNLTELMEESPSGAGELHVLAVDDSLVDRKVIERLLKISSCKVTVVESARRALQFLGLDGENSDVAFDAVKVNLIMTDYSMPGMTGYELLKKIKESSVFREIPVVIMSSENVLTRIDRCLEEGAEDFLLKPVKLSDVRRLKDFIMRGEVKDGEKCSLKRMRSSDDCSPCPSLSTTFSPMRHSCDPPSSVFSPLSPSTLSSKKSRL

SEQ ID NO: 2749 - protein, 425 aa, Lactobacillus curvatus
CKNLALNIESRGYTVAIYNRTGAKTEAVMQDHSEKKLVPSYTIEEFVQSLEKPRRIILMVKAGAGTDAVINELLPLLDKGDILIDGGNTFFGDTIRRNAELDKSGINFIGMGVSGGELGALEGPSMMPGGQKEAYELVAPILEQMSAKAEDGQPCVTYIGPNGAGHYVKMVHNGIEYGDMELISESYNLLRNVVGLSVEEIADVFKEWNHGELDSYLMEITADILTRKDDLETDKPIVDVILDAAGNKGTGKWSSQSALELGVPQSLITESVYARYISAMKDERVAASKILPAPTVAKLTEDKKELIEKIRQALYFSKIMSYAQGFEQMRVASDQYDWSLNYGEIAKIWREGCIIRARFLQKITDAFDKKADLNNLLLDDYFLDITKNYQGAVRDVAAMAIQQGVPAPGFSAAITYFDSYRSEVL

SEQ ID NO: 2750 - protein, 187 aa, Phelipanche bungeana
FGHHSRKWNPKMKPYISAERKHRHIINLTKTARFLYEACNLVFYAASRGKQFLIVGTNKMRDDLVEQAAIKAQCHFVNKKWTGGTLTNWSITEARLQKFRNLIIEQKAGRLDCLPKKDAAVVKRQLSRFQKNLGGIKYMRGLPDIVIILDQNEDFTALLECLHLGIPTISLIDTNSDPDLADISIPA

SEQ ID NO: 2751 - protein, 154 aa, Sesbania rostrata
QKKTKNMGFTDKQEALVNTSYEAFKKNLPGHSVLFYSFILEKEPAAKGLFSFLKDSDGVPQNNPSLQAHAEKVFGLVHDAAAQLRATGVVVLADASLGSVHVQKGVTDPHFVVVKEALLKTLKEAAGATWSDEVSIAWEVAYDGLAAAIKKAMS

SEQ ID NO: 2752 - protein, 313 aa, Vauquelinia californica
GGLGDVLGGLPPAMAANGHRVMTVSPRYDQYKDAWDTSVLVDIEVGGRVETVRFFHCYKRGVDRVFVDHPLFLERVWGETGSKIYGPRTGMDYTDNQFRFSLLCQAALEAPRVLNSNSNKYFSGPYGDDVVFIANDWHTALLPCYLKTIYKPKGIYKNAKVAFCIHNIAYQGRFPSSDFSLLDLPDNLKGSFDFIDGYHKPVKGRKINWMKAGILESDRVVTVSPYYAQELVSGEDKGVELDNIIRKTGITGIVNGMDVQEWNPATDKYLDIKYDNTTVLDAKPLLKEALQAEVGLPVDRNIPVIGFIGRLEE

SEQ ID NO: 2753 - protein, 148 aa, Sesbania rostrata
GAFTESQEALVTSSYETFKQNASDLSVLFYTFILEKAPGAKNLFSFLKDSDGVPKDNPNLKAHAAKVFELVVDSAVQLRTKGAVVIADANLGPVHVQKGVTDAHFVVVKEALLKTVKEATGAKWSDELSNAWEVAYDELAAAIKKAMG

SEQ ID NO: 2754 - protein, 180 aa, Musa acuminata
  misc_feature (29)..(29): Xaa can be any naturally occurring amino acid
  misc_feature (128)..(128): Xaa can be any naturally occurring amino acid
  misc_feature (168)..(168): Xaa can be any naturally occurring amino acid
  misc_feature (170)..(170): Xaa can be any naturally occurring amino acid
MAKSYPTVSEEYQKAVEKAKRKLRGLIAXKNCAPLMLRLAWHSAGTYDVVSKTGGPFGTMRFPAELAHGANNGLNIAVRLLEPIKEQFPILTYADFYQLAGVVAVEVTGGPEIPFHPGREDKPEPPVXGRLPDATKGSDHLRDVFGHMGLSDRISLHYLVDTHWEGAXRXDLVSKGLGLP

SEQ ID NO: 2755 - protein, 1127 aa, Aspergillus nidulans
MSPTAIETVPTGKNNWWKEATIYQVYPASFKDSNGDGWGDIPGVIEKVPYLHSLGVDVVWLSPMYDSPMLDMGYDVSDYENVLPAYGTVVDVEKLVEECHKYGMRLILDLVINHTSDQHKWFLESRSSKDNPKRDWAIGCLRATIGGILQGVHVRSLFPTAGHALIRTGTWDEHTQEYYLHLYAKEQPDLNWDNLETRKAIYDSAVRFWLDRGVDGFRVDTVNKYSKYTDFPDAPITDPKSYIQPAIGMWCNGPRIHEFIREMYDEALEPYGDVVTVGELANTPDPAHVLRYVGASAKQLSMVFHLDIGHIGMGSLEDKYVLQPWKLTEMKSIVAKWQTFIEGTDGWTTAFCENHDNGRSVSRFASDAPEHRERSAKMLALMMVAMTGTLFLYQGQEIGMINAPRDWPIDEYKDIEGLGYYREAQAQVASGVDPMREERIMDGLRVLARDHSRLPMQWDDSPEAGFTTGVPWMRTHDLYREINVKKQEGDPDSVLSFWKKVLLLRKRYRHLFIHGAFEVLDFDNLDTFCFIKSRGEERALVVLNFSAGEQPFTQAEMAADMELLVGNYAEAELFPHPCAGISYYSDRWILVTRFIAEGLAFALLHCNRFSLTSIFPCDACRRRKVKCDGQQPCGRCRDAEISCRTTSVRRKKGRQGATATVLHELRKAPAPVAQVQSVPSPQPTVISDPFIRQPGLLHPSVVQSCAEYFFPRMLGTVPILVPTTFQDHVARIEESLHSYCLVTAFCAFVFAQTGYVSWLNAGNQSASLGRLLLDEAMAARRHLDLFSASTRQGITISFLLYGCQIGMGNQRQAYYFLREATTLYTAGMLDPADADDEDAGNLFWLLLISERAHAIRRHRPITLQVTRDSPILCDTRSDAFSLGFRCLAELYRPFDQTFLSRWNGTDSSATTEQLIQLEDHLLQAVPADVELPDIVLADLRVSQQWLRTMIWQLATSAGFLSSTPSRPCLGFAYPLQIARDLSLATWKLSKESLETHGIGLAEKIFEITCTLTDVMACMTSAGLRSSSFDLGPQDYLKHLCTLIHSLPGGETKFLPLLLAKISQTLPSMLTPVTRHLSLPSCMAEQVSVSPNVGIGSPVSHRDDWSKALNWAEMSRIGDRTPEARRGA

SEQ ID NO: 2756 - protein, 313 aa, Aruncus dioicus
  misc_feature (118)..(118): Xaa can be any naturally occurring amino acid
GGLGDVLGGLPPAMAANGHRVMTVSPRYDQYKDAWDTSVLVELEVGGRTETVRFFHCYKRGVDRVFVDHPLFLERVWGQTGSKIYGPRAGVDYNDNQLRFRILCQAALEAPRVLNLNXNEYFSGPYGEEVVFIANDWHTALLPCYLKAIYKPKGIYYTAKGGFGIHNIAYQGRFRFMEFSELDLPEEFKSSFDFIDGYNKPVKGRKINWMKAGILESDRVVTVSPYYAQELISGEDKGVELDTVIRKTGITGIVNGMDVQEWNPATDKYLDVKYDSTTVMDAKPLLKEALQAEVGLPVDRDIPVIGFIGRLEE

SEQ ID NO: 2757 - protein, 358 aa, Arabidopsis thaliana
MLQTVAVPLIGNACHVFMNGFNRVQVYGLEKLHDALLNRPKNKPLVTVSNHVASVDDPFVIASLLPPKFLLDARNLRWTLCATDRCFKNPVTSAFSRSVKVLPISRGEGIYQQGMDIAISKLNNGGWVHIFPEGSRSRDGGKTMGSAKRGIGRLILDADTLPMVVPFVHTGMQDIMPVGASVPRIGKTVTVIIGDPIHFNDILSTEGAQHVSRKHLYDAVSSRIGQRLYDLKAQVDRVYIEQQSMMSHNAKTPSDRAAEIFHRVDWDSFGMGAQFSEESSPSSKPIGQSDDRIVRSPKRRVSPEGGVSLKIKKLMDSTEMMGFAARGLLMNEYKSRVESANVGRPLKAWREYFMNRGL

SEQ ID NO: 2758 - protein, 266 aa, Cicer arietinum
MAASSMALSSPTLAGKPVKLSPSSQELGASRFTMRKSATTKKVASSGSPWYGPDRVKYLGPFSGEPPSYLTGEFPGDYGWDTAGLSADPETFAKNRELEVIHSRWAMLGALGCVFPELLSRNGVKFGEAVWFKAGSQIFSEGGLDYLGNPSLVHAQSILAIWATQVVLMGAVEGYRIAGGPLGEVTDPLYPGGSFDPLGLADDPEAFAELKVKELKNGRLAMFSMFGFFVQAIVTGKGPLENLADHLSDPVNNNAWAYATNFVPGK

SEQ ID NO: 2759 - protein, 229 aa, Zea mays
MAHLISSAIAGAGNLVADGISGVTGVASQVVEGVEDTLGSIVEAIDQGVKDEDQLDLPKYVCFKGDNGLYLSARTVEGHPYLQFASEDIGDPSVRFITYNHKVNGKRVVRFKSNHLGKFWRRSPNWIWADTDDTSTNNSDTLFEVIKIDEDGVYALRNLGNNHFCHRLTYDGKESCLNATIPTIRKEAHIKDPKKAVLFAKDLQHRVPPQGRPDFSTRMAKIPHPLERR

SEQ ID NO: 2760 - protein, 322 aa, Candida albicans
MSVKRILGGLYLSSIDPIFKEIDLKSEYGITHILSVVPGTMKESYFSDYEWKQIEITDEETTNVIQYFPESYAFIESALFQNSNDKKHQSCVLVHCSQGVSRSATFIIAYLMQKYHLSIDQALHAVKRKCPGAEPNPGFMNQLKLYNEMGFKIDESNQKYNEILKSNSLKTDPTGRSLRDMIMEKSGSPKEVKEESLYELRCKRCRQILASSVHIENHDIPESDSRQSSFIKTAPNSRRIISVERASSICSHYFFKEPVKWMKQELDKAEMEGKFSCPKCSSKVGGYSWRGSRCSCGKWMVPAIHLQEAKVDYIKRESTLRN

SEQ ID NO: 2761 - protein, 1066 aa, Yersinia pseudotuberculosis
MTSQEKVPFQVQLSLPQILSRRDWENPQITQYHRLEAHPPFHSWRDVESAQKDRPSPQQQTLNGLWSFSYFTQPEAVPEHWVRCDLAEAKPLPVPANWQLHGYDAPIYTNIQYPIPVNPPRVPDLNPTGCYSRDFTLEPSWLASGKTRIIFDGVSSAFYLWCNGQWVGYSQDSRLPAEFDLTPYLQAGSNRIAVLVLRWSDGSYLEDQDMWRMSGIFRDVKLLHKPEIHLRDIHIMTHLSPEFTSANLEVMAAVNIPSLQLNDPQVTGSYQLRVQLWLADKLVASLQQPLGTQAIDERGPYTDRTQLVLRIDQPLLWSAEQPTLYRAVVSLLNHQQELIEAEAYDVGFRQVAIHQGLLKINGKAVLIRGVNRHEHHPQTGQAIDEESLLQDILLMKQHNFNAVRCSHYPNHPLWYRLCDRYGLYVVDEANIETHGMQPMSRLSDDPSWFSAFSERVTRMVQRDRNHPCIIIWSLGNESGHGATHDALYRWIKTNDPTRPVQYEGGGANTLATDILCPMYARVDEDQPFPAVPKWSIKKWIGLPNESRPLILCEYAHAMGNSFGGFARYWQAFRQYPRLQGGFIWDWVDQSLTHHNDHGQPYWAYGGDFGDTPNDRQFCMNGLVFPDRSPHPSLYEAQCAQQFFQFSLLSTTPLVINITSEYLFRESDNEQLYWRIMLEGESVLEGSQPLNLSPESSQCYRLAEKLPTLNKPGQLWLNVEIRQPKETPWSPAQHRSAWHQWRLPQPLFSPSSDLTNATAHYAPQLQHNLQLQHNRQLQHDLQLQQDEQHIKVTYQQQCWQFSRQTGRLDQWWVADKPMLLRPLQDQFVRAPLDNDIGISEATHIDPNAWVERWKKAGMYQLQQRCLSLHVDHLSHSVQISAEYGYEFEQEPLLHSHWVYRFDRHGRMTIDVNVRIATSLPAPARIGMCCQLADISPTVEWLGLGPHENYPDRQLAAQYGHWSLPLEQMHTAYIFPSENGLRCNTHTLNYGRWTLTGDFHFGISRYSTQQLMVTSHQHLLEPEEGTWLNIDGFHMGVGGDDSWSPSVHIDDILTRETYQYQICWQYKV

SEQ ID NO: 2762 - protein, 255 aa, Unknown
  Oceanobacter sp. RED65
MSTELFNLSGKVALVTGASRGIGESIAKLLAEQGAHVIVSSRKIEGCQAVVDQITEAGFSAEAIPCHIGELEQIASLFAEIKEKHGKLDVLVNNAATNPFFGHILDTDLMAYQKTVDVNIRGYFFMCVEGGKLMKANGGGSIINVASVNGVIPGSLQGIYSITKGSVITMTKSFAKECAQLGIRVNALLPGATDTKFAATLVKNPQILEKALEHIPMNRVAEPDEMAGTVLYLASDASSYTTGACINVDGGYLIG

SEQ ID NO: 2763 - protein, 198 aa, Gluconobacter oxydans
MNESRHARLHRATSETDITLALTLDGQGRSDVDSGIGFFDHMLTALAKHGGFDLELKAKGDLHIDGHHTVEDVGIVFGQAFRQAIGDKRGIERFGHALVPLDEALCEAVVDISGRPYLAWNVVFPREKIGTMDTELFEEFFRAFAMSAHIALHLTCKSGTNAHHIAESGFKAVARALKVAVSHDPRSAGAIPSTKGVL

SEQ ID NO: 2764 - protein, 339 aa, Escherichia coli
MNQRNASMTVIGAGSYGTALAITLARNGHEVVLWGHDPEHIATLERDRCNAAFLPDVPFPDTLHLESDLATALAASRNILVVVPSHVFGEVLRQIKPLMRPDARLVWATKGLEAETGRLLQDVAREALGDQIPLAVISGPTFAKELAAGLPTAISLASTDQTFADDLQQLLHCGKSFRVYSNPDFIGVQLGGAVKNVIAIGAGMSDGIGFGANARTALITRGLAEMSRLGAALGADPATFMGMAGLGDLVLTCTDNQSRNRRFGMMLGQGMDVQSAQEKIGQVVEGYRNTKEVRELAYRFGVEMPITEEIYQVLYCGKNAREAALTLLGRARKDERSSH

SEQ ID NO: 2765 - protein, 361 aa, Kineococcus radiotolerans
MTSQSQSRPGTTQRLLALPTSPPVASPGPTPTGRAALVVNPTKFSGEQALARLRADVEREFSRFGWEMVLWLPTTATSRGRDEARQAVEAGADLVLVAGGDGTVRVVAEVLLGTDVAMGLLPCGTGNLLARNLGIPLNDVAAAVRTACLGTDVAVDAGRLEVDRDGEGTNVEHHLFLVMTGIGFDAALIAGAGEDLKRRFGHVAYLASGVRALRGPCARVTVRADGGESWTRATQGVTVGNCGQLTMGLALMPEADPCDGVLNGVVLPPRDLVQWARAVWSVAVGVPAPHLLPRLGARGLEVRSDVALPVQVDGDLVGRARCIRLCTTPAALRVRRPSAHRVEGHVEETRAPSTADLRLAS

SEQ ID NO: 2766 - protein, 222 aa, Zea mays
MGTPETSREPCPDRILDDVGGAFGMGAVGGSAYHFIKGIYNSPNGMRLSGGAQTVRMNAPRVGGSFAVWGGLFSTFDCAMVYARQKEDPWNSIVAGAATGGFLSMRQGMGAAGRSALMGGILLALIEGAGLMLNRVLANPPLPADDPNLTAAMGGNPFPGLPQAPPVVAPPEATTSSGVGGLFGGLFGRKEEEKKPSAGGGKSEILESFDTPSSPIPSFEYK

SEQ ID NO: 2767 - protein, 187 aa, Brassica napus
MSIDLSSDRVCYVLCNFCTTTLAVSVPYASLFTLVTVRCGHCTNLLSLNIGVSLHQSSPPPIHQDLQHKQHITSSVTRKEYGSSSRSSNHFSTTLSENVDREAPRMPPIRPPEKRQRVPSAYNRFIKEEIQRIKAGNPEISHREAFSTAAKNWAHFPHIHFGLKLDGNKKGKQLDQTVAGHKSNGYF

SEQ ID NO: 2768 - protein, 609 aa, Oryza sativa
MSALTTSQLATSATGFGIADRSAPSSLLRHGFQGLKPRSPAGGDATSLSVTTSARATPKQQRSVQRGSRRFPSVVVYATGAGMNVVFVGAEMAPWSKTGGLGDVLGGLPPAMAANGHRVMVISPRYDQYKDAWDTSVVAEIKVADRYERVRFFHCYKRGVDRVFIDHPSFLEKVWGKTGEKIYGPDTGVDYKDNQMRFSLLCQAALEAPRILNLNNNPYFKGTYGEDVVFVCNDWHTGPLASYLKNNYQPNGIYRNAKVAFCIHNISYQGRFAFEDYPELNLSERFRSSFDFIDGYDTPVEGRKINWMKAGILEADRVLTVSPYYAEELISGIARGCELDNIMRLTGITGIVNGMDVSEWDPSKDKYITAKYDATTAIEAKALNKEALQAEAGLPVDRKIPLIAFIGRLEEQKGSDVMAAAIPELMQEDVQIVLLGTGKKKFEKLLKSMEEKYPGKVRAVVKFNAPLAHLIMAGADVLAVPSRFEPCGLIQLQGMRYGTPCACASTGGLVDTVIEGKTGFHMGRLSVDCKVVEPSDVKKVAATLKRAIKVVGTPAYEEMVRNCMNQDLSWKGPAKNWENVLLGLGVAGSAPGIEGDEIAPLAKENVAAP

SEQ ID NO: 2769 - protein, 455 aa, Thiomicrospira crunogena
MSEDFKKYICKTCGLIYDEELGDPDSGLAPGTRFEDIPEDWYCPLCLVSKSDFIPLDQAKVKSSPDGSPKRKASTHADVLIIGAGYAGWQAAENIRAALPEAEISLLTACDGTVYPKPSLSMALSQGRTPDDLKEMTAEAKAAELNMGVKTRTKVMSINTKRKKVMTTSGSFQYDKLILATGAKAMVPQVEGNAAHDIMTINDLSAYRRFYKALVGKQSVTLIGGGLIATELAEDLSSQDIEVNMVVRGAHLMSQILPEAISNSLETKLKENGVHLYKNSELKEINESENGYVLQTDQGEFLETNIVIAAIGLAPNLDLAKKAKLETNRGICINGACQTSDPDIFAIGDCAEAGGVLQAYLEPIRRQAKAIAAHLKGEDTDQFQVLPSLIKTKTPSLSIMISPPLHATHGQWEQTIMVGDNQRLLYKEGEGVSGFALSGDLVTSANALYQELFSA

SEQ ID NO: 2770 - protein, 136 aa, Brassica napus
  misc_feature (133)..(133): Xaa can be any naturally occurring amino acid
MATDETIFDHLKKEIPVDEESLLLKPDSSVGLVIVDVVNGFCTVGSGNMAPTKPNEQISKMVEESARLAREFCDRKWPVFAFLDSHLPDVPEIPYPPHCIIGTQEAELVPALQWLESESCATLMRKDCINGFXGSM

SEQ ID NO: 2771 - protein, 91 aa, Brassica napus
  misc_feature (30)..(30): Xaa can be any naturally occurring amino acid
IVPHCAQISKGSVTHACPSVHTHSSGVTAXTLCSTEGPDVDFNPPVTPIDDSKSSGPFKFYNAEIHSAALCLPSFAKKVIDSPTQLKMGKK

SEQ ID NO: 2772 - protein, 313 aa, Oryza sativa
MALVEYWCAGLVLVLLLELSTVKEALLEQSDLKNAKRDKLVKCPLKVPFLKLFTPQRGGRFEIVFVSPTGEEIKNKRQLSQYLKAHPGGPASSEFDWGTGDTPRRSARISEKVKAFDSPEGEKIPKRSRNSSGRKGKQEKKEATENEEAKDAEADKEAPSEDAPKETDVETKPAEEAKEAPSEDAPKDTDVEMKTAEDASKTADADTPAPAPAGTEKEDAKPAESEAAPPAPSEGGEKKEDAKPAEPEAAAAPPSNPTEPSAPKAAAAAPVENSADKGPHQDSQPPSAAAPAKESSPVNNGQLPAGASAVKCT

SEQ ID NO: 2773 - protein, 73 aa, Ralstonia eutropha
MAKEELVEFGGKVSEVLPDNRFRVTLENGFEVWAYSSGRLKRNRIRILAGDRVTLEMSPYDLTKGRINYRHKF

SEQ ID NO: 2774 - protein, 527 aa, Zea mays
  misc_feature (374)..(374): Xaa can be any naturally occurring amino acid
  misc_feature (398)..(398): Xaa can be any naturally occurring amino acid
MTGPIPSSIGNLEHLLRLNLSKNDLVGFIPAEFGNLRSVMEIDLSYNHLGGLIPQELGMLQNLMLLNVSYNNLAGAVPTDNNFTRFSHDSFLGNPGLCGYWLGSSCRSTGHRDKPPISKAAIIGVAVGGLVILLMILVAVCRPHHPPAFKDATVSKPVSNGPPKLVILHMNMALHVFDDIMRMTENLSEKYIIGYGASSTVYKCVLKNCKPVAIKKLYAHYPQSLKEFETELETVGSIKHRNLVSLQGYSLSPVGNLLFYDYMESGSLWDVLHEGSSKKNKLDWVTRLRIALGAAQGLAYLHHDCSPRIIHRDVKSKNILLDKDYEAHLTDFGIAKSLCVSKTHTSTYVMGTIGYIDPEYARTSRLNEKSDVYXLRHRSAGAADRQEASGQRVQSPSXILSKTASNEVMETVDPDVGDTCKDLGEVKKLFQLALLCTKRQPSDRPTMHEVVRVLDCLVNPEPPPQPQQQQQKAHAHHQLPPQPSPPAYVDEYVSLRGTGALSCANSSSTSDAELFLKFGEAISQNMV

SEQ ID NO: 2775 - protein, 76 aa, Brassica napus
FAKGFLNGTLRNPKTNKPLAILDIKRWQGMSGFHEVELTVRDYELDQFGVVNNAIYANYCQHARHEFLESIGINCD

SEQ ID NO: 2776 - protein, 590 aa, Saccharomyces bayanus
MTTPKQDSEVEEKHMYTEPAGTFFHDVEASQTHHRRGSLSLKDEKSKELYPLRSFPNGVNGQDTFSMEEDIQDEDEGEVQNAEVKRELKQRHIGMIALGGTIGTGLFIGLSTPLTNAGPVGALISYLFMGSLAYSVTQSLGEMATFIPVTSSFTVFSQRFLSPAFGAANGYMYWFSWAVTFALELSVVGQVIQFWTYAVPLAAWISIFWVIITAMNMFPVKYYGEFEFWVASIKVIAIIGFLIYCFCMVCGAGVTGPVGFRYWRNPGAWGPGIISKNKNEARFLGWVSSLINAAFTFQGTELVGITAGEAANPRKTVPRAIKKVVFRILTFYIGSLLFIGLLVPYNDPKLTSATSYVSTSPFIIAIENSGTKVLPHIFNAVILTTIISAANSNIYVGSRVLFGLSKSKLAPKFFSKTTKGGVPYIAVFATSIFGALAYMETSTGGGKVFAWLLNITGVAGFFAWLFISVSHIRFMQALKYRGISRDELPFKAKLMPGLAYYATFFMVVIILIQGFTSFTPTFNGVNFLAAYISVFLFLAIWILFELIFRCRFVWKIEDVDIDSDRRDIEAIVWEEPEPKTLWDKFWNVVG

SEQ ID NO: 2777 - protein, 499 aa, Rhodospirillum rubrum
MDSFPIFLTLTGVRVLVVGGGAAAAAKARLALKAGARVSVFAPALSADWQDLRGHPALDHRQGFPGQGGEEEWRDVRLVYAAGESLEEDRAVHAAASARGVLVNVVDRPELCDFLTPAIVDRSPIVVAIGTGGRAPVLARRVRAAIDRLLPARLGALARLAEGFRGTVAQALPDGDRRRRFWDRFFDGAPALAALEGDEPRARTAALRLLNDGEALDNGAPAAGVVHLVGAGPGDPDLLTLKAQRLLQEADALVYDDLVGEGILDMARRDAARIYVGKRKGRASLTQEQIGRLMCDLAAAGRVVVRLKGGDPAVFARLSEEIDALAAAGVAWTVVPGITAASAAAAAIGISLTDRDGAPSVTLLSGHRRAPAAGESEAAVDWRAAARTGGTLAVYMGLSRATAAAEGLIEGGLSAETPVAVVHDASRQGQRVSRGTLGELPRLVAQGALAAPDAPGLVLVGKVVAKAGRLPAIAPVFSTPRAFAGDPSFASQALPSQAG

SEQ ID NO: 2778 - protein, 709 aa, Photorhabdus luminescens
MLNPIVRKFQYGQHTVAIETGMMARQATAAVMVNMDDTAVFVTVVGQKKVKEGQDFFPLTVNYQERTYAAGRVPGSFFRREGRPGEGETLVARLIDRPLRPLFPDGFLNEVQIVATVVSVNPQVNPDIVAMIGASAVLALSGIPFNGPIGAARVGYINDQYVLNPTSDELKNSRLDLVVSGTAGAVLMVESEADILTEEQMLGAVVFGHEQQQVVIDNINALAAEAGKEKWNWVPESVNQALHDRVAGLAEDRLGDAYRITEKQERYAQVDAIKEEVTAALLEQDEALEEAEIHEILGSLEKKVVRSRVLRGEPRIDGREKDMVRALDVRTGVLPRTHGSALFTRGETQALVTATLGTERDAQIIDELMGERTDRFLLHYNFPPYSVGETGMMGSPKRREIGHGRLAKRGVAAVMPKANEFPYTVRVVSEITESNGSSSMASVCGASLALMDAGVPIKAAVAGIAMGLVKEDDNFVVLSDILGDEDHLGDMDFKVAGSCEGISALQMDIKIEGITREIMQIALNQAKGARLHILSVMEQAINSPRNDISEFAPRIHTIKINPDKIKDVIGKGGSVIRALTEETGTTIEIEDDGTVKIAATDGEKAKHAISRIEEITAEIEVARIYTGKVTRIVDFGAFVAIGGGKEGLVHISQIADKRVEKVADYLQVGQEVSVKVLEIDRQGRVRLSIKEATVGVIVEDTPVAPQSAE

SEQ ID NO: 2779 - protein, 75 aa, Arabidopsis thaliana
  misc_feature (29)..(29): Xaa can be any naturally occurring amino acid
  misc_feature (62)..(62): Xaa can be any naturally occurring amino acid
MASSMLSSIGVVTSPAQATMVVPFTGLKXSVSFPAARKGNRGLTSIKGNGGRVSCLKVGPPXWKAQILQTRARLP

SEQ ID NO: 2780 - protein, 313 aa, Exochorda racemosa
GGLGDVLGGLPPAMAANGHRVMTVSPRYDQYKDAWDTSVLVELEVDGRIETVRFFHCYKRGVDRVFVDHPLFLERVWGKTGSKIYGPRTGVDYKDNQLRFILLCQAALEAPRVLNLNNNEYFSGPYGDDVVFIANDWHTALLPCYLKTLYKPRGIYQTAKVAFCIHNIAYQGRFPFSDFSLLDLPDQLKGSFDFIDGYNKPVKGRKINWMKAGILESDRVVTVSPYYAQELVSGEDKGVELDNIIRKTGITGIVNGMDVQEWNPTTDKYLDVKYDETTVLDAKPLLKEVLQAEVGLPVDRNIPVIGFIGRLEE

SEQ ID NO: 2781 - protein, 283 aa, Arabidopsis thaliana
MDAKETSATDLKRPREEDDNGGAATMETENGDQKKEPACFSTVIPGWFSEMSPMWPGEAHSLKVEKVLFQGKSDYQDVIVFQSATYGKVLVLDGVIQLTERDECAYQEMITHLPLCSIPNPKKVLVIGGGDGGVLREVARHASIEQIDMCEIDKMVVDVSKQFFPDVAIGYEDPRVNLVIGDGVAFLKNAAEGSYDAVIVDSSDPIGPAKELFEKPFFQSVARALRPGGVVCTQAESLWLHMDIIEDIVSNCREIFKGSVNYAWTSVPTYPRHWGHWIYALFN

SEQ ID NO: 2782 - protein, 461 aa, Desulfitobacterium hafniense
MKKKWLGLGLGILILFTGYFWPETAGLTQPGKMSIAILMAGIVLWVTEVMPLAITALLLMVCMPYFEIFNWSTTWSKFISSVIFFIIATFAISVALIKTSLATRIAGVLIKWSQGNSKRLVLGFMAGTALLSAVCNNVPACSLFMSLALSILITDNAIPGKSNLGKCLMIGIPFGAMIGGTMTPAGTSINIMAMGLLEEATGITISFLDWMLMGIPFAIIIVPVCWLSLIMIFKPEDISQKSIDILQNRVVTTEKLNKEEKKIIIIIAVMLAAWIASTWIPWLDATGIAVMGLIAFFFPGIEVLSWDEFIKGVSWEVVLMIGGVNAVAAGIMSTGAAAWIVDSIMGGASGWSYPMLAGVTATVMAVLHGICPVGPAICGMATVPISGLAELINASPAVLTIIVAFGAGITFLLPLDCVPLITYGKGYYKMVDMVKAGIIPTIAVILVSAFMLPPLGALIGL

SEQ ID NO: 2783 - protein, 299 aa, Pediococcus pentosaceus
MKIGLIGLGKMGLNLAENMLDNNIEVLAFDVFDKARENAEKHNIITVDSIEQLVKQLDQLRIIWIMVPAGAPTNDTIGQLSNLLSKNDVVIDGGNTYYQDSLHHNQVLSKAGIYFFDVGTSGGMSGARHGGNFMIGGDKDKFGEIEPLFKAIAEKDGYLYTGQAGSGHYLKMVHNGIEYGMMQAIGEGFEVLSKSEFDYDNEAVAKVWNHGSVVRSWLMELAQSAFSNDPNLDEIKGVMHSSGEGAWTVEEAIRLHVPTPVISSSLMMRYRSEEDDTMTGKVVSALRNGFGGHKVDHKE

SEQ ID NO: 2784 - protein, 308 aa, Gibberella zeae
MSDYKTYSFNPAQDIPSLDGKVILITGANTGLGKATALELAKHNPAHIYITARNSTKGNTALEEVKGVASEGTQVSLLELDLSSFDSIKAAAKDFLDREVRLDVLLLNAGVMGAPPVLTKDGYEMHIGTNHLGHALLLKLLTPVLDKTPNARVVHLFSAGFRHVGPNGIEFDTLKSATSPTPLPLRYAQSKLACLLYAREAAKRYNFTNIAINPGEVQTELFSRKAGDEMMKHLQENVAPKMAGPISEGVKNHLWAATSTEIKNGEFYEPVGKTGGLEGAGLDEEMANKLWDWTEEQLEGLRVSEIDR

SEQ ID NO: 2785 - protein, 193 aa, Streptomyces coelicolor
MRARPRDPGKIQTAPPSILCMTSAPNTRNDDNLPLDVEIGALQGGAADLSQYAGRVVLVVNVASKCGLTPQYAGLERLHERYAEQGFTVLGVPCNQFMGQEPGSADEIAEFCSATYGVTFPMTGKAEVNGEGRHPLYDRLTGFADAEGHSGDIRWNFEKFLIGRDGKVAARFSPQTEPEAAEVVAAVEERLAG

SEQ ID NO: 2786 - protein, 181 aa, Cicer arietinum
MASSMISSSAVTTVKRASSVPSGAVAPFVGLKSMAGFPVRKVNNDITSIASNGGRVHCMQVWPPIGKKKFETLSYLPPLTEEQLLKEVEYLLRKGWVPCLEFELEKGFVYREHNNSPGYYDGRYWTMWKLPLFGCTEAVQVLKELQEVVKAYPNAFVRIIGFDNVRQVQCISFIAHTPKEF

SEQ ID NO: 2787 - protein, 378 aa, Glycine max
  misc_feature (254)..(254): Xaa can be any naturally occurring amino acid
MAVMAVHQFAQCITCHAWSPDQSMVALCPNNNEVHIYRLVEDKWEKLYVLQKHDQVISGIDWSARSNRIVTASHDRNSYVWNLEGSEWVPTLVILRLNRAALCVQWSPKENKFAVGSGAKTVCICYYEQENNWWVSKLIRKRHDSSVTSVSWHPDNILLATTSTDGKCRVFSTFIKGVDARDSKKGTSPDSKFGEQIVQLDLSSSWTFGVKWSPSGNTLAYVGHNSMIYFVDDVGPSPLAQNVVFRDLPLRDVXVLFVSERKVIGVGFDCNPMVFAADERGIWSFVRYLAERKAVSSGSRYGSQFSEAFGKFYGQSKHGVSNDTVETSRTRGTVHENCINCIMPLGDHGTLLRRFSTSGLDGRIVVWDLENEQDLLEL

SEQ ID NO: 2788 - protein, 309 aa, Candida glabrata
MGKSSKDKRDLYYRKAKEEGYRARSAYKLLQLNEEFHFLDDPELKRVVDLCAAPGSWSQVLSRKLFAEREPVADGQEDDRKIIAVDLQPMSPIDHVITLQADITHPRTLERIYELFGNQKADFVCSDGAPDVTGLHDLDEYIQHQLIMSALQLTTCVLKRGGTFVAKIFRGRDIDMLYSQLGYLFEKIVCAKPRSSRGTSLEAFIVCIGYNPPAGWEPKLDVNSSVTEFFATCDLGKLSIDDTLQPWKDQPRSIADFMACGSLSSYDSDATYHDLPKYGVALDPVQAPTNPPYKRALELKRDGKLTRNI

SEQ ID NO: 2789 - protein, 315 aa, Vitis vinifera
MEIDSIECVSSTDGIYEEEIHHHHHQFSSSSKPHSNVVSPAISPATSVHELLECPVCTNSMYPPIHQCHNGHTLCSTCKSRVHNRCPTCRQELGDIRCLALEKVAESLELPCKYCSLGCPEIFPYYSKLKHEAQCNFRPYNCPYAGSECAVVGDIPFLVSHLRDDHKVDMHTGCTFNHRYVKSNPREVENATWMLTVFNCFGQYFCLHFEAFQLGMAPVYMAFLRFMGDEIEARNFSYSLEVGANGRKLIWEGTPRSIRDSHKKVRDSHDGLIIQRNMALFFLWWGQEGAEASGHRTNMEGTTKSRCRGVHTQSL

SEQ ID NO: 2790 - protein, 681 aa, Ralstonia metallidurans
MRIQHAFRLITLAMVATIVGFGSYLWTEEWRAYAVAQHSEAMLQAFRATLVAAEKVSAERGPSNAALGAAPGVAAGALLRAREQSDASLTAAIAMLHGANCPECGAAKGSLEHARAQLAAARSQIDRLIARPLSERHDVQRAVSGMFTIVDEILRVADGPLSRLQRSAPVAAQHAVSARFAAELREYAGRAGSEFTSALVSNRPMHSEERERLAGDLGRVQTLGDQIQQRVSFQLASKPGLRDADTALHKRFFGDGLAYLQKVEAIGPAEPRPTTAELASTYVPLMAPIVAMRDAVLDVAQAEVQADTTRAKRRLGGLLAILAIITSFVAATFWLFAKRVLRPLTLATEATVELAEGRYDGPTHVWPKTDEIGAIFVALEQLRAGLLRKVALEHERTTLIARLQAAVTHERAQMMALAQARDAAEASARTKSSFLAMMSHEIRTPLQGILGLLELVEYSPLSAEQRRQVRLASEAGQALRQILDDVLDYAKMDAGRLRLALAPLDLRGLFANVLSLLAPRAQAKGLQLQQWVQPDVPVQLVADGARLRQILLNLVGNAIKFTECGSVDLLASVEPTSAGEDVLVVSVADTGIGIAPEDIARLFTPFVQGESGPARRFDGTGLGLAISRQLAQLMGGELMLDSTLGVGTQVMLRVPMPGCPDAGSPLSNSERREHRAEFRLA

SEQ ID NO: 2791 - protein, 266 aa, Glycine max
MLLKCLAAISSSYTTTSNSLLVFASSSLSSPAKTKFLPSLSRFSVKRLCFLSQTRPHISVNKPSMNLLNRLGFGSARAPENMDSSIPQGPDDDIPAPGQQFAEFGAGCFWGVELAFQRVPGVTKTEVGYTQGLVHNPTYEDVCTGTTNHSEVVRVQYDPKICSYETLLDVFWARHDPTTLNRQGNDVGTQYRSGIYYYTPEQEKAAKESLEQQQKQLNRKIVTEILPAKKFYRAEEYHQQYLEKGGRSGFKQSASKGCNDPIRCYG

SEQ ID NO: 2792 - protein, 275 aa, Bacillus clausii
MEFWFTEKQTERFGITMKIKRTLHTEKTDFQQLDMVETEEFGNMLLLDGMVMTTEKDEFVYHEMVTHVPLFTHPNPKHVLVVGGGDGGAIREILKHPSVEKATLVDIDGKVIEYSKTYLPTIACALEDERVDVKVADGFMHIAQSANEYDVIMVDSTEPVGPAAKLFERGFYEGISKALKEDGIFVAQTDNPWFHQELVSNVYKDVKEIFPITRLYTANIPTYPSGMWTFTIGSKKHDPLAVEATRFHDVQTKYYTPDIHRAAFVLPKFVQDLLK

SEQ ID NO: 2793 - protein, 524 aa, Ralstonia metallidurans
MRQMNAPVDLPDRLIPTRPNDAACDIAIIGSGFSGLAMGIRLKQAGVDDFLIFEKAGSVGGTWRDNHYPGCACDVQSHLYSFSFAPNPSWSRMFSPQPEIRRYLEHSAETFGLSSHLRFGHELKQAVWDASAGVWRLEMADGRRVRARILVSGMGGLSRPAIPDIPGLDTFAGTTFHSQQWRHDYPLAGKRVAVIGTGASAIQFVPQIAPQVDRLDLYQRTPPWVMPKPDRDVSALERWMFRQFPFTQWLVRAGLYWMLEMRVMGFVMHPKLMKAVEQMARRHLAREVRDPELRAKLTPDYTIGCKRVLMSNDYYGALTRANVDVVTTGIDHVEPDALVMRDGSRRPADCIILGTGFRATDPLPRGVIIGRDGRDVLDAWRDGAEAYLGTTVSGFPNLFLIMGPNTGLGHSSMVFMIESQVRYVLDALQQMRQERVQAVDVRPSIQDGFNRGIQQKLNHTIWSAGGCASWYMDPRSGKNTTLWPGFTWQFWRATQTFRMADYERWPMREQGVAPLPEQAETARA

SEQ ID NO: 2794 - protein, 448 aa, Helicobacter pylori
MYVEKILQSLQKKYPYQKEFHQAVYEAITSLKPLLDSDKSYEKHAILERLIEPEREIFFRVCWLDDNNQIQVNRGCRVEFNSAIGPYKGGLRFHPSVNESVIKFLGFEQVLKNSLTTLAMGGAKGGSDFDPKGKSEHEIMRFCQAFMNELYRHIGATTDVPAGDIGVGEREIGYLFGQYKKLVNRFEGVLTGKGLTYGGSLCRKEATGYGCVYFAEEMLQERNSSLEGKVCSVSGSGNVAIYTIEKLLQIGAKPVTASDSNGMIYDKDGIDLELLKEIKEVRRGRIKEYALEKKSAEYTPTENYPKGGNAVWHVPCFAAFPSATENELSVLDAKTLLSNGCKCVAEGANMPSSNEAIGLFLQAKISYGIGKAANAGGVSVSGLEMAQNASMHPWSFEVVDAKLHHIMKEIYKNVSQTAKEFKDPTNFVLGANIAGFRKVASAMIAQGV

SEQ ID NO: 2795 - protein, 145 aa, Unknown
  Bradyrhizobium sp. BTAi1
MTAANSASEAHSTDAIVVEATPYELIGGEAGVRRLADRFYAIMDEEPDARKIRAMHDADLGPIRQLLFEFLSGWLGGPALYFERAEHRCIMSAHRPYAIGDAERDEWMTCMRRAMFDCDITGDMYDLLDRAFLRMANAFRTRPAG

SEQ ID NO: 2796 - protein, 385 aa, Glycine max
ELSASTLVLYPASQPPQEPKNENNGGIVFDSKNLQQMQGEMPKEFLWPSRDLVDTTQEELKEPLVDLAIFKNGDEKAISNAAELVRKACLKHGFFQVINHGVDPDLIDAAYHEIDSIFKLPLSKKMGAKRKPGGVSGYSGAHADRYSSKLPWKETFSFLYDHQSFSNSQIVDYFKSVLGEDLQHTGRVYQKYCEAMKDLSLVIMELLGISLGVDREHYRRFFQDGDSIMRCNYYPPCNRANLTLGTGPHTDPTSLTILHQDQVGGLEVFVDNKWLAVRPRSEALVINIGDTFMALSNGRYKSCLHRALVNTYRERRSLVYFVCPREDKIVRPPDNLLCRNEERKYPDFTWSNLFEFTQKHYRADVATLQSFIEWQQCSNSNPSNF

SEQ ID NO: 2797 - protein, 315 aa, Mycoplasma genitalium
MLKVNADFLTKDQVIYDLVIVGAGPAGIASAIYGKRANLNLAIIEGNTPGGKIVKTNIVENYPGFKTITGPELGLEMYNHLLAFEPVVFYNNLIKIDHLNDTFILYLDNKTTVFSKTVIYATGMEERKLGIEKEDYFYGKGISYCAICDAALYKGKTVGVVGGGNSAIQEAIYLSSIAKTVHLIHRREVFRSDALLVEKLKKISNVVFHLNATVKQLIGQEKLQTVKLASTVDKSESEIAIDCLFPYIGFESNNKPVLDLKLNLDQNGFILGDENMQTNIKGFYVAGDCRSKSFRQIATAISDGVTAVLKVRDDI

SEQ ID NO: 2798 - protein, 520 aa, Gibberella zeae
MSTFQKKLLAAIIKSLLRGKSLVQSLLAYWSSSLGHDTSSKPRVGNTPRRSIQEFLKEAETLFLDPIGQDSLQQLSRNLRKQLLQRLEADMECMLPSYSHQLPRGTEVGRFVALDVGGSTLRVALVELCGRMSNIGEESKIASMRNFRITPDIKALEGMAFFDWMAEKILETLSEELEQDGRSDGPLPMSMAWSFPIEQTSLAGGKLQGMGKGFCACDGLLGWDLGDIVRTACLNRGLNVELRAIVNDSSACLLSESYNHPTTRFGLILGTGVNLAAYLPVSAIGRVKFGQRPPQWFEKATHVIINSEISMMGRDILPLTRWDRQLLANHARPEFQPLEHMVSGIEFDHSVDYDGTLMMNRDTTSGLEEARKQFSSCHPAKHAPTTADMELLKQLAGFISKRSSALVATGVHAFWNLRIESQNNFVQTMSTESPERESAEADRDLAETTVAYNGGVIESYPGYLDSCQSYLDELVAGDKREKSGNRTIKLVSAKESSLMGAAVALASLEEVVEGPLGVVG

SEQ ID NO: 2799 - protein, 322 aa, Arabidopsis thaliana
MASRIAKDVTELIGNTPLVYLNNVAEGCVGRVAAKLEMMEPCSSVADRIGFSMISDAEKKGLIKPGESVLIEPTSGNTGVGLAFTAAAKGYKLIITMPASMSTERRIILLAFGVELVLTDPAKGMKGAIAKAEEILAKTPNGYMLQQFENPANPKIHYETTGPEIWKGTGGKIDGFVSGIGTGGTITGAGKYLKEQNANVKLYGVEPVESAILSGGKPGPHKIQGIGAGFIPSVLNVDLIDEVVQVSSDESIDMARQLALKEGLLVGISSGAAAAAAIKLAQRPENAGKLFVAIFPSFGERYLSTVLFDATRKEAEAMTFEA

SEQ ID NO: 2800 - protein, 338 aa, Arabidopsis thaliana
MRETKKEEEEVEEEEAMNALAATNRNFKLAARLLGLDSKLEKSLLIPFREIKVECTIPKDDGTLASFVGFRVQHDNARGPMKGGIRYHPEVDPDEVNALAQLMTWKTAVAKIPYGGAKGGIGCDPSKLSISELERLTRVFTQKIHDLIGIHTDVPAPDMGTGPQTMAWILDEYSKFHGYSPAVVTGKPIDLGGSLGRDAATGRGVMFGTEALLNEHGKTISGQRFVIQGFGNVGSWAAKLISEKGGKIVAVSDITGAIKNKDGIDIPALLKHTKEHRGVKGFDGADPIDPNSILVEDCDILVPAALGGVINRENANEIKAKFIIEAEIIQLIRTRMRS

SEQ ID NO: 2801 - protein, 174 aa, Glycine max
DRRRDRYEDDRRDYRRRGRDRDDEDDRRDYGRRGRDRDDEDDRRDYGRRGRDKYDRDRDRYERRRRDEHEEEHGRGRENGDRDGNRKGLQHGSGELELYAVYKGRISRVMETGCFVQLDDFRGKEGLVHVSQMATRRITNAKDVVKRDQKVYVKVISVSGQKLSLSMRDVDQHT

SEQ ID NO: 2802 - protein, 976 aa, Pisum sativum
MKSITCYLLVFFCVLFTPCFSITDLDALLKLKESMKGEKSKHPDSLGDWKFSASGSAHCSFSGVTCDQDNRVITLNVTQVPLFGRISKEIGVLDKLERLIITMDNLTGELPFEISNLTSLKILNISHNTFSGNFPGNITLRMTKLEVLDAYDNSFTGHLPEEIVSLKELTILCLAGNYFTGTIPESYSEFQKLEILSINANSLSGKIPKSLSKLKTLKELRLGYNNAYDGGVPPEFGSLKSLRYLEVSNCNLTGEIPPSFGNLENLDSLFLQMNNLTGIIPPELSSMKSLMSLDLSNNALSGEIPESFSNLKSLTLLNFFQNKFRGSIPAFIGDLPNLETLQVWENNFSFVLPQNLGSNGKFIFFDVTKNHLTGLIPPDLCKSKKLQTFIVTDNFFHGPIPKGIGACKSLLKIRVANNYLDGPVPQGIFQMPSVTIIELGNNRFNGQLPSEVSGVNLGILTISNNLFTGRIPASMKNLISLQTLWLDANQFVGEIPKEVFDLPVLTKFNISGNNLTGVIPTTVSQCRSLTAVDFSRNMITGEVPRGMKNLKVLSIFNLSHNNISGLIPDEIRFMTSLTTLDLSYNNFTGIVPTGGQFLVFNDRSFFGNPNLCFPHQSSCSSYTFPSSKSHAKVKAIITAIALATAVLLVIATMHMMRKRKLHMAKAWKLTAFQRLDFKAEEVVECLKEENIIGKGGAGIVYRGSMPNGTDVAIKRLVGQGSGRNDYGFKAEIETLGRIRHRNIMRLLGYVSNKDTNLLLYEYMPNGSLGEWLHGAKGCHLSWEMRYKIAVEAGKGLCYLHHDCSPLIIHRDVKSNNILLDADFEAHVADFGLAKFLYDPGASQSMSSIAGSYGYIAPEYAYTLKVDEKSDVYSFGVVLLELIIGRKPVGEFGDGVDIVGWINKTELELYQPSDKALVSAVVDPRLTGYPMASVIYMFNIAMMCVKEMGPARPTMREVVHMLTNPPQSTTHNNLINL

SEQ ID NO: 2803 - protein, 487 aa, Desulfitobacterium hafniense
MRALEPLIFELSREGRTGVSLPACDVPEIPLEELIPQEFLRDKEPELPEVSEVDVVRHFTRLSSFNHGVDTGFYPLGSCTMKYNPKVNEKLARLPGFSQIHPYQPEELTQGALGLMVELQEELAEITGMDAFTLQPAAGAHGEMTGILIIKAYHDHRQDVKRRKVIVPDSAHGTNPATGAMAGYDIVQVPSNERGGVDIEALRQVANEEVAALMLTNPNTLGLFDENILEIAEIIHAVGGLIYYDGANANAIMGIARPGDMGFDVVHLNLHKTFATPHGGGGPGSGPVGVKEFLAPYLPKPVAIRTPEGRYSWDDDRPLSIGRVRAFQANFGVLVKAYAYIRALGGEGLKAASQNAVLNANFLMSILKEHYHLPYDRVCMHEFIITPKNLKNYGIHTLDIAKRLLDYGYHPPTIYFPLIVEEAMMIEPTETESLETLEQFAQVMIQIAEEVKQDAEMVKNAPHDTLVTRLDETGAARKPDLRWRKPQ

SEQ ID NO: 2804 - protein, 209 aa, Photorhabdus luminescens
MANKKRSASSSRWLQEHFSDKYVLQAQKKGLRSRAWFKLDEIQQSDKIFKPGMTVVDLGAAPGGWSQYAVSQISDNGRVIACDLLPMDPIVGVDFLQGDFRDELVLKTLLERVGDNKVQVVMSDMAPNMSGTPAVDIPRSMYLVELALDMCRDVLAPEGSFIVKVFQGEGFDEYLREIRSLFTNVKIRKPDASRARSREVYIVATGRKL

SEQ ID NO: 2805 - protein, 339 aa, Triticum aestivum
MATAAFLPPAPVLRPRIPTARYRASPICAAASDAPPPDADTDEGEAPRGGRKDRRRVVRIAWEKLVRWSRSWRSRNRSDVLETTRKVVVLGGGSFGTAMAAQVAAKKPDLEVAMLLRDDLVCRSINDRHVNSKYLSEYSLPENIVATTSASEALAGADFCFHAVPVQFSSSFLGSISSYVDPKLPFISLSKGLELNTLRTMSQIIPLALGNPRQPFIVLSGPSFAVELMEKLPTAMVVASKDKKLASAVQQLLASSNLRISTSRNVGLRLGSGEKLGEILDSMNQVAEGVSTAGAVIALAQKYNVKLPVLTAVARIIDNELTPKRAVMELMNLPQVEEV

SEQ ID NO: 2806 - protein, 446 aa, Desulfitobacterium hafniense
MNYVPNTVDQQEQILTRIGVGSLEELFADIPESVRRQAQLKIREGLSELELVKYMGRLAAENKTVEEYTSYLGAGAYEHFIPSYVDQLLLRSEFYTAYTPYQPEISQGTLQAIYEFQTLVCELTGMDGANASMYDGASALAEAALMSCDATRRKKVLVPQTIHPEYREVLRTYLLPRGVEILEIPYQEGAVDSEALEKALNTEVAAVLIQSPNFFGMIEKAEEIGQMAHAKGGLLVMAVNPVSLGLLKSPGELGADIVVGEGQPFGNPLNFGGPYLGFLACREKYVRRMPGRIVGATKDKNGKKGYVLTLQAREQHIRREKAASNICSNEALCALAFTIHLSGLGKRGLKEMARLNLQKAHYGAEEIGKLPGMSLAFQGPFFHEFVIKTEVSPRKINEALLSHKIIGGLELSRFYPELDQHLLFCVTETKTKEDIDRLVAGMGEIK

SEQ ID NO: 2807 - protein, 1088 aa, Gibberella zeae
MTATIQKRIVVVGLGMVGIAFIEKLLKYDAKSKEYTITVVGEEPYLAYNRVGLTTFFEHRKVEELYMNPSEWYLESEASLNYHINTKATHIDTDNKLIECANGESYPYDILVLATGSEAILPRTLKGWDSNGVFVYRTIDDLNKLIKFSGDKQGTNGVVVGGGLLGLEAAKAMLDLECYNKIDLIERSPWVLSRQVDETAGKMVADQVQQLGVNINLGKGVSSLKTDENNNLTGVVFDDDSEVDCSTLCFAIGVKPRDDLARAANLEVGQRGGIVVNDDLRTSMPDIYAIGECASWRGMAYGLIGPGVAMAEVVAFNLTQAKLHSPQTFKTPDMSTKLKLLGVNVASFGDCFADRDGPITLPRKYAKNLVNGDAKSPKSVQALTYRDPFSNVYKKYIFTKDGKYLLGGMMIGDVCDYVKLLPMVKSQKELDVSPSELILGAKKGEEDSDDLDDDAQVCSCHNVTKGDIVKVIKDGTCKDIASIKKCTKAGTGCGGCVPLVTTIFNKTMASMGQEVTNYLCSHFSYSRADLFNIVMVKRLKSMNEVMREVGNDKNAVGCELCKPAVASIMASLWNRHVMDKTTHGLQDTNDRFLGNIQRDGTYSVVPRVSGGEITPDKLVVIGEVAQKYNLYTKITGGQRIDLFGAQKQDLLDIWGQLVAGGMESGHAYAKSLRTVKSCVGSTWCRFGLSDSVGLAVRLEERYKSIRAPHKIKGGVSGCVRECAEAQSKDFGLIATEKGWNIFVGGNGGANPRHAELLAKDVPPTDVVTILDRYLMFYMRTADKLQRTARWIENLPGGIKYLQEVILEDKLGINASLEAQMEELVDSFFDEWAEAIKTPAIANKFKQFANTSDTTRNMELEDDRGQKRPAFWPNDAAAKDDFQGLKDKWSMTAWEPIIESSYFDGADELPNGISATIKRGDTQLAIWRIKGVYYATQQMCPHKRAFILSDGLIGQEGHKTEQNGDKAGAAPWVSCPHHKRNFDLENGACKTDESMSIATFPTEARPDGMLYLKLPPVDELDSALGTKKWMVKKGEAGEAPLAKLDSKIKFVGIRGKKPYVKPTGQSKMTTKPMDLMMASNGCGGGAPEW

SEQ ID NO: 2808 - protein, 464 aa, Desulfitobacterium hafniense
MVLMKKKWLGLGLGILIMVIAYFLPETAGLTQAGKMAIAILLTGIVLWVTEVMPLAITALLLMVCLPYFDILNWSTTWSKFISSVIFFVIATFAITVALIKTSLATRIAGVLVRWSKGDPKGLVLGFMVGSALLSSVCNNVPTCSLFMSLALSILITDNAIPGKSNLGKCLMIGIPFGTMIGGAMTPAGTSINIMAIGLLEEATGMTISFLDWMLMGIPFAVIMVPISWLSLIMIFKPEAISQKSEDTINNMVISAGRLTSQEKKIIAIIGVMLVAWIASTWVPWLDATGIAVMGLIAFFFPGIEVLTWDEFVKGVSWEVILMIGGVQAVAAGIMATGAANWLVDGIMAGAANWSTPMLAGAAASVMTILHAICPVGPAICGMATVPISGLALLAGASPAVLTMIVALGAAITFILPLDCVPLITYSKGYYKMGDMVKAGIVPTFAMILVCAFVLPVLGTLIGI

SEQ ID NO: 2809 - protein, 143 aa, Lentinula edodes
MARTKQTARKSTGGKAPRKQLASKSATKSSAARKTAQGAAGGVKKPHRFRPGTVALREIRRYQKSTELLIRKLPFQRLVREIAQDFKTDLRFQSSAVMALQEAAEAYLVSLFEDTNLAAIHAKRVTIQPKDLALARRLRGERS

SEQ ID NO: 2810 - protein, 270 aa, Unknown
  delta proteobacterium MLMS-1
MTQVETPSISMREMLEAGLHFGHQTRRWNPKMKPYIFGARNGIYIINLDKTLPLFQRATEYVARKAAKGGSILFVGTKRQAQDIVREEAERCGMYFVNHRWLGGMLTNHQTIKKSVDRLKSYTSMQEDGSIHRYKKKEIMMIQKETLKLERNLGGIKEMKSLPAAIFVVDPKREDIAVTEANRLGVPVVAIADTNCDPTGIDYLIPGNDDAIKSIRLVCSKLADAILAGKESHAMAQQAAADKAAEVEVTAAADETGQPEPAGEAVATTT

SEQ ID NO: 2811 - protein, 187 aa, Phelipanche lavandulacea
FGHHSRKWNPKMKPYISAERKHRHIINLTKTARFLYEACNLVFYAASRGKQFLIVGTNKMRDDLVEQAAIKAQCHFVNKKWTGGTLTNWSITEARLQKFRNLIIEQKAGRLDCLPKKDAAVVKRQLSRFQKNLGGIKYMRGLPDIVIILDQNEDFKALQECINLGIPTISLIDTNSDPDLADIPIPA

SEQ ID NO: 2812 - protein, 131 aa, Brassica napus
  misc_feature (54)..(54): Xaa can be any naturally occurring amino acid
RHGGLAHMLTTVFLSSFAGFLVRPVMTDVTVAAVCSGLNDSCSLAVYLTGVHQXTLGLGTMVMMPVIGNLADRYGIKALLTLPMCLSIIPPAILGYRRDTLFFYTYYVIKIIFDMVCQGTVDCLAQAYVAK

SEQ ID NO: 2813 - protein, 161 aa, Pseudomonas aeruginosa
MSDSLLSIPCTTIKGEQKTLADFGGKALLVVNTASKCGFTPQYQGLEALWEKYRERGLVVLGFPCNQFGKQEPGDEGEISQFCELNYGVSFPLFRKIEVNGAGAHPLFVSLKKRALGLLGSQGIKWNFTKFLIGRDGQVVKRYAPTTKPEELSSAIEALLE

SEQ ID NO: 2814 - protein, 333 aa, Pediococcus pentosaceus
MRKRARIIYNPTSGREMIKQHLVEILAVIEKAGYETSAFATTPEPDSAKNEARRAAKDGFDLVVAAGGDGTINEVVNGIAPLLRRPKMAIIPTGTTNDYARALRIPREDPVGAAKVILQNQRLKMDIGKAGENYFINIAAGGLLTELTYDVPSNLKSIFGYLAYIVKGAELLPRVKPVEMDIEYDGERYHGKASMFFLALTNSIGGFEQIVPDASLDDGKFTMIIVKSGNLPNLLHLMVKALNGKHVNDSRIIYRKARKVTVRPVNDRVMVNLDGEYGGDAPMVFKNLKRHIEMFTNLDDVPVNLIKEDDEYRQVEQQFVEEVQNLPDDNKID

SEQ ID NO: 2815 - protein, 188 aa, Zea mays
  misc_feature (156)..(156): Xaa can be any naturally occurring amino acid
MGRRPARCYRYCKNKPYPKSRFCRGVPDAKIRIFDLGRKKAKVDEFPLCGHMVSDAYEQLSSEALEAARICANKYMVKSCGKDGFHIRVRLHPFHVIRINKMLSCAGADRLQTGMRGAFGKPQGTVARVHIGQVIMSIRTKLQNKEHVIECSAQGXFKFPGRQKIHISKKWGFTKFNADEFEDMVAEK

SEQ ID NO: 2816 - protein, 203 aa, Burkholderia mallei
MSFGPLDSTNREETLDIAIIGTGFSGLGMAIRLRQTGNQDFAVFEKASSVGGTWRDNHYPGCACDVQSHVYSFSFAPNPRWTRMFAPQPEIRAYMEDCVQRFNVGSHLRFDHELVNATYDETAHRWHLTFANGKRVCARVLVSGMGGLSRAAYPNIPGIETFKGEAFHSQHWKHDYALEGKRVAVIGTGASVTCPLQTGPAGV

SEQ ID NO: 2817 - protein, 173 aa, Pseudomonas fluorescens
MSLNELNTFPGVTAQPDAATARFVFNHTMLRVKDITRSLDFYTRVLGFSLVEKRDFPEAEFSLYFLALVDKAQIPADAGARTEWMKSIPGILELTHNHGTENDPAFAYHNGNSDPRGFGHICISVPDIVAACERFEALGCDFQKRLNDGRMKSLAFIKDPDGYWVEIIQPAPL

SEQ ID NO: 2818 - protein, 259 aa, Oryza sativa
MEPSSQPQPVMGVATGGSQAYPPPAAAYPPQAMVPGAPAVVPPGSQPSAPFPTNPAQLSAQHQLVYQQAQQFHQQLQQQQQQQLREFWANQMEEIEQTTDFKNHSLPLARIKKIMKADEDVRMISAEAPVVFAKACEVFILELTLRSWMHTEENKRRTLQKNDIAAAITRTDIYDFLVDIVPRDEMKEEGLGLPRVGLPPNVGGAADTYPYYYVPAQQGPGSGMMYGGQQGHPVTYVWQQPQEQQEEAPEEQHSLPESS

SEQ ID NO: 2819 - protein, 521 aa, Pseudomonas fluorescens
MLDANLKAQLKSYLERVTQPIEIVASLDDGAKSQEMLALLKDIVSLSNQITLLDNGSDARKPSFSLNRPGSDISLRFAGIPMGHEFTSLVLALLQVGGHPSKASAEVIEQIRSLKGEFNFETYFSLSCQNCPDVVQALNLMAVLNPNIRHVAIDGALFQAEVDERKVMAVPSVYLNGVNFGQGRMGLEEILAKLDTGAVEKQAQKLNAKEAFDVLVVGGGPAGASAAIYAARKGIRTGVAAERFGGQVLDTMAIENFISVQATEGPKLAAALEEHVKQYDVDIMNLQRASALVPAKEVGGLHEIQFESGASLKAKSVILATGARWREMGVPGEQEYKAKGVCFCPHCDGPLFKGKRVAVIGGGNSGVEAAIDLAGIVSHVTLLEFDSKLRADAVLQRKLFSLPNVKVITSALTSEVKGDGQKVTGLAYKDRDSGEFHTVDLEGIFVQIGLLPNTDWLKGTVELSPRGEIIVDARGETSLPGVFAAGDVTTVPYKQIVIAVGEGAKASLSAFDHLIRTSAPA

SEQ ID NO: 2820 - protein, 220 aa, Debaryomyces hansenii
MSDNTDDYSYDYEYLYKIVLIGDSGVGKSNLLSRFTRDEFNLESRSTIGVEFATRTLEIDGKRVKAQIWDTAGQERYRAITSAYYRGAVGALIVYDISKAESYESVSRWLKELKEHADANIVIELVGNKSDLDHLRAVPTDEAKNFANENNLLFTEASALSSDNVDLSFHQLLKNIYEMISKHQLDTNEGSNGNKPSGGPTISLTPAPQEKKSKNNSNCC

SEQ ID NO: 2821 - protein, 267 aa, Triticum aestivum
VTLQNKFVQKSRLVPVRNSRDIVDPRVRSSSVSRRRRSRRLPRAAVAMGRRPARCYRQIKNKPYPKSRYCRGVPDPKIRIYDVGMKKKGVDEFSHCVHLVSWEKENVSSEALEAARIACNKYMTKHAGKDAFHLRVRVHPFHVLRINKMLSCAGADRLQTGMRGAFREAAGSLVPVLPLGRSLLSVRCKPNNAIHATEALRRAKFKFPGRQKIIESRKWGFTKFNRNDYLKFKSEGRILPDGVNAKLLGCHGRLANRAPGQAFLSAA

SEQ ID NO: 2822 - protein, 100 aa, Mycoplasma gallisepticum
MKHITNKAELDQLLTTNKKVVVDFYANWCGPCKILGPIFEEVAQDKKDWTFVKVDVDQANEISSEYEIRSIPTIIFFQDGKMADKRIGFIPKNELKELLK

SEQ ID NO: 2823 - protein, 341 aa, Arabidopsis thaliana
  misc_feature (123)..(123): Xaa can be any naturally occurring amino acid
  misc_feature (275)..(275): Xaa can be any naturally occurring amino acid
  misc_feature (298)..(298): Xaa can be any naturally occurring amino acid
IISIWFEGFEKRLEVTFFEPSIFQDSKGLGLRALTKSQLDEILTPAACTIVSSLSNDQLDSYVLSESSFFVYPYKVIIKTCGTTKLLLSIPPLLKLAGELSLSVKSVKYTRGSFLCPGGQPFXPHRSFSEEVSVLDGHFTQLGLNSVAYLMGNDDETKKWHVYAASAQDSSNCNNNVYTLEMCMTGLDREKAAVFYKDEADKTGSMTDNSGIRKILPKSEICDFEFEPCGYSMNSIEGDAISTIHVTPEDGFSYASFEAVGYDFNTLDLSQLVTXGLSCFEPKQFSVAVHSSVGANSXSPEITVDLEDYGCRKRKFESSRKESGTVMYQTFEKLGKYCGSP

SEQ ID NO: 2824 - protein, 929 aa, Unknown
  Mesorhizobium sp. BNC1
MANGITFTLDGKTVTAGEEETIWDVAKREGTKIPHLCHVDLPGYRPDGNCRACMVDIEGERVLAASCIRRPTAGMVVNTSTERARKSREMVFELLASNMRPVSEGPDQQSLFWQWANSMGISGNRYGSKFAQDSVPAEFDVTNPAIAVNLDACIACGACVRACREVQVNDVIGMAERGNHSVPVFDMHDPMGLSTCVTCGECVQACPTGALFEKSLMDGEGKTRVVQSFDKVVDSVCPFCGVGCQTKVAVKDNRIVQIDGRNGPANENRLCVKGRFGFDYAMSPERLTKPLIRRDDAPKTGDLDLSNVDPLTVFREASWEEALERAAGGLKRIRDEHGGAALAGFGSAKGSNEEAYLFQKFVRQGFGTNNVDHCTRLCHASSVAALMEGVGSGAVSAPFMDALKADCVIIIGARPATNHPVAATYFKQAAKRGTKLIVMDPRGQELMRHASYALRFKPGSDVAMLNALLHVIIEEKLYDEQYIQANVSGFEALKEKVRDFSPEAMAPVCGIEANVLREVARTYAKAERSMIFWGMGISQHTHGTDNSRCLIALALITGHVGRPGTGLHPLRGQNNVQGASDAGLIPMYFPDYRSVENIDTRGQYENFWGQTLDPKRGLTVVEIVDAIHDGEIRGMYIMGENPAMSDPDQSHARAALAKLEHLVVQDIFLTETAWHADVVLPASAHAEKLGTYTNTNRQVQIGRPALELPGDARQDLDLIIELASRMGLGWNYGHVSEVYNEMASVMPSLKHISWERIEREESVIYPADGPDIPGNEIVFSSGFPTTDGRGRIVPADLLPPDEVPDEEYPLVLTTGRLLEHWHTGAMTRRAGVLNAIEPYGIAAMSPYEIRRRGLSQGDVIAVETRRGTVEAILRADREVAEGMVFMPFCFNESPANKLTNPMLDPYGKIPEFKYCAARVVPSSRGEAAE

SEQ ID NO: 2825 - protein, 112 aa, Unknown
  Synechococcus sp. RS9916
MKKVEAIIRPFKLEDVKLALVNAGIVGMTVSEVRGFGRQKGQVERYRGSEFTVEFLQKLKIEVVIDDSNVDTVVNAIAEAAKTGEIGDGKIFISPVESVVRIRTGDRDTTAL

SEQ ID NO: 2826 - protein, 328 aa, Prochlorococcus marinus
MSRIYEDNSFAIGHTPLVKLNSITKNAKATVLAKIEGRNPAYSVKCRIGANMIWDAEKKGLLNKDKVIIEPTSGNTGIALAYTAAARGYKLILTMPESMSIERRRMMAVLGAELILTEAAKGMPGAIAKAKEIADGDPQKYFMPGQFDNPANPEIHFKTTGPEIWDDTDGQIDVLVSGVGTGGTITGVSRFIKQEKNHSLLSVAVEPTHSPVITQTLNGEEVKPGPHKIQGIGAGFIPKNLDLSVVDQVEQVSNDESIAMALRLAQEEGLLVGISCGAAAAVALRLAEKEEFAGKTIVVVLPDLAERYISSVMFENVPTGVIKEPSLA

SEQ ID NO: 2827 - protein, 99 aa, Anabaena variabilis
MATYQVRLISKKENIDTTIEIDEETTILDGAEENGIELPFSCHSGSCSSCVGKVVEGEVDQSDQIFLDDEQVGKGFALLCVTYPRSNCTIKTHQEPYLA

SEQ ID NO: 2828 - protein, 456 aa, Mycoplasma genitalium
MKSVTVKQLLQTPRKFNNKQIKLSGWVKNKRASANIIFLAISDGSSINTLQAVVKQEDNPQVFSLLQTVNLASAVMVWGEIILTPKAKQPLELKLKQVSLLAQAESDYPLQKKEHSQEFFRSNAHLRVRAKTYFAVMKIRSVLSHAIFEYFFKNDFILVQSPILTSNDCEGAGETFVIKDSETFFNKTTFLTVSGQFGAEAFAQAFKKVFTFGPTFRAEKSHTNRHLSEFWMIEPEIAFANLKDLMQLIQNLIKFLIKKVMENASDELNVLAKQFSNDIISNLKTIISTKKFPIIEYSKALAILKESSDTKKTNFELNDFSFGIDLKTEHERFLCEQYFQNQPLFVINYPKELKAFYMKTNTDNKTVAAVDLLLPKIGEICGGSERESDLNQLKNRCQSLNIDTKSLNWYLDMRKWGYFASAGFGLGFDRLLAYICGLENIRDAIPFPRVHGTINF

SEQ ID NO: 2829 - protein, 392 aa, Unknown
  Mycobacterium sp. MCS
MAQREWVEKDFYKELGVSSDASADEIKKAYRKLARDLHPDTNPDPSAAERFKAVSEAHSVLSDAAKRKEYDETRRLFAGGGFGRGRFNGGGGGFGGFGGADGGVEFNLNDLFDAAGQTGGANIGDLFGGLFGRGASPRPSRPRRGNDLETETELSFLEATKGVAMPLRLTSPAPCTNCHGSGARPGTSPKVCPNCNGAGVVNRNQGAFGFSEPCTECKGSGSIIEHPCGECKGTGVTTRTRTINVRIPPGVEDGQRIRLAGQGEAGLRGAPSGDLYVTVHVRPDKVFGRDGDDLTVSVPVSFHELALGTTLSVPTLEGKVGVRVPKGTSDGRILRVRGRGVPKRGGGHGDLLVTVKVAVPPNLEGEAAEALEAYAKAERASGFDPRAGWAGA

SEQ ID NO: 2830 - protein, 221 aa, Glycine max
VVYFRRALKLNKNFLSAWTLMGHEFVEMKNTPAAVDAYRRAVDIDPRDYRAWYGLGQAYEMMGMPFYALHYFKKSVFLQPNDSRLWIAMAQCYETDQLRMLDEAIKCYRRAANCNDREAIALHNLAKLHSELGRPEEAAFYYKKDLERMESEEREGPKMVEALLYLAKYYRAQKKFEDAEVYCTRLLDYTGPERETAKSILRGMRSTQSNFPSMDVEHFPP

SEQ ID NO: 2831 - protein, 484 aa, Desulfotalea psychrophila
MNASGNTGLILDEPLLWEKGSKGRMAFSMPENDVPAAELDPSLLGAGPDFPDLSEVDVVRHYTRLSQWNFGVDTGMYPLGSCTMKYNPKINERFAAMPEITSAHPMLEAEDCQGLLQLQYDLQEELARITGMDATTLQPAAGAQGEFTGMLAFACFHKSNGEKRSKILIPDTAHGTNPASASLCGFKPVSLKSNDTGVLDAAEVERLMDEDTAGIMLTIPNTLGIFERDIRKIADIVHAKGGLVYGDGANMNASMGMIDYKRCGVDIMHLNLHKTFSTPHGGGGPGAGAVCAVNRLLPFLPRPMVIKDGESYKLDFDRPQSLGRVHAFYGNYGVLVRTHSYIRSMGGNGLRLASQLAVLNANYIKAELRDTFHLGYETETLHECVFSDANQVEYGVTTLDMAKRLIDYGYHPPTIYFPLIVHGAIMIEPTETECKADIDLFIGAMKQVAQEAIDDADLLHSAPVNTKVGRLDETLAARKPCLRG

SEQ ID NO: 2832 - protein, 373 aa, Gibberella zeae
MGKSSKDKRDAYYRLAKEQGWRARSAFKLLQLDEEFDLFADVTRVVDLCAAPGSWSQVLSRVLIKGEKFGRAAWQDKEAKFRQQMLGILPKDGDDEQQTTEIQQNEEEPAKPREDVKIVSIDLQPISPLAGITTLRADITHPATVPLLLSALDSSYDPKAAGTQASHPVDLVLSDGAPDVTGLHDLDIYVQSQLLFAALNLALCVLKPGGKFVAKIFRGRNVDVLYAQLKIFFEKVIVAKPRSSRASSVEAFIVCINFQPPAGFRASLEEPLGVGGRLEEMLKEKGDVDMQDSMAKDEGVVEMEVYDEVPEDTERNSRWVAPFIACGDLSAFDSDASYQLPEDYVSLDPVQPPIAPPYKRAIEMRAAMSGSQR

SEQ ID NO: 2833 - protein, 450 aa, Desulfotalea psychrophila
MRYLPHTEEEIQEMLEVVGKESLDDLFSSVPAECRYQGDIPIPAALTEWQLKDHFAALMSKNRVNQEHKVLIGAGSYDHYVPEILPSLMSRSEFLTAYTPYQPEVAQGTLQGIFEYQTLTARLLGTDAVNASMYDGASALAESALMSFRIARKKKTVALSAAIHPHYREVVATYLQATDFTIIELPVDAEGRTDLSSLAGIEGLASVAIQSPNFFGVVEDLQGCGEKIHDVDALFISCFSEALAYGLLKSPGECGADIICGEGQSFGLGRSYGGPGVGMMGCRDKLVRNMPGRIVGQTLDTKGKRGFVLTLATREQHIRREKATSNICSNQGICAMTAGMYMATLGGTGIRQLARLNYDKAAYLRSELIKLGAKPLFDAPVFNEFALRFPFDFERVREALKEESVVAGLSLEAYYPDLQGAYLFCATETLKKEDIDRIVSSIKKHALQEV

SEQ ID NO: 2834 - protein, 225 aa, Oryza sativa
MLQCLEGVKQLCGVLLKCCDLDLKQPKGLEDPEILARETVFSVSEVEALYELFKKISSAVIDDGLINKEEFQLALFKTNKKESLFADRVFDLFDTKHNGILGFEEFARALSVFHPNAPLDEKIDFSFQLYDLKQQGFIERQEVKQMVVATLAESGMNLSDEVIESIIDKTFEEADTKHDGKIDKEEWRNLVLRHPSLLKNMTLQYLKDITTTFPSFVFHSQVDDT

SEQ ID NO: 2835 - protein, 358 aa, Mycobacterium leprae
MATLQVDAVVLVGGKGTRLRPLTLSAPKPMLPTAGLPFLTHLLSRIAAAGIEHVILSTSYRDAVFEAEFGDGSKLGLQIDYVIEESPLGTGGGIANVIDQLRHDTVMVFNGDVLSGVDLGQLLGFQRTNFADVTLHLVRVGDPRAFGCVSTEDGRVTAFLEKTQDPPTDQINAGCYVFERNVIDRIPRGREVSVEREVFPTLLSDADVKVCGYVDATYWRDMGTPEDFVRGSADLVRGIAPSPALGGHRGEHLVHDGAAVSPGAVLIGGTVVGRGAEIGPGVRLDGAVIFDGAKVEAGSVIERSILGFGVRIGPRALIRDGVIGDGADIGARCELLRGARVWPGVSIPDGGIRYSSDV

SEQ ID NO: 2836 - protein, 543 aa, Hordeum brevisubulatum
MGWGLGDPPADYGSIMAVGLIVALMCICIIVGHPLEENRWMNESTTALLLGLGAGTVILFASSGKNSRLMVFSEDLFFIYLLPPIIFNAGFQVRKKQFFRNFMTITLFAVVGTLISFSIISLGAMGLISRLNIGALELGDYLALGAIFSATDSVCTLQVLSQDETPFLYSLVFGEGVVNDATSVVLFNAIQTFDLGNFSSLKFLQFIGNFLYLFGASTFLGVASGLLSAYVIKKLYFGRHSTDREVAIMMLMAYLSYMLAELLDLSGILTVFFCGIVMSHYTWHNVTESSRVTTKHAFATLSFISETFLFLYVGMDALDIEKWKIVSETYSPMKSIALSSIILALVLVARAAFVFPLSYLSNLTKKTAGEKISIRQQVIIWWAGLMRGAVSIALAYNKFAKSGHTQLPSNAIMITSTIIIVLFSTIVFGLLTKPLIRLLIPARHLTREVSALSEPSSPKSFLEQLTVNGPETDVENGVSIRRPTSLRMLLASPTRSVHHYWRKFDNAFMRPVFGGRGFVPFVPGSPTESSVPLLAHGSENQNH

SEQ ID NO: 2837 - protein, 232 aa, Glycine max
FGSRSSSNLSNRKPSLKNITIPSITSGLATAMSQTTATTTTIATTMYNNNQVSSSSFSSDETNNTKDDKHYRGVRRRPWGKYAAEIRDPNRKGSRVWLGTFDTAIEAAKAYDKAAFKMRGSKAILNFPLEIGSDQSKEESSSSSSSVSSSSIVIKVGVKREREEESERKNNYEKSEFNNNSNSNKHVKKEECSPKAVCPLTPSCWKGFWDTDVMGTIFSVPPLSPLSPLMVV

SEQ ID NO: 2838 - protein, 244 aa, Gloeobacter violaceus
MYRPFLEHLQQKLQSSFDLQSLTIPAGLDYRISERGRESTTIRSWCYTCSELRKIRYTYIDGGEHAQVFNSVIYPAHRYDLPLLGIDLLAFGKKKNLIVLDFQPLFRDKAYLARYIEPMRILRERYGDVAQDVEMKFYDANQYFSKYLLFARTDAETVAGRVFTAYCDYLDLYWQLLASAAPLGDAQDIRRIVKAQKDYDQYSADRDPASGLFSSYFGHEWAERFLYEFLFEDAVPLAVGQPGR

SEQ ID NO: 2839 - protein, 656 aa, Burkholderia mallei
MCGITGFVGPVACAPQTARATLARMTDSLAHRGPDDTGLWIDHDAGVALGHRRLSIVDLSEHGHQPMLSACGRYAMTFNGEIYNFRQLRSELEREHRAPEWRGHSDSEVLLAAFCAWGVDRALQKAVGMFALALWNRESRVLTLARDRIGEKPLYYGRIGGSFVFGSELKALRRFPGFDAHPIDRDALCLYLRHASVPAPYTIYEGIRKLPPGTYAQLEDLAEAPAPRRYWSLERAIAAGRANPFDGDANAAVAQLDYVLRDAIAEQSVADVPLGAFLSGGVDSSVIVALMQTQTAQPVQTFTIGFHEAGYDEAGYAKAVARHLGTSHTELYVKPADVLATVPRMPCVYDEPFADSSQIPTLLVSELTRRHVKVSLSGDGGDELFGGYTRYFLTPRLWGRLRRVPAAVRMRIAAALHALRPDHADQIASLVQGAWSASAQRDASPRVGDRLHKLANVMTADSRASLYRLLMSSVHHPERFTLAGHEPQTLIDTPGAWPAGLSFAEQAMAVDTLTYLPTDILTKVDRAAMAVSLETRMPFLDHRVVEFAWRLPEALRIPDGQDKWLLRKLLYRYVPRPLIDRPKQGFCAPVGAWLRGELSDWAAELLRPARLRDEGYLDAARVERLWRQHQSGRMNWQHPLWTVLMFQAWLERQRAE

SEQ ID NO: 2840 - protein, 167 aa, Triticum aestivum
  misc_feature (129)..(129): Xaa can be any naturally occurring amino acid
  misc_feature (142)..(142): Xaa can be any naturally occurring amino acid
MENHQLPYTTQPPATGAAGGAPVPGVPGPPPVPHHHLLQQQQAQLQAFWAYQRQEAERASASDFKNHQLPLARIKKIMKADEDVRMISAEAPVLFAKACELFILEAHHSASWVARPRRTSRRTLARNDXAAAFARTDVFDFXVKFVPREEAQGGARQRSPRVCRPEG

SEQ ID NO: 2841 - protein, 139 aa, Brassica napus
  misc_feature (31)..(32): Xaa can be any naturally occurring amino acid
  misc_feature (136)..(136): Xaa can be any naturally occurring amino acid
VIGDAARPGQKWHIYYATEYPEQPMVNLEMXXTGLDTKKASVFFKTNADGNTTCAKEMTKLSGISEIIPEMEICDFDFEPCGYSMNAIHGSAFSTIHVTPEDGFSYASYEVMGLDATALSYGDLVKRVLGCFGPSXFSV

SEQ ID NO: 2842 - protein, 233 aa, Zea mays
  misc_feature (201)..(201): Xaa can be any naturally occurring amino acid
  misc_feature (210)..(210): Xaa can be any naturally occurring amino acid
MVDFVRRLASALLKCCDLDIPNRPKGLEDPERLARETVFNVNEIEALYELFKKISSAVVDDGLINKDEFQLALFKTNRKDSMFADRVFDLFDTKHNGILEFEEFARALSVFHPSAPIDDKIDFAFKLYDLKQQGFIEKQEVKQMVVATLAESGMNLSDDIIEGIIDKTFEEADTKHDGKIDKEEWRSLVLRHPSLVKNMTXLPYLRDITXTTFPSFVVNSSRGCVKSQRLRHH

SEQ ID NO: 2843 - protein, 277 aa, Aeropyrum pernix
MSEEGGVEVKLLKPRKPLPDVGEIVVGTVQEVHDYGAYLILDEYGGVRAFLPWSEIASRAVRNIHAVLKPRQKVVVKVIRVYKKRGQVDVSLKRVMDSEKKRKMMFYKRYLKAATLVELIAEKLGKSVDEAYREVLWKLEDAYGDPMKGLEAAVLQGREALEKAGVPEEWIEPLLETAKTHVRVKTVKITFYLTLRSMAGDGVERVRKVLEAAKSQIESFKDSKVVARIYTVGAPKYRVELQGYNYKTLEKALEKMVEAARKTASKLGVEFSFERED

SEQ ID NO: 2844 - protein, 282 aa, Beta vulgaris
MCESFKRQYQLCDEIGRGRFGVVFRCFSPSSHTSFAVKSIDKRLLLDDETDRECLDKEPKILQILSPHPNILQIHDIFDSDSHLLIVTDLCQESTLYDRVVSAGPFSETDACSVFTQLIDALAHCHRNYICHRDVKPDNILFDSRNRVKLCDFGSAEWFGGVEGRERMNGIVGTPYYVAPEVLAGREYNEKIDVWSAGVILYIMLGGVPPFYGDTVEDTFAAVLRGNLRFPTKIFRSISPEAKDLMRKMLSKDVSRRFSAEQVLRHPWVTSGGMTSTMNDMS

SEQ ID NO: 2845 - protein, 322 aa, Buchnera aphidicola
MNKIYEDNSFTIGNTPLVRLNNIGNGNILAKIESRNPSFSVKCRIGANMIWDAEKKGRLNKNIEIIEATSGNTGIALAYVAAARNYSLTLIMPDSMSIERRKLLKSLGAHLILTNGKHGMKGAISKANEIVSLNTKRYLLLKQFENPANPEIHQKTTGPEIWKDTKGNIDILISGVGTGGTITGITKYIKIKEGKKDLISVAVEPLESPVITQFLSGKKIKPGLHKIQGIGAGFIPKNLDLSLIDRIITVSSEEAIFNAKKIMKKEGILSGISSGAAIAAALKIQKENDFKNKNIVVILPSSGERYLSTELFSRSFKNENNY

SEQ ID NO: 2846 - protein, 358 aa, Oryza sativa
MSRLAAVYRLFTTDEEIHELTGERSVVKTKDAELELVIPPVFVRCNKVLDAGEQKEGERERERGRRGNNREVMSWHPDMWGHVGLPLTQRLRRIKLGSKPPKDLKHSTHSYKSTVIKLPYAGQPAAAGAGAPVPGVPGAGGPPAVPHHHLLQQQQAQLQAFWAYQRQEAERASASDFKNHQLPLARIKKIMKADEDVRMISAEAPVLFAKACELFILELTIRSWLHAEENKRRTLQRNDVAAAIARTDVFDFLVDIVPREEAKEEPGSALGFAAGGPAGAVGAAGPAAGLPYYYPPMGQPAPMMPAWHVPAWDPAWQQGAAPDVDQGAAGSFSEEGQQGFAGHGGAAASFPPAPPSSE

SEQ ID NO: 2847 - protein, 564 aa, Oryza sativa
MAIIACRNSIFALVILSGKWKGLSKLSAAPPSQPPKPVLQGAAIKPLVATIGTGVLIWLVPPPAGVARNAWQLLSIFLATIVGIITQPLPLGAVALLGLGAAVLTRTLTFAAAFSAFGDPIPWLIALAFFFARGFIKTGLGSRVAYAFVSAFGGSSLGLGYALVFAEALLAPAIPSVSARAGGIFLPLVKSLCEACGSRAGDGTERRLGSWLMLTCFQTSVISSAMFLTAMAANPLAANLTAGTIGQGIGWTLWAKAAIVPGLLSLVFVPLILYLIYPPEVKTSPDAPRLAKERLEKMGPMSKEEKIMAGTLFLTVGLWIFGGMLNVDAVSAAILGLSVLLISGVVTWKECLGEAVAWDTLTWFAALIAMAGYLNKYGLISWFSETVVKFVGGLGLSWQLSFGVLVLLYFYSHYFFASGAAHIGAMFTAFLSVSSALGTPPLIAAMVLSFLSNIMGGLTHYGIGSAPVFYGAGYVPLAQWWGYGFVISIVNIIIWLGAGGFWWKMLGLCAFTNLHLQIAELVVVLSQNTKFKFKMANFAQVLYLTFTGVTCLNMGSLCLTFSGV

SEQ ID NO: 2848 - protein, 556 aa, Helicobacter pylori
MSKIADDQNFNDEEENFAKLFKKELEKEETLEKGTIKEGLVVSINENDGYAMVSVGGKTEGRLALNEITDEKGQLLYQKNDPIIVHVSEKGEHPSVSYKKAISQQKIQAKIEELGENYENAIIEGKIVGKNKGGYIVESQGVEYFLSRSHSSLKNDANHIGKRVKACIIRVDKENHSINISRKRFFEVNDKRQLEVSKELLEATEPVLGVVRQITPFGIFVEAKGIEGLVHYSEISHKGPVNPEKYYKEGDEVYVKAIAYDAEKRRLSLSIKATIEDPWEEIQDKLKPGYAIKVVVSNIEHYGVFVDIGNDIEGFLHVSEISWDKNVSHPNNYLSVGQEIDVKIIDIDPKNRRLRVSLKQLTNRPFDVFESKHQVGDVLEGKVATLTDFGAFLNLGGVDGLLHNHDAFWDKDKKCKDHYKIGDVIKVKILKINKKDKKISLSAKHLVTSPTEEFAQKHKTDSVIQGKVVSIKDFGVFINADGIDVLIKNEDLNPLKKDEIKIGQEITCVVVAIEKSNNKVRASVHRLERKKEKEELQAFNTSDDKMTLGDILKEKL

SEQ ID NO: 2849 - protein, 955 aa, Bradyrhizobium japonicum
MMTAHRKSNGDTTNFARRHIGPSARDVAAMLETVGAKSVDALMAETLPASIRQAAPLDLGKPLSETEAIAHMGELAAQNQVFTSLIGQGYSGTILPAVIQRNILENPAWYTAYTPYQPEISQGRLEALFNFQTMICDLTGLDVANASLLDEATAAAEAMALAERHSRVEAKAFFVDKDVHPQTLAVMRTRAEPLGWNLIVGDPLTDLDKADVLGALLQYPGSSGALRDLRPAIAALKAKGALAIVAADLLALTLLASPGELGADIAIGSAQRFGVPMGYGGPHAAYMAVRDALKRSLPGRIVGLSVDSRGMPAYRLALQTREQHIRREKATSNICTAQVLLAVIAAMYAVYHGPEGLSQIARQVHRRAAVLAAGLRKLGFAPHSDSFFDTLSVDAGAKRAEIVARAAAEKINLGVGETALRIALDETTTPATVEAVWRAFGGQLAYAELDATTREALPEALKRTTAFLTHPVFHAHRSETEMLRYMRKLSDRDLALDRAMIPLGSCTMKLNATTEMMPLTWPEFGSLHPFAPREQAKGYHALFARLEKWLCDITGYDAISLQPNSGAQGEYAGLLAIRGYHAARGEAHRKICLIPSSAHGTNPASAAMVGMDVVVVACEKNGDVDVNDLRAKADKHANDLAAIMITYPSTHGVFEEHIREICDIVHGHGGQVYLDGANLNAQVGLSRPGDYGADVSHLNLHKTFCIPHGGGGPGMGPIGVKAHLAPFLPGHPATRGDAPVGPVSAAPFGSASILTISYIYILMMGGEGLKRATEIAILNANYIAARLDAHFPVLYKNARGRVAHECIVDPRALKTTSGVTVDDIAKRLIDYGFHAPTMSFPVPGTLMIEPTESESKAELDRFCDAMIAIRKEIGEVEAGRFKIEASPLRHAPHTVHDIADDAWARAYSRAEGCFPDGVSRTDKYWSPVGRVDNVYGDRNLVCSCPPVSDYAEAAE

SEQ ID NO: 2850 - protein, 310 aa, Hyphomonas neptunium
MRNSTLPEHWTAAYIPDQRGRFAVITGTGGLGFEGAVALARSGASVVLAGRNAHKGADAVAAIRQAAPASDIRYERLDLACLASVADFAARLRGQMDRLDLLINNAAVMNPPARQETEDGFELQLGTNYLGHFALTGHLLPLLRKGANARVISVSSIAARNGLINLEDLQAEQSYRPGSAYAQSKLACLMFALELHRRSQLGGWGVASIAAHPGVSRTELLHNAPGRGSPASLARSLLWFLFQPADQGALPTLFAATWPEAKSGAYYGPHGLSETRGFPAAAQIPPQALDAALSARLWEVSENLTGVTLR

SEQ ID NO: 2851 - protein, 408 aa, Oryza sativa
MAVQVQRTPLPRSTYTGHRGYLLRAPPAVTRCTVDRAFPRSHGPPLPRLLYKTSRPDASSSNSTSRHFPRRSKDCCCFAVRSIPDGIMGETIAKDVTELIGNTPLVYLNRVTDGCVGRVAAKLESMEPCSSVKDRIGYSMITDAEEKGLITPGKSVLIEPTSGNTGIGLAFMAAAKGYRLVLTMPASMSMERRIILKAFGAELILTDPLLGMKGAVQKAEELAAKTNNSFILQQFENPANPKIHYETTGPEIWKGTGGKVDGLVSGIGTGGTITGAGRYLREQNPDIKIYGVEPVESAVLSGGKPGPHKIQGIGAGFVPGVLDVDLINETVQVSSDEAIEMAKALALKEGLLVGISSGAAAAAAVRLAQRPENEGKLFVVVFPSFGERYLSSVLFQSIKKEAENMVVE

SEQ ID NO: 2852 - protein, 100 aa, Mycoplasma gallisepticum
MKHITNKAELDQLLTTNKKVVVDFYANWCGPCKILGPIFEEVAQDKKDWTFVKVDVDQANEISSEYEIRSIPTIIFFQDGKMADKIIGFIPKNELKELLK

SEQ ID NO: 2853 - protein, 112 aa, Photorhabdus luminescens
MKLITTIIKPFKLEDIREVLSGLGVQGLTITEVKGFGRQRGHAELYRGAEYSVNFLPKIKIDIAVADELVEEVIHAIQQSAFTGKVGDGKIFVIELQQAIRIRTGETNDAAL

SEQ ID NO: 2854 - protein, 296 aa, Streptomyces avermitilis
MTSEITLFVNPTAGRGRGAHAAQPAASALRAAGFSVRTILGENAEDALARAREAVAGGTGALVAVGGDGMAHLALQAVGGTRTPLGLVAVGTGNDFARALGLPVRDPAAAGRVIAEALKGARLRDVDLGRVDGTWFGTVLASGFDSRVNDRGNRMRWPTGRFKYDLAMLAELAAFTPVPYRMTLDDGAVREIEATLVAVGNGSSYGGGMKICADADLDDGLFDITVVGDCSRTTLLKVFPKVYKGTHLDHPKVTVHRAAKVELVAQGITGYADGEPLGPLPLTAECIPGAARVAVP

SEQ ID NO: 2855 - protein, 215 aa, Photorhabdus luminescens
MPTSANKSLSIDPHSALPGRTEPLKVSPNHAVTDHTIEPVPENMEVAYFGMGCFWGVERLFWQQPDIYTTSAGYSGGTTANPTYEEICSGLTGHAEVVRIVYDPAKNSYENLLKLFWENHDPAQGMRQGGDIGSQYRSAIYTVSPQQHELALASREHFQKAMQQQSDNRPITTEITEAGPFYFAEDYHQQYLFKNPEGYCGLGGIGVCLPKMNEN

SEQ ID NO: 2856 - protein, 212 aa, Glycine max
MTTMEIKLWNDKREREMYDNFGELYAIIKATERLEKAYVRDIISPQEYELECQKLIAHFKTLASTLKDTVPTIERLADAYGMDCPASINRLVVSRVPATVEHRATAAASASTSAATVAECVQNFITSMDSLKLNMVAVDQVHPLLSDLYASLNKLTILPPDFEGKTKMKEWIARLSKMGAADELTEQQARQLHFDLESSYNSFMAALPNAGT

SEQ ID NO: 2857 - protein, 559 aa, Zea mays
MMSPASERSLIIQSDDDDDARSGHDVEEPEPEQEQDSDSSSSSSSCATPRRGPSSPPYIQQWPQSYRQSIDILSSVQSPNLTFLGTPTLSRLSNSFLAITDSFRSKAPETISSFIKPLLGPTPSDDQQRQHEGTRKSSEYLVPSRRSSLQQIPEDQKPPVGGHGASHDQNCSYTQGVMNGINVLCGVGILSTPYAIKQGGWIGLAILCIFALLAWYTGVLLRHCLDSKEGLKTYPDIGHAAFGSTGRIVISIILYVELYACCIEYLILEGDNLSKLFPNAHLTIGSMTLNSHVFFAILTTIIVMPTTWLRDLSWLSYISAGGVIASILVVICLFLVGVVNDVGFENEGTALNAPGIPIAIGLYGYCYSGHGFFPNIYSSLKNRNQFPSILFTCIGLSTFLYAGAAVMGYKMFGEATESQFTLNLPDNSVISKIAVWTTVANPITKYALTIIPLAMSLEELLPPNQQKYFTIIMLRSSLVISTLLIALFVPFFGLVMALVGSLFAMLVTYILPCACFLAILKTKVGWHQIAACSFIIVVGVCCAYVGTYSSLSKIIQNYA

SEQ ID NO: 2858 - protein, 145 aa, Unknown
  Shewanella sp. MR-7
MNWLKKIFSKHTSVPDDRDPNQSNAYDLIGGDKVIRAIAHSFYQKMASSEETQALFAIHRAPIAESEQKLYEFLSGWLGGPQLYQQKYGHPALRARHMPFAVDETMRDQWLFCMKFAIEEHIKKPEHRAAIYEAISTLADHMRNQ

SEQ ID NO: 2859 - protein, 344 aa, Glycine max
  misc_feature (87)..(87): Xaa can be any naturally occurring amino acid
  misc_feature (108)..(108): Xaa can be any naturally occurring amino acid
  misc_feature (125)..(125): Xaa can be any naturally occurring amino acid
  misc_feature (141)..(141): Xaa can be any naturally occurring amino acid
  misc_feature (148)..(148): Xaa can be any naturally occurring amino acid
  misc_feature (176)..(176): Xaa can be any naturally occurring amino acid
MGEAPEVFYINGFSKFEHEIETQQNHHVNDQNHDSSWYEEIIDEDLKWSFKLNSVLHKAISEYQDIALLDTKRFGKGWMLDAMMPSXNLLTLLLMIFDILPFIYILFXNHKTIVLDGINFLNLKXKFKLQNFKMKYISLLXIIKGFIXALKINNYLLPQGQINYLNSPMTFLIFEXAELEKRKEKFDIIVGDLADPLEDGPCYQLYTKSFYEKILKPKLNDNGIFVTQAGPAGIFTHKEVFTSIYNTIKQVFKYVIAYTTHVPSFADTWGWVMASDQPLSICADEMDRRIEARIDGELLYLNGAWFHSSTTMNKTVYQSLQNETHVYTEESARFIPGHGMAFHL

SEQ ID NO: 2860 - protein, 73 aa, Chlamydophila caviae
MAKKEDTIVLEGRVQELLPGMHFKILLENGMPVTAHLCGKMRMSNIRLLVGDRVTVEMSAYDLTKARVVYRHR

SEQ ID NO: 2861 - protein, 112 aa, Roseovarius nubinhibens
MKLIIATIKPFKLDEVREALTGVGVTGMSVTEIKGFGNQSGHTEIYRGAEYSVNYVPKIRLEIAVSDALADEVIQTIAKTARTGKIGDGKIFALDLQQAMRVRTGDLNDDAL

SEQ ID NO: 2862 - protein, 221 aa, Medicago truncatula
MGHYDTLKSSPPENQVMKRASLIGILTTTMFYMLCGCLGYAAFGNDAPGNFLTGFGFYEPFWLIDLANIFIAVHLIGAYQVFCQPIFGFVESKSKEKWSNSQFVNGEHAVNIPLCGTLHVNFFRVVWRTAYVVITALIAMIFPFFNDFLGLIGSLSFWPLTVYFPIEMYIKQSKMQRFSFTWTWMKILSWACLIVSIISAAGSIQGLAHDLKKYQPFKAQQ

SEQ ID NO: 2863 - protein, 473 aa, Arabidopsis thaliana
MSSSVPNSDRKIVTGPAGYILEDVPHFSDDFPDHPTYPNPLQDNAAYSVVKQYFVDEDDTVPQKIVVHPDSPRGTHFRRAGPRQRVYFESDDVLACIVTCGGLCPGLNTVIREIVCGLSYMYGVKRILGIDGGYRGFYARNTIHLDLKTVNDIHRSGGTILGTSRGGHNTTKIVDSIQDRGINQVYIIGGDGSQKGAAAIFEEIRKRKLKVAVAGIPKTIDNDIPIIDRSFGFDTAVEEAQRAINAAHVEATSFENGIGLVKLMGRYSGFIAMHATLASRDVDCCLIPESPFFLEGSGGLFEFIDKRLKESGHMVIVIAEGAGQDLLSESMKESTTLKDASGNKLLQDIGLWISQRIKDHFAKKMTLTLKYIDPTYMIRAVPSNASDNVCCTLLAQSAVHGVMAGYNGFTVGLVNGRHTYIPFNRITEKQNKVVITDRMWARLLSSTNQPSFMKQADKIHSNQLVGEPGTMKW

SEQ ID NO: 2864 - protein, 275 aa, Medicago truncatula
MSRDQFQKNSMYIETPEAFTDGSKNFDDDGRAKRTGTWVTASAHIITAVIGSGVLSLAWAIAQMGWIAGPAVLLAFSFITYFTSTLLADSYRSPDPVHGKRNYTYSEVVRSVLGGRKFQLCGLAQYINLIGVTIGYTITASISMVAVKRSNCYHKQGHDAKCYISNNPFMIIFACIQIVLSQIPNFHKLSWLSIVAAVMSFAYSSIGLGLSIAKVAGRGPAVRTSLTGVQVGVDVTGTEKVWRMFQAIGDIAFAYAYSNVLIEIQASPMLNIYCS

SEQ ID NO: 2865 - protein, 209 aa, Arabidopsis thaliana
MEVKLWNDKREREMYENFAELFAIIKATEKLEKAYIRDLINPSEYESECQKLIVHFKTLSATLKDTVPNIERFADTYKMDCPAALYRLVTSGLPATVEHRATVAASTSNSASIVAECVQNFITSMDSLKLNMVAVDQVYPLLSDLSASLNKLSILPPDFEGKTKMKEWLSRLSKMGAADELTEQQSRQLHFDLESSYNSFMAALPKAGN

SEQ ID NO: 2866 - protein, 463 aa, Crocosphaera watsonii
MQTKRVRDILRHGQPDETVTIQGWVRTKRELKDFSFMEVNDGSSLNSLQVVLDESVPDYQDVLKLLNTGSSVEVSGTLVQSLGKGQKIELKAATVQVYGTSDPETYPLQKKRHSFEFLRTIGHLRSRTNTIGAVMRVRNACATAIHNFFQERDFMWVHTPIITASDCEGAGELFTVTNFDLSKIPVDKQEKIDYSQDFFGKQAYLTVSGQLEAEVMAMSFQNVYTFGPTFRAENSNTSRHLAEFWMVEPEMAFCDIEGDQDLAEEFLKYIFKYVLETCPEDMEFFNKRIDKSVLETADNIINNEFERITYTKAIELLEKCNKKFEYAVEWGIDLQSEHERYLAEELFKKPLIVTNYPAAIKAFYMRLNDNEKTVAAMDVLAPKIGEIIGGSQREERLDVLERRINEMEIIPDDLWWYLDLRKYGTVPHAGFGLGFERVVQFMTGMGNIRDVIPFPRTPLSAEF

SEQ ID NO: 2867 - protein, 236 aa, Unknown
  Saccharum hybrid cultivar SP-80-3280
MTRRYWNINLKEMIEAGVHFGHGIKKWNPKMAPYISAKRKGTHITNLARTARFLSEACDLVFDAASQGKSFLIVGTKKRAADLVASAAIRSRCHYVNKKWFSGMLTNWSITKTRLSQFRDLRAEEKMGKFHHLPKRDAAILKRKLSTLQRYLGGIKYMTRLPDIVIVLDQQKEYIALRECAILGIPTISLVDTNCDPDLANISIPANDDTMTSIRLILNKLVFAISEGRSLYIRNR

SEQ ID NO: 2868 - protein, 530 aa, Xanthomonas campestris
MLDANLKTQLTAYLERVTRPIQINASIDDSAGSREMLDLLEELVLLSDKISLDIHRDDNQRKPSFALTTPGQDISLRFAGLPMGHEFTSLVLALLQVGGHPSKAAAELIEQVQHLEGDYQFETYFSLSCQNCPDVVQALNLAAVLNPRIKHVAIDGAWFQDEVQARQIMSVPTVYLNGELFDQGRMTLEQIVAKLDTNAAKRDAAKIAAKEAFDVLVVGGGPAGSAAAVYAARKGIRTGVAAERFGGQVLDTMSIENFISVPETEGPKMAAALEQHVRQYDVDIMNLQRAEQLIPAGADGLIEIKLANGASLKSKTVILSTGARWRQMNVPGEDQYKNKGVAYCPHCDGPLFKGKRVAVIGGGNSGVEAAIDLAGIVAHVTLVEFDDKLRADEVLQRKLRSLHNVRIITSAQTTEVLGDGQKVTGLVYKDRTGGDIQHIELEGVFVQIGLLPNTEFLRGTVALSPRGEIIVDDRGQTDVPGVFAAGDATTVPYKQIVIAMGEGSKAALSAFDHLIRTSAPATADSVAQAA

SEQ ID NO: 2869 - protein, 380 aa, Brassica oleracea
MESGSNSTSCPMAFAGDNSDGPMCPMMMMMMPVITSHQQHHGHDQQHQHQQQHDGYAYQSHHQHSSLLFLQSLTPPSQEAKNKVRSSCSPSSGAPAYSFMEINHQNELLAGGLNPCSSASVKAKIMGHPHYHRLLLAYVNCQKVGAPPEVQARLEETCSSAAAAAASMGPTGSLGEDPGLDQFMEAYCEMLVKYEQELSKPFKEAMVFLQHVECQFKSLSLSSPSPFSGYGEAAIERNNNGSSEEEVDMNNEFVDPQAEDRELKGQLLRKYSGYLGSLKQEFMKKRKKGKLPKEARQQLLDWWSRHYKWPYPSQKLALAESTGLDQKQINNWFINQRKRHWKPSEDMQFVVMDATHPHHYFMDNVMGNPFPIDHISSTML

SEQ ID NO: 2870 - protein, 445 aa, Desulfitobacterium hafniense
MKIALIQPKMNKRPMDTDLKTRMSPPLSLLTLMGLTPEGHEVIMVNENVEKIDYACGAELVGITITLDVMPRAVEIAEEFHRLGIPVVAGGIHVTSSPDECRGYFDAICIGAAERVWERMIEDAEESRLQQVYHDMTDFRGEEIASPAYHRIDKNRYLYTNIMTTSRGCPNRCGFCYNSCRNRMYIRRPVTDVLRDIEGLGTRHILFIDDNFIGVPAYTRELLNHLRGRELKWSAAVTTKIADYPDVLDLMAETGCQSLFIGFESINNSSLHGVNKDNQFEKYERIVTAIHSRGIMINASMVFGLDGDEPDVFQRTLDWLVKNKIETLTSHILTPYPGTELHGRMKEEGRILDHELSRYNTAHVVFQPKGMTAEELYKGYLWIYREFYSFPNIWRRRPEHKAQRKSFFLFNILYRKFGGLTSVLARIIPMRTVGRLAARISYRVK

SEQ ID NO: 2871 - protein, 417 aa, Idiomarina baltica
MSQDLAQQIAKRAADAAHAVATLSEQEKNAVLQKMANAIRAHKDEILKVNETDMKTGKEKGLSDAMMDRLHLTEERVEGMATAIEEIIDLKDPVGDSYLLEERPNGLKIEKMRIPLGVICMIYEARPNVTADAGALCFKSGNAVILRCGREAIESSKAIADALHEALEQSGLPKDVITVVPTPDREVMTELLQQKDYIDLVIPRGGEGLIHFVSDTSKIPVIQHYKGVCHLYVDKDADLDKALAILLNGKTQRTGVCNALEGLLVHQDIADKFLPMAAKALAEKDVTIHACNKSVGYFDGADEISVDDFGQEYLALEIAVRTVDDFDGALEHIKRFGSGHTEVIVTENDQTAKRFIREVDSAVTMANASSRFSDGGQLGLGAEIGISTSKLHAYGPMGLQALTTEKFVVTGNGQIRD

SEQ ID NO: 2872 - protein, 173 aa, Brassica napus
RVQVVDVGTVDTATYPIPKTKLTLERLREFPHLRSRTNSISAIARIRHALAIATHTFFDEEGFLYIQTPIITTSDCEGAGEMFQVTTLISHTEKLERDLIENPPPTEADVEAARLIVKARGEAVAQLKSAKASKETITASVAELNEAKASLSRTEERSRLKPGLPKLDGKIDY

SEQ ID NO: 2873 - protein, 965 aa, Unknown
  Nostoc sp. PCC 7120
MNHYVPCTVLLIDKCSEERANMTRHLQQDSLYNYQIIEFSIAKEALNWCLEKTPEIILLDFASVNENASIFLEKLRSRLSNSQFTVILLIKPGDEDLAVRAMKSGAQDYLIKNQITPEILQRVIRHGMEKMYLMQQLAQTKAALQQSEHRYATLAEVVPVAIFRLDADGNCIYVNDRWSQITGEPIQAALGRGCLDTIHPEDSDRLFHQWTEVLTQEKMYCYEGKFLRKDGTTIWFYMQILPETDQNVTTIGYVGTLTDISEQQAALDDGLRPTIGDLIEAEAKLRKISERLTLAISSGRFGIWEFDCVQEKVIWDERMYELYGVHPEDFPGNFDAWLSFVHPDDQDYLLVTIQQVLHQNQEYDAEFQIIQPSGEIRVIKAYGVLNCDEQGKPILMVGINIDITERKQAEQELIHNRDLREVIFNESADALFLVDPVTLLTLDCNRRTVELFEATNKGELLGIEGRTLQRRPFTSNEIDTIVTQMQTKGFWSQEIEYVTLKGKLFWGNIAAKPITIAGRTLNLVRVTDINERKQAEEKLLRTNEQLAKANAELARATRLKDEFLANMSHELRTPLNAILGMSEGFIEGVFGAINQKQAKAIATIKRSGKHLLELINDILDLSKIESGKLELQISDVSVRSICDGSLTFIQQMALKKNICLSTHIGSNLDTIQVDDRRLRQVLINLLSNAVKFTPEGGNVKLTVWLEEVGTNETLGAEKLISQSSIPSPHICFRVTDTGIGIASEDISKLFQPFTQLDSSLNRNYTGTGLGLALVKRITTLHGGTILVNSEVGQGSCFTVRIPYLSGDNSLKKLQDPERVDLPATLIPKTLTIPVILLAEDNQANIDTISSYLESRGYEMVLAENGQQALDFAREKCPDLIIMDIQMPGMNGLEAIRQIRNEQKFIDIPIIALTALAMPSDRTTCLAAGANEYLTKPIKLKQLVLTIQQLLKNHQELHTSKYRKSD

SEQ ID NO: 2874 - protein, 781 aa, Thiobacillus denitrificans
MSPEGTSTTLRARLRRTSLITLAVALGIVAVIIMASSFAAGLISLASTNRVEARVLAENVSASLLFEDRTSAEELLHSLRHSRVVHGAAVYDNARRVFARYEHGSDRVPAILGPLSEGVDYGLRRVTVVQPVMLDGRQVGSVLLSVGLESLYAQIGWQALVTLLAAALAMLVANRLLGRLNESVVVPLARLSALMLRISSRNDYTVRAAGSEIAEMNTLARGFNDMLGQIQQRDQELAEHRARLEDQVAHRTVALKAAEAASQAKSDFLATMSHEIRTPMNGVLGMNELLLGSSLDPQQRMWAESVQHSGQHLLGVINDILDFSKIESGHLSLETVDFDLVELIDDTMRMFAHQAEHKGLELACRITPSQRTIGLRGDPFRLRQIVANLVGNAIKFTEHGAVVVHATVNDNGDAAAVGLCVEDTGIGIAPEAQARIFEHFSQADGSTTRRFGGTGLGLAICRRLANLMGSDITVASAPGQGARFCLDLRLARASADFERPDPAGEASGAGTSAPAFQGRGERVLLVEDNPVNQQVAQAMLAKLGLATTVASDGREAVDLVASRAFDAVLMDCQMPVMDGYEATRAIRRLPGARLPVIALTANALHGDRQKCLDSGMDDFLPKPYSLAQLQATLARWLRPTNPTPEAQAAAPQHGPDGEIASPQAPAINMKTLNALRELDPEGGMGLAHQIVRTFLESAQTWVDRVEQAVAGGDGDALRQSAHALKSSSANVGAERLSGLYRQMEKLGRERRLDEAREALGEVRGEYARAVSEMHAILTGGR

SEQ ID NO: 2875 - protein, 467 aa, Bacillus licheniformis
MCNTIGVIGLGVMGSNIALNMASKGEQVAVYNYTRDLTDQLVQKTGGQTVKPYYELEDFVQSLEKPRKIFLMVTAGKPVDSVIDSLVPLLEEGDVIMDGGNSHYEDTERRYDSLKVKGIGYLGIGISGGEIGALKGPSIMPGGDRDVYEKAAPILTKIAAQVDGDPCCVYIGPKGAGHFVKMVHNGIEYADMQLIAEAYTFLREKLLLPIDEIADIFDTWNQGELNSYLIEITAEILRKKDEKTGAPLIDVILDKTGQKGTGKWTSLQAVDNGIPSSIITESLFARYLSSLKDERTAAEKVLAGPATEERRLDQNVWIDRVRQALYMGKICAYAQGFAQYKMTSDLNGWNLPLKDIALIFRGGCIIRAQFLNLISEAFDKQPDLSNLLVAPDFAEKLKEYQSGLRKVVCEGISSGISFPCLSTALSYYDGYRTGRSNANLLQAQRDYFGAHTYERTDMEGVFHTDWY

SEQ ID NO: 2876 - protein, 140 aa, Solanum lycopersicum
MAPKAEKKPAEKKPAEEKKAEKTPKAGKKLPKESGSSGADKKKKKSKKSIETYKIYIFKVLKQVHPDIGISSKSMGIMNSFINDIFEKLAQESSRLARINKKPTITSREIQTAVRLVLPGELAKHAVSEGTKAVTKFTSS

SEQ ID NO: 2877 - protein, 591 aa, Prochlorococcus marinus
MSVANKDTTVTTTSTAPRLSLQCAAIASDTTTIRALDWDRSRFDIEFGLRNGTTYNSFLVRGAQTALIDTNHLKFEDTWLPMLKEQIDPKAIDYLIISHTEPDHSGLVGQIIDLNPEIEIVASKVAIKFLEDQVHRPFRSREVKSGEELDLGTNPTSGIAHRFEFLSAPNLHWPDTIFSFDHATGILYTCDAFGLHYCSDELFDQDPSALAPDFRFYYDCLMGPNARSVVQALKRMDQLPEITTIAVGHGPLLRHHLKLWVDDYRDWSSQRSEGESYAAICYLSYYGFCDRLSQAIAHGIGKAKGEVQLVDLRATDAQELSALIGEAKAVVVPTWPSQPDAELQSSIGTLLAALNQKQWVAVYDAYGGNDEPIDAVAAQLRSLGQKEAFEPLRVRQAPDGNLYQRFEEAGTDLGQLLNQKQNIAAMKSLDTELDKAMGTLSGGLYVVTASQDEESGQRRGAMIASWVSQASFTPPGLTVAVAKDRAIETLMQVGDRFVINVLREDNYQPLLRQFLKRFPPGADRFEGVNVLNNVAKGGPVLVDALAFLDCLVKQRLETPDHWIIYALVEQGNVADAEAKTAVHHRKVGNHY

SEQ ID NO: 2878 - protein, 1432 aa, Unknown
  Shewanella sp. ANA-3
MIELKIDNHSVTAEPNDNLLQAARKAGIAIPSLCDPTDATRQLGTAPNADKQDCNLCLVQIENTDASLRCVKACETPAEAGLKVITQSAYLTKQRQAALSTILSDHFADCEAPCQQACPAGVDVQSYLYHIAQGDHTQAIKVIKDTLPLPLSIGRVCPAFCESECRRGLVDDPIAIRQLKRHAADLDLADDEQGNSYQPPRLADTGKKIAIIGAGPAGLSAGYYLSNQGHNVEIFEAMPKAGGWLRYGIPEYRLPKAILDKEIELLCRNGLTIHTDTRLGHEIHLAQLVADFDVVCLAIGAQKAVPMNYKGSALAGCYLGVDFLKDHCLDKQLKLGKKVAVIGGGNTAIDCARTAVREGCDVTLIYRRTRAEMPAEAYEVHEAEVEGVKFHFLTNPIENHSDDNGRVQSVTFSKMTLGEADTSGRRAPVDTGETFTEAFDTVIAAVSQAPDLSFMQDPMGQLSQGELALSRWNTLIGCEQTMSSGVEKLFVMGDARRGPATAVAAIGDGRKAAIAIDKMLKIGLSCDLHAHAFNSVKTIPSALIPSALKQTETSSKAGSTLYPHTPRQLRLKMPELTALQRLLNYSEVELGFPADAAMQEAARCLECACQANTDCKLRDYATDYGVEAKSLATENARHFSVDKSAPFIQFDANRCISCGKCVDVCQQQSGHCAIQFSQDSYQALPQEMTQHMERRAPRVGFSASMADSHCVQCGNCVQVCPTGALVDARDKRQGDCTELKTASTICTYCGVGCRLDLKIDPNANRIRHIEGNKDSVVNQGMLCVKGRFGFDFIHSDKRLTTPLIRKNGELQPSSWPEAIAYVAKRLTEIKQKDGSNALASLASAKATNEDNFVLQKFVRSVLGTNNIDHCARLCHSSTVTGLQQSIGSGAMTNDIPSIKDSDVIFILGSDTTCAHPIIASKIQQAVMQHGARLLVADPKRVGIAEKAELYVAHRPGTDVMLLNAIMAEIIRHDWQDKAYIAERTEGIEALYAELAKDDYSLENAALITGVKAEDIARLARTIGTAEKTAVYYAMGITQHTTGHDNVTAISNLQLLCGNIGVSGAGINPLRGQSNVQGACDMGALPNYFTGYQKVTDLHARMRFENHWQTRLSGEIGVTATHMMHDIAKGKIKALYVMGENPVLSDPDQAHVLNALSQIEFLVVQDIFLTETAELAHVVLPAAAFVEKRGHFTNTERRVQRLEQALASPGEALPDWQIVQAVANAMGANWDYTNEEAIWREINELTPQYRGIRWDRLSANAEGQISQGIQWPCPDETHPGTPIMHQSQFTRGLGLFTPVSYRLPAEMPCNEYPLTLSTGRLLEQFHTGTLTRKTPGLDLLGAPKVMISVYDAEQLGINNGDKLRLTTRRGEIEIDAFVTKRAQAGVLFLPFHFVEAAANKLTINALDPVAYIPEYKVCAVRAEKVTARVSEPA

SEQ ID NO: 2879 - protein, 447 aa, Vibrio vulnificus
MTKRKKRAAINLTRLPIEYIDWLSRPIYRFIHIESAAGIVLFISTLLAVLLANSHLSEEFARFWQISLGMTVGDLVFERSLHKWVNDAGMTLFFFLIALELKRELVLGELRNPQLALLSIAAALGGMSTPPLFYLLLQYGESGQHGWGTVMATDTAFVIGCLALLGRSIPSSLRIFMLSMAVVDDIGAIFVVAIGYGEAVDWLVLSYALLGFMLVRAMAFLGVRSLVLFSIVGGAIWLVIDMSGVHPTITGVILGLLTPTNKWMSRQHLFIIMEALVPSSPSQQWSGDKREGEILKTAAAAARETLSPVERLEMLLHPWVGFVVLPLFALANAGVSLTSVNLTSPITLAVFVGFVFGKPIGIVLFSWIAVWLGIAKLPENLNWGMVFGGGMLAGIGFTMALFISELAYNPDQINAAKLGIFIASITSALIGFLCLRYFAAREKQKRT

SEQ ID NO: 2880 - protein, 159 aa, Unknown
  Synechococcus sp. RS9916
MAPSVNGVTVRSADGSDKSLGDFAGNVLLIVNVASRCGFTKQYAGLEAINQSYGAKGLKVLGFPCNDFGAQEPGTLEEIKTFCSTTYGASFELFDKVHATGTTTEPYTTLNQMEPAGDVAWNFEKFLVGKDGTVIARFKSGVDPESAELKSAIEAALAA

SEQ ID NO: 2881 - protein, 923 aa, Xanthomonas campestris
MRAHAKHNVTRALRAGYAVRACTGLFWLCSAWPIIAAPHAASDASRERISLDAQWRFHRGDPPANQEILDYDVRPQVVRSSDGRVADAQPEQAQLIDAPAVRVLKPWILPTANGLIADPAQRHIRPPGNPGSTVAYVQPHFDDSAWETVDLPHDWAIAGPFLADGPYGGMGRLPSWGIGWYRKSLDIPASDRGRAMFLDLDGAMSYATVWLNGKLVGGWPYGYSSWRVDLTPYAIAGKRNQLVIRLDNPPESARWYPGGGLYRNVWLTKAAPLHIAHWGTQLTTPYVSADAAQVQLTVTLDNAARSATQAQVRTAIYLLDDASDRPSGEAVARIPAQPISVPAGGTAQVQGSTRIDAPRLWGPPPTQHPHRYVAVTEVDQQGRVVDRYETRFGIRSIVFDADKGLLVNGEHVPIRGVNNHHDLGALGAAFNRRAAERQLQLLQQMGANAIRMSHNPPAPELLDLTDRMGLLVVDEVFDSWEMKKTPLDFHLVFPQWHAADLRAMLRRDRNHPSVMLWSVGNEVGEQYTGQQGAAIARTLRAIVHAEDPTRPATVAMNYASPEMPLPAALDVVSLNYQGEGIRDAAEFEGTERIRKPPQYPAFHARFPHKAIVSSETASALSSRGVYLFPVTADNSAPVRDGRGGDSVAHQVSAYELHAVDFGSSADKVFAALDQHPYVAGEFVWTGFDYLGEPTPYYSSRSSYSGIFDLAGFPKDRYWLYQSRWRPELPVAHLLPHWSWPGREGQVTPVHVFTSGDEAELFVNGVSQGRKRKAPRQYRLRWDAVVYQPGELRVQAYKDGKPWASERVQTAGRAARMQLTPDRCSIRGDGQDLSFITVRLLDRDGRPAPTAGDRLRFRIEGPGELVATDNGDPTNLETFAASQRHAFNGLCLAIVRAKAGARGTITVHVESDTLQAAQTQVAVQ

SEQ ID NO: 2882 - protein, 509 aa, Bacillus licheniformis
MVLEANIKAQLNQYMQMIENDIVLKVSAGDDSVSKDMLALVEELASMSSKITVEKAQLDRTPSFSVNRAEEDTGVTFAGVPLGHEFTSLVLALLQVSGRPPKVDQKIIDQIKNISGEYRFESYISLTCHNCPDVVQALNMMSVLNPNISHTMIDGAAYKSEVESKNIMAVPTVYLNGESFGSGRMTLEEILAKMGSGTDASELSDKEPFDVLVVGGGPAGASAAIYAARKGIRTGIVAERFGGQVLDTMSIENFISVKRTEGPKLAASLEEHVKDYDIDVMNLQRAKGLEKKDLFHLELENGAVLKSKTVILSTGARWRNIGVPGEQEFKNKGVAYCPHCDGPLFEGKDVAVIGGGNSGIEAAIDLAGIVNHVTVLEFAPELKADKVLQKRLYSLPNVTVVKNAQTKEITGDENVNGITYVDRETGEEKHVELQGVFVQIGLVPNTEWLPETVERNRIGEIAVDKRGETTIPGLFAAGDCTDSPYNQIIISMGSGANAALGAFDYLIRN

SEQ ID NO: 2883 - protein, 102 aa, Arabidopsis thaliana
  misc_feature (12)..(12): Xaa can be any naturally occurring amino acid
  misc_feature (32)..(32): Xaa can be any naturally occurring amino acid
  misc_feature (38)..(38): Xaa can be any naturally occurring amino acid
  misc_feature (44)..(44): Xaa can be any naturally occurring amino acid
  misc_feature (47)..(47): Xaa can be any naturally occurring amino acid
  misc_feature (49)..(49): Xaa can be any naturally occurring amino acid
  misc_feature (61)..(63): Xaa can be any naturally occurring amino acid
  misc_feature (65)..(66): Xaa can be any naturally occurring amino acid
WLSSMLSSAAGXTSPAQATMVAPFTGLKSSAXFPVTRXTTKALXTPXAXNGGRVSCMKGVXXXIXXKKFETLSYLPGPAGQASRPFLQQGGFLGSGYLFTLF

SEQ ID NO: 2884 - protein, 461 aa, Lactobacillus plantarum
MMKKVSAEDTVKTSVKEDQTSFGFDNSLPNLPIKTILAMTFGCIGVNMAFTLQGSQMSRITQTIGVNPNSLGWFFLLPPLLGMFVQPLLGKYSDSTWTRWGRRIPYLLVGAPITVIVMIMLPFTGSFGFGYGSMTAMVYAAIAIALMDLFSNVCLAPYKMLAGDMVNEKQKNLAWSWQQVFGYAGGILAALLPYILTKVGIANTASKGQVPATVIWAYLIGAVMLLVTSLVTIFNVHEYDPKTYAKYHKINESKQKVTPSLWKLLKTAPRSFWELAIVQLFSWIGIMYTWTYATGAMANNIWNTTNPASSGFQAAGNWYGVMTAFYSVAALLWGLFYAKTKATQRKFWYSFGLFADAISIIIVATTHNQWVALIAFALYGIGNFTINTLPYTMLTTSLDGRNNGSYLGLFNIAVCLPQIIGSLASFIIFPLVGNSQSMMMIIGFVAMVIGGFSVAIVHEGK

SEQ ID NO: 2885 - protein, 322 aa, Prochlorococcus marinus
MEIASDITSLVGNTPLVKLDRIKDYCKCHTEIIAKLESFNPSASVKDRIAYSMLNSAEEDGLILPGKTTLIEATSGNTGIALAMVAAAKGYRLILTMPDTMSIERRAMLRAYGAELQLTPGTEGMRGALELANELSSSIPNSFQFNQFENLANPEIHERTTAKEIWDQSNQNIDGLVSGVGTGGTITGCARFLKKVNPNCKIYAVEPAKSAVISGEKPSSHSIQGIGAGFIPKVLNTQLIDEIIKIDDDDAFYYGRLLARLEGLLSGISSGAALAAAIKIGKRKEFIKKRLIVILPSFGERYLSTAMFESNTVVQARQDGYL

SEQ ID NO: 2886 - protein, 418 aa, Streptococcus pyogenes
MIFDKGNVEDFDKELWDAIHAEEERQEHHIELIASENMVSKAVMAAQGSVLTNKYAEGYPGNRYYGGTECVDIVETLAIERAKKLFGAAFANVQAHSGSQANAAAYMALIEAGDTVLGMDLAAGGHLTHGSPVNFSGKTYHFVGYSVDTDTEMLNYEAILEQAKAVQPKLIVAGASAYSRSIDFEKFRAIADHVGAYLMVDMAHIAGLVAAGVHPSPVPYAHIVTSTTHKTLRGPRGGLILTNDEALAKKINSAVFPGLQGGPLEHVIAAKAVAFKEALDPAFKDYAQAIIDNTAAMAAVFAQDDRFRLISGGTDNHVFLVDVTKVIANGKLAQNLLDEVNITLNKNAIPFETLSPFKTSGIRIGCAAITSRGMGVKESQTIARLIIKALVNHDQETILEEVRQEVRQLTDAFPLYKK

SEQ ID NO: 2887 - protein, 613 aa, Unknown
  Mycobacterium sp. MCS
MTEASARTIGPLPSRFSRDPKTPRSTDNAAAALLLAFTVLAILWANSPWAQSYSIFWDTDVAVSFGEYRAELSVKHLVNDGLMAFFFFIVGLEVKSEFVIGELTDRSRAAVPVVAAIAGLIVPAVIFLTFNPSGPDAQAWGVVISTDTAFLVGALAVIKPKFPARLRIFLLTLAVVDDVGALGAIALFYTDDLKLAPLAVAALLIAALAMVRRLPSLRGPAYAVLGFALWIALYLAHVHPTLAGVAVAVLIPVFTPERRQVEQTVDLVRAFRQSPNPQYARAVTRGLRESISINERLQTAVGPYVSFVVLPIFALANAGVHLDEQTITAAMSSTLTWGIVAGLVVGKFVGITAATALMSATGWGQLAPGLSLRRVAGGAALSGIGFTISLFIVDVAIEDPARQDEARVGVLIASVLAFTLSWALFRITDWISPPEPVGLTLVRPVDPERDHIRGDPDAPLVLVEYGDYECPFCGRATGAIDEVRTHFGDDLLYVWRHFPLERAHPRSFDAARASEGAAAQGKFFEMGRELFAHQDDLEWSDMYRYAVAIGLDIEQFDQDVRVHASKVLHRVRDDAQDAEVMDLNSTPTFFVNGKRHKGPWDAASLIRALEAGR

SEQ ID NO: 2888 - protein, 394 aa, Hordeum vulgare
RQGTMQLLKLILTWVQNHHLQKKRPRVGAMDQEAPPAGGQLPSPGANPGYEFPAETGAAAATSWMPYQAFSPTASYGGEAMYPFQQGCSTSSVVVSSQPFSPPAAADMHAGAWPLQYAAFVPAGATSAGTQTYPMPPPGPVPQPFAAPGFAGQFPQRMEPAATREARKKRMARQRRLSCLQQQRSQQLNLSQIQTGGFPQEPSPRAAHSAPVWGGHWSPPAVQAQPHGQLMIQVPNPLSTKSNSSRQKQQKPSPDAAARPPSGGAASQQRQGQAAASDKQRQQGASRTAAAPPAGDKNLRFLLQKVLKQSDVGTLGRIVLPKKEAETHLPELKTGDGISIPIEDIGTSQVWSMRYRFWPNNKSRMYLLENTGDFVRSNELQEGDFIVLYSDVKS

SEQ ID NO: 2889 - protein, 840 aa, Zea mays
MAAAVAMRGGSSDSGGFDKVPGMDSGKYVRYTPEQVEVLERLYIDCPKPSSSRRQQLLRECPILSNIEPKQIKVWFQNRRCRDKQRKESSRLQAVNRRLTAMNKLLMEENERLQKQVSQLVHENAHMRQQLQNTSLANDTSCESNVTAPPNAIRDASNPSGLLAIAEETFTEFLSKATGTAIDWVQMPGMKPGPDSVGIVAISHGCRGVAARACGLVNLEPTKVIEILKDRPSWFRDCRSLEVFTMFPAGNGGTIELIYMQMYAPTTLVPARDFWTLRYTTTMEDGSLVVCERSLTGSGGGPNAASAQQFVRAEMLPSGYLVRPCEGGGSIVHIVDHLDLEAWSVPEVLRPLYESSRVVAQKMTTVALRHLRQIAQETSGEVVYALGRQPAVLRTFSQRLSRGFNDAISGFNDDGWSVMGGDGIEDVVVACNSTKKIRNNSNAGITFGAPGGIICAKASMLLQSVPPAVLVRFLREHRSEWADYNIDAYLASSLKTSACSLPGLRPMRFSGGQMIMPLAHTVENEEILEVVRLEGQPLTHDEALLSRDIHLLQLCTGIDEKSVGSSFQLVFAPIDEHFPDDAPLISSGFRVIPLDMKTDGVSSGRTLDLASSLDVGSAAPQASGDAPPDDCNLRSVLTIAFQFPYEMHLQDSVATMARQYVRSVVSAVQRVSMAISPSQSGLNAGQRMLSGFPEAATLARWVCQSYHYHLGVELLNQSDEAGEALLKMLWHHPDAVLCCSFKEKPMFTFANKAGLDMLETSLIALQDLTLDKIFDESGRKAIFSDISKLMEQGYAYLPSGVCMSGMGRHVSFDQAVAWKVLGEDSSVHCLAFCFVNWSFV

SEQ ID NO: 2890 - protein, 682 aa, Pisum sativum
MSSGGCSIVWFRRDLRVEDNPALAAGVRAGAVVGVFIWAPEEEGQYYPGRVSRWWLKNSLSQLDSSLRNLGTPLVTKRSTDSISSLLEVVKSTGATQIFFNHLYDPLSLVRDHRAKEILTAQGITVRSYNSDLLYEPWDVNDEHGQPFTTFDSFWERCLSMPYDPQAPLLPPKRIIPGDVSRCPSDTLVFEDELEKSSNALLARAWSPGWSNANKALTTFINGPLIEYSVNRRKADSATTSFLSPHLHFEEVSVKKVFHLVRIKQVFWANEGNKAGEESVNLFLKSIGLREYSRYISFNHPYSHERPLLGHLKFFPWVVDEGYFKAWRQGRTGYPLVDAGMRELWATGWLHDRIRVVVSSFFVKVLQLPWRWGMKYFWDTLLDADLESDALGWQYISGTLPDGREFDRIDNPQFEGYKCDPNGEYVRRWLPELARLPTEWIHHPWNAPESVLQAAGIELGSNYPLPIVEIDAATVRLEEALIQMWQLEAASRTAAENGTEEGLGDSTESAPIAFPQDIQMEERHEPVRNNPPHGTRRYQDQMVPSMTYSRVRVEDEETSSVRNSAGDSRAEVPTNANTQQNGREPMDQGMLQNVNRNTRQRRNNTTTTFWLRNAAEDSTAESSSSTRRERDGGVVPEWSPQASNFSDQFVDDENGIGATSPYLQRHPQTHQMMSWTRLPQTG

SEQ ID NO: 2891 - protein, 72 aa, Pediococcus pentosaceus
MAKDNVIEIEGTVKETMPNAMFKVELENGHEILAHVSGKIRMHYIKILPGDKVTVEMSPYDLSKGRITYRFK

SEQ ID NO: 2892 - protein, 973 aa, Unknown
  Mesorhizobium sp. BNC1
MLTKRKGGQTNRTGLQAMMGSAASAPMDRRTFLRRSGLVAGGVAALGTFQLGTVRKAAAIAPPQPGVPIELKKSICTHCAVGCTVTAEVQNGVWTGQEPSWDSPINRGSHCAKGASVRELVHSDRRLKYPMRLSGGQWERVSWEEAINGIGDKLLEIREASGPESVYWMGSAKFSNEGTYLFRKLAALWGTNNQDHQARICHSTTVAGVANTWGYGAMTNSFNDIRNSKTMMIMGGNPAEAHPIAMQHLLEGKELNNANLIVVDPRFTRTAAHATEYVRFRSGTDIALIWGMLWHIFENGWEDKEFIAQRVYGMDEIRKEVAKYTPDEVELITGVPEEQVKRVAEMFATQRPSTMIWCMGQTHHTVGTANTRASCILCLATGNVGKPGTGANIFRGHDNVQGATDIGLDVVTLPFYYGLTEGAWKHWARVWEIPYEDLVGQFSSKELMETPGIPLTRWFDSVSLPKEDVQQPDVMRAMFVQGHASNSIARIPESMKGLAGLELLVIADPHPTTWASLAVQAGRQDNTYLLPVCTQFETSGSRVASNRAIQWGEQIVKPSFEQKDDYQVLYLLSQKLGLSDWMFKNIAVEGDRPVPEDVLREMNRGSWSTGYCGQSPERLKAHMRNQHKFDLVTMRAPKEDPEVGGDYYGLPWPCWGKPELRHPGTANLYSTGLHVMDGGSPFRARFGVERNGETLLAEGSYTEGSELTDGYPEFTMAVLQKLGWDQDLTPEERSIIEQIGADMGDVGKVSWSTDLSGGIQRVALSHGCHPYGNGKARAVAWNLPDPVPIHREPIYTPKVDLVAKYPTYPDAKQFRLPNIGFSVQKAAVDNGIANSFPIILTSGRLVEYEGGGEETRSNRWLAELQQEMFVEINPADAAERGISDGAWVWVNGAENNAKARVRALVTERVGKGVAFMPFHFGGWFQGQDLRANYPQGTDPYVLGESANTITTYGYDPVTGMQEPKVTLCQIAAA

SEQ ID NO: 2893 - protein, 112 aa, Desulfotalea psychrophila
MKKIEAIIKPFKLEEIKEALTELAITGMTISEVKGYGRQKGHKEMYRGAEYSIDFNPKLKIELVVRAEIADKVVEKIRLAARTGKIGDGKIFVLPIEEVVRVRTGEQGREAI

SEQ ID NO: 2894 - protein, 667 aa, Glycine max
  misc_feature (44)..(44): Xaa can be any naturally occurring amino acid
MKRMNESNNTDDGNNHNWLGFSLSPHMKMEVTSAATVDNNVRQXFYMSPSQSHLSNFGMCYSVGENGNFHSPLTVMPLKSDGSLCILEALKRSQTQVMVPTSSPKLEDFLGGATMGTHEYGSHERGLSLDSIYYNSQNAEAQPNRNLLSQPFRQQGHMSVQTHPYYSGFACHGLYQAPLEEETTKETHVSDCSSLMPQMTEGLKNWVAPTREFSTHQQILEQQMNCGIWNERSGVSVGTVGCGELQSLSLSMSPGSQSSCVTAPSGTDSVAVDAKKRGHAKLGQKQPVHRKSIDTFGQRTSQYRGVTRHRWTGRYEAHLWDNSCKKEGQTRKGRQVYLGGYDMEEKAARAYDLAALKYWGPSTHNFFSIENYQVQLEEMKNMSRQEYVAHLRRKSSGFSRGASIYRGVTRHHQHGRWQARIGRVAGNKDLYLGTFSTQEEAAEAYDVAAIKFRGANAVTNFDISRYDVERIMASSNLLAGELARRKKDNDPRNKDIDYNKSVVTSVNNEETVQVQAGNNNNENDSEWKMVLFNHPSQQQQANGNGSDQKIMNCGNYRNSAFSMALQDLIGIDSVGSGQHNMLDESSKIGTHFSNTSSLVTSLSSSREASPEKRGPSLLFPMPPMETKIVNPIGTSVTSWLPSPTVQMRPSPAISLSHLPVFASWTDT

SEQ ID NO: 2895 - protein, 287 aa, Coprinopsis cinerea
MPSPPSTFALYAFVLSLLSFVSLASCSVIPVDVSQRSQASEVTEPIEARQNFTLRGESRQLEKRFSNARFTFYDAGLGACGRVNTNSDFIVALNAAQWNGGAHCFETVTISYRGRTARATVMDLCPGCPYGGLDLTRGLFGYFANHDLGVIHGDWDFGGAAVQPAPPPPPPPRTSTPPPPPPPPPTSTRRPTSTPQAPPPPPPPTSTPRPPPTSTPRAAPPPPPTSSSRPASTQSPAPTPSSPSALAPTGAADRIPDNVLNELNRAFSAIGILLANILQNPENRQQQ

SEQ ID NO: 2896 - protein, 729 aa, Aspergillus oryzae
MYVWYVHANATFVHSNGCGLDIGVKDGRVVGVRGRATDRVNKGRLGPKGLHGWESIHHPDRLKHPLIRRNGKLEQASWDEAMSLIVDKAKEIRARLTNHGIGFYTSGQLFLEEYYVLAMIGKAGLNTLHMDGNTRLCTATAAASMRESFGSDGQPGSYGDIDYTECLFMVGHNVANTQTVLWSRILDRLEGAYPPKLIVVDPRRSETAKKATIHLAPKIGTNVALLNGLQHLLFKNGWVNEAFVSKHVVGLQQLEAVVEEYTPEYVMQVTGVPTTLLEEAARIIGTSSSLLSTALQGVYQSNQATAAACQINNINLLLGHIGKPGSGILQMNGQPTAQNNREAGCDGEYPGFRNFQNQKHMQEIADHWNIDLIRMPHWNQPTHIQNMLNYIENGSIEMFWVSGTNPLVSLPNLHRVRDLFTKPDLFLVVQDIFPTETTAVADVVLPAAQWAEKTGCFTNADRTMHLSQKAVEPPGEAKSDLDIFLDFGRRMGFKSKDGGPLIPYTTPEEVFDAWKKMSYGRPCDCSELTYEKLTGGSGIQWPCTKEYPNGKERLFTDGKFFTDPDYCEDFGHDLETGAPYTRAQYQAMNPAGRAILKAAHHKAPLEAPDDQFPLLLSTGRNVFHFHTRTKTGRARRLQQADPQPFVRISEADARALYLTEGEMVVVRSRRGSVELPVRIGEINKGHVFIPFHFGYFDSKDPRARAANELTVAYQGQKPSDSACSSGSIG

SEQ ID NO: 2897 - protein, 426 aa, Ralstonia metallidurans
MTEFDLHAYMTRVGQQARAASRAMARASTADKNRALLTIAAAIRRDADKLKAVNARDVERARTNGQDAAFIDRLTLSDKAIATMAAGLEQIAALADPIGEISNMKFRPTGIQVGQMRVPLGVIGIIYESRPNVTIDAAALCLKSGNSTILRGGSEAIESNTALAALVAEGLAAAGLPSEAVQVIETTDRAAVGRLITMTEYVDVIVPRGGKSLIARLMEEARVPMIKHLDGICHVYIDDDADLEKAVRVCDNAKTQRYAPCNTMETLLVSREIAAKALPPLCRIYQEKGVELRVCPATRATLEAAGFSGLVDATEEDWRLEYLAPVLAIRTVDGLDAAIAHINTYGSAHTDSIITENYTTGMRFLREVDSASVMINASTRFADGFEYGLGAEIGISNDKLHARGPVGLEGLTSLKYVVFGHGEIRT

SEQ ID NO: 2898 - protein, 258 aa, Triticum aestivum
  misc_feature (243)..(243): Xaa can be any naturally occurring amino acid
  misc_feature (251)..(251): Xaa can be any naturally occurring amino acid
VTSRTSLYKKAGCYRSGIPGISSTHASAGAQAPEYLDGTLVGDYGFDPFGLGKPAEYLQYDVDSLDQNLAQNLAGEIIGTRFEDADVKSTPFQPYAEVFGLQRFRECELIHGRWAMLATLGALTVEWLTGVTWQDAGKVELVDGSSYLGQPLPFTLTTLIWIEVLVIGYIEFQRNAELDPERRLYPGGSYFDPLGLAADPVKEETLQLGEIKHARLAMVAFLGFRVQARATGKGPLNNWGTHXSDPLNTTXFEPFGSS

SEQ ID NO: 2899 - protein, 482 aa, Treponema denticola
MSELIFEKSVKGHKFAEAKLTVPEYKLDSKYLRASDAKLPEVSELEFVRHYMELSKRTHGVDNGFYPLGSCTMKYNPKLNEEVADLPNFTNIHPLQPEHTMKGCIEAMGDLGKKLGEITGMDAFSLQPSAGAHGEFTALLVIRAYHEKRGDHARNKILVPDSAHGTNPASAAMVGCEIVNIPSDKDGNVDIEELKKTVGNDTAALMLTNPNTLGLFETHIKEIAEIVHKAGGLLYYDGANLNAIMGRLRPGDMGYDIVHLNLHKTFSTPHGGGGPGSGPIGCKKFLEEFLPVPVVTGSDGSYKLDYNRPDSIGRVRNFYGNFLVFLRAYAYILTLGSEGIRESSGYAVLNANYLKKKLEKEYDVAFDRICMHEFVLTLEKIKEETGVSALDIAKGLIDDGIHPPTMYFPLIVHEALMFEPTETESKSTLDFTAEVMIKLKKEAYSNPEKLHGYPYTRPIGRVDETKAAREPVLRYKACCCCK

SEQ ID NO: 2900 - protein, 603 aa, Glycine max
MQRSRKALLERRAIQEATSGRNYLYKVSLSLVFVLWGLVFLFSLCISHGHGYGDHESREVPVGVSNWNEDEHRQCKNSNSADEYLTKETDDVYIPSETFSSDGAKTDGLISESLSSGESINRVEPGDKESSISPDTEEHEVERSESAVKHQNDVQKYNHLSQAMPLGLDEFKSRAIGSKIKSGTNPSGSVIHRLEPGGAEYNYASASKGAKVLASNKEARGASDILSRNKDKYLRNPCSSEEKFVVIELSEETLVKTIEIANFEHHSSNFKEFELYGSLVYPTEAWIFLGNFTASNVKQAQRFVLEEQKWMRYIKLNLQSHYGSEFYCTLSIVEVYGVDAIERMLEDLIYAQDKPFASGEGNGEKRVASPLSNAAKADNVRPNTITGINSDPASEISSENQEAIIVKRNVPDPVEEIRQQVGRMPGDTVLKILMQKVRYLDLNLSVLEQYMEDLNSRYINIFKEYSKDMGEKDLLLEKIKEEISRFLERQDVMMKEFSDLDSWRSHFSVQLDHVLRDNAVLRSEVEKVRENQVSLENKVVVVFSVCVIFSLLAIFRLSLDMIMNLYRVLSFDRTITSRRFWQGSSSWFFLLLSCSIVIFTLTL

SEQ ID NO: 2901 - protein, 652 aa, Gibberella zeae
MAFPHNKDDDVVAGDGPSAYDNYDSTRLNDTSEFGSIDPDSGVKRGLKNRHLSMMALAGIIGPGLLVGAGGALNVGGPAALLIGFGVVGIIAFCIMQSLGEVTTLYPGGGSFISLAERMVDKSFSVAVGWNYFVIWAAVLANEYNVICSILTYWGPVVPLWGYFLIFWTVFMAFQLLGVEAFGEAEFWLALMKLLGLTAYFIFAIIYAAGGLVGQDEPLGFRYWSDPGAFNGNGFRGVAAVFVFCATFYSGVESIAVAATETRNPGVAVPQAIRQVFWRIIFVYMGSALFFGITCPANASGLVNGGSKALQSPMTIAIENAGWQGGVHLINAFILLTCLSAINSSIYFGSRTVFYMAQSGKAPKIFAWTNKRGVPVWAILITNAVGAISMMNVSTGASKAYSYIVNLSGVSAFLVWGSICFIHIRFRRAWVAQGRSLDELPYKALGFPYLAWFGLAACIFLALVQGWTTLSPFDAGNFVDAYILVPLFGIIYVFCKILWRGSDPLKRSWSIDLDSGRRTDLDQKSGPTSRDLPGQMPWWRKRNDGDKLSRYRTESHSHLFPFYHRNLGNFTAGILGRSLESRLCDGNSVWMPAAAIWRHSVGDVRWAVLKGLYCERICCDFDGYIDVFQSTEIALISVPFFYYSKQRTTTNR

SEQ ID NO: 2902 - protein, 434 aa, Treponema denticola
MSNYIPHSAEETKEMLDLIGVKSIDDLYSFDNKGCKKVDIGEGKTQAEVEKFFQNLSSENTVFKSILRGAGAYNHYAPAAVRHMASREEFLTAYTPYQPEMNQGELQAGFEYQSMICELTGMDVSNASVYDGGTAVADAIVMSLGRKQNKVLISECVEPSSIEIAKTYLKHSGVEFVMIPRDGYKTDVSKIKGLLDESVGAVVMQQPNRFGTIEDCEAVGKLVEGTKTQFVMSCNPISLAILKTPKECGASIALGEGQALGLPLGAGGPYLGFLSTIEANMRKIPGRIIGQSTDHDGRRAFVLTLQAREQHIRREKASSSICSNQALCALRASMFMTAYGKEGLKTVAKVSVSNAHYLADELKKIGLTVKNNGEFFHEFVTDGKGKADAILSNLEKNNILGGLKICDDSILWCATDVLCKCELDKAVKIIKEVL

SEQ ID NO: 2903 - protein, 974 aa, Anabaena variabilis
MVSYASIRQSSDEADSTVDASQKLDARKQDLNNFIQRHIGPSSADIQHMLDVLGFSSLDDLIEKTVPSTIRLHKKLQLPTAQTEYAALAKLKQIASKNQVFRSYIGMGYYDTITPPVIGRNILENPGWYTAYTPYQPEIAQGRLEALLNFQTMIIDLTGLEIANASLLDEATAAAEAMSMSYGVSKNKANAYFVSHDCHPQTIDVLQTRAKPLGIEIIIGDHQTFDFQKPIFGAVLQYPASDGTIYDYRAFIETAHAQGALVTVAADPLSLTLLTPPGEFGADIAVGSTQRFGIPLGFGGPHAAYFATKEEYKRQVPGRIVGVSKDVNGKTALRLALQTREQHIRREKATSNICTAQVLLAVMASMYAVYHGPEGLKQIAENIHQLTVTLAEGLKRLGYKISSEHFFDTLRVELGTNNLETILAGCQARNINLRIFDETAVGISLDETTTPEDLIDLWQIFAGEDNLPFTPEELISSLNLPLRSSSYLTHPVFNRYHSETELLRYLHRLETKDLSLTTSMIPLGSCTMKLNATSEMIPVTWEEFGRIHPFAPLTQTRGYQILFQQLEAWLAEITGFAGVALQPNAGSQGEYTGLLVIRQYHESRGETHRNVCLIPTSAHGTNPASAVMCGMKVVAVACDAGGNIDIDDLKAKAEKHSHELAALMVTYPSTHGVFEAGIQEICAVIHSHGGQVYMDGANMNAQVGICRPGDIGADVCHLNLHKTFCIPHGGGGPGMGPIGVASHLVRFLPGHPVLGSGKNPQNIGAVAAAPWGSASILVISWMYIAMMGADGLTQATKVAILNANYIAKRLETYYPVLYKGQNGLVAHECILDLRALKKSANIEIDDIAKRLIDYGFHAPTVSWPVTGTIMVEPTESESQAELDRFCDALIAIRQEIAAIEAGKMDTHNNLLKNAPHTIESLIVGEWLHPYSREQAAYPVSWTREYKFWPSVGRIDAAFGDRNFVCSCLPMEAYN

SEQ ID NO: 2904 - protein, 165 aa, Candida glabrata
MDSQSSFYDLSPHDKDNNEFPFSNLKGQVVLIVNVASKCNFTPQYNDLQYLHEKYSYRGLKIIGFPCNQFGQQEPENDEVIQKFCLSNYGVSFKILKKIKVNGPNADPVYTYLKNEMPSQIGLKVIRWNFEKFLVDKHGRVRHRYSSLTSPKSLQRTIDQLLDDK

SEQ ID NO: 2905 - protein, 161 aa, Candida glabrata
MSPFHQLRPVDGQGNIYPFEMLKGKVVLIVNTASNCGFTPQYIELENMYQKYKNEGFEILGFPCNQFGHQEPGSDAEIQKFCSSKYKVTFPIMKKIDVNGPYEDPVFKYIKEQKPGMLGLKGIKWNFEKFLIDRQGNVVLRASSLTKPSTLNETIEKLLKN

SEQ ID NO: 2906 - protein, 70 aa, Arabidopsis thaliana
  misc_feature (12)..(12): Xaa can be any naturally occurring amino acid
  misc_feature (33)..(33): Xaa can be any naturally occurring amino acid
  misc_feature (36)..(36): Xaa can be any naturally occurring amino acid
  misc_feature (52)..(52): Xaa can be any naturally occurring amino acid
TITSSILSSATXISSPPQPTMVSPFNRLKSSPXFPXTLNANNNITSITSNRXRVHCLHVSPPIVKTTSNT

SEQ ID NO: 2907 - protein, 176 aa, Triticum aestivum
MESLLAALAASSGGTVAAAAVGGLAAAAALAVQAGNGGTGPKDRTNAPPVVPGLPLIGNLHQLKEKKPHKTFSKWSETYGPIYTIKTGASSVAVLNTREVAKEAMVAKYSSISTRKLPKSLDVLGRDKAMVAMSDYGDFYKKVKRLVMAGMLGSSTQKQFRETRDLMMDNMLSSFR

SEQ ID NO: 2908 - protein, 357 aa, Unknown
  Acinetobacter sp. ADP1
MTDLKFTDLVEPVVIDKKTALRVTVLGGGSFGTAMANLATRNGCNTMIWIRDQKMADEINQTHFNQRYLPDFNLEPELKAVSDLELAVRDRDIIFVAIPSHSFREVVKQISPYITAQAIVSLTKGIEANTFSFMSDIIREELPEVPYGVLSGPNLAKEIVAGMPSGTVIASDSELVRYAVQHALHSALFRVFGSDDVHGVELGGALKNIYAIAMGMAAAYNIGENTKSMIITRALAEMSRFAVKLGANPLTFLGLSGVGDLFATCNSPLSRNYQIGYALGSGKTLDQAIKALGQTAEGINTIVQVRTRAIELDVYMPITNALYEVIFEGAPPLNIALALMKNGHRSDVEFVLPHHQV

SEQ ID NO: 2909 - protein, 551 aa, Thiocapsa roseopersicina
MRILMIQPNYHCGGAEIAGNWPPGWVAYIGGALKHAGMTNIRFIDAMTYDIPDEKLREIIRVNQPDVVLATAITPQIYKAQTTLQIAKEVLPNCVTVLGGIHPTFMYTQVFSEAPWIDYIVRGEGEEIAVALLQSIEAGTHRQDRKRIWGIAYIDDDGQVVATPARPVIEDLDTLTPDWSLLDWDKYIYTPLNCRVAVPNFARGCPFTCRFCSQWKFWRKYRHRDPKKFVDEIETLVRDYNVGFMILADEEPTIFQKKFVALCEELIKRDLPLHWGINTRVTDIMRDRNLLPLYRKAGLVHVSLGTEAVSQLNLDTFRKQTTVEQNKLAVKLLQQAGIVAEVQFIMGLENETPETIEETYKLAQDWKPDMANWNMYTPWPFAELFEELGDRVEVRDYSKYNFVTPIMKPEAMTREQVLKGVLKNYARFYMRKSFLEYPWIKDKFRRRYMLGCLKAFAKTTASKKFYDLERLKMKGMSTEVDLGFDASKVLTADEIAQLKRDRPELSADMNFKGTPVKIVACGAPDDLQVSESDLPVKAAASKPKMTAVQPD

SEQ ID NO: 2910 - protein, 443 aa, Escherichia coli
MCVPEMIKKELVMVSLEKNDHLMLARQLPLKSVALILAGGRGTRLKDLTNKRAKPAVHFGGKFRIIDFALSNCINSGIRRMGVITQYQSHTLVQHIQRGWSFFNEEMNEFVDLLPAQQRMKGENWYRGTADAVTQNLDIIRRYKAEYVVILAGDHIYKQDYSRMLIDHVEKGARCTVACMPVPIEEASAFGVMAVDENDKIIEFVEKPANPPSMPNDPSKSLASMGIYVFDADYLYELLEEDDRDENSSHDFGKDLIPKITEAGLAYAHPFPLSCVQSDPDAEPYWRDVGTLEAYWKANLDLASVVPELDMYDRNWPIRTYNESLPPAKFVQDRSGSHGMTLNSLVSGGCVISGSVVVQSVLFSRVRVNSFCNIDSAVLLPEVWVGRSCRLRRCVIDRACVIPEGMVIGENAEEDARRFYRSEEGIVLVTREMLRKLGHKQER

SEQ ID NO: 2911 - protein, 328 aa, Prochlorococcus marinus
MSRIYEDNSQAIGNTPLVKLHAVSKNAKATVLAKIEGRNPAYSVKCRIGANMIWDAEKRGLLSKERTIIEPTSGNTGIALAYTAAARGYKLILTMPESMSLERRRVMAVLGAELILTEAAKGMPGAIAKAKEIAESDPQKYFMPGQFENPANPDIHSKTTGPEIWNDCDGAIDVLVSGVGTGGTITGVSRYIKQEKGKAIISVAVEPTHSPVISQTLNGEEVKPGPHKIQGIGAGFIPKNLDLSLVDRVEQVSNDESIAMALRLANEEGLLVGISSGAAVAAAIRLAEQPEFAGKTIVVVLPDMAERYLSSVMFESVPTGIIQAPVAA

SEQ ID NO: 2912 - protein, 657 aa, Escherichia coli
MTQLAIGKPTPLGAHYDGQGVNFTLFSAHAERVELCVFDANGQEHRYDLPGHSGDIWHGYLPDARPGLRYGYRVHGPWQPAEGHRFNPAKLLIDPCARQIDGEFKDNPLLHAGHNEPDYRDNASIAPKCVVVVDHYDWEDDAPPRTPWGSTIIYEAHVKGLTYLHPEIPVEIRGTYKALGHPVMINYLKQLGITALELLPVAQFASEPRLQRMGLSNYWGYNPVAMFALHPAYACSPETALDEFRDAIKALHKAGIEVILDIVLNHSAELDLDGPLFSLRGIDNRSYYWIREDGDYHNWTGCGNTLNLSHPAVVDYASACLRYWVETCHVDGFRFDLAAVMGRTPEFRQDAPLFTAIQNCPVLSQVKLIAEPWDIAPGGYQVGNFPPLFAEWNDHFRDAARRFWLHYDLPLGVFAGRFAASSDVFKRNDRLPSAAINLVTAHDGFTLRDCVCFNHKHNEANGEENRDGTNNNYSNNHGKEGLGGTLDLVERRRDSIHALLTTLLLSQGTPMLLAGDEHGHSQHGNNNAYCQDNQLTWLDWSQASSGLTAFTAALIHLRKRIPALMENRWWEEGDGNVRWLNRYAQPLSTDEWQNGPKQLQILLSDRFLIAINATLEVTEIVLPAGEWHAIPPFAGEDNPVITAVWQGPAHGLCVFQR

SEQ ID NO: 2913 - protein, 558 aa, Oryza sativa
MESNGGGGGSPKEAAVVVPSSGDATLGGHLARRLVQVGVSDVFAVPGDFNLTLLDHLIAEPGLRVVGCCNELNAGYAADGYARARGVGACAVTFTVGGLSVLNAIGGAYSENLPLICIVGGPNSNDYGTNRILHHTIGLPDFSQELRCFQPLTCYQAVVNNLDDAHDQIDRAISTAIRESKPVYISASLHAALDATLAFLDKAVKPVLVAGPKLRVAKAGGAFVDLADASGYAVAAMPSAKGLVPETLPRFIGTYWGAVSTAFCAEIVESADAYLFAGPIFNDYSSVGYSCLLKKEKAVVVQPDRVTVGNGPAFGCVMMRDFLSELAKRVRKNTTAFDNYKRIFVPEGQLPECEAGEALRVNVLFKHIQRMIGGAEIGAVMAETGDSWFNCQKLRLPEGCGYEFQMQYGSIGWSVGALLGYAQAVQKRVVACIGDGSFQVTAQDVSTMLRCGQRSIIFLINNGGYTIEVEIHDGPYNVIKNWDYVGLVNAIHNGEGRCWATRVRCEEELEAAIATATGDKADSLCFIEVVAHKDDTSKELLEWGSRVSAANSRPPNPQ

SEQ ID NO: 2914 - protein, 547 aa, Zea mays
MEARLTCVLAGRCGEQSARARTPSSDDGSTPSYLAPTSEAVDKLRQDLNPCCVYRDSIQHHRVEDPSAEEDLQPQAEVVESFESESAPPPIVYDCYDEPNHDEIAEVLALLEYNEGTSSATVLVDYTTTSMSPTKCSTMDFSDADSARTCDVTDVPIVHSALKAFVKMLNGGSEHPQEVTQTSIARLMDSSRSWIFTELGQPTYCPETFPEVPFERPTPPIIFFDEEHIFEEESSSSTTATPRNPSDPKQAGGDLDSIATAALSASEEIPQSLLVIDLERATSKCIRTHAVNDVPAVHSIIKGLQLERIGLAGSAPDLDTLTTARHCGSELSCQLGSNKRDVSLRVGCDQSYEWVDPETLDRSFVVLDNACATHEVFEGLVAETHLHFIGTYRGVVSTAFCTEIVESADAYIFAGSIFKDYSSVGYSFLLKKAKAIIVQPERVGVGNGLSFRCLMMKEYWTEIAKKVKKNTTTYENYKRNFVPEGQALESEPNEPLRVNVLFKYIQKMMTVNSVVMAETDDSWFNCHKLKLPESCGYEFQMQYGCES

SEQ ID NO: 2915 - protein, 546 aa, Oryza sativa
MVKIKMPALFRRRSGSKSPPLPQADPASGGGSPAPTPEEEMERVFRKFDANGDGRISRSELGALFESLGHAATDDELARMMAEADADGDGFISLDEFAALNATASGDAAAVEEDLRHAFRVFDADGNGTISAAELARVLHGLGEKATVQQCRRMIEGVDQNGDGLISFEEFKLSHLPEPEYTSAVLGMARSYVIFCQKHAWMTGGMRWCSGWQEESCFAIGAGTDVANLFISIKRTQLLLATEEWLLAGLACSWGESMSSGGVGGGSLGAGLLYHKFVSFALEETRLRTTLTPHPSQYLSELCRPIVAASFNHVSKPCLRLSIFLSHVNEKFKSIKPNDDNTVFNALSFSAPKIRLLRSLTIEKKNSYQVLDFAAFSEPEYDLPIFCANVFTTHAQSIVVLDLNPLYDTTVHKDYKDKYYRSIMPLVHKYNEVWLELMDQAIKENNKATIARNQEEQHKYLTWRAEKDPGYPLLKKLIGESRAEDLVMEFLFEGVNTLGTKSFLDYFPEYARDDGSVNKKRSMIGKSFETRPWDANGEFIGDAEAQ

SEQ ID NO: 2916 - protein, 303 aa, Streptococcus pyogenes
MKTVRIFYNPNSGKKESQLARQVKDYFCQHGFSEDSVKVITPKDADQAFQLAKQAAKDKIDLVIPLGGDGTLNKIIGGIYEGGAHCLIGLVPSGTVNNFAKAMHIPLQITEALDTILTGQIKQVDICKANQQYMISSLTLGLLADIAADVTAEEKRRFGPLAFLKDSIRILKRNRSYAISLISHNHRIHLKTKFLLITMTNTIAGFPSFSPGAQADDGYFQVYTMKKVSFFKFLWHINDFKQGDFSKAEEISHFQANTLSLLPQAKKQAILPRTRIDGDKSDYLPIQLDIIPKAVSIIVPTED

SEQ ID NO: 2917 - protein, 427 aa, Sinorhizobium meliloti [sequence omitted]

SEQ ID NO: 2918 - protein, 501 aa, Oryza sativa
MPRRPSGGGGGAGPAAAAVRKVPLRKLLRAASVACGVQFGWAPQLSLLTPYVQELGIPHAFASLVWLCGPLSGLLVQPLVGHLSDRIAPAASPLGRRRPFIAAGAASIAAAVLTVRFSADLGRIFGDSITPGSTRLGAITAYLVGFWLLDVGNNATQGPCRAFPADLTENDPKRTRIANAYFSLFMALGNILGYATGAYSGWYKIFPFTVTPSCSISCANLKSAFLLDIIILVVTTCITVASVQEPQSFGSDEADHPSTEQEAFLWELFGSFRYFTLPVWMVLIVTALTWIGWFPFILFDTDWMGREIYRGSPDDPSITQSYHDGVRMGSFGLMLNSVLLGFTSIVLEKLCRKWGAGLVWGVSNILMALCFVAMLVITYVAKNMDYPPSGVPPTGIVIASLVVFTILGAPLAITYSIPYAMAASRVENLGLGQGLAMGILNLAIVIPQVIVSLGSGPWDQLFGGGNAPAFAVAAAASFIGGLVAILGLPRARIASRRRGHR

SEQ ID NO: 2919 - protein, 420 aa, Unknown
  marine gamma proteobacterium HTCC2143
MFTKDMQIEDFDNEIFSAIQQENQRQEQHIELIASENYASPRVMEAQGSSMTNKYAEGYPGKRYYGGCEFVDKAEVLAIERAKTLFGADYANVQPHSGSQANSAVYLALLEAGDTVLGMSLDAGGHLTHGAKPNFSGKVYNAVQYGLNAETGIIDYEQVEALALEHKPKMIVAGFSAYSGIVDWAKFREIADKVGAYLLVDMAHIAGLVAAGLYPNPVPFADVVTSTTHKTLRGPRGGIILAKHNEALEKKFNSAVFPGGQGGPLMHVIAAKAVSFKEAATAEFKEYQQQVITNAKVMAETFIARGIKIVSGGTYNHLMLVDLIGKEYTGKDADAALGDAFITVNKNAVPNDPRSPFVTSGLRVGTPAITTRGFKEDETRELTHWMCDVLESLESGNSETVIPQVKAKVLDICSRFPVYK

SEQ ID NO: 2920 - protein, 517 aa, Unknown
  Nostoc sp. PCC 7120
MTQQNGKVYLVGAGPGDVAYLTVKAYNLLATAQVLVYDALVDEQLLQCVSSDCLKLDVGKRGGKPSTPQTEINNLLVKFCQEGALVVRLKSGDPFIFGRSTSEIEALKAAGCEFEVVPGISSAIAAPLLAGIPLTDPVMSRCFAVLTAHEPEVLDWEALSRLDTLVILMGGKNLADIVHELLRRERSHLTPIAIIRWAGTPSQEIWTGQLGDILQQTAGLSLSPVVIVIGEVVRLRKYLQPEKIFPENSTTPMSSNQPLTGKTILVTRSSGQSSQFSDRLTTLGATVIEMPALEIGPPSSWKELDQAIANLSHFDWLILTSTNGVDYFFERLYIQGKDTRALAGLKIAVVGEKTSQSLKQRGIQADFIPPNFVADSLVEHFPESLLNKKILFPRVESGGREILVKELSAKGADVIEVAAYQSCCPTSIPLAAELALKNRTIHIITFASSKTVQFFCQLADKIFPHNIPNALEGICIASIGPQTSKTCHTLLGRVDIEAEEYTLDGLTQAIIQWSLKP

SEQ ID NO: 2921 - protein, 446 aa, Oryza sativa
MAKRSSPDPASSSPSASSSPSSPSSSSSEDSSSPMSMPCKRRARPRTDKSTGKAKRPKKESKEVVDPSSNGGGGGKRSSIYRGVTRHRWTGRFEAHLWDKNCSTSLQNKKKGRQVYLGAYDSEEAAARAYDLAALKYWGPETVLNFPLEEYEKERSEMEGVSREEYLASLRRRSSGFSRGVSKYRGVARHHHNGRWEARIGRVLGNKYLYLGTFDTQEEAAKAYDLAAIEYRGANAVTNFDISCYLDQPQLLAQLQQEPQLLAQLQQELQVVPALHEEPQDDDRSENAVQELSSSEANTSSDNNEPLAADDSAECMNEPLPIVDGIEESLWSPCLDYELDTMPGAYFSNSMNFSEWFNDEAFEGGMEYLFEGCSSITEGGNSMDNSGVTEYNLFEECNMLEKDISDFLDKDISDFLDKDISISDRERISPQANNISCPQKMISVCN

SEQ ID NO: 2922 - protein, 144 aa, Nicotiana tabacum
MASISGTMVSTSFLPRKPVVTSLKAIPNVGQALFGLKSERGGRITCMASYKVKLITPEGTVEFDCPDDVYILDQAEEEGHELPYSCRAGSCSSCAGKVTGGNVDQSDGNFLDDDQMADGFVLTCVAYPQSDVTIETHKEEELTG

SEQ ID NO: 2923 - protein, 185 aa, Dechloromonas aromatica
MFSSLKRCFGIAALITVGVVPVAAAAECPPLLNHSFASLQDGKPMPLCQYAGKVILVVNTASYCGFTSQYDGLEKLYARLKDKGLVVLGFPSNDFGEQEPGSEKEIADFCRLTYGVEFPMVSKTVVKGKGAHPFYLKLAEITGSKPKWNFHKYLINRDATQVVAYTSFTKPDDKDLLKKIDEFLK

SEQ ID NO: 2924 - protein, 348 aa, Unknown
  Frankia sp. CcI3
MTAQEDGQDVTGRSSQPDGDDDIRDVVIVGSGPAGYTAAVYTARANLRPLVFEGAVSAGGALMNTTEVENFPGFPDGIQGPELMENLRRQAERFGAELVADDVTELDLAANPKVVKIEDRTYLARTIIVATGSAYRMLGVEHEERLLGRGVSACATCDGFFFRDQDIAVVGGGDSAMEEATFLTRFARSVTVIHRRDKLRASAIMQERAFANEKIRFRWNAEVTELLGADKLTGVRLRDTVTGEAKDLPVTGLFVAIGHLPRTELVRGQLDLDDAGYISVAHPTTKTNLDGVFACGDVVDHTYRQAITAAGTGCAAALDAERFIAAGEGPGEVTTVAPRVVTPTPQPA

SEQ ID NO: 2925 - protein, 108 aa, Unknown
  Frankia sp. CcI3
MAGSTTPVTDSTFVTEVLESDKPVLVDFWAEWCGPCKMVAPVLEEIAKEHGEKLRVVKLNIDENPETARNYQIMSIPTMAVFVKGVIDKSIVGAKPKAALLRDLSVYI

SEQ ID NO: 2926 - protein, 224 aa, Triticum aestivum
  misc_feature (97)..(97): Xaa can be any naturally occurring amino acid
  misc_feature (105)..(105): Xaa can be any naturally occurring amino acid
  misc_feature (123)..(123): Xaa can be any naturally occurring amino acid
  misc_feature (138)..(138): Xaa can be any naturally occurring amino acid
  misc_feature (151)..(151): Xaa can be any naturally occurring amino acid
  misc_feature (158)..(158): Xaa can be any naturally occurring amino acid
  misc_feature (167)..(167): Xaa can be any naturally occurring amino acid
  misc_feature (171)..(171): Xaa can be any naturally occurring amino acid
  misc_feature (177)..(177): Xaa can be any naturally occurring amino acid
  misc_feature (185)..(185): Xaa can be any naturally occurring amino acid
  misc_feature (187)..(187): Xaa can be any naturally occurring amino acid
MEGCACIEQFRQTDGLLIKYQYISDFFIALAYFSIPLELIYFAKKSSSFPYRWVLIQFSAFIVLCGATHFINLWTFTKHTRTDIVMTVTKITTAVVXCANRLTLXHIVPDLLGVKTRELFLKXKADELDREMGLVRTXEETGRHVRMLIPXIKSTLDXHTNLKTTLXELGXALGLEXCAFLMPPXSXSSLELTYTMHNPLPGGSFLEINLPVGNQFFIPTRANI

SEQ ID NO: 2927 - protein, 324 aa, Ralstonia metallidurans
MREPDGGKTAILAEAGGIPGTDPALRRGTQAWTEWLIPGVGTTLGEITLLAAACSPYQQIEIGESAHFGRIFRLDGRVMSTEADAWIQHELMVAPMAATHGAPRSALVVGGGDGGSAFELLRIPTMREVVVAELDGEVVRLAREWLRGIHQGALDEPGDPRLSLAIGEGLGLMEAFARAGRQFDLIVYDLTEADDGSPAAALFSPHGLHTARRCLAPGGAMSLHLGPPLHRPETARRLLARLRHVFRHVAPLTTFVPAYGALWGIALASDALDIAAQPADKIATRLQQWQLEHKLRAYHAYLHPALFVHPRHVQAIFDSGSRPA

SEQ ID NO: 2928 - protein, 456 aa, Escherichia coli
MEGQQHGEQLKRGLKNRHIQLIALGGAIGTGLFLGSASVIQSAGPGIILGYAIAGFIAFLIMRQLGEMVVEEPVAGSFSHFAYKYWGSFAGFASGWNYWVLYVLVAMAELTAVGKYIQFWYPEIPTWVSAAVFFVVINAINLTNVKVFGEMEFWFAIIKVIAVVAMIIFGGWLLFSGNGGPQATVSNLWDQGGFLPHGFTGLVMMMAIIMFSFGGLELVGITAAEADNPEQSIPKATNQVIYRILIFYIGSLAVLLSLMPWTRVTADTSPFVLIFHELGDTFVANALNIVVLTAALSVYNSCVYCNSRMLFGLAQQGNAPKALASVDKRGVPVNTILVSALVTALCVLINYLAPESAFGLLMALVVSALVINWAMISLAHMKFRRAKQEQGVVTRFPALLYPLGNWICLLFMAAVLVIMLMTPGMAISVYLIPVWLIVLGIGYLFKEKTAKAVKAH

SEQ ID NO: 2929 - protein, 355 aa, Buchnera aphidicola
MKQKILFIDRDGTLIHEPSNDCQVDAINKLEFKKYIISSLCQLMNFGYKFVMVTNQDGLGSKSFPRENFNIPHFFMLNIFRSEGIIFEDVLICPHFLDDNCDCRKPQTKLLKPWLKKNKIDKQRSYVIGDRETDMELAKNINLTGIQYKEKEFNWIDITKEIIKRNRYREVIRETKETYIHIKLWLDLEHHSCIQTGINFFDHMLEQLSIHSGISMYILAKGDLQIDDHHTIEDTGIVLGEALSQALNNKNGLSRYGFVLPMDESQAKCIIDLSNRPYLSFNAHFKHKMVGDMNTDMVEHFFYSLCCSMKITLHIDVKGKNDHHCIESLFKAFGRALRKAVKIEGNTLPTSKGIL

SEQ ID NO: 2930 - protein, 150 aa, Brassica napus
  misc_feature (148)..(148): Xaa can be any naturally occurring amino acid
MNALAATNRNFKLASRLLGLDSKLEQSLLIPFREIKVECTIPKDDGTLASFVGFRVQHDNARGPMKGGIRYHPEVEPDEVNALAQLMTWKTAVAKIPYGGAKGGIGCDTSELSISELERLTRVFTQKIHDLIGIHTDVPAPDMGTGSXTM

SEQ ID NO: 2931 - protein, 279 aa, Unknown
  Frankia sp. EAN1pec
MSRTIRAALVQARWTGDRETMIKAHEEHARSAAALGAQVICFQELFYGPYFCQVQDAAFYSYAESVPGPIVDRFAALAAELGIVMILPVYEQEQPGILYNTAAVVDADGSFLGKYRKTHIPHVAGFWEKFYFRPGNLGYPVFDTAVGRIGVYICYDRHFPEGWRALGLNGAELVFNPSATSRGLSNYLWKLEQPAAAVANEYYVGAVNRVGVEDLGDDDFYGTSYFVDPEGTFVDGTADAHEPELLVRDLDMSLLTTVRNRWAFYRDRRPDTYGDLTAP

SEQ ID NO: 2932 - protein, 392 aa, Xanthobacter autotrophicus
MSAPVVIVGAGQAAAQAVTSLKAEGYAGDIIVIGDEPYLPYQRPPLSKAYLGDEMTEDRLELKAPKFYADAGAELRLATRVARLLPSEKAVELADGSRLAYGALLIATGTRARALPVPGAELAGLFSIRSIDDVKHFRASAVPGAKLVIIGGGYIGLEVAAKAKKLGLEVTVVEGQPRLLARVACATISDFARTLHEGNGVTILTGMGVARLVGTERVTGVELADGRVLPADLVLSAVGAVPNAELASEAGLVLENGISVDEATRTSAPDIYAAGDVASFPSRLYGRRVRLESVQNAIDQAKAAAKAITGGGVVYDPIPWFWSDQYDVKLQIAGLLDGCERTETEGEVAAGRFCVRYFAGDRLLAVCSVNDPKSHMLARKALATPPPVPAPG

SEQ ID NO: 2933 - protein, 571 aa, Enterococcus faecalis
MSEVYKKKERLMKNYPVKKNDVIEVEIIDLTHEGLGVAKVDHYPLFIENALPGEKLEIKVLKTGKSFGYGKVLTVLKSSEQRVPVKDENFTKVGISPLQHLAYGAQLSFKTQQVENVMQRVAKLQEVPVLPTIGMNDPWHYRNKAQIPVRKIDNQLQTGFFRKNSHDLIPMEHFYIQDPEIDAAIVKIRDIMRKYSVKPYNESDNTGNLRHIVVRRGYHTGEMMVVLITRTPKLFPISKIVPDILEAIPEVVSIVQNVNPKRTNVIFGDETILLHGSEKITDTIFDLKFEISARSFYQVNPQQTEVMYQKVKEYAALTGNEIVVDAYCGIGTIGLTLAQDAKQVYGIEVIEEAVKDAENNAKLNNIENATFTAGLAEELLPKLVENGLQPDVVVVDPPRKGLDGQLVNTLIETQPERIVYVSCNPATLARDIALLTEGGYEAKEIQPVDNFPQTTHIETVVLLSHKKPDGHINVKVEFGEGDGKVPLDNIAKRAESYKPKERVTYKMIKEYIEAKYGFKVHTAYIAEVKRDLGLPMYDAPNAVEELKQPRKHPTPEKVEAIKDALKHFEVI

SEQ ID NO: 2934 - protein, 454 aa, Xanthobacter autotrophicus
MAQQKQFLSQPFAGYLNEPAPEENVELTHIEKGSAAGELLRRYWQPVALTSEIKDVPLGIRMFGEDLVVFRNTAGEYGILDRHCPHRGTSLEFGLPTECGLRCCYHGWLFGMDGKVLETPGDPPGSTLKDRLYHAAYPAREYKGLVFGYFGPIEAMPEFPIYDSYEHPDDKLVPYCVTYPCNWLQVLENVMDPAHAVFLHTRVTFSHFSDTWGELPVMDFVETPTGMIYVTTRRWKDKVWVRSNDILMPNLAQVGHIWEDGQEAKQFGRVGITRWTTPIDNQTCRVIGWRHFHPDVDPRGLAKEEECGVEKVDFYGQGIGASFEERQRLPGDYDAIVSQRPIAVHALEHLTYCDKGVVMLRKLLRRDIRGLAAGEERAASPLRSNGLIPTYCHDTVLDIPPIDGVDDLELLEEVGRRVTEIIIEGEHHSADDRIEIVRRKLLEYQRSLLPRAAE

SEQ ID NO: 2935 - protein, 134 aa, Helianthus annuus
GVGYSWIDGLKSHAEQHVTNKMMLNAERIFPHNTPVTKEAYYYRMIFERFFPQNSAKLTVPGGASVACSTAKAIEWEGFWSNNLDPSGRGALGVHNAAYKKKSGSISPAKLAPSIADNVPRMMDITGPEIVIRS

SEQ ID NO: 2936 - protein, 444 aa, Unknown
  delta proteobacterium MLMS-1
MEKVTEFMKVVTDKNPGESEFHQAVLEVVETLMPFIEDNPKYRETKILERMVEPERVIIFRVPWVDDKGEVQINRGYRIQMNSAIGPYKGGLRFHPSVNLSILKFLAFEQVFKNSLTTLPMGGGKGGSDFDPKGKSDNEVMRFCQSFMTELYRHIGAETDVPAGDIGVGGREIGFMFGQYRKITNEFTGVLTGKSRNWGGSLIRPEATGYGAVFFAEEMFKVRGDSLAGKTCIVSGSGNVAQYTIEKVNQLGGKCVTLSDSAGFIHDPEGIDDEKLAYVMELKNVKRGRISEYAEKYGCKYYPGERPWKIPGDVAFPSATQNEIDAQDAETLVAGGCTCVSEGANMPSTSEAVRIFLKAKIMYGPGKAANAGGVATSGLEMSQNSLKLSWPREEVEERLRQIMEGIHEACYKYGKEGDFVNYVKGANIAGFVKVADAMIEQGVI

SEQ ID NO: 2937 - protein, 729 aa, Triticum aestivum
  misc_feature (120)..(120): Xaa can be any naturally occurring amino acid
MARHFASAGAGAVQRYYCGGACDGGDDGAVQAMLQCQRVSDFLIAASYLSIPLELLYFASCAGPAPLKWLLLQLAAFAVLGGATHLLAVFPLAHPHSSGLLLASTAAKLLAALVSFATAXVSLVALIPRLIRAKLREAFLRAKARQLDRDLGLIRRRVEATSRVVRMLTHRIRSSPLDAHSVLHTTMLHLADALELHSCAVWMPGQDAGADLHLVHQLSLRGKGPVRVVLGSQAPISPDDPDVVDVMASEAAKVLRPGSELATASSGELQPPGAVAAIRIPMLKVSNFDGGKTPVASSYAILVLALRSKASGSGYREWSGHDMEVVQVIADQVAVALSHAAVLEEWQAMSNRLAEQNRALLHAKQDAMMATEGINSIQSAMCEGMRRPMYSIIGLLSMVRQAKDMRPEQRLVADAIARTSTLSLALMNDVDTETLTVNRMPFDLHSLMREAMSVAGCLASCGGAGFSYQLENGLPEWVVGDETRVFHLLLQMAGDVLGQRRDGAGRLSFSIKSCSADQKNCIPVWPNLSAGCSICVEFQVAMERSTGCSQPPSSPASSQINMCKKIVQMMNGTMWSALDGESITLILHFQLQQSHVCRRTSSSIPHFNGLRILLADGDDMSRAVTQKLLEELGCQVISVSSGTHCLALLGSAGSSFQLLLLDLDMDAFEVALQIRGLKNRRWLLIVAALAVTVDDNIREMCRHSGINGLIQKPLTLTALGGQLHRVLRN

SEQ ID NO: 2938 - protein, 450 aa, Clostridium perfringens
MKKGLVVDLSKAAPYLKSHEVAYMQETINQAHNKLHNGTGAGNDFLGWVDLPVNYDKDEFARIKEAAKKIQSDSDVLVVIGIGGSYLGARAAIEMLTNNFYNSMSKDKRKTPAIFYAGNNISSSYMADLLKAIDGLDVSLNVISKSGTTTEPAIAFRILKDYMEKKYGKEEAKKRIYATTDAKKGALKTLADAEGYETFVIPDDVGGRFSVLTAVGLLPIAAAGINIDEMMEGAADAREEYANPSLADNECYKYAAARNALYNKGKAIEILVNYEPSVHYFNEWWKQLYGESEGKDNKGLFPAAVDFSTDLHSMGQYIQEGRRDIFETVINVGSPREEIVIEANDENIDGLNFLAGKTMDYVNKQAFRGTLLAHNDGEVPNVVVNVPELTPYYFGRLVYFFEKACGISGYVLGINPFDQPGVEAYKKNMFALLGKPGFEDLKAELEERLK

SEQ ID NO: 2939 - protein, 564 aa, Unknown
  delta proteobacterium MLMS-1
MFCYQCEQTAKGEGCKTIGVCGKKPEVAALQDLLIYALQGLSLVAVAGRKVGVNDGEVNLFTCEAVFSTLTNVDFDPERFVALIKRTVSLREALLPKVQAAGGQVDSSVAAVTFTPAADQAEMVKQGEEIDMKNSADDDADIQSLKHILLFGLKGVAAYADHAKILGQEDDQVYAFIQEGLVNLLRRDMGLQDWVGLVLKCGEINLRAMELLDAGNTGSYGHPVPTEVPLGAKAGKAILVSGHDLKDLEMLLKQTEGKGINIYTHGEMLPAHGYPELKKYPHFYGHYGTAWQNQHKEFGEFPGAILMTTNCIQKPQESYKGNIFTTGLVGWPAVAHVDDHGCPSLLDKVKSAVGLNYAGQGKDFTPVIKKAQELPGFAADTDKGKVMVGFGRNAVMGVADKVIEAVKGKDIRHFFLVAGCDGAKPGRNYYTEFVEKVPGDCVVLTLACGKFRFFDKDLGDIGGIPRLLDVGQCNDAYSAIQIAVALSQAFECEVNDLPLSLVLSWYEQKAVAILLTLLHLGIKDIRLGPSLPAFVTPNVLNVLVENFDIKPISTPDEDLKAILG

SEQ ID NO: 2940 - protein, 72 aa, Staphylococcus epidermidis
MAKQDVIELEGTVLDTLPNAMFKVELENGHEILAHVSGKIRMNYIRILPGDKVTVEMSPYDLSRGRITYRYK

SEQ ID NO: 2941 - protein, 566 aa, Clostridium perfringens
MSKKIVIVGGVAGGASTAARLRRLDENNQIIMFERGPHVSFSNCCLPYYLSGKVENHEDLVLMTPEKFYSQYRIDARVYTEVVSINRKAKEVTVRNVVSGQEYTESYDKLVLSPGAKAIVPPIKGIEDVNVFTVRNVVDIAKLDSFIKDNNSKNISVIGGGFIGVEVAENLHEAGYNVTLIEAMDQIMKPFDYDMVQVLHKEMYDKGVNLIVGDKVSSFESGKVVLESGKKINSDAVVMAIGIAPETDLAREAGLEIGQTGAIKVNQNYLTNDKDIYAVGDAVEVYNSLTNSISRLPLAGPAQKQARAVADHIHGRPSRNSGYIGSSCVQIFDYNGASTGLTEGQIKAMNLSLNYDIVRVIPQDKVGLMPGSEPLHFKLIFEVPTGRILGAQAIGKGNADKRVDIIATLIKMGGTVEDLKDLELCYAPPFGTAKDVVNHAALVASNLLEGTFKQVYVHEVRDLVESGACIIDVREVSEYEAGHIKGAKNLPLSEIRDRLDEIPTDRPVYLHCRSAQRSYNACLALQHLGFDNIYNVSGGFMGISFYEYYNDKVQDREPIVTEYNFN

SEQ ID NO: 2942 - protein, 121 aa, Mycobacterium tuberculosis
DRWGSMTDSEKSATIKVTDASFATDVLSSNKPVLVDFWATWCGPCKMVAPVLEEIATERATDLTVAKLDVDTNPETARNFQVVSIPTLILFKDGQPVKRIVGAKGKAALLRELSDVVPNLN

SEQ ID NO: 2943 - protein, 196 aa, Myxococcus xanthus
MKTLPLLTLASALAFTPALAAAPKPPPPAKSEPTSEKKPMSFHHLSANRLDGKPETLSGYQGKVVLVVNTASECGYTPQYAGLEKLHQEYKDKGLVVVGFPSNDFGGQEPGSSEEIKKFCELRYKVTFPMFEKVKTKGDGQSPVYAFLSQHHPAPKWNFHKYVVGKDGQVKAGFPSAVTPDSAELKAAIDSALAQP

SEQ ID NO: 2944 - protein, 508 aa, Desulfotalea psychrophila
MNKSYKILLTGSVIAIGAMGLMANSINSREAERKEINTGPVVQAEGVASKNEEWYRYYPREYDSWKQTKKSDKITDLLREKPQLAIIWAGYGFAKDYNAPRGHFYAIQDNINTLRTGAPTGPSNGPMPTACWTCKSPDVPRLMDEVGENEFFTGKWAKYGNQIVNPIGCADCHNSQTGNLGFSRPHLGRALEASGVNLDEITFQDMRTLVCAQCHVEYYFRPTEWTDKTGKTKTAKVVTLPWAKGLSAENMEEYYDEYSFKDWTHKISKAPMLKAQHPGYELFSKGIHAQNGVSCADCHMPYKQQGSIKYTDHNIGNPLDDIASTCLTCHRDSEKAFRDRVASKLERKEQLMKMAMDTLAAAHLEAGKAWELGATEAEMQPVLELLRSGQWLWDYSIASHGSFFHSPEETLRLLGVANDKGGKARIKLAAILAQHGLIGYQVPDFSTKEKAQALAGVPLQKLITEKKAFESTLLEQWNEEAVKAGRLDPKTLEGMSNKSSWSQTELSQ

SEQ ID NO: 2945 - protein, 630 aa, Unknown
  Candidatus Desulfococcus oleovorans Hxd3
MCGISGIITRSLAENQVLARLERMGQLQRHRGPDDRREQVFDGPEDRRIGLGLARLSILDLETGMQPIVCPEDGAAIVCNGQVYNYLELRRELAGQSFVSKGDIETALHTYRKKGLDFVNDLNGMYGGAIYDPVNHRVVLFRDRFGIKPLYYTTHKGTFVFASEIKPLLAGSGRPARLNEARLATFFTYRYVPGEQTLFEGVLRLPPASFLIYDLRTGKHEIHRYWNYQPDRPEPAMTPEAAQETFYDLFSDAVRIRLRSDVEVGALVSGGIDSSAVASQAVALRGPARLFTIAFEEQAYNELADVNAFLAANSGRFAGCDHIVQSCDRLMLERLPGIVESLEEPVSLGTVLPTDQVCELAGSHLKVVVTGEGADEIFAGYRKFLVEAAAHAYPTLLPADQKELAATYPELLPYLAVRHGDPAKRYIQSELLFDAPFLEQLLGRGGLDTAFPADALPTVDPAGHPVNTAIAFECRARLPDYVILRLDKLSMRHSLETRTPFLDYRLAEFAARLPVHLKLDTFAGMEKVVCRQAFERFGVLDRQTAFRKKKPFTIPLAPWLSEPDRLPEPIQEVVRGDMVARQGIVDPAIFKRLVENITSDNIGPHTLVSEADRVFAVIVFTLWYDRFMEK

SEQ ID NO: 2946 - protein, 286 aa, Oryza sativa
MQSIDGVDQVLNHGVPVELTLSVLAVAHDFFRLPAEEKAKLYSDDPAKKIRLSTSFNVRKETVHNWRDYLRLHCYPLHRYLPDWPSNPPSFREIISTYCKEVRELGFRLYGAISESLGLEQDYIKKVLGEQEQHMAVNFYPKCPEPELTFGLPAHTDPNALTILLMDQQVAGLQVLKEGRWIAVNPQPNALVINIGDQLQALSNGRYKSVWHRAVVNSDKARMSVASFLCPCNDVLIGPAQKLITDGSPAVYRNYTYDEYYKKFWSRNLDQEHCLELFRTTPTDTS

SEQ ID NO: 2947 - protein, 127 aa, Agrobacterium tumefaciens
MEGQRCIALIAHDEKKDDMADFARHHQKVLASFRIVATGTTGGRVQEACPGLEVIRLKSGPLGGDQQIGAMIATGEVDMLIFFTDPLTAMPHDVDVKALTRLATVYDIPMALNRATAENLIDFNSAD

SEQ ID NO: 2948 - protein, 113 aa, Hordeum vulgare
MTEKKNRREKKNPREAKVTFEGLVTEALPNGMFRVRLENDTIILGYISGKIRSSSIRILMGDRVKIEVSRYDSSKGRIIYRLPHKDSKRIEDSKDSEDLKDSEDLKNTKDSKD

SEQ ID NO: 2949 - protein, 294 aa, Streptococcus acidominimus
YHPDINKDPGAEDKYKEVQEAYETLSDPQKRSAYDQYGSAGANGGFGGGAGGFSGFDGAGFGGFEDIFSSFFGGGGATRNPNAPRQGDNLQYAINLKFEEAIFGVEKEVSYHREAVCRTCTGSGAKPGTSPVTCGRCHGTGVINVDTQTPLGTMRRQMTCDVCHGRGKQIKEPCQICRGTGHEKQAHTVTVKVPAGVETGQRIRLAGQGEAGFNGGPYGDLYVVVQVQASDKFEREGTTILYKLDLNFVQAALGDTVHVPTVHGDVDMVIPEGTQTGRTFRLKGKGAPSIRGGA

SEQ ID NO: 2950 - protein, 340 aa, Gibberella zeae
MQMATERHFYYHGKEGYQEECSNCHWCQIRSFPTHSTLPVTVVNEQDFEVLPDDFRFIKNVVLGVGVRQAEDSFHSGCSCDNDAECQFTGCHCLADLDEEDSSEDDDDPFGDFINGMDIDRPRRKAYAYHAHGAKAGLLRSKFHNSKMPIYECHQSCACSINCPNRVVERGRTIPLEIFRTEDRGWGVRSPVSIRKGQFVDRYLGEIITSTEADRRRSQSAISQRKDVYLFALDKFTDPDSLDTRLKGPSLEVDGEFMSGPTRFVNHSCEPNMRIFARVGDHADKHIHDLALFAIKDIPRGEELTFDYVDGVSHEGEEPGEKSHMTPCLCGSKNCRKFLW

SEQ ID NO: 2951 - protein, 473 aa, Buchnera aphidicola
MLKQQVGVIGMAVMGRNLALNIESKKYTVSIFNRTQSVTEEVINNNKEKKIFPYFSIKDFVNSLRKPRCILLMVKSGQPTDETIQFILPYLNKGDILIDGGNTFYKDSIRRSNDLMKCGINFIGMGVSGGELGALNGPSIMPGGSREAYDLVSSMLKKISAKFKNEPCVSYIGPNGAGHYVKMIHNGIEYGDMQLISESYFILKNVLNMKNEELSNTFSQWNKGELNSYLIEITKNIFLKKEKDGIHYLIDSILDHAEDKGTGKWISQDALELHEPLSLITESVFARYLSSLKDQRLIASKILKGPILKCISSQNKELFVEEVRRALYLGKIISYAQGFSQLKKASEKYSWNLQYGKIAKIFRAGCIIRADFLERITDAFKSNNVTNLLLTPYFSEISNKYEKSLRYITSYAIKYGIPVPTFASAISYYDNYRTMSSSANLIQAQRDYFGAHTYRRTDKKGYFHTNWLTKKEL

SEQ ID NO: 2952 - protein, 838 aa, Anaplasma phagocytophilum
MFDITRKCVEWGDRSLTIESGKIARQAGGAVVVDYGGTSVLATVVSQKSKEAVDFLPLTVQFLAKSYAVGKIPGGFFKREGKPSDRETLISRIIDRSIRPLFPSGFSDEVAVVCNLLSYDASSPPETVALIGASAALAISGIPFHCPVAGARIGYIRGEGRYILNPSADELSVSALDMFYARTDTSILMVESEAHELTEAEMLGALQFGHEHCEEIIKVIGEFAEEARKCAPAEFVPCDLSTIIDSIGSDYKERFLVAYSEKEKKARVAKLDAVRASLTEDLRVKFLSESEGGSKYIAQDIVYAMKTFERSLVRERVLESKSRIDGRAYDQIRNIEIEVDLISKAHGSALFTRGDTQALVITALGTPQDEQIVDGFDGDKRERFLLHYNFPPYAVGEASALRPPGRREIGHGKLAWRAIHPVLPSKADFPYTIRVVSEITESDGSSSMATVCGASLALMDTGVPLKSSVAGIAMGLIKEGDRYAILSDILGDEDYLGDMDFKVAGTREGITALQMDMKVKGIDFAVLGTALDQAKEGRFFIIEKMDRVIKESRGAVREHVPRMESMLIDKGKIKNVIGAGGKNVREICEKTGAKIEISQDGTVMIYAVGREAIESAKDMITGIVSEPEVGKIYSGEVCELAKYGAFVTFLGARKGLVHISEIRNEHINAVADVLAVGDKVKVLVIDMDKDHIQLSMRRIDQETGDQVDCELYAPQRRNGVAAGNTVGDSSVNGGGAGSVYVPRGDYGGASAGRNGRGGGKRDGAAKSSSSAGNGGGRSSSSTRRRHSAGSSGYSSDSSSGNTKSSSSESSGGTGGRGRNGANGDVQNGPAAPKKPRFF

SEQ ID NO: 2953 - protein, 284 aa, Streptococcus agalactiae
QRKNDKEVKKLMKPWSDTQKRAAYDQYGAAGANGGFGGFDGGGFGGFEDIFSSFFGGGGMRNPNAPRQGDDLQYRVNLSFEEAIFGAEKEVSYNRESSCHTCSGSGAKPGTSPVTCQKCHGSGVINVDTQTPLGTMRRQVTCDVCQGSGQEIKEKCPTCHGTGHEKKTHKVSVKIPAGVETGQQIRLTGQGEAGFNGGPYGDLFVIINVLPSQQFERNGSTIYYTLNISFVQAALGDTIDIPTVHGAVEMSIPAGTQTGKTFRLRGKGAPKLRGGGQGDQHVTV

SEQ ID NO: 2954 - protein, 246 aa, Yarrowia lipolytica
MSLPYAPLTHMPPQRSSNISLNEEVRLYSSPKERERYENLAELYSIIVSLDYLEKAFLKDSVSQQDYSSICTRLLSQYNTLLKDEGVQNEFVSLQHFKDKYGLDCSLATQRISVGIPASVVIASQASSALASTNIGGMDGGGRSTPTGEGPSTSRAVAEATGNFITCMDALKLNYSATDQLHPLLGDLMTSLGKVTNKDFAGRDKIVKWLITLNNMKATESITDDQSRQLLFDLDNAYKGFFAELD

SEQ ID NO: 2955 - protein, 1046 aa, Oryza sativa
MSGGGCSVRAIWILTPHDAVAFSRRFAVVEKRWRVAWEAEGGARAEMMPLPADYEVAAAFAERRRREGTARGSGIRTSMSSAGSDSWVDDPITRHIISLHIDKEEGEGFMLWPVVLQKRGSYYILVLPLVDPQSFKAYESLLKRSDCGSSAKEKGNLSSILLNLPCITGALMVAHVIGDIITGDTAEPEVIVSTGPSVGGLLDSLTGSIGISARPKPIAAPVAAPTASISSPVGAPQSESLKGGMRPFDKDLLRNFILGAMPFGTPQDLNYANVTSVRTTGFSADPLPTDQKQPAWKPYLYKGRQRTLFSSLETLNAALYDRDDVQDFLSVSGQVTCRAELEGLPDVSLPLSGLKAAHVEVSSFHHCVQASEPTNDKQTLIFQPPLGNFVLMHYQASCNMDPPVKGFYQLSMVSENEGAFLFKLRLMEGYKSPFLMEFCMVTMPFPRRRVASYDGNPSVGTVSMTEHSIEWRIVSSGRGLSGRSIEATFSGTVRFHPITIQRVNSSFRSVPSTAFVEDSDSEQDNTKNGANLDDYLMEKMNKDLQAVNLEEPLSWQAYNYAKVSFKIVGGTLSGLTIDPKSVTIYPSVKAPVEYSMQRSGTVPGVGLVHAPFSLLPTHLPESHWRQACELAPIFNELVDRVSLDGDFLQDSLSKTKQVDDFTSRLLEIHRKMMEINKEENIRLGLHRSDYMLDSETNSLLQIELNTISASFPGLGSLVSELHRTLIDQYGHLFCLDSKRVPGNEASSQFAKALARAWDEFNVDSAVIMMIVQPEERNMYDQYWLAKHLKESYPFMLFLSSTWSKHKIYTPLTIHYTWHNDYQENFVRDGKTVSVVYFRAGYTPNDYPSEAEWAARLLLEQSSAVKCPSISYHLVGTKKIQQELARPNVLERFLENKEEITKIRKCFAGLWSLDDEEIVKSTIQKPELFVLKPQREGGGNNIYGIDVRETLIRLQKEGGDALAAYILMQRIFPKASLSNLVRGGVCHEALTISELGIYGAYLRNNDKVVMNEQSGYLMRTKVSSSDEGGVAAGFAVLDSLYLTDKAM

SEQ ID NO: 2956 - protein, 200 aa, Oryza sativa
MSEGAAGTTRLPEWLETLLSTRFFLACGAHPASPRNECNMFCLDCPSPSPPFCYYCRSHRHQSHRVIQIRRSSYHDVVRVTEVEDVLDISGVQTYVINSAKVLFLNERPQPRGAGAAAGKAAASPYNCQICARALLDPFRFCSLGCKLVDTKTGGRGATVQPGDATNDDAAAAGGSSKNGGARPQGRRRKGIPQRAPFGS

SEQ ID NO: 2957 - protein, 225 aa, Amaranthus tricolor
KWHVIMACRDFLKAERAAKSAGMAKENYTIMHLDLASLDSVRQFVNNFRQSGRPLDVLVCNAAVYLPTAREPTYTAEGFELSVGTNHLGHFLLSRLLLEDLKKSDYPSTRLIIVGSITGNTNTLAGNVPPKANLGDMRGLAGGLNGLNSSAMIDGGDFDGAKAYKDSKVCNMLTMQEFHRRYHEETGITFASLYPGCIATTGLFREHIPLFRFLFPPFQKYITKG

SEQ ID NO: 2958 - protein, 525 aa, Unknown
  Shewanella sp. ANA-3
MLDANLKNQLQTYLQNLKRPVELVVSADESKKSQELKSLANDIVSLSSLVSLKEAQGSRTPAMTVVNTDLNTQISFAGLPMGHEFTSLVLALLHTGGHPIKLSDEVIEQIRNLPGKYEFETYVSLTCQNCPDVIQALNMMAAINPNITNVMIDGALFQDEVASRNIMAVPSVYLNGEVFAAGRISIGEILNKLDTGAASRKAEELSQKAPYEVLVVGGGPAGAAAAIYAARKGLRTGVVADKFGGQVAETVGIENFISVKATEGPKLVANLEAHVRDYEVDIMDNQKAVKLASDGLFELELASGATLRSRTILLATGARWREMNVPGEKEYRGKGVAYCPHCDGPLFKGKRVAVIGGGNSGIEAAIDLANIVEHVTVLEFDSKLRADDVLQRKAASMGNIHIITQAMTTEVTGDGTRVNGLNYTDRATGESHHIALAGIFVQIGLVPNAEWLKGTVDLTPRGEIIVDERGQTSIPGVFAAGDVTNSPYKQIIIAMGSGANASLGAFDYLIRHSDDSAETTETKAA

SEQ ID NO: 2959 - protein, 183 aa, Escherichia coli
MQDSILTTVVKDIDGEVTTLEKFAGNVLLIVNVASKCGLTPQYEQLENIQKAWVDRGFMVLGFPCNQFLEQEPGSDEEIKTYCTTTWGVTFPMFSKIEVNGEGRHPLYQKLIAAAPTAVAPEESGFYARMVSKGRAPLYPDDILWNFEKFLVGRDGKVIQRFSPDMTPEDPIVMESIKLALAK

SEQ ID NO: 2960 - protein, 154 aa, Amaranthus tricolor
DYGWDTAGLSADPETFAKNRELEVIHCRWAMLGALGCIFPELLARNGVKFGEAVWFKAGSQIFSEGGLDYLGNPTLIHAQSILAIWACQVILMGAVEGYRIAGGPLGEVVDPLYPGGSFDPLGLADDPDAFAELKVKEIKNGRLAMFSMFGFFV

SEQ ID NO: 2961 - protein, 316 aa, Medicago truncatula
MGKASRDKRDIYYRKAKEEGWRARSAFKLLQIDEEFNIFEGVKRVVDLCAAPGSWSQVLSRKLYLPAKLAPDAKDENLPLIVAIDLQPMAPIEGVIQVQGDITNARTAEVVIRHFDGCKANLVVCDGAPDVTGLHDMDEFVQSQLILAGLTIVTHVLKEGGKFIAKIFRGKDTSLLYCQLKLFFPVVTFAKPKSSRNSSIEAFAVCENYSPPEGFNPKDLHRLLEKVGSPSGVDDTDCVSGWLEGPNKVYIPFLACGDLTGYDSDRSYPLPKVAGGTYQSLDPVQPPIAPPYKRALELKKASPQGFRELENLSLDS

SEQ ID NO: 2962 - protein, 224 aa, Amaranthus tricolor
KWHVIMACRDFLKAERAAKRIGMPKDSYTVMHLDLASLESVRQFVENFRRSGMPLDVLVCNAAVYLPTDKEPTFTAEGFELSVGTNHLGHFLLSRLLLDDLKQSDYPSKRLIIVGSITGNSNTLAGNVPPKANLGDLRGLAGGLNGVNSSPMIDGGEFDGAKAYKDSKVCNMLTMQEFHRRFHEETGITFSSLYPGCIAETGLFRNHVALFRTLFPPFQKYITK

SEQ ID NO: 2963 - protein, 319 aa, Clostridium acetobutylicum
MKTIAVLTSGGDAPGMNAAIRAVVRTAIEKGINVKGIQGGYSGLINGEIFDMNRHSVSDIIQRGGTILRTARCPEFLKEEVRQKAANVLRVFGIDGLVVIGGNGSFMGAQKLSKLGVKTVGLPGTIDNDLPYTDYTIGFDTTLNTVLDAINKLRDTSTSHERVSIIEVMGRDCGDIALFSGIAGGAESVIIPEIGYDFNELCKNILEGKLRGKMHNLIILAEGVGGAAELAKKVEEVTGIETRSTILGHIQRGGSPSAFDRMLASRMGVKAVEVLMEGKTSRVIGIKEGKIMDQDIDEALAVPRSFNKELYDIANMLSK

SEQ ID NO: 2964 - protein, 367 aa, Prochlorococcus marinus
MSATPTEQVQDSAAESTSSEQVINTASETAEAANQALAEEDLSIPEDVPTADDPSSRAAKNDLSGAGFTLDEFASLLSKYDYNFKPGDIVNGTVFALESKGAMIDIGAKTAAFMPLQEVSINRVEGLSDVLLPGEIREFFIMSEENEDGQLSLSIRRIEYQRAWERVRQLQKEDATIYSEVFATNRGGALVRVEGLRGFIPGSHISTRKPKEELVADFLPLKFLEVDEERNRLVLSHRRALVERKMNRLEVGEVVIGAVRGIKPYGAFIDIGGVSGLLHISEISHEHIETPHSVLNVNDQMKVMIIDLDAERGRISLSTKALEPEPGDMLTDPQKVFDKAEEMAARYKQMLLEQAEEGEDPEVVPLD

SEQ ID NO: 2965 - protein, 194 aa, Rhizobium leguminosarum
DVFPTLEQLPLWGFDGSSTQQAEGRSSDCVLKPVAIYPDPARTNGALVMCEVMMPDGVTPHASNARATILDDEDAWFGFEQEYFFYQNGRPLGFPEQGYPAPQGPYYTGVGYSNVGDVAREIVEEHLDLCLAAGINHEGINAEVAKGQWEFQIFGKGSKKAADQIWMARYLLQRLTEKYGIDIEYHCKPLGDTD

SEQ ID NO: 2966 - protein, 154 aa, Amaranthus tricolor
DYGWDTAGLSADPETFAKNRELEVIHCRWAMLGALGCVFPELLARNGVKFGEAVWFKAGSQIFSEGGLDYLGNPSLIHAQSILAIWACQVILMGAVEGYRIAGGPLGEVVDPLYPGGSFDPLGLADDPDAFAELKVKEIKNGRLAMFSMFGFFV

SEQ ID NO: 2967 - protein, 156 aa, Amaranthus tricolor
DYGWDTAGLSADPEAFARNRALEVIHGRWAMLGALGCITPEVLQKWVRVSFKEPVWFKAGAQIFSEGGLDYLGNPNLVHAQSILAVLGFQVVLMGLVEGFRINGLDGVGEGNDLYPGGQYFDPLGLADDPVPFAELKVKEIKNGRLAMFSMFGFFV

SEQ ID NO: 2968 - protein, 240 aa, Triticum aestivum
  misc_feature (141)..(141): Xaa can be any naturally occurring amino acid
MANASLQSFLPQHHHSFLSSATHDGSPPALLKLTTTTASNSISFKLFASGSSSVTTTANSPAPTPAATTSPPTPSLELLGQQLAAGDYRQADETTRALLIVLAGEAARRRGYVFFSEVQFISVEDLRAVDALWLEHSGGRXFGYSVQRRVWEKSLREFTRFFIRIGWMKKLDTGGGAVSTTGPFPDEVHLGSSPTDTPGGATWPLTNAPSGARRLPGRKSFTPPRLFNWGRKEEGSLAPK

SEQ ID NO: 2969 - protein, 203 aa, Glycine max
TLKFVILHVLKAGDGGAGGGISLTGTWWDKKALAIAKEVTLSFDGELQIYAFRTLVNCTIQVHIENLSKKSGSPSMEDIEAFSTTYRAKLDEAEIAKVVPDNICLEVSSPGVERIVRIPDDLDRFKDRPMYVKYAINDDQNNPAAEGDGVFRLESFDMETKCCTWGLADVTVNRQKAGKGKRLNKEQREWRLSTPFDSLRFVR

SEQ ID NO: 2970 - protein, 80 aa, Sclerotinia sclerotiorum
MWPGQAMSLKVEKVLHVEKSKYQDVLVFKSTDYGNVLVLDDCIQCTERDEFSYQEMIAHLALNSHPNPKKALVIGGGDGG

SEQ ID NO: 2971 - protein, 330 aa, Chlamydophila caviae
MIMKLMRTVSVAVTGGTGQIAYSFLFALAHGDVFGSDCSIDLRVYDLPGLERALSGVRMELDDCAYPLLQSLRVTTSLEDACDGIDAAFLIGAAPRGPGMERSDLLKRNGEIFSLQGSVLNVCAKRDAKIFVVGNPVNTNCWIAMNKAPKLNRRNFHSMLRLDQNRMHTMLAHRAEVPLDEVTNVVVWGNHSAKQVPDFTQALISGKPAVEVISDRDWLENIMFPSIQNRGSAVIEARGKSSAGSAARALAEAARSIFLPKDGEWFSSGVCSDYNPYGIPDDLIFGFPCRMLPSGDYEIVPGLPWDAFIKNKIQISLDEISQEKASVSLL

SEQ ID NO: 2972 - protein, 795 aa, Aspergillus nidulans
MAPTVATQPPPPKRRRIGVLTSGGDAPGMNGAVRAVVRMAIHSDCEAYAVYEGYEGLVEGGDMIRQLHWEDVRGWLSQGGTLIGSARCMSFRERSGRLRAAKNMVLRGIDALVVCGGDGSLTGADVFRSEWPGLLDELVKNGELTAEQVEPYRVLNIVGLVGSIDNDMSGTDATIGCYSSLTRICDAVDDVFDTAFSHQRGFVIEVMGRHCGWLALMAAISTGADWLFIPEMPPKDGWEDIMCANITKNRRERGKRRTIVIVAEGAQDRNLNKITSDRVKDILTERLGLDTRTTILGHTQRGGAACAYDRSLSTLQGVEAVRAVLDMTPDSPSPVITIRENKIMRTPLMDAVKATQEVTAHIKNREFEKAMLLRDSEFKEYHFAYLKTATPDHPKLSLTQEKRMRIAIVHVGAPAGGMNQATRAAVTYCLTRGHTPIAIHNGFPGLIRHHADQPISSVREVKWQETDAWVNEGGSDIGTNRGLPSEDYDEVARCFKEHKFDALFVVGGFEAFTAVSQLRQARDKYDAFKIPMVVLPATISNNVPGTEYSLGSDTCLNALIDFCDAIRQSASSSRRRVFVIETQGGKSGYIATTAGLAVGAVAVYIPEEGIDIKMLARDIDFLRENFARDKGANRAGKIIMRNETASSTYTTQVIADMIKEEAKGRFESRAAVPGHFQQGGKPSPMDRIRALRMAIKCMMHLEGYAGKSKDEIANDEMSATVIGIKGSQVLFSVMGGEHGLEKVETDWARRRPKAEFWLQLQDTVNILSGRAGAKAMWTGYEDESRTRPSSPAHLS

SEQ ID NO: 2973 - protein, 527 aa, Chlamydophila caviae
MNKKGFLDSSSTKILQDLAVAPIDLTAPGVISKERIERFSLSVEGFTLSYATERVDEGILSALEDLASERGLIESMQAMQNGEVVNYIENFPSESRPALHTATRAWVKESPLQGNAEDISLRSKIEAQRLKDFLNRYRDVFTTIVQIGIGGSELGPKALHWALKGCCPSDKKVYFVSNVDPDNAAEVLQEIDCAKTLVVTVSKSGTTLETAVNEELLADHFLKQGLHFQDHFIAVTCEGSPMDDTSKYLEVFHIWDSIGGRYSSTSMVGGVVLGFAYGFDVFLQLLEGAASMDLAALEPRMSENLPLLSAMLGIWNRNFLRYPTSAVVPYATGLEYFPAHLQQCGMESNGKSVAQTGEVIGFATSPILWGEVGTNSQHSFFQCLHQGSDIVPIEFIGFQENQRGKDIVIAGSSSSQKLFANMVAQSIALAKGRENTNPNKNFRGNRPSSLLVSERLTPYTMGALLAFYEHKIVFQGFCWGINSFDQEGVTLGKDLANQVLQVMQGQEKEGALLEAEALLRLFNNIKK

SEQ ID NO: 2974 - protein, 103 aa, Schizosaccharomyces pombe
MSGRGKGGKGLGKGGAKRHRKILRDNIQGITKPAIRRLARRGGVKRISALVYEETRAVLKLFLENVIRDAVTYTEHAKRKTVTSLDVVYSLKRQGRTIYGFGG

SEQ ID NO: 2975 - protein, 194 aa, Glycine max
MDSFFVECCNCRLPGDYGFDPLGLGKDPAFLKWYREAELIHGRWAMAAVVGIFIGQAWSGVPWFEAGADPNAIAPFSFGSLLGTQLLLMGWVESKRWVDFFNPDSQSVEWATPWSKTAENFGNSTGEQGYPGGKFFDPLGFAGAIKDGVYIPDADKLERLKLAEIKHARIAMLAMLIFYFEAGQGKTPLGALGL

SEQ ID NO: 2976 - protein, 417 aa, Haemophilus influenzae
MLEQMGKQAKDAAFILAQLTTAEKNRALSIIAEQLEQQAPLILAENAKDIELAKQNELSDALIDRLLLTQERLQGIANDVRHVISLADPVGKIIDGGTLDSGLKIERVRTPLGVIGTIYEARPNVTIDVASLCLKTGNAVILRGGKETQFSNKILIEVVQNALEQAGLPKFAVQAITDPNRELVMQLLKLDRYVDMIIPRGGSDLHELCKQHSTIPVIVGGVGVCHTFVEESADQNKAIFVIDNAKTQRPSTCNTLETLLVQHSIAEEFLPKLVSHLSAKNVKYHAKPTALNILKQAGANVCEVTEKELRKEWGSLDLNVVVVEDIHAAIEHIRQYGTQHSESILTSSQNLARQFINQVDAAAVYVNASTRFTDGGQFGLGAEVAVSTQKLHARGPMGLEALTSYKWVCEGEYTVRK

SEQ ID NO: 2977 - protein, 310 aa, Mycobacterium leprae
MSIAEDVTQLVGNTPLVRLRRVTEGALADVVAKLESFNPANSVKDRIGVAMIDTAEEAGLIKPDTVILEPTSGNTGIALAMVCAARGYHCVLTMPETMSIERRMLLRAYGAELILTPGADGMSGAIAKAEELAKSDKRYFIPQQFENPANPAIHAATTAEEVWRDTDGKVDIFVSGIGTGGTITGVARIIKERRPATQFVAVEPAASPVLSGGQKGPHPIQGIGAGFVPSVLVLDLVDEIVTVGNEEALDLARRLAKEEGLLVGISAGAAVCAALHVARRPENTGKLIVVVLPDFGERYLSTMLFADLAN

SEQ ID NO: 2978 - protein, 291 aa, Aspergillus nidulans
MVFGSRPPALTEANIGDQSGKNNGTVYLAARNAKKTAEVIADLKQRFPASRGRLDSISLNLSDLSTIKKSAEEFLAKETRLHVLWNNAGVMFPPAGSTTSQGYELQLGTNNVGPHLFTKLLYPTLAATAKEAPKNTVRVVWVSSDAASWAPKPAIDFNNLDYRRNESDRSKYGRSKAGTVMQAVELARRARKDGSGIVSIALDPGIANTGLQRDMGRLMSTMVKLIANKPEIGAYTQLFAGLSPEITAEVAEKEWVVPPGKIGCPRRDLFTDTETSRKWWEWNEEQVKAYL

SEQ ID NO: 2979 - protein, 161 aa, Zea mays
  misc_feature (23)..(23): Xaa can be any naturally occurring amino acid
  misc_feature (37)..(37): Xaa can be any naturally occurring amino acid
  misc_feature (56)..(56): Xaa can be any naturally occurring amino acid
  misc_feature (60)..(60): Xaa can be any naturally occurring amino acid
  misc_feature (81)..(81): Xaa can be any naturally occurring amino acid
  misc_feature (121)..(121): Xaa can be any naturally occurring amino acid
MPRTPATCYPWIENKPYPPTRTXRAVPDLNMKTTRLXMKITSVDASPYCAFLAPSXRKMXFMDALEAARIACDRSRGHVSXDDMFDLQDGAHPFHDLRITEMLTSVRADGLHTTNDRRALXDPHALWALAHTGKNLLSVQGDTPNAADGTQTLRGTKLKIP

SEQ ID NO: 2980 - protein, 324 aa, Streptococcus anginosus
YHPDINKEPGAEEKYKEVQEAYETLSDEQKRAAYDQYGAAGANGGFGGGAGGFGGFDGSSFGGFEDIFSSFFGGGGASRNPNAPRQGDDLQYRVNLKFEEAIFGTDKEIKYNREATCHTCHGSGAKPGTNPVTCSRCHGAGVINVDTQTPLGMMRRQVTCDVCHGRGQEIKDPCQTCHGTGHEKQAHSVHVKIPAGVETGQQVRLSGQGEAGFNGGPYGDLYVVVQVESSDKFERDGSTIYYKLNLNFVQAALGDSVEIPTVHGDVELTIPEGTQTGKRFRLRGKGAPSLRGGSMGDQYVTVNVVTPTGLNDKQKAALKEFAEA

SEQ ID NO: 2981 - protein, 323 aa, Streptococcus canis
HPDINKEAGAEQKYKDVQEAYETLSDSQKRAAYDQYGAAGANGGFGSGAGGFGGFDGAGFGGFEDIFSSFFGGGGMRNPNAPRQGDDLQYRVNLSFEEAVFGVEKEVSYNREATCGTCAGSGAKPGTSPVTCRKCHGSGVMTVDTQTPLGMMRRQVTCDVCHGSGQEIKEPCPTCHGTGHEKKVHKVSVKIPAGVETGQQIRLQGQGEAGFNGGPYGDLFVILNVLPSKKFERNGSTIYYSLNITFTQAALGDTVDIPTVHGDVEMAIPAGTQTGKTFRLKGKGAPKLRGGGQGDQHVTVNIVTPTKLNEAQKEALRALLRQG

SEQ ID NO: 2982 - protein, 617 aa, Armoracia rusticana
MTTNKKTIVWFRRDLRIEDNPALAAAAHEGSVFPVFIWCPEEEGQFYPGRASRWWMKQSLAHLSQSLKALGSELTLIKTHNTVSAILDCIRITGATKVVFNHLYDPVSLVRDHTVKEKLVELGISVQSFNGDLLYEPWEIYFEKGKPFTNFSSYWKKCLDMSIESVMLPPPWRLMPISTAAEAVWACSIEELGLENETEKPSNALLTRAWSPGWSNADKILNEFIEKQLIDYAKNSKKVVGNSTSLLSPYLHYGEISIRRIFQCARMKQIIWARDKNSEGDESADLFLKGIGLREYSRYICFNFPFTHEQSLLSHLRFFPWDTDVDKFKAWRQGRTGYPLVDAGMRELWATGWMHNRLRVIVSSFAVKFLLLPWKWGMKYFWDTLLDADLECDILGWQYISGSLPDGHELDRLDNPAIQGAKYDPEGEYIRQWLPELARLPTEWIHHPWDAPLTVLKASGVELGTNYAKPIVDIDTARELLTKAISRTREAQIMIGAAPDEIVVDSFEALEGNTVKEPGLYPSVSSNDQQVPSAVRYNGSKRVKHVEEEERDMKKSRGFDEVMREERDLFSTAESSSSSTTVRFLVSHSCSLVSEGKSLEGIQDPSDQITTSLGKNC

SEQ ID NO: 2983 - protein, 483 aa, Pediococcus pentosaceus
MAEQGGSQVKRALKTRHISMISLGGSIGTGLFVASGSAISTAGPGGALLAYVGMGVMVYFLMTSLGEMATYMPVSGSFSTYATKYVDPAFGFAMGWNYWFNWAITVAVDISTIALIMKFWFPHAPGWIWSLLALVLVFLVNALTVKAFGETEYWIALIKLVTVIIFLVVGVLTIVGIMGGKATYLENFVYHKAPFVGGIPAILSVFVVAGFSFQGTELIGITAGESETPETSVPKAISQVFWRILLFYILAIFVIACIIPYTSPNLLGSSARDVSISPFTLVFRRAGLAGAAGVMNAVILTSVLSSANSGMYASTRMLYSLSKQGFAAKIFGKTSKRGIPYLALLGTTIVGLLTFISSIMGPKIYIWLVAASGLTGFVAWVGIAIAHWRFRRAFIKQGHDVSELRYRAKWFPFGPLFAFVLSIIVIAGQDIHSIANFDWQAIGITYMAIPLFIVLYTYYKIRYKTKLIPLEEIDLSRPDITKE

SEQ ID NO: 2984 - protein, 87 aa, Dechloromonas aromatica
MAKEELLEMQGVVNDVLPDTRFRVTLENGHELIAYTSGKMKKNHIRILVGDKVTLELSPYDLSKGRITFRHIENRGTPNPQAQRRRY

SEQ ID NO: 2985 - protein, 321 aa, Streptococcus criceti
DINKEPGAEEKYKEIQEAYDTLGDEQKRANYDQFGPEGAANGGFGGGAGGFSGFDSAGFGGFEDIFSSFFGGGGASRNPNAPRQGDDLQYRVNLKFEEAIFGTEKEVHYNREVTCHTCDGSGAKPGTSPVTCSKCHGSGVINVDTQTPLGMMRRQMTCDVCHGSGKEIKEPCPTCHGSGREKQRHKMAVTIPAGVETGHQVRVVGQGEAGFNGGPYGDLYVIINVLASDKFERDGSTIYYNLDINFVQAALGDTVEVPTVHGAVDLKIPAGTQAGKVIRIKGKGAPRLNGNGQGDQRVTVNVVTPTKLNEAQKEALQALLS

SEQ ID NO: 2986 - protein, 617 aa, Armoracia rusticana
MTTNKKTIVWFRRDLRIEDNPALAAAAHEGSVFPVFIWCPEEEGQFYPGRASRWWMKQSLAHLSQSLKALGSELTLIKTHNTVSAILDCIRITGATKVVFNHLYDPVSLVRDHTVKEKLVELGISVQSFNGDLLYEPWEIYFEKGKPFTNFSSYWKKCLDMSIESVMLPPPWRLMPISTAAEAVWACSIEELGLENEAEKPSNALLTRAWSPGWSNADKILNEFIEKQLIDYAKNSKKVVGNSTSLLSPYLHYGEISVRRIFQCARMKQIIWARDKNSEGDESADLFLKGIGLREYLGIYVSISRLLTSNLCGVIFVFSLGMADVDKFQGLETRQDWLSVGGCRNERALGYGCMHNRLRVIVSSFAVKFLLLPWKWGMKYFWDTLLDADLECDILGWQYISGSLPDGHELDRLDNPAIQGAKYDPEGEYIRQWLPELARLPTEWIHHPWDAPLTVLKASGVELGTNYAKPILDIDTARELLTKAISRTREAQIMIGAAPDEIVADSFEALEGNTVKEPGLYPSVSSNDQQVPSAVRYNGSKRVKHVEEEERDMKKSRGFDEVMREERDLFSTAESSSSSTTVRFLVSHSCSLVSEGKSLEGIQDPSDKITTSLGKNG

SEQ ID NO: 2987 - protein, 298 aa, Streptococcus cristatus
GAEEKYKEVQEAYETLSDDQKRAAYDQYGAAGANGGFGGAGGFGGFDGAGGFGGFEDIFSSFFGGGGASRNPNAPRQGDDLQYRVNLTFEEAIFGAEKEVKYNREASCRTCNGSGAKPGTSPVTCGRCHGAGVINVDTQTPLGMMRRQVTCDVCHGRGKEIKDPCTTCHGTGHEKQAHSVHVKIPAGVETGQQIRLAGQGEAGFNGGPYGDLYVVVSVEASDKFEREGTTIFYKLNLNIVQATLGDTVEIPTVHGDVELVIPEGTQTGKKFRLRGKGAPSLRGGAVGDQYVTVNVVTP

SEQ ID NO: 2988 - protein, 456 aa, Oryza sativa
MPTITHYVLDPLLETGSATQSQKAASKPPPAPPLPQEKAAEKPIPVPVAPVRRAQTASATLYATPESTSLPDSPSSFPGTWSPYLINHKRRGPCLVKTLSQGDVGSDGSQQPTLSVTLPPLPKRSQSFEAQEPEFEFQQASNGVLEGDSGVVETLDWQNGMLQKGKGTVSGEYGHDQAEFEFQHGNPDATVRPVNVGRPANGGTPRKINNDAFFELQDSLSMGLNSEAEDAGGHERWWKPSSPLGTSVGTPGAEFYDAFEEISSDGATRSSQCMDDDLREMRLSLLMEIERRKQAEEALENWQKEWKKLSDHLSLIALTLPPPSLAEDTDDSSMDPGAELCQQITVSQLVAAAIARGFARAEVETDMETKIAAKNFEIARLSDRVQYYEAANREMSQRNQEAIEMSRQQRNIRKKRQKWFWGSVGLAVTLGTAAIAWSYLPAAQPQASQDSNTNSD

SEQ ID NO: 2989 - protein, 617 aa, Armoracia rusticana
MTTNKKTIVWFRRDLRIEDNPALAAAAHQGSVFPVFIWCPEEEGQFYPGRASRWWMKQSLAHLSQSLKALGSELTLIKTHNTVSAILDCIRVTGATKVVFNHLYDPVSLVRDHTVKEKLVELGISVQSFNGDLLYEPWEIYCEKGKPFTSFSSYWKKCLDMSIESVMLPPPWRLIPITAAVEAVWACSIEELGLENDAEKPSNALLTRAWSPGWSNADKILNEFIDKQLIYYAKNSNKVVGNATSLLSPYLHYGEISVRRVFQCARMKQIIWARDKNSEGEESTDLFLKGIGLREYSRYICFNFPFTHEQSLLSHLRFFPWDADVDKFKAWRQGRTGYPLVDAGMRELWATGWMHNRIRVIVSSFAVKFLLLPWKWGMKYFWDTLLDADLECDILGWQYISGSLPDGHELDRLDNPAIQGAKFDPEGEYIRQWLPELARLPTEWIHHPWDAPLTVLKASGVELGTNYVKPIVDIDTARELLTKAISRTREAQIMIGAAPDEIVADSFGALEGNTVKETGLCPSVSSNDQQVPSAVRYNGSKRVKHVEEEERDMKKSRGFDEVMREERDLFSTAESSSSSTTVRFLVSHSCSLVSEGKNLEGIQDPSDQITTKLGKNG

SEQ ID NO: 2990 - protein, 474 aa, Bacillus cereus
MNGYVYLVGAGPGDEGLITKKAIDCLKRADIVLYDRLLNPFFLSYTKETCELIYCGKMPKNHIMRQEMINAHLLQFAKEGKIVVRLKGGDPSIFGRVGEEAETLAAANIPYEIVPGITSSIAASSYAGIPLTHRNYSNSVTLLTGHAKSPLTDYGKFNSSHNSDTIAYYMGIKNLPTICENLLQAGKKKDTPVAVIEWGTTGKQRVVTGTLSTIVSIVKNENISNPSMTIVGDVVSLRNQIAWKERKPLHGKKVLFTSATNKTSVIKQKLQEAGAEIYQIPTFKKVEYTLTFEQINEIFNIDRLVFCSAESVEILMRSCSKHQKDIRSLQAELQHMNVATQEKIMQYGLLSKQAEYSSDTTVYLGRNINRIAFIQEKIGAGSYMMTHKYTIDHRFDEVHSRMLSEFLWDSIVFEGRASIDTFLAEVKRLGFIDIVTLPFSYTDVPTLHYANKVGFHNVDHQLQETLMKKDMVRQ

SEQ ID NO: 2991 - protein, 413 aa, Treponema denticola
MASTYEKLLTTITEAAKTANLEEDDYISLLSPEREMHVSIPVKMDNGKIKVFSGYRVQHSTLRGPAKGGIRFHQDVNIDEVRSLSAWMTFKCAVADIPYGGGKGGICVNPSNLSETELEKLTRGYTRRITSFIGPKTDIPAPDVGTNAKIMSWIVDSYSSYAGEFTPAVVTGKPLPLGGSKGRVEATGRGVLFATREILKKLNKTLKDQSVVIQGLGNVGGVTADLFYKEEARIIAISDTSSAIYNEKGLDIPQILKHKKGGKKLKSFEGDFKRITNEELLELKADILIPAALENQITEKNASNIKASIIIEAANGPITPEADKILEKKNIITVPDVLANSGGVIVSYFEWVQNLQGFYWTEEEVNKRLEDKMIEAFKLVWDVKEAYKVSMRKAAYIKALKELVETQKVKGIN

SEQ ID NO: 2992 - protein, 303 aa, Streptococcus dysgalactiae
EIKKAYRKMSKKYHPDINKEAGAEQKYKDVQEAYETLSDSQKRAAYDQYGAAGANGGFGGGAGGFGGFYGGGFGGFEDIFSSFFGGGGMRNPNAPRQGDDLQYRVNLSFEEAVFGVEKEVSYNREATCGTCSGSGAKPGTSPVTCHKCHGSGVMTVDTQTPLGMMRRQVTCDVCHGTGQEIKEPCPTCHGTGHEKKVHKVSVKIPAGVETGQQIRLQGQGEAGFNGGPYGDLFVILNVLPSKKFERNGSTIYYSLDISFTQAALGDTVDIPTVHGDVEMAIPAGTQTGKTFRLKGKGAPKPRG

SEQ ID NO: 2993 - protein, 801 aa, Bacillus cereus
MKKRLVMIGNGMAGIRCMEEILKHDSDSYEITIFGDEPHPNYNRIMLSHVLQGKTNMQDIIMNEYSWYEENEITLYTNEKVQSINREEKIIMTEKNRTLTYDKLILATGSSAFILPVEGSTLPGVTGFRTIEDTQFMIDTAKEKKKAVVIGGGLLGLEAARGLIDLGMDVHVVHLMPRLMEQQLDTKAASLLREDLEAQGMKFLMEKKTVKILGTDYVEGIQFEDGEVVDCNLIVMAVGIRPNTQIARDAGLIVNRGIVVNDYMLTNDESIYAVGECAEHDGIAYGLVAPLYEQGAILAKHITNLQTDGYTGSIVGTQLKVAGCDLFSAGQIYKDDQTKAISIFDECKRSYKKVLIRDNKVVGIVLYGDTADGTRLFSMLKKEEDIQEYTPASLLHKAGEESELDVATMSVDDTICGCNGVTKGTIVHAILEQELTTFEEVKGCTKAAGSCGKCRPLVEQVLSHTLGDAFDASAQSAGMCGCTPLSRDEVVAAIHEKGLKSPKEVRNVLDFAHEDGCSKCRPALNYYLRMAIPEEYEDDKSSRFVNERMNGNIQHDGTFSVIPRMYGGVTTADDLMKIAEVAKKYDVPLVKITGASRIGLYGVKKQDLPNVWADLHMTSGYAYSKSLRNVKSCVGSRFCRFGTKDSLGLGMFLEQSLEMVDTPHKMKMGVTGCPRNCAEVLTKDFGVVCVENGYQLYIGGNGGTEVREADFVMIVPTEDDVLRIATAYMQYYRETGIYGERTAYWTERLGFDHIKEILQDANMVTTLNERFQIARSTYTEAWGQALETKSLKAMYEVATMK

SEQ ID NO: 2994 - protein, 194 aa, Rhizobium leguminosarum
DVFPTLEQLPLWGFDGSSTMQAEGRSSDCVLKPVAIYPDPARTNGALVMCEVMMPDGVTPHPSNARATILDDEDAWFGFEQEYFFYQNGRPLGFPEQGYPAPQGPYYTGVGYSNVGDVAREIVEEHLDLCLAAGINHEGINAEVAKGQWEFQIFGKGSKKAADQIWMARYLLQRLTEKYGIDIEYHCKPLGDTD

SEQ ID NO: 2995 - protein, 229 aa, Brassica napus
  misc_feature (221)..(221): Xaa can be any naturally occurring amino acid
MSHSAVSQAAAVSVSIGNERSLTRSVFKQNNSISFNTKPWSSSLALTQKTSTIRDAKRYSNTTICMSVQQASSSKVNVSPIELEDPTDPPLNLYKPKDSYTAKIVSVERVVGPKAPGETCHIVIDHDGNLPYWEGQSYGVIPPGENPKKPGAPHNVRLYSIASTRYGDFFDGKTASLCVRRAVYYDPETGKEDPSKNGVCSNFLCDSKPGDKIQITGPPGXVMLLPEND

SEQ ID NO: 2996 - protein, 615 aa, Prochlorococcus marinus
MSISSIHEPAAAAQRTVITLPIEKGLISLRGLSPQRLRFELEYALERGSTANSFLFSAGDDSHGQPQSAVLVHPPGDAYAEVFMPALAKALPSDTTTLKVVVGHINPNRVALLKKLANSYPKLELISSNPGAKLLKELWEQRKPATPNNNEQEESSLPSLPSIEIVRQEQKLSLSNEHALWLLPAPTARWPGGLLAFEESLGLLMSDKLFAAHLCTSEWAEANRISTEEERRHFYDCLMAPMASQVDTLVERLEELDIRTIAPCHGPAIETSWRSLLNDYRRWGESQQQAPLKVVLLFASAYGNTAAIADALAKGVSSTGIQVESLNCEFTPANELVNAIQQADAYLIGSPTLGGHAPTPIVSALGTLLAEGDRNKKVGIFGSYGWSGEALELLEKKLRDGGFSFGFEPIKVKFSPDAAMVKTLEETGTLFGRKLLKQQQREQPRASSGMSASRSDPAVLALGRVVGSLCILTARKGEGNTALSGAMVASWVSQASFSPPGLSVAVAKDRAVEALLHRGDHFALNVLAAGRQHELMKHFLQPFPAGSDRFAGLDLDASPAGQPLLKNALAWLEGCVQQRMECGDHWLLYAEISHGALLEREGTTAVHQRRSGANY

SEQ ID NO: 2997 - protein, 543 aa, Unknown
  Rosa hybrid cultivar
MASHLAMLMTKLPKLQNLSASDHSSVVSLNLFVALLCACIVIGHLLEENRWVNESITALLIGVSTGVLILLISGGKSSHLLVFSEDLFFIYLLPPIIFNAGFQVKKKQFFRNFITIVMFGAIGTLVSCTIIAFGATQIFKKLDIGSLDIGDYLAIGAIFAATDSVCTLQVLHQDETPLLYSLVFGEGVVNDATSVVLFNAIQSFDLTHLDSRIALKFMGNFLYLFFASTMLGVITGLLSAFIIKKLYFARHSTDREVALMMLMAYLSYILAELFYLSGILTVFFCGIVMSHYTWHNVTESSRVTTKHAFATLSFVCETFIFLYVGMDALDIEKWRFVSDSPGTSVAVSSILLSLVMLGRAAFVFPLSFFSNLFKKNQSEKISLQQQVVIWWAGLMRGAVSIALAYNQFTRSGHTQLRANAIMITSTISVVLVSTVVFGLMTKPLIRLLLPHKQLTSTNSIMSDPPSPKSVIVPLLGQDSEADLSGHEVRRPASIRDLLTTPTHTVHRYWRKFDNAFMRPVFGGRGFVPFVPGSPTERNNTQWQ

SEQ ID NO: 2998 - protein, 385 aa, Triticum aestivum
MEGGGARNVSAAAAQTKESADDGSCKPLPPCCVKAQAAVAESEAKCHATVVSGWFTGTRSRSGKPSKAQYFNNPMWPGEAHSLKVEKILYQGKSPYQEVLVFESSTYGNVLVLDGIVQLTDKDECAYQEMVTHLALCSIPSPKNVLVVGGGDGGVLREIAKHDSVESIDICEIDQLVIDVCKDFFPRLYVGYKDPRVKLHVGDAVEFLRNSPEGKYDAIIVDSSDPIGPAQELVEKPFFQTIARALKPGGVLSNLAESMWLHTHLIQDMLSICREVFKGGVHYAWASVPTYPSGVIGFLLCAKDGPPVDFLTPVNPIEKIEGATKDGREMRFYNSEIHRAAFILPTFVKRELEAYNTSTEKEKPEKPTAKPVKMKVMRDSAITAS

SEQ ID NO: 2999 - protein, 449 aa, Xanthomonas campestris
MGASDDSPPQPHHSIHRYTRRFAQLRRAMSLSPDSAPVPGRRRAALIFIFITVLIDVLSFGVIIPVLPDLVRHFTGGDYVVAAGWIGWFGFLFAAIQFVCSPLQGALSDRFGRRPVILLSCLGLGLDFILMAIAHSLPMLLLARVISGVCSASFSTANAYIADVTPPDKRAGAFGMLGAAFGIGFVAGPLIGGWLGSIGLRWPFWFAAGLALLNVLYGWFVLPESLPAERRTARLDWSHANPLGALKLLRRYPQVFGLASVVFLANLAHYVYPSIFVLFAGYQYHWGPREVSWVLAGVGVCSIIVNALLVGRLVRRLGERRALLLGLGCGVIGFIIYGLADSGTAFLIGVPISALWAIAAPSAQALITREVGADAQGRVQGALTGLVSLAGIAGPLLFANVFAWFIGSGAPLHLPGAPWLLAAVLLAAGWAMAWKRAARGAGTSPAAQP

SEQ ID NO: 3000 - protein, 586 aa, Bacillus thuringiensis
MLKEAIYHRPKDNYAYAYDEKTIHIRIRTKRDDVQSTTLIYGDPYEWKDGKWISSSTPMKKTGSTALFDYWFISIEPKFKRLRYGFELKNDTDTLIYAERGFFSTTPNDDVGNFFCFPFIHANDVFKAPSWIKDTVWYQIFPERFANGDHTLNPENTLPWGSAEPTPTNFFGGDFAGIIQNLDYLVKLGISGIYFTPIFKAHSNHKYDTINYMEIDPQFGTKETFKELVQACHTHGIKVMLDAVFNHSGYFFDKFQDVLQNGEQSAYKEWFHIHEFPIRTEPLPNYDTFAFTPYMPKLNTAHPDVKEYLLEVGRYWVREFNIDGWRLDVANEVDHNFWREFRSEIKALNSEVYILGEIWHDALPWLQGDQFDAVMSYPVTNALLSYFANDSIKANEFMKQITESLHSYSMNVNEAAFHLLDSHDTPRILTTCNGDKNKLKLLYVFHLSFIGSPCIYYGDEIGMDGGMDPDCRKCMVWDTEEQDHTLFTHVQTLISLRKQYKAFGGHGTFQFIEANDEYNYISYTKTYEDETIFFVLNPTNSDITASLPLHVTGKKIINIYTNEEFSAEASVLQVTLPPYGFSILKW

SEQ ID NO: 3001 - protein, 73 aa, Unknown
  Frankia sp. EAN1pec
MPKKDGAIEIEGRVVEPLPNAMFRVELQNGHRVLAHISGKMRQHYIRILPEDRVVVELSPYDLSRGRIVYRYK

SEQ ID NO: 3002 - protein, 128 aa, Glycine max
  misc_feature (124)..(124): Xaa can be any naturally occurring amino acid
MVSEAANAGIDRVLWTEAEIATRVAEVASELAADIRRLAEPAVVVGVATGAFLFLADLVRRVDVPLAVDLVRVESYGDGTESSGRPRVTSDLKVDVAGKHVVVVEDIVDTGNTVSCLIAHLQKXGALS

SEQ ID NO: 3003 - protein, 102 aa, Arabidopsis thaliana
  misc_feature (21)..(21): Xaa can be any naturally occurring amino acid
  misc_feature (47)..(47): Xaa can be any naturally occurring amino acid
MASSMLSSANMVASPAQASMXARFNGVRASAGLRGTGRGSCDMNSVXEDGGRDNCVLVGAPSVKTKFETRGYIPDLTDAAWAWGAEGLIRHWGSPLRKHSKC

SEQ ID NO: 3004 - protein, 982 aa, Prochlorococcus marinus
MTLLEQRAVEASSIQSSPFLVRHIGPSFEDQQQMLLELGHRDLQSFVAAVVPPDILETTAPTSSLPEGCGEVQAMEELRLIAAANRVRRSLIGLGYYGTATPALIQRQVLENPAWYTAYTPYQAEISQGRLEALFNFQTLISELTGLPIANASLLDEGTAAAEAMSLSFAICKRPQAHRFLVDAEVLPQTLAVLRTRAEPLGIHLEVAEPMTFQFDAEVFGVLLQLPGRSGRLWDPTTSIQAAHEVGALATVAIDPLAQVLIAPVAEFGADIAVGSVQRFGVPMAFGGPHAAFFATLEIFKRQVPGRLVGQSVDAEGQPALRLALQTREQHIRRDKATSNICTAQVLLAVMASFYAVHHGPDGLAAIARRVLLLRAQLERGLHQLGYPVQSIARFDTIEVICREAPAVHQAAALAGFNLRVLPLGVAPEAAHGFGISFDELSTDQELKSILQILAEAAGQPVPVLEDLGNPHLEELVGLPLRQRPWLQQQVFHRYRSETELLRYLQRLVGRDLSLVHGMIPLGSCTMKLNAAAELIPISWREFAALHPFAPQDQCHGYQRLVQDLEHWFAEITGFAGVSLQPNAGSQGELAGLLVIRAWHHSRGEQQRDVCLIPTSAHGTNPATCVMAGLRVVPVACDAEGNVDLNDLASKAEAHAPQLAALMVTYPSTHGVFEPQIREICELVHGHGGQVYLDGANLNAQIGFCRPGTYGADVCHINLHKTFCIPHGGGGPGVGPIAVAAHLMPFLPGHPLAACGGEQGIGAISAAPWGSAGILPISWMYLRMMGAEGLRQASAVALLSANYLAHRLHPHYPVLFRGQAGLVAHECILDLRPLKRSAGLEVDDIAKRLMDYGFHAPTVSWPVAGTVMVEPTESESLEELNRFCDAMIAIREETAAIESGQIDPQNNPLRRAPHTLAAVTAEVWDRPYSRAEAAFPLAEQRQSKFWPAVSRIDNAYGDRNLLCSCPSVEELADNSVLKPPLV

SEQ ID NO: 3005 - protein, 342 aa, Streptomyces avermitilis
MRVGVLTGGGDCPGLNAVIRGVVRKGVQEYGYDFVGFRDGWRGPLEGDAVRLDIPAVRGILPRGGTILGSSRTNPLKLDDGIRRIKENLAKQEVDALIAIGGEDTLGVAARLTDEYGVPVVGVPKTIDNDLSATDYTFGFDTAVGIATEAIDRLHTTAESHMRVLVCEVMGRHAGWIAIHSGLAGGANVILIPEQRFDVDQVCAYVTSRFKASYAPIVVVAEGAMPKDGQMVLKDESLDSFGHVRLSGVGEWLAKEIEKRTGKEARTTVLGHVQRGGTPSAFDRWLATRFGLHAIEAVRDGDFGKMVALRGTDIVRVPIAEATAKLKTVDPKLYEEVGVFFG

SEQ ID NO: 3006 - protein, 142 aa, Silicibacter pomeroyi
MPLKYLHVMVRVKDLEKSMAFYELLGLREIRRYDSEEGRFTLVYLAAPGQDETPLELTYNWDGDDGLPSDSRHFGHLAYGVDDIYATCAMLQENGITINRPPRDGRMAFIRSPDNISIELLQNGAALDPAEPWVSMDSTGHW

SEQ ID NO: 3007 - protein, 99 aa, Unknown
  Synechococcus sp. WH 5701
MASYKVTLINESEGLNKTIEVPDDQYILDAAEEQGIDLPYSCRAGACSTCAGKLTTGTVDQSDQSFLDDDQIEAGFVLTCVAYPTSDCTIKTHAEEELY

SEQ ID NO: 3008 - protein, 616 aa, Cryptococcus neoformans
MASSSTLANDDWKQGLAAPPKDLRPQTEDVTATQGSRFEDFGLRRELLMGIYTAGFERPSPIQEQAIPMALTGRDILARAKNGTGKTASFIIPTLNRINTSLSHIQALILVPTRELALQTSQVCKTLGAHIPNLQVMITTGGTTLRDDILRLQQPVHILVGTPGRILDLGSKGIAGLNKCGIFVMDEADKLLSEDFMPVIEQTLALCPQERQVMLFSATFPWTVKEFKDQHMVQPYEINLMDELTLKGVTQYYAYVEESQKVHCLNTLFSKLQINQSIIFCNSTNRVELLAKKVTELGYSCFYSHAKMQQAHRNRVFHDFRNGMTRNLVCSDLLTRGIDIQAVNVVINFDFPRTAESYLHRIGRSGRFGHLGLAISLLTLEDRHNLYRIESELGTEIAPIPAVIDPVLYVAPAMVEEERESPPPKPAAIAAPPAQQQPQQRQRQHPPVPSHQVAHHSPAAAPIQQQQQQQQQQQQPQYQLAYGQGPPQPQVPFQQANSSPAPAPLPSYPQQAPTQAQGPAQMQSPPSEPATQPQASAQIPVQGQTPPIQPRAQQQGQQQPSQPGQAEGQSQPNRRPNTGGFRGNGRGQGHRGRGRGRGGQPGHPGAGASQSQQAQA

SEQ ID NO: 3009 - protein, 233 aa, Staurastrum punctulatum
MKTESLTISLEEMMEAGVHFGHQTRKWNPKMAPYIFTKRRGIYILHIFKTARLLAEACEFSANAASQGKQFLIVGTKYQAADLVSAAAKKARCHYVNQKWLGGMLTNWSTIETRVTRLKQLEDQENAGVLNQLPKKEAAVLKRQLIQLRKYLEGIKYMTRLPDIVIIIDQQKEATAVEECIKLGIPTICLVDTDCDPDLTDMPIPANDDARSSIRWILDKLTTAIREGRNRVT

SEQ ID NO: 3010 - protein, 360 aa, Solanum tuberosum
MEMDLPVSAIGFEGFEKRLEISFVEPGLFADPNGKGLRSLSKAQLDEILGPAECTIVDNLSNDYVDSYVLSESSLFVYSYKIIIKTCGTTKLLLAIPPILRLAETLSLKVQDVRYTRGSFIFPGAQSFPHRHFSEEVAVLDGYFGKLAAGSKAVIMGSPDKTQKWHVYSASAGPVQSNDPVYTLEMCMTGLDREKASVFYKTEESSAAHMTVRSGIRKILPKSEICDFEFEPCGYSMNSIEGAAVSTIHITPEDGFSYASFESVGYNPKTMELGPLVERVLACFEPAEFSIALHADVATKLLERTCSVDVKGYSLAEWSPEEFGEGGSIVYQKFTRTPYCESPKSVLKGCWKEEEKEGKE

SEQ ID NO: 3011 - protein, 345 aa, Bacillus subtilis
MYDTIVIGAGQAGISIGYYLKQSDQKFIILDKSHEVGESWKDRYDSLVLFTSRMYSSLPGMHLEGEKHGFPSKNEIVAYLKKYVKKFEIPIQLRTEVISVLKIKNYFLIKTNREEYQTKNLVIATGPFHTPNIPSISKDLSDNINQLHSSQYKNSKQLAYGNVLVVGGGNSGAQIAVELSKERVTYLACSNKLVYFPLMIGKRSIFWWFDKLGVLHASHTSIVGKFIQKKGDPVFGHELKHAIKQKEIILKKRVIAAKQNEIIFKDSSTLEVNNIIWATGFRNPLCWINIKGVLDQEGRIIHHRGVSPVEGLYFIGLPWQHKRGSALLQGVGNDAEYIVKQMNGE

SEQ ID NO: 3012 - protein, 88 aa, Kluyveromyces lactis
ARPAFVNKLWSMVNDKSNEKFIHWSTSGESIVVPNRERFVQEVLPKYFKHSNFASFVRQLNMYGWHKVQDVKSGSNDSRWEFENERHA

SEQ ID NO: 3013 - protein, 112 aa, Xanthomonas oryzae
MKLITAIIRPFKLDEVREALSAAGVSGITVTEVKGFGRQKGHTELYRGAEYVVDFLPKIKIETVVTNDRLDAVVEAIQNAAGTGKIGDGKIFVTAIEQVVRIRTGEIGADAL

SEQ ID NO: 3014 - protein, 100 aa, Triticum aestivum
  misc_feature (31)..(31): Xaa can be any naturally occurring amino acid
  misc_feature (39)..(39): Xaa can be any naturally occurring amino acid
  misc_feature (50)..(50): Xaa can be any naturally occurring amino acid
  misc_feature (58)..(58): Xaa can be any naturally occurring amino acid
  misc_feature (67)..(67): Xaa can be any naturally occurring amino acid
MERRPARCYRQIKNKPYSQVKGLAGVWPDPXKIRIYDVXEKKGVDEFSHXGHLVSWEXENVSSEALXAARFACNKYMTKHARKDAFQPRVRVSPRFHVAP

SEQ ID NO: 3015 - protein, 112 aa, Sinorhizobium meliloti
MKIVMAIIKPFKLDEVREALTAVGIQGLTVTEVKGYGRQKGHTEIYRGTEYAVSFLPKLKVEIAVATEIVDRAVEAIASAAKTGQIGDGKIFVYSIDHAVRIRTGETDSEAL

SEQ ID NO: 3016 - protein, 486 aa, Arabidopsis thaliana
MAVQPTRIGLAGLAVMGQNLALNIAEKGFPISVYNRTTSKVDETVERAKKEGNLPLYGFHDPESFVKSIQKPRVIIMLVKAGSPVDQTIKTLSAYLEKGDCIVDGGNEWYENTERREKAVAENGFLYLGMGVSGGEEGARNGPSMMPGGSYEAYKNIEDIVLKVAAQVRDSGPCVTYIGKGGSGNFVKMVHNGIEYGDMQLIAEAYDVLKSVGKLSNEELHSVFSDWNKGELESFLVEITADIFGIKDDKGDGHLVDKVLDKTGMKGTGKWTVQQAAELSVPAPTIESSLDARFLSGLKDERVQAAKVFKAGGFGDILTDQKVDKKQLVDDVRKALYASKICSYAQGMNLIRAKSIEKGWGLKLGELARIWKGGCIIRAIFLDRIKQAYDRNAELANLLVDPEFAKEIIERQSAWRRVVCLAINSGISTPGMSASLAYFDSYRRERLPANLVQAQRDYFGAHTYERTDVEGSFHTEWFKIARQSKI

SEQ ID NO: 3017 - protein, 524 aa, Magnaporthe grisea
MSGAVARLAGLGRAFPSMNAGSSSSSSTSNNADKSGSADLGLIGLAVMGQNLILNMADHGFTICAFNRTVSKVDNFLANEAKGKSIVGAHSTEEFVSKLKSPRRIMLLVQAGKAVDDWIETLLPLLSKGDIIIDGGNSFFPDSNRRMKYLESKGLQFVGSGVSGGEEGARYGPSIMPGGSEAAWPHIKDIFQSISAKSDGEACCEWVGDEGAGHYVKMVHNGIEYGDMQLICEAYDIMKRGLGMSNKEIGDVFTQWNKGVLDSFLIEITRDIMYFNDEDGLPLVEKILDKAGQKGTGKWTTINALDLGMPVTLIGEAVFGRCLSGIKEQRVRASQKLEYIGRTSSFEGNKEQFIKDLEQALYASKIISYAQGFMLMQEAAKEYGWKLNKPSIALMWRGGCIIRSVFLKDITSAYRKNPDLENLLFDDFFNKAINNAQPGWREVVGRAAFLGIPTPAFSTALSWFDGYRTKDLPANLLQAQRDYFGAHTFRIKPEFANAKYPEGQDIHVNWTGRGGNVSASTYQA

SEQ ID NO: 3018 - protein, 617 aa, Armoracia rusticana
MTTNKKTIVWFRRDLRIEDNPALAAAAHEGSVFPVFIWCPEEEGQFYPGRASRWWMKQSLAHLSQSLKALGSELTLIKTHNTVSAILDCIRVTGATKVVFDHLYDPVSLVRDHTVKEKLVELGISVQSFNGDLLYEPWEIYCEKGKHFTIFSSYWKKCLDMSIESVMLPPPWRLRPITAAADAVWACSIEELGLENDAEKPSNALLTRAWSPGWSNADKILNEFIDKQLIYYAKNSKKVVGNSTSLLSPYLHYGEISVRRVFQCARMKQIIWARDKNSEGEESTDLFLKGIGLREYSRYICFNFPFTHEQSLLSHLRFFPWDTDVDKFKAWRQGRTGYPLVDAGMRELWATGWMHNRIRVIVSSFAVKFLLLPWKWGMKYFWDTLLDADLECDILGWQYISGSLPDGHELDRLDNPAIQGANFDPEGEYIRQWLPELVRLPTEWIHHPWDAPLTVLKASGVELGTNYAKPIVDIDTARELLTKAISRTREAQIMIGAAPDEIVADSFGALEGNTVKETGLCPSVSSNDQQVPSAVRYNGSKRVKHVEEEERDMKKSRGFDEVMREERDLFSTAESSSSSTTVRFLVSHSCSLVSEGKNLEGIQDPSDQITTKLGKNG

SEQ ID NO: 3019 - protein, 57 aa, Brassica rapa
KEVVSYEFPRPNIGIHRFVFVLFKQKQRHVIDISPNIPSRDKFNTRKFAIEYDLGLP

SEQ ID NO: 3020 - protein, 297 aa, Streptococcus equi
EAYETLSDSQKRAAYDQYGAAGANGGFGGGAGGFGGFDGGGFGGFEDIFSSFFGGGGMRNPNAPRQGDDLQYRVNLSFEEAVFGTEKEVSYHRESTCSTCAGSGAKPGTSPTTCRKCHGSGVINVDTQTPLGMMRRQVTCDVCHGSGQEIKEPCHTCHGTGHEKKVHKVSVKIPAGVETGQQIRLQGQGEAGFNGGPYGDLFVILNVLPSKQFERNGSTIYYSLNISFVQAALGDTVDIPTVHGDVAMSIPAGTQTGKVFRLKGKGAPKLRGGGQGDQHVTVNIVTPTKLNEAQKEA

SEQ ID NO: 3021 - protein, 323 aa, Streptococcus equi
HPDINKEPGAEQKYKDVQEAYETLSDSQKRAAYDQYGAAGANGGFGGGAGGFGGFDGGGFGGFEDIFSSFFGGGGMRNPNAPRQGDDLQYRVNLSFEEAVFGTEKEVSYHRESTCSTCAGSGAKPGTSPTTCRKCHGSGVINVDTQTPLGMMRRQVTCDVCHGSGQEIKEPCHTCHGTGHEKKVHKVSVKIPAGVETGQQIRLQGQGEAGFNGGPYGDLFVILNVLPSKQFERNGSTIYYSLNISFVQAALGDTVDIPTVHGDVAMSIPAGTQTGKVFRLKGKGAPKLRGGGQGDQHVTVNIVTPTKLNEAQKEALKAFAEAR

SEQ ID NO: 3022 - protein, 189 aa, Coprinellus disseminatus
TREQHIRREKATSNICTAQALLANMAAMYAVYHGPEGLKRISNKVHGFTQVFKSSVESLGFKATNTTFFDTLTLDITGAVANSWAVHASANAAGINLRRIDDKHVGVTFDESVTPAELVNLINVFATAANKSPLTLSDLAEPTESAISPHLKRTSKFLPHPVFNKHHSETEMLRYINHLSSKDLSLTHS

SEQ ID NO: 3023 - protein, 378 aa, Amanita muscaria
MRFVQIDVNILPLSILLGASNLSVMANQYHNDLLAPYLALDQGGKFHAEYVWIDGDGGLRSKTTTVDQKVTDISQLRVWDFDGSSTNQAPSGNSDVYLRPSAIFKDPFRGGENILVLSETYNNDGTPNRTNHRHHTAKVMELAKDEIPWFGIEQEYTLFDADGSPYGWPKGGFPGPQGPYYCGAGTGKVFARDLIEAHYRACLYAGVNISGINAEVMPSQWEFQVGPCEGISMGDHLWMARYLLIRVAEQWGVKVSFHPKPLQGDWNGAGAHTNYSTLAMREPGGMKYIEAAIEKLAKRHDEHIAVYGEDNEMRLTGRHETGHIGTFSSGVANRGASIRVPRHVANKGYGYLEDRRPASNIDPYRVTGIIIETTILDK

SEQ ID NO: 3024 - protein, 156 aa, Francisella tularensis
MSIYDFKLTANDGSEYHLPKNKVLLIVNVASKCGFTKQYRGLQHLHKIYPDLEIVAFPCNSFGGQEPGSDEEIKNFCETNYNVTFPIMKKTKVNGKDAEPLFEYLKERAKGVLGTEAIKWNFTKFLVSKDGETVVRYAPKTIPEDLIPDIDNFLKD

SEQ ID NO: 3025 - protein, 305 aa, Streptococcus equinus
VQEAYETLGDEQKRAAYDQYGPAGSNGGFNGGAGGFGGFDGAGFGGFEDIFSSFFGGGGGMRNPNAPRQGDDLQYRVNLTFEEAVFGVEKEVAYNRESTCSTCSGSGAKPGTSPVTCSRCHGSGVINVDTQTPLGMMRRQVTCDVCHGTGKEIKEPCHTCHGTGHEKKTHKVSVKIPAGVETGQQIRLQGQGEAGFNGGPYGDLFVIINVLPSNKFERNGSTIYYTMNISFVQAALGDTVEVPTVHGDVEMTIPAGTQTGKTFRLKGKGAPKLRGGGQGDQHVTVNIVTPTKLNDAQVEALKQFA

SEQ ID NO: 3026 - protein, 545 aa, Xylella fastidiosa
MHSIQIVLAMLLVVAASGYLVRIIPFSMPLPLLQIALGAVISGVFDGGYELQPEAFFLLFLPPLLFLDGWRIPKQGLFRDKNVILELALGLVVFTVLGIGFLIHWMIPTMPLPLAFALAAILSPTDPVALSSITSRVPIPKRMMHILEGESLLNDATGLVCFQFAVAAVLTGHFSLATASLTFVWVLVVGLSLGIATTYVLSRVQRWVWRHFGGEPAAAILFNLLTPFAAYLLAESMQASGILAAVAAGITMSYVELSGNAQATIRVQRWAVWETVQFTFNGIIFVLLGEQLPGILDDLVHSAQQAGYMNVGWLLVDVAVISAGLMLLRFLWVWLSLQWNLFKAVCCGKQRISPPWQIVVAMSLSGVRGAVTLAGVLTLPLLMPDGTPLPARQLVIFLAASVILVSLLLASVALPYLLRGLELPEKSSYDKEEDFARRVSAQAALEAVERLRQRLVEDSANAERYNEAAHQVSQLYQRKLGAVDLANVDPQETKVFEQVVRRFRQVGLAAERDELFRLAREHNISDELLQRMVRNLDLIEARRRS

SEQ ID NO: 3027 - protein, 189 aa, Coprinellus disseminatus
TREQHIRREKATSNICTAQALLANMAAMYAVYHGPEGLKRISNKVHGFTQVFKSSVESLGFKATNTTFFDTLTLDTTGAVANSWAVHASANAAGINLRRIDDKHVGVTFDESVTPAELVNLINVFATAANKSPLTLSDLAEPTESAISPHLKRTSKFLPHPVFNKHHSETEMLRYINHLSSKDLSLTHS

SEQ ID NO: 3028 - protein, 301 aa, Streptococcus ferus
DINKEAGAEEKYKAIQEAYETLGDEQKRAAYDQYGPAGASGGFNGGGGFSGFDGGGFGGFEDIFSSFFGGGASRNPNAPRQGDDLQYRVNLKFEEAIFGAEKEVRYNREATCHTCDGSGAKPGTSPVTCSKCHGSGVINVDTQTPLGMMRRQVTCDVCHGSGQEIKEPCQTCHGSGHEKQSHKVSVKIPAGVETGQQIRLAGQGEAGFNGGPYGDLFVIINVLKSDQFERDGSTIYYDLNINFVQAALGDTVEVPTVHGAVEMAIPAGTQTGKTFRLKGKGAPRLRGNGQGDQHVTVNVVT

SEQ ID NO: 3029 - protein, 189 aa, Coprinellus disseminatus
TREQHIRREKATSNICTAQALLANMAAMYAVYHGPEGLKRISNKVHGFTQVFKSSVESLGFKATNTTFFDTLTLDITGAVANSWAVHASANAAGINLRRIDDKHVGVTFDESVTPAELVNLINVFATAANKSPLTLSDLAEPTEPAISPHLKRTSKFLPHPVFNKHHSETEMLRYINHLSSKDLSLTHS

SEQ ID NO: 3030 - protein, 328 aa, Streptococcus gallolyticus
HPDINKAPGAEEKYKEIQEAYETLGDEQKRAAYDQYGAAGANGGFGGGFGGGSGGFGGFDGGAGFGGFEDILSSFFGGGGGMRNPNAPRQGDDLQYRVNLSFEEAIFGVEKEVVYNRESTCSTCSGTGAKPGTSPVTCSRCHGSGVINVDTQTPLGMMRHQVTCDVCHGTGKEIKDPCPTCHGTGHEKKTHKVSVKIPAGVETGQQIRLKGQGEAGFNGGPYGDLFVIINVLPSKQFERNGSTIYYNMNISFVQAALGDTVKVPTVHGDVEMTIPAGTQTGKTFRLKGKGAPKLSGGGQGDQHVTVNIVTPTNLMMLKSKRLKTRSSR

SEQ ID NO: 3031 - protein, 312 aa, Unknown
  Photobacterium sp. SKA34
MDFFPVFLKLTHKKVLVVGGGEVACRKVDLLLKAKANITLVSPELHPHLVSLLDEGKFEYLKARYEKSLLTQFDQVWTTTDSRELNHQVYHDANALKIWTNVVDDPAYCDFITPSMIDRSPMQVAISSGGASPVLVRYLRERFETQLPQNLSLLAHYSGQQRTRIKQHYKTVDERRKFWEAFFRLPAVETATTEQELEQAFSGLLTSYQDTGANLYLIETGNDPELLTLKALRLMQQSEFVLYPEGKNDIFVDLCRRDADRESYEHENVIARAKELLNEGMRVCVLAPKDQHRPVLKKLCVDRNGIFVPSHS

SEQ ID NO: 3032 - protein, 253 aa, Silicibacter pomeroyi
MADSGYLFSVRGRVACVTGASSGLGRRAATVLAQAGAQVVGVARRADALAEWQAEAGGETHAIPYDLSDRDGLEGLARQVVDPFGAPDILVHAAGINTRQPADEVTPEGWDITLTLNLSVPFFLSQYLVPGMKARGWGRIVNFASLQTTRAFPGGIAYGASKGGVAQMTRAMAEAWSPHGITANALGPGFFRTELTAPVFADPERAARNAAQTCIGRNGEPEDLDGPLLFLCSQASAYVTGQVLMVDGGYTAK

SEQ ID NO: 3033 - protein, 493 aa, Magnaporthe grisea
MEPPPKPVQLPKLEILPRGKGWKFQAPTKKINDGADVSHFLTSKAYRDICVFVLQLNRSLCPRKKSGAPANAGTVFTLASPRDDPPSVRRLQTLLDKVVAIVDETPPDPGPRRFGNIAFRTWHKHLEDRVDALLAGSIAPEILSFDNDGEQPKADDSAEGKADEHKIISTASAIDELRAYFLGSFGSSQRLDYGTGHELSFLAFLGGLWKLGAFTDGPESDHGDIERSIVLGVFEQYLKVIRKLILTYTLEPAGSHGVWGLDDHSFLPYIFGSAQLTRPISEDETMPLEGSVMRAPKLGDITKVETVEVQRELNMYFSAVGFINDVKKGPFWEHSPMLWDVSGIKDGWGKVNKGMIKMFNAEVLSKFPVVQHFPIGSLFSWEVDPEAPIPTQSVHMQNQPVFAATGQAPMGMPPTGMPPPQLNPMGVSMGTAAPWAQGGRMPAPGISSRVQQPVTGTTRPPPPDPVARQSGGPAAASSGTNDGQAGLTKAPWA

SEQ ID NO: 3034 - protein, 510 aa, Arabidopsis thaliana
ELRQGLNPSSFLFQNPKTLRNQSPLRCGRSFKMESQKPIFDLEKLDDEFVQKLVYDALVWSSLHGLVVGDKSYQKSGNVPGVGLMHAPIALLPTAFPEAYWKQACNVTPLFNELIDRVSLDGKFLQDSLSRTKKVDVFTSRLLDIHSKMLERNKKEDIRLGLHRFDYMLDEETNSLLQIEMNTISCSFPGLSRLVSQLHQSLLRSYGDQIGIDSERVPINTSTIQFADALAKAWLEYSNPRAVVMVIVQPEERNMYDQHLLSSILREKHNIVVIRKTLAEVEKEGSVQEDETLIVGGQAVAVVYFRSGYTPNDHPSESEWNARLLIEESSAVKCPSIAYHLTGSKKIQQELAKPGVLERFLDNKEDIAKLRKCFAGLWSLDDSEIVKQAIEKPGLFVMKPQREGGGNNIYGDDVRENLLRLQKEGEEGNAAYILMQRIFPKVSNMFLVREGVYHKHQAISELGVYGAYLRSKDEVIVNEQSGYLMRTKIASSDEGGVAAGFGVLDSIYLI

SEQ ID NO: 3035 - protein, 677 aa, Prochlorococcus marinus
MNDIKVGKPLPLGSSITSGGVNFSLIATNAEYIEILLFEKEDSVAPKTIFKLDHSHKTGSYWHAEINNLKEGSIYAFRVKQNDNGLNKNYSKTVLIDPCSRGITGWSNYKRKNALNNIDNMDCCLKSVVCDRKSFNFKDFPRPKHSWKETIIYELHIKAFTQSSNEEESCFKKFLKKIPYLKKLGITSIELLPVFCFDPNDAPNGLENFWGYSPINWFTPHFQYLSNNTAKGNREEFRKFVEECHKANIEVILDVVYNHTSEGDYQGPAISWKGIDDNLYYFIDKDKNYQDVSGCGNTIAANRGLVRKLILESLKCWVNELGVDGFRFDLGIALSRGEDLIPLDNPPIFDDIECDPELADIKFISEPWDCGGLYKLNDFPSKKTFTWNGHFRDDLRRFWKGDKDTAWNMSDKIKGSPSHYKENNFLPKSINFITSHDGFTLKDLVTFNKKHNFANKEQNRDGDNHNNSWNHGVEGPTSDLSIKKLRKRQQKNLLLSLFISRGVPMLLMGDEIGRSQGGNNNSWCQNNSLGWMNWDENQQDLELLNYLKYLIKIRKKFINFFNPISSTNKKEIDNLANYYWHGPKLESPDWSSWSHTVALSINKGENNPLIWAGLNAYSKSIDFYLPKSKSKWLKIIDTNHSENTKPIPITDTFIKVDNRSSVLIISEEVFGTKNNII

SEQ ID NO: 3036 - protein, 226 aa, Triticum aestivum
VTLQNKFVQKSRLVPVRNSRDCGDPRVRRRTRAAEVHNQPERNRRDRINEKMKALQELVPHCNKSDKASILDEAIEYLKSLQLQVQIMWMTTGMAPMMYPGAHQLMPPMAMGLNAACMPATQSLSQLQRIAPFMNHHLPNQMPRVQSPAIDSLNVANQMQNNGVCGEPRNPFLHPDDTLTAASQLPDMFPYASQKAQQNQNHQLLPNTDMPASGPCPPSFADGTGT

SEQ ID NO: 3037 - protein, 455 aa, Bacillus licheniformis
MEKDMQKLERTMTSRHIMMMALGGAIGAGLFKGSSKAIDLAGPSVMIPYLIGGVILLFIMQGLAEMAVRNSEARTFRDLVQSILGPYAAYFLDWIYWKMWVLNIAAEAVVAAMFLQYWLPGLPIWVLALFVSLVITSVNLLSVKSFAETEYWLALIKITVIVVFIISGFILLFFSFGQHSAVGFTHLTDHGGFFPNGAGGLITAMLVVIYSYGGTEIIGVTLAETKNPEKVVPKAVRGTLTRIIAFYLLPFFVIVSLIPWNQVNGVSESPFVMVFKMIGVPGADHLMNAVILLAVISSMNSGLYGASRILYTQASDGRMPKIFSRLSARKVPVYSILLCTSFLYLGVLFSLFAGSQTFEYLMGSLGYTVLVIWMLIAAAHLKSRKRNQTAGNGYYVKWFPYTTWVAIISLTAILIGVILTTSIVITLVTAGIYLLISAAYFFKGRNQTAGQTAAS

SEQ ID NO: 3038 - protein, 193 aa, Unknown
  Photobacterium sp. SKA34
MQVISNNRFILRLILLVSSILFTSLVTTFANASSCPTLYQAPLKKLNSDEYYDFCKQLTGKVVLVVNTASQCGFTPQFKQLEELYKTYKDSGLVVIGFPSNDFKQDRGSDQQTANICYSNYGVTFPMITKTSVKGSKANPLYKHLIAQSGKSVGWNFQKYLLNKQGQVVGVFPSRLSPTSNEMVAAIKQQLNM

SEQ ID NO: 3039 - protein, 1022 aa, Debaryomyces hansenii
MTEYTAQTLQSVLSNPKIVEINRLDSRAYYLPSDSTLSLNGNWDFNYSQSPLVAPLPHDKFAEFPGRLIVPGHWQLQGYGKPHYTNVVFPFAVDPPNPPSQNPTGTYRRKFVVPDEWKSKPFLFRLRFEGVDNSFHIFLNGKLVGYNEGSRNASEFDVAEHILLDEVNELWVRVYQWSSSSYIEDQDQWWLSGIFRDVYLLGFNKSGFIEDFNIVTDLDNKYVDSRLTINLKINFITSNSKLHVLLKREEDEIINKIFDLKDSNFNECLEVQNPLKWTAESPNLYNLELSVLVDNKVTNKVEQDVGFRKVEMKNGTLRVNGKSILIRGVNRHDHHPKHGRAVPLEYIKRDLYIMKKHNINAIRTSHYPNHPKFYELANRLGFWVLDEADLECHGFFEAVRKPVGGNDDAEYDEEKLRLFKLANQFTSDNKEWEAAYVDRAYQLVKRDFNQPCVFLWSLGNEAFYGYNHKSMVAKIRELDTSRPIHYEGDLQAESTDLYSRMYPLFQTLDKFVNQSEKPLILCEYGHAMGNSPGLLRQYQDYFYKYDQLQGGFIWEWANHGLYVNKDGQDIYYYGGDFGEYPHDGVFIMDGLLDSQHNPTPGLIEYAKVIEPIVIKIDKDKIKITNTFDFIDLDNYTATYQVVNYSDLDRKIIKRGELTLPKINAQETVEVSLPGYPQIVSSGTNCLEVQFKTINHTEAVESGHVVSWSQYELEKFPKRHVHQSYDRNLVEFAEDKLKFQIKSPYSDFVFDKISGCISNWQNDTNNLISKGINNLTFWRPSINNDAPVDEPYWRRFGLDHMQYNIRNIHIDKFPDSERIALIKVESLISPPILSWGFKTIQEYSIFTNEIKIYTKLTPEGFKDICIPETIPRLGYEFEINDELGRFVKWFGRGPGESYSDKKESQRIDVYRLPFEDLDYSYEYPQENGNHEETEWLLLENDNESGLYVTMEGKRFGYKASDEYDVQEAKHPHEIKHGSKYIRIDYKQHGVGTGACGPRVLDEFEFKISKETPIIFTISLKGLK

SEQ ID NO: 3040 - protein, 1114 aa, Oryza sativa
MGGVEPPPPPAPAPAGLAAWLVARGVKRRAVSAKRSWPPLCGRFPAPPPPPPTAPVAGDDGSKGVEGVVANQGGAEGVAVSPDRSVPLSGGPTAASSLPPPPPSIIAGNVGDNSVEGRGDVGDKGVHGVTEGNEEEQVASAVVSSAACIGALSHGPSQPEAERMEVDEGEGRETGEAQLPNDTDARLSDDQGMGEVLDVMPLAVAAPVSCGANVSNGSAENVRDVASLLMDREGGKWGCEFERKEVTSDRDGRETESRVGVGQLERTNDVHDGGRKKRWLMSVLNPPPKRRAISAIRKFPRDCGRAASTLAESGASMEELPLEATPISVATGGASMEDSLARTPISVQGASLVCGLDHSSEAIDGKTIEDDESSKVENRIQEFQVATNVALDDFEGAKNGSTHPNDSIAKPSPSHGFVERVNGKGSQQEKKLVARSAGDGKMVSKYEERLQKGTPETRMRDLVDVKAKKKILKSDKMNGALQNDARSSGDGKMKTKASSTQRGVVRSDMSLKQGDIARKVDATGKCKGGVNSLIKEATSGKHATTNGIEENDDRDLVSDRIIVQALMAPDKCPWTRRRKSIGGSSESRTPNLKIKFDPRSKIRNLLIKFHAACRKLVQVEEQHKGNIGRIDIEAGKALKQNGFIKPGPIVGNVAGVEVGDEFNFRIELSFVGLHRPYQGGIDSTKVNGILVAISIVASGGYHDELSSSDELIYTGSGGKAIGNKAAGDQKLERGNLALKNSIETKTPVRVIHGFKGHSKGEASHSKSKQISTYIYDGLYMVVDYWKEGPEGSMVYKYKLQRIPGQPELALHIIKATRKSKVREGVCVPDISQGRERIPIPAINTIDDTQPTAFKYTTEVIYPHSYAKEPLKGCDCTNGCSDSNRCACAVKNGGEIPFNSNGAIVEAKPLVYECGPSCRCPPTCHNRVSQHGIKIPLEIFKTGNKGWGVRSLSSISSGSFVCEYAGEVLQENGDEHVETDEYLFDIGHHYHDEVWEDPKFEGILGLESSTSKTTEDTEGSKTTEDTEGSTIDASKCSNVGRFINHSCSPNLYAQNVLWDHDDMKKPHIMFFATENIPPLQELTYDYNYGKVEDKNGKEKVKPCFCGSPDCSRRLY

SEQ ID NO: 3041 - protein, 354 aa, Brassica napus
MSLLSDLVNLNLSDSTEKIIAEYIWIGGSGMDIRSKARTLPGPVSDPSKLPKWNYDGSSTGQAAGDDSEVILYPQAIFRDPFRKGNNILVMCDAYTPAGNPIPTNKRHNAAKIFSNPKVASEEPWYGIEQEYTLMQKGVNWPIGWPIGGFPGPQGPYYCGVGADKAIGRDIVDAHYKACIYAGIGISGVNGEVMPGQWEFQVGPVEGISAGDQVWVARYLLERITEISGVNVSFDPKPVPGDWNGAGAHCNYSTKSMRNDGGLAVIKKAIEKLQVKHKEHIAAYGEGNERRLTGKHETADINTFSWGVANRGASVRVGRDTEKEGKGYFEDRRPASNMDPYVVTSMIAETTILG

SEQ ID NO: 3042 - protein, 656 aa, Arabidopsis thaliana
MRKSKANNDFRITNSRVQARIISPTLTCLTSHFFGIYDGHRRSRPVSGSVSSDDRMVLQAVSPETVGSTAVVALSDQNPTNSQRIRLHRSVRSVQRRYILLRHSLLSGLVGENKRLLMEEISPAVALTLGLANTMCDSGISSTFDISELENVTDAADMLCNQKRQRYSNGVVDCIMGSVSEEKTLSEVRSLSSDFSVTVQESEEDEPLVSDATIISEGLIVVDARSEISLPDTVETDNGRVLATAIILNETTIEQVPTAEVLIASLNHDVNMEVATSEVVIRLPEENPNVARGSRSVYELECIPLWGTISICGGRSEMEDAVRALPHFLKIPIKMLMGDHEGMSPSLPYLTSHFFGVYDGHGGAQVADYCHDRIHSALAEEIERIKEELCRRNTGEGRQVQWEKVFVDCYLKVDDEVKGKINRPVVGSSDRMVLEAVSPETVGSTAVVALVCSSHIIVSNCGDSRAVLLRGKDSMPLSVDHKPDREDEYARIEKAGGKVIQWQGARVSGVLAMSRSIEMRIITTCYSLCKIMRSPESGFQSASFSGDQYLEPFVIPDPEVTFMPRAREDECLILASDGLWDVMSNQEACDFARRRILAWHKKNGALPLAERGVGEDQACQAAAEYLSKLAIQMGSKDNISIIVIDLKAQRKFKTRS

SEQ ID NO: 3043 - protein, 408 aa, Oryza sativa
MAVQVQRTPLPRSTYTGHRVYLLRAPPAVTRCTVDRAFPRSHGPPLPPLLYKTSRPDASSSNSTSRHFPRRSKDCCCFAVRSIPDGIMGETIAKDVTELIGNTPLVYLNRVTDGCVGRVAAKLESMEPCSSVKDRIGYSMITDAEEKGLITPGKSVLIEPTSGNTGIGLAFMAAAKGYRLVLTMPASMSMERRIILKAFGAELILTDPLLGMKGAVQKAEELAAKTNNSFILQQFENPANPKIHYETTGPEIWKGTGGKVDGLVSGIGTGGTITGAGRYLREQNPDIKIYGVEPVESAVLSGGKPGPHKIQGIGAGFVPGVLDVDLINETVQVSSDEAIEMAKALALKEGLLVGISSGAAAAAAVRLAQRPENEGKLFVVVFPSFGERYLSSVLFQSIKKEAENMVVE

SEQ ID NO: 3044 - protein, 184 aa, Kluyveromyces lactis
MATGISKTLKYNAQTDKLITFAAGCFWGTQHIFLKHFGDKIIDGKVGYSNGSESLKDKPDTVSYERVKKGDTGFAEVYQISYNPKLVSLKELVDFFFRIHDPTTVNAQGPDQGSQYRSAIFAHSEADLNELKKLKEQWQPKWNNKIVTDISLIDNFYDAEEYHQLYLDKNPAGYACPTHYIRDL

SEQ ID NO: 3045 - protein, 957 aa, Chlamydomonas reinhardtii
MATIQLTDQQRKVLHEVACTTAAPVLDTASKDKIKQLLDDYDMRKAAMGSKPGANMVLPGQVLGEAGPFLDYGHPPGVALGDKFKDRGQVMVAGVHGTTVRGIHAPNAGSEHFVRGAYSVLMSGVYVDDEDMGEAFWYTGEGGMDGKKQVKDQQMASGSNAALKNNCDTRTPVRVVRGFVQEAGGGEGGGGGEGGGGAKKGKGGKGGGKKEKGLVYEGLYLVLECKMEPSKDGPQVCKFLMHGLPGHSTVSAKVEYNIFGNAGSAYSLHARRLAGAGAPAGGKRARKAAQDEKARELARQWMLSEIRRQYPGPELQLEDVSGGQEAVPIPVINQVNSERLPTDFAYTREYAWAPGVYQLVAPALRLADEEMLQFSREGDRGGVCGIAFNRHIAALDRRLEQEGRLPQGYEAHLEEQYNAAGCLMVTDPCGVHECGDGCSAKACRRNMQLSAGVQLPLEVFMTESKGWGVRCREEVPAGAFVCCYVGQLITDAMAEVRKGVDHYLFDLDFFAHIYAEIAEKGMQAVAEEIPLHKIPPVLSVGMIRQAQINAADAARRLPEQQPQQQQPQQQQQQPAAGGAAPGGAAAGEQAAGGAEGGGAYGGGGAAAAATAAGTAPGAGDNMDGVEGPAAQRSGGEEAAAGPGSSGAAGGCGYRLDGMVTREGLAQAAHALAEACDALARSVADGASTNLGGENILAAIEAAKARAAAAATTSGGAAAADQHQLEQLDRAAALAAASKAAADAVKAGDPGAFYLQPIISRDEEKAAERAAAAAAAAAAAAGVPPALPSTSDVGNGGTTGSGGGGGAFSNRGPAGCAVGSPRALAARSGMEAAAQAAGGAASGPVAGPGAVEDHGEEYAPMLVIDARTTGNVGRFINHSCDGNLTIQAVFAGVYRSTLLYHVGLYACRNIPQLEELSYNYGYHKQQQQQQQAQRGGAAEKQFVMQCNCGAVGCIGNLM

SEQ ID NO: 3046 - protein, 550 aa, Magnaporthe grisea
MATVDDTQNHVQLNAESSLNEFPYQASADKEEYPSLPSAPLPDVDGSSQNGHTAANADLPPSESTEQPWNKVASGDFIHETKMPSEDRDNLARPGSLPTPEPSRRGSNTLVGSPRQGDGLQMLMDEFADDESSDTSWDIHETIRSRTQALAEKDHQGIFSNQRRGNQADAPDTVTSANAWLPAGFEDDLDEVTGADDEFEPTRGSRWRVRLAPLDTPFHRRMQTLVVLLHVLGMGITFSFFCFLCTLPLFWPIIIAYLVFIRLSRAGSDGKTNRRIEWLRRARIWKYFADYFPVKLHKTADLPPTRKYIFAIHPHGIISHGAFASFATEALGFSEKFPGITNSVCTLHGNFKTPFYREYLMAMGLISVSKESIINTLMTGGINGEGMGRAVSIIVGGAREALEACPKTMRLILKRRGFCRMALRTGADLVPVLCFGENDLYQQWGPQDHPRFRRLQMKALAYLGFAVPVLRGRGVFNYDFGVLPQRRPINVVVGEPIKVEQFRGSGNIEPRVEELWKLYCQKLQELYDQNKHVYFKDRQEDMRFVDSEEL

SEQ ID NO: 3047 - protein, 463 aa, Pseudomonas putida
MDYLPLFHKLQGGRVLVVGGGEIALRKARLLADAGGVLRVVAPDVDGQLAALAREGGGEVLVRGYQAADLVGCRLVIAATDDPGLNAQVSADAQALSLPVNVVDAPALCTVIFPAIVDRSPLVIAVSSGGDAPVLARLIRAKLEAWIPSAYGELAGLAARFRHKVKSLYPDVNQRRGFWETVFQGPIAERQLAGQGAEAERLLQAMVDGAPVQQGGEVYLVGAGPGDPDLLTFRALRLMQQADVVLYDRLVAPAIIDMCRRDAERIYVGKRRADHSVPQDQINRLLVDLARQGKRVLRLKGGDPFIFGRGGEEIEELAEHGIPFQVVPGITAASGCSAYGGIPLTHRDYAQSVRFVTGHLKDGTSNLPWNDLVAPAQTLVFYMGLVGLPTICAELIRHGRAASTPAALVQQGTTRNQRVFTGTLADLPDLVAQHEVHAPTLVIVGEVVQLRDKLAWFEGSQNS

SEQ ID NO: 3048 - protein, 397 aa, Saccharophagus degradans
MKTRKSHPIKRFFEQETAGGILLIVAAALAMLLANSPFYGHYDLLIDTPFIISLGDFALEKPLLLWTNDGLMAVFFLLVGLELKRELLEGELSDPRKIALPAVGAIGGMLVPALIYWWINKDNPLALSGWAIPAATDIAFALGVLALLGSRVPVTVKIFLTSIAVFDDIGAILIIAFFYTSKISMLALVVAAICCAILFICNRSGVTTLRAYLLIGLVMWVALLKSGVHATLGGVILAFFIPMTAARPHPEIKIPSPLKFLEHELHAPVAFLILPIFAFANSGIRFIGMGVEDFTHSVPVGIASGLFFGKQLGVFLFCGVCVLFGWLKLPKGMRWVHLYGVAVLCGIGFTMSLFIGSLAFQESGINSVIDERLGIVFGSLVSAVLGFVVLRSAKQKA

SEQ ID NO: 3049 - protein, 348 aa, Triticum aestivum
MGGLSMDQAFVQAPEHRTKANLADADGIPVIDLSPLAAGDKAGVDALAAEVGRASQDWGFFVVVRHGVLAETVARALEAQRAFFALPADRKAAVRRDEAAPLGYYESEHTKNVRDWKEVFDLVPREPPPPAAVADGELVFENKWPEDLPRFREALEEYAEAMEELAFKLLELIARSLGLRPDRLRCFFKDQTTFIRLNHYPPCPSPDLALGVGRHKDAGALTILYQDDVGGLDVRRRSDGEWVRVRPVPDSYVINVGDIIQVWSNDRYESAEHRVSVNSQKERFSMPYFFNPGSDAMVEPLEEMVSDERPARYDAYNWGNFFSTRKNSNFRKLDVENVQIAHFRKDRS

SEQ ID NO: 3050 - protein, 369 aa, Medicago truncatula
MSTPSEDQIPHFSQFNFTPFTSSSSSMFPLSQRNEINNVNLHTSSNVEAFPSQSNTVNLPPLLQTQPNPRGKHNGKSKVSKNSKSANQISNTDSLNSATVNRYDSSLGLLTKKFISLINEAKDGTLDLNKTAEILKVQKRRIYDITNVLEGIGLIEKTSKNHIRWKGCDGLEPRELEHQVNTLKDEVDSLYAEEFKLDQCISERKELIRNLEEGENTGKYLFFTKEDILTLPCFQNKQLITIKAPKASFIEVPDPDEELGFHQRQYRMIVRSATGPINLYLLNKHDHKFEGVSAKQAKLEDPSRNSNGCRMDGVGLLENQGFQKNPSGSLNSLDSEAFGIQQITPTDLDVDGDYWFQSDPQVGLTELWR

SEQ ID NO: 3051 - protein, 300 aa, Bacillus halodurans
SFMSELSNYIGPDIDVPAGDIGVGAKEIGYMFGQYKKMRGGFEAGVLTGKGIGYGGSLARKEATGYGTVYFVEEMIKDHGFSFAGSTVVVSGSGNVSIYAMEKAMQLGAKVVACSDSGGYVYDKNGIDLQTVKRLKEVERKRISEYVNEHPHAHYVQGCSGIWSVPCDIALPCATQNELDEAAATMLIANGVKAVGEGANMPSTLQAVHTFQEHGVLFAPAKAANAGGVSVSALEMAQNSTRLAWTFEEVDAKLYEIMKNIYRESIKAAELYEASGNLVVGANIAGFVKVADAMISHGVV

SEQ ID NO: 3052 - protein, 112 aa, Azorhizobium caulinodans
MKIVMAIIKPFKLEEVRDALTGIGVHGLTVTEVKGYGRQKGHTEIYRGAEYAVSFLPKLKIEVAVPSDQVAKVVEAITASAKTGQIGDGKIFVFQIDHAVRIRTGETDADAL

SEQ ID NO: 3053 - protein, 70 aa, Brassica rapa
VCYENPSPTAGIHRVVFILFRQLGRQTVYAPGWRQNFNTREFAEIYNLGLPVAAVFYNCQRESGCGGRRL

SEQ ID NO: 3054 - protein, 420 aa, Rickettsia akari
MNIFNNNLHETDKEINEIIKHEKLRQSSVIELIASENFVSPAVLEAQGSILTNKYAEGYSGKRFYNGCEEVDKAENLAIERVKKLFNCKYANVQPHSGSQANQAVYLTLLQPGDTILGMSLDSGGHLTHGASPNMSGKWFNAVSYGVNKKTYLIDYDEIERLAVLHKPKLLIAGFSAYPRNIDFTRFREIADKVGAYFMADIAHIAGLVATGEHQSPISYAHVVTSTTHKTLRGPRGGLVLSDDEEIGKKINSALFPGLQGGPLMHIVAAKAVAFLESLQPEYKSYIKQIISNAKALASSLQERGYDILTGGTDNHIVLVDLRKNGITGKLAANSLDNAGITCNKNAIPFDETSPFITSGIRLGTPACTTRGFKEQDFVSVGHMVADILDGLKNNKDNTKAEQQVLHKVTKLIKLFPFYD

SEQ ID NO: 3055 - protein, 405 aa, Corynebacterium glutamicum
MKGRPNVLAIVLAGGEGKRLFPLTEDRAKPAVPFGGTYRLIDFVLSNLVNSGFLKIAVLTQYKSHSLDRHISLSWNVSGPTGQYIASVPAQQRLGKRWFTGSADAILQSLNLISDEKPDYVIVFGADHVYRMDPSQMLDEHIASGRAVSVAGIRVPREEATAFGCIQSDVDGNITEFLEKPADPPGTPDDPDMTYASMGNYIFTTEALIQALKDDENNENSDHDMGGDIIPYFVSRNDAHVYDFSGNIVPGATERDKGYWRDVGTIDAFYECHMDLISVHPIFNLYNSEWPIHTTSEGNLPPAKFVRGGIAQSSMVSSGSIISAGTVRNSVLSNNVVVEEGATVEGAVLMPGVRIGKGAVVRHAILDKNVVVRDGELIGVDQVRDAQRFKVSAGGVVVVGKNQVV

SEQ ID NO: 3056 - protein, 473 aa, Pichia angusta
MALSFPDLSGAALDDLVEKLTHYAISNGLVIYPPGFKAYQPSVAPVTLYPTPFPRAQFSKGIAISTKFNELYSRVVVDKSWLKQVIADLSKYDRNFTGMLHKTYLEAEPKIVQPVSLGLFRSDYMLDTVSNSIKQVEFNTVSVSFGGLSPKVGQLHSFLNSQGLYGRPQYYQEADLPTSQSMDGLAKGLLEAVKYYETSEKTASTIVLFVVQPGERNVFDQRAIEYSLFAKGVKSERVEFDKVTSSVKVDSSSKLFYKEQEVAVVYYRSAYAPSEYNHPDSWKARLLLETTKAVKCPSLLVQLSGAKKVQQLLTDRAVLQKYGFLDEELLSTFVRIYPLDSSEQGQIAKKLVFEHSERFVLKPQREGGGNNIYKQDIPGFLRSLDEKEWGAYILMELIVPAVHDNHILRNGEVLDESIVSELGMFGTLLFNETDGTILHNDYAGYLLRSKTSTSNEGGVAAGFGCVDSLYLHD

SEQ ID NO: 3057 - protein, 328 aa, Unknown
  Synechococcus sp. RS9917
MSRVYADNSQAIGNTPLVRLNHVTKGCKATVLAKVEGRNPAYSVKCRIGANMIWDAEKRGVLSEGKTIVEPTSGNTGIALAFTAAARGYKLVLTMPESMSIERRRVMAVLGAEIVLTEAAKGMPGAIAKAKQIAESDPAKYFMPGQFENPANPEIHEKTTGPEIWNDCDGAIDVLVAGVGTGGTITGVSRYIKNQAGKAIESVAVEPAHSPVITQTLNGEEVKPGPHKIQGIGAGFIPKNLDLSVVDKVEQVTNEESIAMALRLAKEEGLLVGISCGAAAAAAIRLAQQDAYAGKTIVVVLPDLAERYLSSVMFADVPTGIIEQPVAV

SEQ ID NO: 3058 - protein, 486 aa, Mycobacterium leprae
MQDMSAPESKTAIAQIGVTGLAVMGSNIARNFARHGYTVALHNRSIAKTDTLLKEHGSEGNFVRTETIPEFLAALQTPRRVLIMVKAGDATDAVINELADVMEPSDIIIDGGNSLFTDTIRREKAMRERGLHFVGAGISGGEEGALNGPSIMPGGPAESYTSLGPLLEEISAHVDGVSCCTHIGPGGSGHFVKMVHNGIEYSDMQLIGEAYQLLRDGLGMSAPQIADVFTEWNRGDLNSYLVEITAEVLRQTDIKTGRPLVDVILDKAEQKGTGRWTVQSALDLGVPITGIAEAVFARALSGSVLQRKAAIGLASGKLGNKPTDRETFIEDVRQALYASKIVAYAQGFNHIQTGSTEFGWNITPGDLATIWRGGCIIRAKFLNRIKEAFDAAPDLASLIVAPYFRSAVESAIDSWRRVVSTATQLGIPNPGFSSALSYYDALRTERLPAALTQAQRDFFGAHSYGRVDARGKFHTLWSEDRSEVTV

SEQ ID NO: 3059 - protein, 345 aa, Burkholderia xenovorans
MQLGMIGLGRMGADMVRRLTKGGQQCIAYDVQPAAVEKLKQDGVAGAASLEDLVAQLDKPRAVWLMVPAAVVDMTLEKLVPLLEPGDIVIDGGNSYYHDDIRRGAELAKRQLHYVDVGTSGGVAGRERGYCLMIGGEPEVVKRLEPVFSTLAPGAGTAPATPGRVSGSSTADQGFLHCGPLGAGHFVKMVHNGIEYGMMAAYAEGLNILRHANAGKHAREADAETTPLRRPELYQYELNLADVTEVWRRGSVIGSWLLDLIAGSLVSDADLKNYAGRVSDSGEGRWTVAAAIDEGVPTPVLSAALFARFSSRGEADFANRVLSAMRHDFGGHVEKAATPADGPKG

SEQ ID NO: 3060 - protein, 141 aa, Bacillus anthracis
MGYVEELRKIVGHRPLILVGAVVLVINEHGYVLLQQRTEPYGKWGLPGGLMELGESPEETACREVYEETGIEVKNLQLINVFSGANYFTKLANGDEFQSVTTAYYTDEYDGDFVMNKEEAVQLTFFPLTELPDYIVGSHKK

SEQ ID NO: 3061 - protein, 285 aa, Streptococcus gallolyticus
AYETLGDEQKRAAYDQYGAAGANGGFGGGAGGFGGFDGGAGFGGFEDIFSSFFGGGGGMRNPNAPRQGDDLQYRVNLSFEEAVFGVEKEVAYNRESTCSTCSGTGAKPGTSPVTCSRCHGSGVINVDTQTPLGMMRRQVTCDVCHGTGKEIKDPCHTCHGTGHEKKTHKVSVKIPAGVETGQQIRLQGQGEAGFNGGPYGDLFVIINVLPSKQFERNGSTIYYNMNISFVQAALGDTVEVPTVHGDVEMTIPAGTQTGKTFRLKGKGAPKLRGGGQGPTCNRQYC

SEQ ID NO: 3062 - protein, 428 aa, Arabidopsis thaliana
  misc_feature (376)..(376): Xaa can be any naturally occurring amino acid
MATSASALLSPTTFSTAISHKNPNSISFHGLRPLRLGGSSSALPKLSTTGRKSSSAVVRAELSPSIVISLSTGLSLFLGRFVFFNFQRENVAKQGLPIRRIELCFRGAICAAVQRNYEETTSSVEEAEEDDESSSSYGEVNKIIGSRTAGEGAMEYLIEWKDGHSPSWVPSSYIAADVVSEYETPWWTAARKADEQALSQLLEDRDVDAVDENGRTALLFVAGLGSDKCVRLLAEAGADLDHRDMRGGLTALHMAAGYVRPEVVEALVELGADIEVEDERGLTALELAREILKTTPKGNPMQFGRRIGLEKVINVLEGQVFEYAEVDEIVEKRGKGKDVEYLVRWKDGGDCEWVKGVHVAEDVAKDYEDGLEYAVXAESVIGKRVGDDGKTIEYLVKWTDMSDATWEPQDNVDSTLVLLYQQQQPMNE

SEQ ID NO: 3063 - protein, 130 aa, Zea mays
  misc_feature (70)..(70): Xaa can be any naturally occurring amino acid
  misc_feature (81)..(81): Xaa can be any naturally occurring amino acid
  misc_feature (94)..(94): Xaa can be any naturally occurring amino acid
  misc_feature (101)..(101): Xaa can be any naturally occurring amino acid
HACVDSYALSESRLSEYTRRAEITTWGTTNLLLTRARMLELAARLTLPLSSAKESGGTLSLPGTQSAPNXSLSDERSALNXYYGNLKISGICDXMIGEPSXSNAKGHEYYSTYEPERSMTTLDMCMAELD

SEQ ID NO: 3064 - protein, 677 aa, Mycobacterium leprae
MDDRRLRTLPNEAYWIAVCGLLAFVVASARADSRGSGGTNNILQADHSMARAVHLMRHRGPDELSTWSDPDIDGFSGGVAFGFNRLSIIDIAHSHQPLRWGPPETPNRYILVFNGEIYNYLELRDELVIRHGAAFATDGDGESIVAGFHYWGTEILTRLRGMFAFALWDTIAHELFCARDPFGIKPLFMATGTNGTAVASEKKCLLELAEVIRFDTQIDTRALQHYTVLQYVPEPETLHRGVHRLESGCYARIRPEQLDPATTRYFVPQFAATPITSSTEQTRYGEITAVLADSVAKHMRADVTVGSFLSGGIDSTAIAALAIRHNPRLITFTTGFEHEGFSEIDVAAASAEAIGARHIVKVVTPNEFVAALPEIVWYLDEPIADPALVPLFFVAREARKHVKVVLSGEGADELFGGYRIYREPLSLKPFDYLPGPLRRSMGKVSKSLPEGMRGKNLLHRGSLTLEERYYGNARNFSEAQLQAVLPRFHTGWTHTDVTAAVYAESVGWDPVARMQHIDLFTWLRGDILAKADKMTMANSLELRVPFLDPEVFAVASRLPMQAKITRTTTKYALRRALESIVPAHVLHRPKLGFPVPIRHWLRAGELLEWAYALVNSSQAEHLVNLAAVHRMLDEHRGGISDHSRRLWTVLIFMLWHAIFIEHSVVPQISEPQYPVQP

SEQ ID NO: 3065 - protein, 303 aa, Bacillus cereus
MCENVTELIGDTPVVRLSKFIPEDAADVYVKLEMFNPSRSVKDRAAYNLLHVAEENGLIKPGDTIIEPTSGNTGIGLAMNAAAKGYKAILIMPDNMSKERINLLKAYGAEVVLTPAEQRMPGAIAKALELQKQIPNSFIPQQFENPANPNIHRYTTALEIYEQMDGELDAFVATAGTGGTITGTGETLKEKLPNLYIAVVEPKGSPVLSGGVPGPHKLVGTSPGFIPKNLNTEVYNEIIQIADEEALTTMRNLARQEGLLVGPSSGASVYAAIMIAKRLGVGKKVLCIAPDTGERYLSMGLFE

SEQ ID NO: 3066 - protein, 312 aa, Streptococcus gordonii
PDINKDPGAEDKYKEVQEAYETLSDEQKRAAYDQYGAAGANGGFGGGAGGFGGFDGSGFGGFEDIFSSFFGGGASRNPNAPRQGDDLQYRVNLKFEEAIFGTEKEIKYNREASCRTCSGSGAKPGTSPVTCGRCHGSGVINVDTQTPLGMMRRQVTCDVCHGRGKEIKEPCTTCHGTGHEKQAHSVHVKIPAGVETGQQVRLAGQGEAGFNGGPYGDLYVVVNVEPSDKFERDGSTIYYKLNLNFVQAALGDSVDVPTVHGDVELNIPEGTQTGKRFRLRGKGAPSLRGGSMGDQYVTVNVVTPTGLNDKQK

SEQ ID NO: 3067 - protein, 338 aa, Streptococcus hyointestinalis
EIKKAYRKMSKKYHPDINKEPGAEEKYKEVQEAYDTLGDEQKRAAYDQYGPAGANGFNGGAGGFGGFDGAGGFGGFEDIFSSFFGGGAAQRNPNAPRQGDDLQYRVQLKFEEAIFGTEKEVTYNREATCHTCGGSGAKPGTSPVTCHKCHGQGVITVDTQTPLGTMRRQVTCDVCHGTGQEIKDPCPTCHGTGHEKEKHTVSVKIPAGVETGQQIRLAGQGEAGFNGGPYGDLFVMITVQPSDKFEREGSTIYYTLNLNIVQAALGDVVDVPTVHGDVELSIPAGTQTGKTFRLRGKGAPKLRGGGQGDEHVTVKVVTPTKVNSAQKEALRALQKLGD

SEQ ID NO: 3068 - protein, 324 aa, Streptococcus hyovaginalis
HPDINKEAGAEQKYKDVQEAYETLSDSQKRAAYDQYGAAGAQGGFGGGAGGFGGFDGAGGFGGFEDIFSSFFGGGGASRNPNAPRQGDDLQYRVNLKFEEAIFGAEKEVTYSREATCHTCHGNGAKPGTQPVTCSRCHGQGVINVDTQTPLGMMRRQVTCDVCHGTGKEIKDPCPTCHGSGHEKETHKVDVKIPAGVETGQQIRLQGQGEAGFNGGPYGDLFVIINVMKSDKFEREGSTIYYTMDVSFVQAALGDVVDIPTVHGDVELTIPAGTQTGKTFRLKGKGAPRLRGNGQGDQHVTINIVTPTKLNDAQKEALHALQKL

SEQ ID NO: 3069 - protein, 450 aa, Bacillus cereus
MSTHVTFDYSKALSFIGEHEITYLRDAVKVTHHAIHEKTGAGNDFLGWVDLPLQYDKEEFARIQKCAEKIKNDSDILLVVGIGGSYLGARAAIEMLNHSFYNTLSKEQRKTPQVLFVGQNISSTYMKDLMDVLEGKDFSINVISKSGTTTEPALAFRIFRKLLEEKYGKEEARKRIYATTDKARGALKTLADNEGYETFVIPDDVGGRFSVLTPVGLLPIAVSGLNIEEMMKGAAAGREDFGTSELEENPAYQYAVVRNALYNKGKTIEMLVNYEPALQYFAEWWKQLFGESEGKDQKGIFPSSANFSTDLHSLGQYVQEGRRDLFETVLKVGKSTHELTIESEENDLDGLNYLAGETVDFVNTKAYEGTLLAHSDGGVPNLIVNIPELNEYTFGYLVYFFEKACAMSGYLLGVNPFDQPGVEAYKKNMFALLGKPGFEELKAELEERLK

SEQ ID NO: 3070 - protein, 124 aa, Thermotoga maritima
MKVGELVKGKVSKIVKYGAFVDIEGGERGFIHISKISKNYVKRIEDYLHEGQEISAKVIGRARNGGWELSLKDLEEETPKTGEKSEEKKNMDFEKKLSRFLKESSQKLSEYKKRLEKKGRRSAW

SEQ ID NO: 3071 - protein, 377 aa, Rhodopirellula baltica
MSSASSNGNAPSKIEKTIIIGSGPAGWSAAIYAARANLDPVLYEGTVKPEMIPLGQLAYTTEIENFAGFPAGNVRAFVESAVDKDRHWNLPMAPEGHEKDGQPHYAVQGVELMELMKQQALNFGTRVVGDDIERVDFSGPPHTLYPASGDPVQAHTVIIATGARANYLGLPSEELYKNKGVSACAVCDGALPVYRSKPLAVVGGGDSAVEEATYLANLKGADKIYLLVRRDQMRASKVMQDRAINHPNIEILWNTVVEEVLGDEKLVNGLRLKDTVDGSTRELKVGGMFVAIGHTPNTSFLDGAVEMNSEGYIQWTKAFRTNTSVNGVFAAGDVADDYYRQAITSAGTGCMAALDAERFLVEHEETTGTSEARPSLT

SEQ ID NO: 3072 - protein, 278 aa, Streptococcus infantis
EVQEAYETLSDEQKRAAYDQYGAAGANGGFGGAGGFGGFDGAGGFGGFEDIFSSFFGGGGSSRNPNAPRQGDDLQYRVNLTFEEAIFGTEKEVKYNRESSCRTCNGSGAKPGTSPVTCGRCHGSGVINVDTQTPLGMMRRQVTCDVCHGRGKEIKDPCTTCHGTGHEKQAHSVHVKIPAGVETGQQIRLAGQGEAGFNGGPYGDLYVVVSVEASDKFEREGTTIFYKLNLNIVQATLGDTVDIPTVHGDVELVIPEGTQTGKRFRLRGKGAPSLRGGA

SEQ ID NO: 3073 - protein, 265 aa, Magnaporthe grisea
MAAMFSQNPVMNGPNYAFSDTPRVNAPGGARQHGFNPYTDNGGSTLAIAGDDFAIMAGDTRMASGYSINTRFYPKVFKIGGTTADNSDATLVLSVVGFAADGEALKERLDAICKIYRYRHGKPMTVKACAKRLSTILYQKRFFPYYTHAILAGIDEEGHGAVYSYDPVGSYEREQCRAGGAAASLIMPFLDNQVNFKNQYVPGSGTGHDLQERERKPLPRETVETLVKDAFDGAVERHIEVGDGLQMMIITKDGIEEVIMPLKKD

SEQ ID NO: 3074 - protein, 189 aa, Coprinellus disseminatus
TREQHIRREKATSNICTAQALLANMAAMYAVYHGPEGLKRISNKVHGFTQVFKSSVESLGFKATNTTFFDTLTLDTTGAVANSWAVHVSANAAGINLRRIDDKHVGVTFDESVTPAELVNLINVFATAANKSPLTLSDLAEPTESAISPHLKRTSKFLPHPVFNKHHSETEMLRYINHLSSKDLSLTHS

SEQ ID NO: 3075 - protein, 135 aa, Zea mays
MATVLSSPRAPAFSFSLRAAPATTVAMTRGASSRLRAQATYNVKLITPEGEVELQVPDDVYILDYAEEEGIDLPYSCRAGSCSSCAGKVVSGSLDQSDQSFLDDSQVADGWVLTCVAYPTSDVVIETHKEDDLIS

SEQ ID NO: 3076 - protein, 542 aa, Oryza sativa
METTVSLLPHLLVKPSSSFSCCFTMGIGRRYGRIKVYAVLGDDEAQHAKNNMRGALFHVDNPGPMAPIAKGNFLDVNQALEVVRFGIQYCDWRARQDLLTIMVLHNKVVEVLKSLAIEFKSNGTLRKELAELQEELAKAHNQVHLSETRASSALDKLAQADNLVNDRLLQDGGSSASIDNYVSLASRTSSASRFVNKKTLRPSLDVSGPVQPYNPNLKNFWYPVVFSGDLKDDTMVPIDCFEEQWVIFRGKDGRPGCVQNTCAHRACPLHLGSVSEGRIQCPFHGWEYSTDGKCEKMPATKLLNVRIRSLPCFEQEGMVWIWPGDGTPESTIPSLQPPSGFTIHAEMVMELPVEHGLLLDNLLDIAHAPFAHTSTFAKGWSVPSLVKFLTPASGLQGYWDPYPIDMEFRPPCMVLSTTGISKPGKLEGKSIKQCSTHLHQLHICLPSSRNKTRMLYQMSLNFAPWLKHIPFMHILWSHFGEKVLNEDLRLVLGQQERMINGANVWNWPVSYDKLGIRYRLWRDAIERGANRLPFNNQSESGS

SEQ ID NO: 3077 - protein, 446 aa, Triticum aestivum
SLQLSHTLRHQITVGSSIPINLPVVNQVFSSNRAIIIPHTSPLARIRPLAGRYVPPEVAAVRVPLLNLSNFQINDWPELSAKSYAIMVLMLPSDSARNWHVHELELVEVVADQVAVALSHAAILEESMRARDLLMEQNVALDLARREAEMAIRARNDFLAVMNHEMRTPMNAIIALSSLLLETELTPEQRLMVETVLKSSNLLATLINDVLDLSKLEDRSLELEIRAFNLHAVFKEVMGFIRPIAAIKRLSMSVMLTPDLPLCAIGDEKRLMQTILNISGNAVKFTKEGHITLLASVLKPDSLREFRTPDFHPAASDDHFYLKVQLKDTGCGISPQDLPHVFTKFAQTQPGGNQGYSGSGLGLAICRRFVTLMGGHIWLDSEGAGRGCTATFIIRLGVSDNTDAYQQQLAPLAWPGSANVESAGPKALHEETWPPSSLKPRYQRSV

SEQ ID NO: 3078 - protein, 257 aa, Prochlorococcus marinus
MKPLRLSSLDPVRMPEWRWAPFLSHAINALIPLKPEPYPVAPEFLQREGKTGSKSQPIKVTTCTWACRTKKFRQVRAACVEAGSSASVLNFVINPYHTFDLPFFGADLVTLPSGHLLALDLQPAITSDERHTKQVWERLMPIFEQWRVRLPEGGPIPEEAKPYFSPGFLWTRLHLGSEGNQLIDEVIMPAFRDYLNLYLDLVEMAEEVSPQRAFKLLEGQKRYLSYRGKKDPARAMLARFHGHQWTESYIHNVLFDL

SEQ ID NO: 3079 - protein, 331 aa, Bacillus thuringiensis
MNLAKFPRKKYTESYTPIEKLNNFSEALGGPTIYFKRDDLLGLTAGGNKTRKLEFLVADAQAKGADTLITAGGIQSNHCRLTLAAAVKEKMKCILVLEEGLEPEEKRDFNGNYFLYHLLGAENVIVVPNGADLMEEMHKVAKEVSEKGNTPYVIPVGGSNPTGAMGYVACAQEIMAQSFDQGIDFSSVVCVSGSGGMHAGLITGFAGTQSNIPVIGINVSRGKAEQEEKVAKLVDETSAHVGIPNFIPREAVTCFDEYVGPGYALPTPEMVEAVQLLAKTEGILLDPVYTGKAVAGLIDLIRKGTFNKEDNILFVHSGGSPALYANTSLFA

SEQ ID NO: 3080 - protein, 330 aa, Schizosaccharomyces pombe
MSNKSAWQPQFDEIHSSVQEAEGFLQSSNDVQKAIDEVHYPDSLNDLSEISKNLYISSWKTASELVSTSDKGIDYTLSAMSINPNLSVPEQQHLWLQIEDSSSQNILQYFEKSNKFIAFALSKNAKVLVHCFAGISRSVTLVAAYLMKENNWNTEEALSHINERRSGISPNANFLRQLRVYFECNYQLDRSLRPYRQWLFRRYGDFAVLNTRVPSEVAYAETVRARAGQLELRCKKCRFVLASSDYLVSHEPKDENNYSHTRCTHYFLEPIRWMQPELELGNLEGRFDCPKCNSKIGSYKWQGLQCSCLQWVCPALSILQSRVDAVRKLG

SEQ ID NO: 3081 - protein, 430 aa, Staphylococcus aureus
MKTTIKQAKDHLNQDVTIGAWLTNKRSSGKIAFLQLRDGTGFMQGVVVKSEVDEEVFKLAKEITQESSLYVTGTITEDNRSDLGYEMQVKSIEVISEAHDYPITPKNHGTEFLMDHRHLWLRSKKQHAVMKIRNEVIRATYEFFNKDGFTKVDPPILTASAPEGTSELFHTKYFDQDAFLSQSGQLYLEAAAMAHGKVFSFGPTFRAEKSKTRRHLIEFWMIEGEMAFINHAESLEIQEQYVTHVVKSVLENCKLELKILERDTSKLEKVATPFPRISYDDAIEFLKSEGFDDIEWGEDFGAPHETAIANHYDLPVFITNYPTKIKPFYMQPNPENEETVLCADLIAPEGYGEIIGGSERVDDLELLEQRVKEHGLDEEAYSYYLDLRRYGSVPHCGFGLGLERTVAWISGVEHVRETAPFPRLLNRLYP

SEQ ID NO: 3082 - protein, 847 aa, Escherichia coli
  misc_feature (399)..(399): Xaa can be any naturally occurring amino acid
  misc_feature (721)..(721): Xaa can be any naturally occurring amino acid
MSKVRLAIIGNGMVGHRFIEDLLDKSDAANFDITVFCEEPRIAYDRVHLSSYFSHHTAEELSLVREGFYEKHGIKVLVGERAITINRQEKVIHSSAGRTVFYDKLIMATGSYPWIPPIKGSDTQDCFVYRTIEDLNAIESCARRSKRGAVVGGGLLGLEAAGALKNLGIETHVIEFAPMLMAEQLDQMGGEQLRRKIESMGVRVHTSKNTLEIVQEGVEARKTMRFADGSELEVDFIVFSTGIRPRDKLATQCGLDVAPRGGIVINDSCQTSDPDIYAIGECASWNNRVFGLVAPGYKMAQVAVDHILGSENAFEGADLSAKLKLLGVDVGGIGDAHGRTPGARSYVYLDESKEIYKRLIVSEDNKTLLGAVLVGDTSDYGNLLQLVLNAIELPENPDXLILPAHSGSGKPSIGVDKLPDSAQICSCFDVTKGDLIAAINKGCHTVAALKAETKAGTGCGGCIPLVTQVLNAELAKQGIEVNNNLCEHFAYSRQELFHLIRVEGIKTFEELLAKHGKGYGCEVCKPTVGSLLASCWNEYILKPEHTPLQDSNDNFLANIQKDGTYSVIPRSPGGEITPEGLMAVGRIAREFNLYTKITGSQRLAMFGAQKDDLPEIWRQLIEAGFETGHAYAKALRMAKTCVGSTWCRYGVGDSVGLGVELENRYKGIRTPHKMKFGVSGCTRECSEAQGKDVGIIATEKGWNLYVCGNGGMKPRHADLLXADIDRETLIKYLDRFMMFYIRTADKLTRTAPWLENLEGGIDYLKAVIIDDKLGLNAHLEEEMARLREAVVCEWTETVNTPSAQTRFKHFINSDKRDPNVQMVPEREQHRPATPYERIPVTLVEDNA

SEQ ID NO: 3083 - protein, 460 aa, Oryza sativa
MAAAGRTLGCIYAGTLVTASAHIITAVIGSGVLSLAWAIAQLGWVIGPAVLVAFSVITWFCSSLLADCYRSPDPVHGKRNYTYGQAVRANLGVAKYRLCSVAQYVNLVGVTIGYTITTAISMGAIKRSNWFHRNGHDAACLASDTTNMIIFAGIQILLSQLPNFHKIWWLSIVAAVMSLAYSTIGLGLSIAKIAGGAHPEATLTGVTVGVDVSASEKIWRTFQSLGDIAFAYSYSNVLIEIQDTLRSSPAENEVMKKASFIGVSTTTTFYMLCGVLGYAAFGNRAPGNFLTGFGFYEPFWLVDVGNVCIVVHLVGAYQVFCQPIYQFAEAWARSRWPDSAFVNGERVLRLPLGAGDFPVSALRLVWRTAYVVLTAVAAMAFPFFNDFLGLIGAVSFWPLTVYFPVQMYMSQAKVRRFSPTWTWMNVLSLACLVVSLLAAAGSIQGLIKSVAHYKPFSVSS

SEQ ID NO: 3084 - protein, 218 aa, Brucella melitensis
MSFFDSYRKKMQMPSKEEVLPGRVQPIPTAAAHFVSGHPLKGPWPDGMKQVLFGMGCFWGAERLFWQVPGVYVTAVGYAGGITPNPTYEETCTGLTGHAEVVLVVYDPKVVTLNELLALFWEEHDPTQGMRQGNDIGTTYRSVIYTFNAVDRAVAEKSRDAYSQALASRGLGPVTTQITDAPDFYYAEDYHQQYLAKNPDGYCGLRGTGVSCPIPLAH

SEQ ID NO: 3085 - protein, 361 aa, Helianthus annuus
MTSAIGFEGFEKRLEISFFNPGPSVDPVARGLRSLTKNQLDKFLAPAECTIVSSLSNDLLDSYVLSESSLFVYPYKIIIKTCGTTKLLLSIPHILELSGELSLTVQSVRYTRGSFIFPGAQTFPHRSFTEEVMVLDSHFGKLGMCSNAYVMGGAEKDQKWHVYSASAESANLVTQTAPVYTLEMSMTGLSKRNASVFFKSESSSAAVMTEDSGIRKILPESQICDFDFDPCGYSMNAIEGDAISTIHVTPEDGFSYASFEAVGYDFKSMGLTVLIERVLACFEPSEFSVALHGNENVVKDLNLENNDVNVKGYNVEETKFEVLGGEGGSMVYYGFARGGSSCGSPRSTLHRCWSETENEEE

SEQ ID NO: 3086 - protein, 430 aa, Agrobacterium tumefaciens
MQDKILLIEDSVALSMLLRTRLSDETEAEVVHCASMAEADALMQANNFTLALTGLNLPDAPKGEILTLLSERKVPAIVFTATVDEEARKRYAEKKIIDYIVKDGHRTVDAVVKTVDRIMTNKRFSVLVVDDARTARSGLVEILERQNFKVSEAHSGNRALEILSQDPSIQLVITDYHMPDMDGYELTRRIRDSRSSEDLRVIGISSSTDRLLSASFLKAGASDFVYRPFVPEELQCRIDNNIETLKQLKRLRELAERDHLTGLPNRRSFFERTRALMDVINDNDESGAVAILDIDHFKKINDTLGHDAGDRALKKLAELLQGMCDEQRHIPARLGGEEFAVFLRGLDARAAYAFCEELREQVEKNGRQLSGSSLALTISLGVVEIEKGEPFDNQLNAADQLLYLAKANGRNRVYSDIMIQEGLQKIGLNG

SEQ ID NO: 3087 - protein, 547 aa, Clostridium perfringens
MFCFQCQETAGCKGCTVRGVCGKTEDVAKIQDLLIFVTKGLATVANEGRKVGIVDKKVNRMIIDNLFITITNANFDFKAIEKRVKDTLVAREELKERVQANGGNPIGSDFKGCATWTATTSEEMMEKASQVGVLATENEDIRSLRELIMYGLKGLAAYMEHAMNLGHDKEEVHAFMAETLVKILDDSLSADELTALALETGKFGVDGMALLDEANTSTYGHPEITKVNIGVRNNPGILISGHDLKDLEMLLEQTEGTGVDVYTHGEMLPGHYYPKFKKYAHFAGNYGNAWWLQNKEFASFNGPILMTTNCITPVQDSYRGRIFTTGAVGYEGCIHITADENGHKDFSQIIELAKTCKAPTEIETGEIVGGFAHNQVLALADQVVDAVKSGAIRRFFVMAGCDGRAKSRDYYREFAEKLPKDTVILTAGCAKYKYNKLPLGDINGIPRVLDAGQCNDSYSLVVIALKLAEVFGTDSVNELPISYNIAWYEQKAVIVLLSLLHLGVKNIHLGPTLPAFLSPNVAKVLVENFGIGGITNVEDDMKMFLGE

SEQ ID NO: 3088 - protein, 256 aa, Streptococcus agalactiae
MAVISMKQLLEAGVHFGHQTRRWNPKMAKYIFTERNGIHVIDLQQTVKLADQAYEFVRDAAANDAVILFVGTKKQAAEAVAEEAKRAGQYFINHRWLGGTLTNWGTIQKRIARLKEIKRMEEEGTFELLPKKEVALLNKQRARLEKFLGGIEDMPRIPDVMYVVDPHKEQIAVKEAKKLGIPVVAMVDTNADPDDIDVIIPANDDAIRAVKLITSKLADAVIEGRQGEDADVDFAQEAQADSIEEIVEVVEGSKND

SEQ ID NO: 3089 - protein, 283 aa, Brassica juncea
MAATSLGVSEMLGTPLNFRAVSRPSAPLASIPATFKTVALFSKKKPAPPPKAKTVSAANDELAKWYGPDRRIFLPDGLLDRSEIPEYLNGEVAGDYGYDPFGLGKKPENFAKYQAFELIHARWAMLGAAGCIIPEALNKYGANCGPEAVWFKTGALLLDGNTLSYFGKNIPINLVLAVVGEVVLLGGAEYYRITNGLDFEDKLHPGGPFDPLDLAKDPEQGALLKVKEIKNGRLAMFSMFAFFIQAYVTGEGPVENLSKHLSDPFGNNLLTVIAGTAERAPTL

SEQ ID NO: 3090 - protein, 301 aa, Streptococcus iniae
KYKDVQEAYETLSDSQKRASYDQYGAAGAQGGGFGGGFGGGFDGGGFGGFEDIFSSFFGGGGASRHPNAPRQGDDLQYRVNLDFEEAVFGTEKEVSYHRESTCGTCSGSGAKPGTSPVTCGRCHGAGVINVDTQTPLGMMRRQVTCDVCHGSGKEIKEPCHTCHGTGHEKKTHKVSVKIPAGVETGQQIRLQGQGEAGFNGGPYGDLFVVLNVLPSKKFERNGSTIYYDLNISFVQAALGDTVDIPTVHGDVEMSIPAGTQTGKTFRLKGKGAPKLRGAGQGDQHVTITVVTPTKLNHEQK

SEQ ID NO: 3091 - protein, 944 aa, Cryptococcus neoformans
MSSLASAPPTASIPASDSYNSPVQSSGPGLGNGNSTPSKWKSVFKLGRTATIGRGKENRSALGGESFVLDNKEQQSFAGEVSPAVPTEPYLPPRKTQLRAHTDPYPPKSPSVKNNPGSVSVEHFDSKVLHEEGMPKTREEGSSESFNVHLNSSNGNLQTTSTSGEQSRPYSSVTDSASASTTERTSHSSGGHFLPGDGSLHGVASSNTYGTASTRSPTGGPLGIGNLKSRFFSAPLSAPAGKNKHDKSKSEKYRGLGKVATDFPQSTAPPSSAGGASSSGGGRKKSDGSSSLSSRGAASPRTPAKSKREPSANSSRRMPFGQTNDNGSNSGSVAARFLRRVVSAPNTKALFSNNLFSNAPDVPPLPAPKNQPNSSTSSKEKSSSPVVIVGNSGGHIDLTSSPDSDHPPSISPLSNSSTMYTSQTSHTPSASASATPTPSPLKQKNHFLSPTASPSPGQGSGLSAKGTRASRSLTTGTAPVLKNIRQLQGYSGSSPGGGGYMDGESRHKQVFKRTYSSNSIKTKQVEVTASSFQKIKLLGKGDVGKVYLVREKKTDKLFAMKVLSKKEMIKRNKIKRALAEQEILATANHPFIVTLFHSFQSQDYLFFVLDYCMGGEFFRALQTRPGKCLSEEHAKFYAAEVTAALEYLHLNGYIYRDLKPENILLHQSGHIMLSDFDLSKQSGEAGGAPAAIRHGGPNGQTILVDTRSCIADFRTNSFVGTEEYIAPEVIKGHSHSSAVDWWTLGILVYEMIFATTPFKGPNRNATFANVMKNEVLFPESVPVSSNCKSCIRKLLIKDENKRLGSASGASEVKQHKWFASVNWGLLRNMTPPIIPEESNGIDTINFRPLRESKSIDFDRDDITTDIIHAKAGSPSVSGNSTPGMLTPKELVQTTSSSSPIGGGAGGTSGHSSSAMPIPGSMRGYDKEKNPFGEFSSVTRDFGEC

SEQ ID NO: 3092 - protein, 350 aa, Streptococcus macacae
EIKKAYRKMSKKYRPDINKEPGAEEKYKEIQEAYRTLGDDQKRANYDQFGPEGAANGGFGGGAGGFSGFDSAGFGGFEDIFSSFFGGGGASRNPNAPRQGDDLQYRVNLKFEEAIFGTEKEVHYNREVTCHTCDGSGAKPGTSPVTCSKCHGSGVINVDTQTPLGMMRRQMTCDVCHGSGKVIKEPCPTCHGSGREKQRHKMAVTIPAGVETGHQVRVVGQGEAGFNGGPYGDLYVIINVLASDKFERDGSTIYYNLDINFVQAALGDTVEVPTVHGAVDLKIPAGTQAGKVIRIKGKGAPRLNGNGQGDQRVTVNVVTPTKLNEAQKEALQAFAKASNMNPVHPKKKAS

SEQ ID NO: 3093 - protein, 64 aa, Glycine max
ENLAELGCVDNSQTKRARIIELSRRLRHRGPDWSGIHCYEDCYLAHRRLAIVDPTSGDQPLYNE

SEQ ID NO: 3094 - protein, 134 aa, Unknown
  Erwinia sp. Ejp 556
MSETLKVLNNIRTLRAQAREVSLSELEEMLEKLEAVVNERRDAEAAIASEIKEKEEKLAKYRQMLLEDGIDLSELTSAENTSGKPRAKRAPRPAKYEYTDENGEQKSWTGQGRTPAVIKQALDAGKKLEDFLIK

SEQ ID NO: 3095 - protein, 178 aa, Bacillus cereus
MSEKTYELATFAGGCFWCMVKPFDELPGIHKVLSGYAGGHVENPTYEQVKAGTSGHLEVVQITFDPSIFPYQKLLDLYWPQIDPTDDGGQFFDRGPSYRTAIFYHNETQKGLAEKSKQALAESGMFKDPIVTEIRPAAPFYEAEEYHQHFYKKNPEKYATEQKESGREDFIKENWQKK

SEQ ID NO: 3096 - protein, 487 aa, Skeletonema costatum
MSEVQSGQAEIKKYQTYALNVDPLQDDKATEIKLCNFSRPHMRAFHCSWFCFFTAFFIWFAIAPLMPEIKTTLGLTKQQIWTSNICSVAGTIFMRFVNGPICDKYGARIPMGFILVGASIPCAMTGLVTNAANLSVLRFFIGLGGSTFVMCQYWTSRMFTKEVVGTANALVGGWGNLGGGVTQLIMGSVLFPLFKLGMSAEMAWRTVCIVPAVVGIAVGFIILKISDDAPKGNYNEMKKNGTMAEVSAAASFRAGAMNFNTWLLFVQYACCFGVELTMNNAAALYFREKFLLTTETAAAIASLFGWMNLFARGVGGFVSDKANARMGMRGRIWWQTICLVCEGIMVLIFAHSNSLGAAIVLMVIFSSFVQAAEGSSYGIVPYINPPATGSIAGIVGAGGNTGAVAFGLGFRQLPYYDAFILMGSCIIASGVLSLFICIKGHAGLVTGQDSEEAIAAWKKLGSAPAATTLQVPEPDEDAAAEIEEDKA

SEQ ID NO: 3097 - protein, 348 aa, Streptococcus mitis
KSKKAYRKLSKKYHPDINKEPGAEEKYKEVQEAYETLSDDQKRAAYDQYGAAGANGGFGGAGGFGGFDGAGGFGGFEDIFSSFFGGGGASRNPNAPRQGDDLQYRVNLTFEEAIFGAEKEVKYNREASCSTCNGSGAKPGTSPVTCGRCHGAGVINVDTQTPLGMMRRQVTCDVCHGRGKEIKDPCTTCHGTGHEKQAHSVHVKIPAGVETGQQIRLAGQGEAGFNGGPYGDLYVVVSVEASDKFEREGTTIFYNLNLNFVQAALGDTVDIPTVHGDVELVIPEGTQTGKKFRLRGKGAPSLRGGAVGDQYVTVNVVTPTGLNERQKAALKEFAAAGDLKVNPKKKGF

SEQ ID NO: 3098 - protein, 175 aa, Oryza sativa
MAPSVMASSATTVAPFQGLKSTAGMPVARRSGNSSFGNVSNGGRIRCMQVWPIEGIKKFETLSYLPPLTVEDLLKQIEYLLRSKWVPCLEFSKVGFVYRENHRSPGYYDGRYWTMWKLPMFGCTDATQVLKELEEAKKANPDAFVRIIGFDNVRQVQLISFIAYKPPGCEESGGN

SEQ ID NO: 3099 - protein, 445 aa, Thalassiosira weissflogii
KPHMRTFHCSWICFFTAFFIWFAIAPLLPEVKETLGLSKQQVWTSNICSVAGTIFMRFVNGPLCDKYGARILMGAMLFLASIPCALTGLVQNSAQLCVLRFFIGLGGSTFVMCQYWSSRMFTKEVAGTANAIVGGWGNLGGGVTQLIMGSVLFPLFKTGMSAEQAWRTVCIVPAVVGMTLGILVTKISDDAPKGNYSEMKKNGTMPEVSAAASFRTGTLNVNTWLLFIQYACCFGVELTMNNAAASYFKSTFELTTESAAAIASIFGWMNLFARGLGGFFSDKLNSKMGMRGRLIVQTICLVAEGVLVFVFANTPQLWAAILVMVFFSMFVQAAEGSTYGIVPYVNPPATGSIAGIVGAGGNTGAVCFGLGFRQLEAKPAFYLMGGCIVASGVLSLFICIKGHAGLVTGQDNPEVIAAYKKTAGAASATIQVPEPDAEAAEEMEK

SEQ ID NO: 3100 - protein, 310 aa, Selenomonas ruminantium
MAKIYNSVTELIGNTPLLKANNFIEANDLQANILVKLEYLNPAGSVKDRIAKAMIEQAEKEGKITKDTVIIEPTSGNTGIGLASFAAARGYKAILTMPETMSVERRNLLKAYGAQIVLTDGAKGMKGAIAKAEELAKETPNAFIPSQFTNQANPAIHEATTGPEIWQDAEGKVDVFIAGVGTGGTLTGVGRYLKKQNAAVHIVAVEPESSPVLSQGTAGPHKIQGIGAGFVPETLDTKVYDEVLPISNEDAFKYGRQFAHSEGVLVGISAGAALAAAVQLAKRPEFAGKNIVALLPDTGDRYLSTELFND

SEQ ID NO: 3101 - protein, 347 aa, Streptococcus mutans
EIKKAYRRMSKKYHPDINKEPGAEEKYKEIQEAYDTLGDEQKRAAYDQYGPAGANGGFGDGSGFSGFDSSGFGGFEDIFSSFFGGGASRNPNAPRQGDDLQYRVNLQFEEAVFGTEKEVHYNREASCHTCNGSGAKPGTSPVTCSKCHGSGVINMDTQTPLGMMRRQVTCDVCHGTGQEIKEPCPTCHGTGHEKQSHKVSVKIPAGVETGQQIRLAGQGEAGFNGGPYGDLFVIINVLKSDKFERDGSTIYYSMDINFVQAALGDTVEVPTVHGNVELAIPAGTQTGKTFRLKGKGAPRLRGNGQGDQHVTVNVVTPTKLNDAQKEALQDFAKASGINPVHPKKKGF

SEQ ID NO: 3102 - protein, 204 aa, Zea mays
MASSMLSSAAVVTSPAQATMVAPFTGLKSSSAFPVTRKANNDITSIVSNGGRVSCMKVWPPVGKKKFETLSYLPDLTEVELGKEVDYLLRNKWIPCVEFELEHGFVYREHGSTPGYYDGRYWTMWKLPLFGCTDSAQVLKEVQECKTEYPNAFIRIIGFDNNRQVQWISFIAYNPQASPVFNSRWRTFKKKSTPSPISPLAGSF

SEQ ID NO: 3103 - protein, 489 aa, Unknown
  Photobacterium sp. SKA34
MTNKAVKEQHVIIWFRSDLRVVDNTALNHAIESGLPIIALFIATPMQWHQHNMAAVQVDFIHRRLQVLKQQLAKRNIPLQVIEVNDFSESVYLIEQVCIDYNAVHVFANKQYPINEHKRDNSVGELLAKKSIKFSIFDDNYILQPEMVLTRDGELFKVFTPFRNAWIKRFSSSTCYPVTINSDIVTSGVVSKLLSDSSQIKAFNYPIIDSVLWPVDEETIAQRLETFCETKAETYHQNRDFPAIDGTSCLSPYLAIGALSARQCLHQLQQYFPNAFEINKDDGAFTWLNEIVWREFYGHLLHRYPELSKHQPFQKFTQFVKWKDDEALLKAWQEGKTGFPIVDAGMRQLRATGWMHNRLRMITASFLTKDLLCDWRVGEQWFMQHLIDGDFSSNNGGWQWAASTGTDAQPYFRVFNPTLQGQRFDPKGDFIRTWVKELEHVPDKYIHTPHQWASEESLNYPLPIVDHKEARLIAIESFKQAKAYMDIHQ

SEQ ID NO: 3104 - protein, 254 aa, Cryptococcus neoformans
MRLSTILSKSSSSSNRWLTRQSRDPYVRQRTGTSSSPSQPSYRSRSSFKLVSLAKSHPILSRETKSVVDLGAAPGGWSQVAAHLLGVDKKPTSKPRVWAIDILPMDPIPAVQTLQGDFLSSSVRETLQSLVGTPESGGGVDTVLSDMMAPMTGVRTRDVGLSLELCAAATVFARGVLKQASKEDEVKVVKGKKVWPGGNLVMKFFAHPDLDEFRKLELDRWFGKVVVEKPKESRSESSEAYWVCLGFKGDPALR

SEQ ID NO: 3105 - protein, 348 aa, Streptococcus oralis
EIKKAYRKLSKKYHPDINKEPGAEEKYKEVQEAYETLSDDQKRAAYDQYGAAGANGGFGGAGGFGGFDGAGGFGGFEDIFSSFFGGGGASRNPNSPRQGDDLQYRVNLTFEEAIFGTEKEVKYNREASCRTCNGSGAKPGTSPVTCGRCHGAGVINVDTQTPLGMMRRQVTCDVCHGRGKEIKDPCTTCHGTGHEKQAHSVHVKIPAGVETGQQIRLAGQGEAGFNGGPYGDLYVVVSVEASDKFEREGTTIFYKLNLNIVQATLGDTVEIPTVHGDVELVIPEGTQTGKKFRLRGKGAPSLRGGAVGDQYVTVNVVTPTGLNDRQKAALKEFAAAGDLKVNPKKKGF

SEQ ID NO: 3106 - protein, 490 aa, Geobacter sulfurreducens
MSKRSMKRWAVVTALAATAAVAAAGAGCAPKKVEQAGRVAIPDGTIDPAEWGKAYPVHYDLWKKTEEPTVAGKSRYKKGYDDDGVFYDKLDEFPFLALLYNGWGFGVEYKEPRGHAHMVRDQFEVDPGRVKAGGSCLTCKTPYAPALQQRLGKDYFSKPYKEVHAQIPKEHQMLGVACIDCHNNNDLSLKVSRGFTLGKALEKLGVDQEKLSTQDKRTLVCAQCHVTYSIPKDENMKSTDVFFPWDGSSYGGITIENIIAKLRSNPANREWTQGVTGFKLAFIRHPEFELFSNNSVHWQAGVACSDCHMPYTKVGTRKVSDHRVMSPLKNDLKACQQCHAESPEWLRNQVYAIQDRTMSQFIRAGYATATVAKLFEMAHKAQAEGKQIDKALYDQARDHYEEAFYRVVFIGAENSIGFHNPTEALRITGDAAAHAGKAEGFLRQALAKAGVTVPLKVDLELAKYTNNRGVKKLMFKAEHEIKDPLAAKEK

SEQ ID NO: 3107 - protein, 159 aa, Burkholderia vietnamiensis
MSTLYSFSAETLAGEPVSLDAYRGKVLLIVNTASECGFTPQYAGLQKLYDRYAARGFSVLGFPCNQFGKQEPGDATQIGAFCERNYGVTFPMFAKIDVKGDHAHPLYRYLTDEAPGILGLKAIKWNFTKFLIGRDGRIVKRYAPSTKPEEIAADIDKLL

SEQ ID NO: 3108 - protein, 255 aa, Nostoc punctiforme
MNSERSDVTLYQPFLDYAIAYMRSRLDLEPYPIPTGFESNSAVVGKGKNQEEVVTTSYAFQTAKLRQIRAAHVQGGNSLQVLNFVIFPHLNYDLPFFGADLVTLPGGHLIALDMQPLFRDDSAYQAKYTEPILPIFHAHQQHLSWGGDFPEEAQPFFSPAFLWTRPQETAVVETQVFAAFKDYLKAYLDFVEQAEAVTDSQNLVAIKQAQLRYLRYRAEKDPARGMFKRFYGAEWTEEYIHGFLFDLERKLTVVK

SEQ ID NO: 3109 - protein, 457 aa, Escherichia coli
MDHLPIFCQLRDRDCLIVGGGDVAERKARLLLDAGARLTVNALAFIPQFTAWADAGMLTLVEGPFDESLLDTCWLAIAATDDDALNQRVSEAAEARRIFCNVVDAPKAASFIMPSIIDRSPLMVAVSSGGTSPVLARLLREKLESLLPLHLGQVAKYAGQLRGRVKQQFATMGERRRFWEKLFVNDRLAQSLANNDQKAITETTEQLINEPLDHRGEVVLVGAGPGDAGLLTLKGLQQIQQADVVVYDRLVSDDIMNLVRRDADRVFVGKRAGYHCVPQEEINQILLREAQKGKRVVRLKGGDPFIFGRGGEELETLCNAGIPFSVVPGITAASGCSAYSGIPLTHRDYAQSVRLITGHLKTGGELDWENLAAEKQTLVFYMGLNQAATIQQKLIEHGMPGEMPVAIVENGTAVTQRVIDGTLTQLGELAQQMNSPSLIIIGRVVGLRDKLNWFSNH

SEQ ID NO: 3110 - protein, 366 aa, Rhodopirellula baltica
MSDSFILCSGKTATGTKKVFRRLASMTKCKLEYIWLDGYQPTQSMRSKTKIVEDFSGKVEDAEMWSFDGSSTEQAPGGASDCLLKPVFCLPDPDRLGTGFLVMCEVMNADGTPHRSNGRATIKDDDNDFWFGFEQEYTIFDPETKKPIGFPAEGFPGPQGPYYCSVGAGKAVGREIVEEHLELCLQAGLNVEGINAEVMMGQWEFQIFAKGAAQAGDEIWLARYLLDRTGEKYGMEINYHCKPVKGDWNGSGMHANFSNTTLRTCGSKEVYEAICQAFEPRITEHIDVYGADNDQRLTGLHETQSIDKFSYGISDRGASIRIPIATVEKGWKGWLEDRRPASNADPYMVASAIIATVKTANVPAGV

SEQ ID NO: 3111 - protein, 168 aa, Yarrowia lipolytica
MSAEKTNTAFYNLAPLDKNGEPFPFKQLEGKVVLIVNVASKCGFTPQYKGLEEVYQKYKDQGFTIIGFPCNQFGGQEPGSADEISSFCQLNYGVTFPVLQKINVNGNDADPVYVYLKEQKAGLLGFRGIKWNFEKFLVDKHGNVVDRYASLKTPAGLESTIETLLKKP

SEQ ID NO: 3112 - protein, 308 aa, Geobacter sulfurreducens
MEHPPFSLAGSIGATPLVELRHLNPNPRVRILAKLEGNNVGGSVKDRPALYMLAKAEESGELVPEKTILEPTSGNTGIALAMLGTVKGYRVKLVMPACVSLERRAVLEAYGAELVLSPHDEATDGAIRLAHRILEEEPDRYYMPNQYANPNNPLAHYETTAPEIFRDTGGAVDFFVAGMGTGGTLMGTSRYFREKKPSVRIVGVEPRLGHKVQGLKNMQEAIVPPIYHPEALDLKLTVHDEPAFDTARELAAREGLFVGMSSGAAVAGAVQVARDAPAGSTIVVLLPDRGDRYLSTVLFRSVCGKCPP

SEQ ID NO: 3113 - protein, 711 aa, Salmonella enterica
MLNPIVREFQYGQHTVTLETGMMARQATAAVMVSMDDTAVFVTVVGQKKAKPGQDFFPLTVNYQERTYAAGRIPGSFFRREGRPSEGETLIARLIDRPVRPLFPEGFVNEVQVIATVVSVNPQVNPDIVAMIGASAALSLSGIPFNGPIGAARVGYINDQYVLNPTQDELKESKLDLVVAGTEAAVLMVESEAELLSEDTMLGAVVFGHEQQQVVIQAINDLVKEAGKPRWDWQPEAVNDALNARVAALAESRLSDAYRITDKQERYAQVDVIKSETIEQLIAEDETLDANELGEILHAIEKNVVRSRVLAGEPRIDGREKDMIRGLDVRTGVLPRTHGSALFTRGETQALVTATLGTARDAQVLDELMGERTDSFLFHYNFPPYSVGETGMVGSPKRREIGHGRLAKRGVLAVMPDMDKFPYTVRVVSEITESNGSSSMASVCGASLALMDAGVPIKAAVAGIAMGLVKEGDNYVVLSDILGDEDHLGDMDFKVAGSRDGISALQMDIKIEGITKEIMQVALNQAKGARLHILGVMEQAINAPRGDISEFAPRIHTIKISTDKIKDVIGKGGSVIRALTEETGTTIEIEDDGTVKIAATDGEKAKYAIRRIEEITAEIEVGRIYNSKVTRIVDFGAFVAIGGGKEGLVHISQIADKRVEKVTDYLQMGQEVPVKVLEVDRQGRVRLSIKEATEQSQPAAAPEAPASEQAE

SEQ ID NO: 3114 - protein, 361 aa, Nicotiana sylvestris
MDMALPVSAIGFEGFEKRLEISFFEPGLFADPNGKGLRSLSKAQLDEILGPAECTIVDSLSNDDVDSYVLSESSLFVYSYKIIIKTCGTTKLLLAIPPILKLAETLSLKVQDVRYTRGSFIFPGAQSFPHRHFSEEVAVLDGYFGKLAAGSKAVIMGSPDKAQKWHVYSASAGPIQSNDPVYTLEMCMTGLDREKASVFYKTEGSSAAHMTVRSGIRKILPNSEICDFEFEPCGYSMNSIEGAALSTIHITPEDGFSYASFEAVGYDMKTMKLGPLVERVLACFEPDEFSIALHADVATKLLERVCSVDVKGYSLAEWSPEEFGKGGSIVYQKFTRTPFCGSPKSVLKGCWKEDEEKEEKE

SEQ ID NO: 3115 - protein, 284 aa, Francisella tularensis
MLKTKSLTPHEYDIIINKATEKPFTGRYNDLDQKGVYICRNCGTPLFRADSKFISACGWPSYDIHIDNNVKQLPDADGRRTEILCNNCDGHLGHIFHGEGYTKLNTRYCVNSACVDFIPIEDFGTTEEIIVAAGCFWGVEYYMKKLPGVLFAESGYCGGDQPYPDYKKVCQGDTGYLEVVRVIFDTSKVSLQQVLKYFFEIHDFEQVDGQGPDIGEQYKSAIFYYDDKQKQIAEDLKHILAQKGYKVATEIRAMKPYYVAEDYHLDYYMKKGTLPYCHSHKKIF

SEQ ID NO: 3116 - protein, 771 aa, Candida glabrata
MSEKDGGNTVFINKLYDLLENKDLDDLIWWAANGESFLIRPSESFSQNLAHYFKHTNITSFVRQLNIYGFHKISNDHFHNLKREKKQKSSTDNNTGVSNNNSGDENIKVWEFKHSGGLFKKGDLENLKLIKRRSSSRTIPSLSLASSNTNTSTLETNDGAEIDNVKVIASAVHNATEHLKKKDKVKKEGKKSSKKSTKLKNEPTVDISNTETTSAAITNESEQSSNKRATRVYKSVGTISNQDSKNPEKLTKKPKKNSNLKNKGKKSKSNSVDGQSIDNIQPNENQPINIQVNTTEIPTDNTLHHYNETLYEQSIQLNHQIAQMRNTNMDMLAILELMSKLAEMNKEVLNINNSEKIPELMANHYRFFDAQLTSLKNNILDRINNTNIHKFGMDSNDLRSASQTNIHLSHPIAQNMVYSSADQAIPKSVPYYLKQGQRTSPDNGTTTPAGAQNYSKNQVVQHPQAANDYFSSVHVQTANPFEKFQTEKNGIINVTARRHMSVLVDPLTPASMMSVPTTTQSSLSGPSLYNQQHAIIFPHDLNQAFNSRSEPTITPITGHHSNFTRASDSNLMNTKQTIVNSMKNRASYPSRRTESPLKYSSGMPIEEEQRWEYKITKDNGRNTDIPQLPSNQCQIDSPVPVRSPYNKFVSPHSFYAGGRNISPPMNGNVDMLAQRPSTEVVSLTSSDNKIDNAVVIKRSSTANPILRGSSSEKENKESSNKLIGSTVTEKTSRTKRNSSGVYSLLNGTIKEEKANETFIDTDSHVDKKIKL

SEQ ID NO: 3117 - protein, 449 aa, Francisella tularensis
MNAQKYIDSVIAQVEKRDGHEKEFIQAVKEVFSTLKPALEHNPKYIEENILARMVEPERGISFRVPWVDKDGNIQVNRGYRYQFNGAIGPFKGGIRFHPSVYSGIIKFLGFEQVFKNSLTTLPMGGGKGGADFDPKGKTDAEIMNFCQSFMIELQRHIGPDIDVPAGDIGVGGKEIGYMYGQYRRIRACFENGVLTGKSLESGGSLIRPEATGYGAVFFLDEMLKHDGETLQGKTVVTSGYGNVAWGVCKKVAQLGGKVVTISGSKGFVHDPEGITTDEKIEFLLKIRNGEKTMQDYSKEFNASWHAGQKPWGIKADIAIPAATQNEIDVEDAQKLIDSGVKYVVEASNMPTTNEAIEFLMKKGIILAPGKAANAGGVAVSGLEMSQNSARLSWSAEEVESKLQQIMANIFHACKFASSKYNLGYNLVAGANLAGFEKVAEAMIQQGRY

SEQ ID NO: 3118 - protein, 123 aa, Dianthus caryophyllus
MITIHHPWVFAFGLLGNFISFMVFLAPLPTFIRVYKKKSTEGFQSFPYVVAIFSAMLWIYYALLKGNSLLLITVNVTGVIIETIYVIIFITYAPRQARISTMKLLLFMNFGGFCMIVPRPRPR

SEQ ID NO: 3119 - protein, 935 aa, Haemophilus influenzae
MLINATQKEELRVALVDGQRLFDLDIESPGHEQKKANIYKGKITRVEPSLEAAFVDYGAERHGFLPLKEIAREYFPDDYVFQGRPNIRDILTEGQEVIVQVNKEERGNKGAALTTFVSLAGSYLVFMPNNPRAGGISRRIEGDERTELKEALSSLDVPDGVGLIVRTAGVGKSPEELQWDLKVLLHHWEAIKQASQSRPAPFLIHQESDVIVRAIRDYLRRDIGEILIDSPKIFEKAKEHIKLVRPDFINRVKLYQGEVPLFSHYQIESQIESAFQREVRLPSGGSIVIDVTEALTAIDINSARSTRGGDIEETALNTNLEAADEIARQLRLRDLGGLVVIDFIDMTPIRHQREVENRIRDAVRPDRARIQISRISRFGLLEMSRQRLSPSLGESSHHICPRCQGTGKVRDNESLSLSILRLLEEEALKENTKQVHTIVPVQIASYLLNEKRKAISNIEKRHNVDIIVAPNEAMETPHFSVFRLRDGEEVNELSYNLAKIHCAQDENTEESLLSRNVETTAVIEQPAVESAVVALSISEAAPTPVERKSNEPSLLAKIIAKIKGLFATKSEENKPKNNRTSRNPNRNQRRSQDRRSSRRPRSENNETERNEEQVRNVRERNQRRPRRNLVEESITESAVNSTPVFEAKEERTEPVTQRRQRRDLRKRVRVEDNETNETVVENNFSTTEKMPEVDVITVQNNDEKPVHQNQRSERQERQRRTPRHLRAANNQRRRRNQEPKSPMPLFAAVVSPELASGKAWIDYSTVNLPKENHFLSVDELLEQEKTKKGFITPAMGIVVEEKSPDVKPALDFITQPANESVQKKVQESLDRLSSYKPQEVVESIDPAINVDEPETLEKVSKFVRTYEFNGRLGTISSVPHTKAEMTLAKANDEIPEAFPIRAWQDSRYYFYGKGAAGHHCAISHVYSEPTRAKSE

SEQ ID NO: 3120 - protein, 147 aa, Nicotiana benthamiana
MAPKAEKKPAEKKPAAEKAPVAAGAAEKKPKAGKKLPKDGAGAAAGDKKKKRLKKSVETYKIYIFKVLKQVHPDIGISSKAMGIMNSFINDIFEKLAQESSRLARYNKKPTITSREIQTAVRLVLPGELAKHAVSEGTKAVTKFTSS

SEQ ID NO: 3121 - protein, 147 aa, Schizosaccharomyces pombe
MLIPKENRKAIHQALFQQGVLVAKKDFNLPKHPEVGVPNLQVIKACQSLDSRGYLKTRYNWGWFYYTLTNEGVEYLREYLHLPAEVVPATHKRQVRPAAPRAGRPEPRERSSAADAGYRRAEKKDDGAAPGGFAPSFRGGFGRPVAA

SEQ ID NO: 3122 - protein, 112 aa, Azorhizobium caulinodans
MKKIEAIIKPFKLDEVKEALQEVGLQGITVTEAKGFGRQKGHTELYRGAEYVVDFLPKVKIEVVLADDMVEKAVEALLRAAQTGRIGDGKIFVSSIEEAIRIRTGETGLDAI

SEQ ID NO: 3123 - protein, 443 aa, Aspergillus nidulans
MPSATGENWEKYKKNFADDEEPEKKITPLTDEDIAVLKTYGAAPYANALKKLEKQIKERQASVNEKIGVKESDTGLAPPHLWDVAADRQRMAEEQPLQVARCTKIIQDEKDSDKSKYVINVKQIAKFVVNLGERVSPTDIEEDLSHTDRLSVDRNKYQIMLPLPPKIDPSVTMMTVEDKPDVTYGDVGGCKEQIEKLREVVEMPLLSPERFVNLGIDPPKGALLYGPPGTGKTLCARAVANRTDATFIRVIGSELVQKYVGEGARMVRELFEMARTKKACIIFFDEIDAVGGARFDDGAGGDNEVQRTMLELITQLDGFDARGNIKVMFATNRPSTLDPALMRPGRIDRKIEFSLPDVEGRANILRIHAKSMSVERDIRWELISRLCPNATGAELRSVATEAGMFAIRARRKVATEKDFLAAVDKVIKGNLKFNSTATYMQYN

SEQ ID NO: 3124 - protein, 112 aa, Crocosphaera watsonii
MKKVEAIIRPFKLDEVKIALVNAGIVGMTVSEVRGFGRQKGQTERYRGSEYTVEFLQKLKLEIVVENDQVAMVIDKLRGAARTGEIGDGKIFVSPVDQVIRIRTGESDLEAI

SEQ ID NO: 3125 - protein, 418 aa, Dechloromonas aromatica
MDIKHYMHTVGRQARAASRRLAGATTAEKNAALLAIAAAIRRESAALVAANQEDLTAARAAGLETAMLDRLTLSAKGVESMAEGVEQVATLADPIGEMTDIKYRPSGIQVGKMRVPLGVIGIIYEARPNVTADAAALCLKSGNAAILRGGSEAIRSNRAIAALVHEGLKAAGLPAESVQVIDTTDRAAVGELITMREFVDVIVPRGGKGLIARLLAESRVPMIQHLDGNCHVYLEAEADPAKALKIVENAKTQRYGTCNTAESLLVDRSVAAMLLPPIAAMLTAKGVEIRGCAETQAIVPNAIAATEEDYYTEYLAPIISVKVVSGIDEAIEHINQYSSHHSEAIITDNHPKAMRFLREVDSASVMINASTRFADGFEYGLGAEIGISTDKIHARGPVGLEGLTSQKWVVLGDGHVRG

SEQ ID NO: 3126 - protein, 367 aa, Kineococcus radiotolerans
MTSRPRSPRQRGGSTLSVHPVPGWSGASRGPGAADRPVRGGATDRPRAGPARGGPPMAVVTMRQLLESGVHFGHQTRRWNPKMKRFLFTERNGIYIIDLQQSLSFIDRAYDFVKETVAHGGSIMFIGTKKQAQESIAEQARRVGMPFVNQRWLGGMLTNFQTVNKRIARMRELEQVDFDDVAGSGLTKKELLVLRREYDKLTKTLGGIREMTKVPSAVWIVDTNKEHLAVDEAKKLNIPVVAILDSNCDPDDVDYRIPGNDDAIRSVTLLTRVIADAVAEGLQVRHGGKSDAAEPLAAWEQDLLAGDEGVQSGGSESVATVEGSTAPEAAQAEAAEGQPAEAAAEAGDTAEAPVAGDEAPAEAAAQV

SEQ ID NO: 3127 - protein, 371 aa, Streptococcus agalactiae
MNNTEFYDRLGVSKDASQDEIKKAYRRMSKKYHPDINKEAGAEEKYKEVQEAYETLSDTQKRAAYDQYGAAGANGGFGGFDGGGFGGFEDIFSSFFGGGGMRNPNAPRQGDDLQYRVNLSFEEAIFGAEKEVSYNRESSCHTCSGSGAKPGTSPVTCQKCHGSGVINVDTQTPLGTMRRQVTCDVCQGSGQEIKEKCPTCHGTGHEKKTHKVSVKIPAGVETGQQIRLTGQGEAGFNGGPYGDLFVIINVLPSQQFERNGSTIYYTLNISFVQAALGDTIDIPTVHGAVEMSIPAGTQTGKTFRLRGKGAPKLRGGGQGDQHVTVNIVTPTKLNDAQKEALHAFAEASGDKMVHPKKKGFFDKVKDALDVD

SEQ ID NO: 3128 - protein, 738 aa, Burkholderia xenovorans
MSSQVNYSTRIAEGTPFPLGATWNGSGVNFALFSAHATKVELCLFDETGENEIERIELPEYTDEVWHVFVPNLKPGAVYGYRVHGPYEPEKGHRFNPNKLLLDPYAKAHIGELKWAPEIFGYTLDSEEGDLSFDERDSAPFVPKCKVVDANFSWSHPERNALPWERVIFYEAHVRGFTKRHPEVPENLRGTFAGLGQQVVLDYIKNLGVTSVELMPIQTFVNDSYLLDKGLTNYWGYNTIGFFAADPRFFASSIDSVGEFKEMVDRFHNANLEVILDVVYNHTAEGNERGPTISFKGIDNASYYRLMPDEPRYYINDTGTGNTLNLSHPRVLQMVTDSLRYWVTEMKVDGFRFDLATILGRELHGFDEGGGFLDSCRQDPVLSSVRLVAEPWDCGPGGYQVGGFPPGWAEWNDRFRDTVREYWKGDEGKVPDLATRLTGSGDKFNHRGRRPWASVNFIAAHDGFTLNDLVSYNDKHNEANGEDNKDGHSDNKSWNMGVEGPTDDPDIRQQRERQKRNLLATLLLSQGTPMILAGDEFGRTQKGNNNAYCQDNEISWVDWEAIDDDGRALIEFVRNLTTLRHRLPVLRRGRFLTGEYNEALDVTDARWISPDGKDLSQEQWDDASMRCFGLVIDGRAQASGIRRPASDATLLLVLNAHHDVVNFTLPDIPEGQRWTCLLDTNMPVRSELPHFAAGDAYQVTARSLLLLALEAPSRATQRVFDRLEEQLTTEDSEPPAQA

SEQ ID NO: 3129 - protein, 274 aa, Pyrococcus abyssi
PRRAREYPEEGEFVVATVKRIHNYGAFLELDEYPGKEAFMHISEVASTWVRNIRDYLKEGQKVVAKVIRVDPRKGHIDLSLRRVTQQQRKAKLQEFKRAQKAENLLKLAAEKLGKDFETAWREVWVPLEEEWGEVYAAFEDAAKDGIDVLKGHVPDEWLPVLKEIIDNYVEVPTVTIDAEFEITVPKPNGVEIIKEALIRARDRANKEKDVEVKFTYLGAPRYRIDITAPDYYKAEEVLESIAEEILRVIKEAGGEATLLRKEKRIKKVKKRKK

SEQ ID NO: 3130 - protein, 325 aa, Streptococcus parasanguinis
YHPDINKEPGAEEKYKEVQEAYETLSDDQKRAAYDQYGAAGANGGFGGAGGFGGFDGAGGFGGFEDIFSSFFGGGGASRNPNAPRQGDDLQYRVNLTFEEAIFGAEKEVKYNREASCSTCNGSGAKPGTSPVTCGRCHGAGVINVDTQTPLGMMRRQVTCDVCHGRGKEIKDPCTTCHGTGHEKQAHSVHVKIPAGVETGQQIRLAGQGEAGFNGGPYGDLYVVVSVEASDKFEREGTTIFYNLNLNFVQAALGDTVDIPTVHGDVELVIPEGTQTGKKFRLRGKGAPSLRGGAVGDQYVTVNVVTPTGLNERQKAALKEFAAAG

SEQ ID NO: 3131 - protein, 350 aa, Brassica napus
MNHSRRKRHPNSLTQFHLSLTRTKKEMWFFGKKGASGFSARSTAEEVTHGVDGTGLTAIVTGASSGIGVETARVLALRGVHVVMAVRNTGSGAKVKEDIVNRVPGAKLDVMELDLSSMDSVRKFASDYKSSGRPLNLLINNAGIMACPFMLSKDNIELQFATNHLGHFLLTKLLLDTMKNTSRESKREGRIVNLSSEAHRYSYPEGVRFDKINDKSSYSSIRAYGQSKLCNILHANELTKQLKEDGVNITANSLHPGAIMTNLGRYFNSYLAGAVGAVAKYVLKTVPQGAATTCYVALSPQVTGVTGEYFLDSNIAKPISLAKDSELAKKVWDFSTKLTESQSGESSTSN

SEQ ID NO: 3132 - protein, 296 aa, Streptococcus parauberis
PDINKEAGAEQKYKDVQEAYETLSDSQKRAAYDQYGAAGAQGGFGGQGGFGGGFDGAGFGGFEDIFSSFFGGGGGMRNPNAPRQGDDLQYRVNLSFEEAVFGAEKEVTYNRESSCSTCNGSGAKPGTSPVTCGRCHGAGVINVDTQTPLGMMRRQVTCDVCHGTGKEIKEPCQTCHGTGHEKEVHKVSVKIPAGVETGQQIRLQGQGEAGTNGGPYGDLFVILNVLPSKQFERNGSTIYYTMNISFVQAALGANVDIPTVHGEVEMSIPAGTQTGKVFRLKGKGAPKLRGAGQGDQ

SEQ ID NO: 3133 - protein, 315 aa, Zea mays
MACSTASLAATLLAFALMFQACVAGRRRLTALVQEPAITMKYHKGALLSGPIAVNFIWYGDFTAPQRAVITDFVSSLSAAPRAAAQSQPEPSVSTWFKTARKYYDTSKARFPALRLGSHAVDRNCSLGRRLTERDLLRLAARGAPSRAINLVLTAADVAVDGFCASRCGTHGASPRSRAGRFAYVWVGNPASQCPGQCAWPFHQPVYGPQAPPLTPPNGDVGVDGMVISLASMIVGTVTNPFGNGFYQEGSADAPLEAATACAGVYGKGAYPGYAGALLVDPASGASFNANGAHGRKYLVPALVDPDTSSCATLG

SEQ ID NO: 3134 - protein, 124 aa, Brassica napus
MAKSSLKDPFNWRIRVNLFNVRGINRRFWAAGVDGFQTGLRGPLGRAWGTGPGVAMGQGLLFGRGRDNHGVNAKEAFRRAKLKFPGRKKIMVSRKGGLTKLNRPDSTRWGQSKRVVPDGVIANF

SEQ ID NO: 3135 - protein, 605 aa, Arabidopsis thaliana
  misc_feature (556)..(556): Xaa can be any naturally occurring amino acid
MASLALSGSCSLAFPLKSRSLSLPRPPSSSLNLTKPLRSLDSRFSLLKSPLPVSLRRRSSTLVKASSTVASASSSPTPPLVPAPVPWQGAAIKPLLASIATGLILWFVPVPEGVTRNAWQLLAIFLATIVGIITQPLPLGAVALMGLGASVLTKTLTFAAAFSAFGDPIPWLIALAFFFARGFIKTGLGNRVAYQFVRLFGSSSLGLGYSLVFSEALLAPAIPSVSARAGGIFLPLVKSLCVACGSNVGDGTEHRLGSWLMLTCFQTSVISSSMFLTAMAANPLSANLAFNTIKQTIGWTDWAKAAIVPGLVSLIVVPFLLYLIYPPTVKSSPDAPKLAQEKLDKMGPMSKNELIMAATLFLTRRFSFSKKVFSLTQVGLWIFGAKLGVDAVTAAILGLSVLLVTGVVTWKECLAESVAWDTLTWFAALIAMAGYLNKYGLIEWFSQTVVKFVGGLGLSWQLSFGILVLLYFYTHYFFASGAAHIGAMFTAFLSVSTALGTPPYFAALVLAFLSNLMGGLTHYGIGSAPIFYGANYVPLAKWWGYGFLISIVNILXIWLGCRWCPWWKVSIWLCGEGPNPITPKFFPHFFSLNLKIIINLLRNRF

SEQ ID NO: 3136 - protein, 326 aa, Streptococcus peroris
IHPDINKEPGAEEKYKEVQEAYETLSDEQKRAAYDQYGAAGANGGFGGGAGGFGGFGGGAAGFGGFEDIFSSFFGGGGSSRNPNAPRQGDDLQYRVNLTFEEAIFGTEKEVKYNREASCRTCNGSGAKPGTSPVTCGRCHGSGVINVDTQTPLGMMRRQVTCDVCHGRGQEIKDPCATCHGTGHEKQAHSVHVKIPAGVETGQQIRLAGQGEAGFNGGPYGDLYVVVSVEASDKFEREGTTIFYTLNLNFVQAALGDTVDIPTVHGDVELVIPEGTQTGKRFRLRGKGAPSLRGGAVGDQFVTVNVVTPTGLNERQKAALKEFAAA

SEQ ID NO: 3137 - protein, 398 aa, Magnaporthe grisea
MIIRNAAVRHCRSAFSAPVARAVNGNTSGIRSISTETPSTSGTAHASTPLTHPLPSTGTATATATSAAPLAVPKVLDPRLQARFGETQKEAAPDTTARDWIELKRFRKKTSGLGSQRSTRTYRPSDLLRDPPKPKDVTLELLMASQCHMGHHKSLWNPANARFIYGVRQDIHIISLEQTAAHLRRAARLVEEVAFCGGLILFVGTRQGQMEIVTRAAELSRSCHLFNKWTPGTITNRDQLLAGGALRMVDEHDRELPGFEKHLQERRPITPDLVVVLNPLENNILLHECKVSQIPTIGVIDTNADVTKVTYPIPANDDSLRSMAVIAGVLGRAGELGQKRRLADAKGGQVHWENPADVTRFLDSLNRDAIEATRQQMEVEVKEEKRLLETAGIKDLLM

SEQ ID NO: 3138 - protein, 978 aa, Brassica napus
MAMRLLKTHLLFLHLHYVISILLLSFSPCFASTDMDHLLTLKSSMVGPNGHGLHDWVRSPSPSAHCSFSGVSCDGDARVISLNVSFTPLFGTISPEIGMLDRLVNLTLAANNFSGMLPLEMKSLTSLKVLNISNNVNLNGTFPGEILTPMVDLEVLDAYNNNFTGPLPPEIPGLKKLRHLSLGGNFLTGEIPESYGDIQSLEYLGLNGAGLSGESPAFLSRLKNLKEMYVGYFNSYTGGVPPEFGELTNLEVLDMASCTLTGEIPTTLSNLKHLHTLFLHINNLTGNIPPELSGLISLKSLDLSINQLTGEIPQSFISLWNITLVNLFRNNLHGPIPEFIGDMPNLQVLQVWENNFTLELPANLGRNGNLKKLDVSDNHLTGLIPMDLCRGGKLETLVLSDNFFFGSIPEKLGRCKSLNKIRIVKNLLNGTVPAGLFTLPLVTIIELTDNFFSGELPGEMSGDLLDHIYLSNNWFTGLIPPAIGNFKNLQDLFLDRNRFSGNIPREVFELKHLTKINTSANNLTGDIPDSISRCTSLISVDLSRNRIGGDIPKDIHDVINLGTLNLSGNQLTGSIPIGIGKMTSLTTLDLSFNDLSGRVPLGGQFLVFNDTSFAGNPYLCLPRHVSCLTRPGQTSDRIHTALFSPSRIAITIIAAVTALILISVAIRQMNKKKHERSLSWKLTAFQRLDFKAEDVLECLQEENIIGKGGAGIVYRGSMPNNVDVAIKRLVGRGTGRSDHGFTAEIQTLGRIRHRHIVRLLGYVANRDTNLLLYEYMPNGSLGELLHGSKGGHLQWETRHRVAVEAAKGLCYLHHDCSPLILHRDVKSNNILLDSDFEAHVADFGLAKFLLDGAASECMSSIAGSYGYIAPEYAYTLKVDEKSDVYSFGVVLLELIAGKKPVGEFGEGVDIVRWVRNTEGEIPQPSDAATVVAIVDQRLTGYPLTSVIHVFKIAMMCVEDEATTRPTMREVVHMLTNPP

SEQ ID NO: 3139 - protein, 237 aa, Zea mays
MATAGGGAGHLKLLGAWPSPFVNRVRMALHLKGLEYENVEEDLTNKSDLLLASNPVHKLVPVLLHGDKPISESLVIVEYLDDAFPGAGQAVLPADPYERAVARFWAKYVDGKLHGMMVKALMGATEEERATATADALAAMDTLEGAFAECSGGKEFFAGDAPGYLDVALGGFIGWLRAWDKVGGVKLLDAGRAPRLATWAERFAALDVAKEVIPDPDHIAEFAKVLQARSAAAATSN

SEQ ID NO: 3140 - protein, 1010 aa, Bacillus licheniformis
MFYCSLVREEKWIIRYIHKQERGMEMAEQKKITINGVEMEASEEQTVLQLLNNSSIEVPQICYHPSLGPIETCDTCIVSINGELKRSCSAEVKDGDVIDTLSPDVKKAQVIGMDKILYNHELYCTVCDYNNGGCEIHNTVKEMKVNHQSIPFDQKPYHKDESNPFYRYDPDQCILCGRCVEACQDVQVTETLTIDWERKRPRVIWDNDVPINESSCVSCGHCSTVCPCNAMMEKGMEGEAGYLTGIDDETLRPMIEITKGVETGYGSILAISDMESAMRDERIKKTKTVCTYCGVGCSFDVWTKGRDILKVEPQEEAPANGISTCVKGKFGWDFINSEERLTKPLIREGDHFREAEWEEALTLIASKFTDLKEEFGPDSLAFITSSKCTNEESYLMQKLARGIIGTNNVDNCSRYCQSPATAGLFRTVGYGGDSGSIADIAQADLVLIIGSNTSESHPVLSTRIKRAHKLRGQKVIVADIRKHEMAERSDLFVQPRAGSDIVWLNAIAKYLIENGKADERFLQERVNGRDEYVKSLTPYTLEYAEEKTGIDQETLIQMAEMIGQADSVCALWAMGVTQHIGGSDTSTAISNLLLVTGNYGKPGAGSYPLRGHNNVQGASDFGSMPDRLPGYEKVTDEQVRQKYEQAWGVPLPKEPGMTNHEMIEKIHSGKLKAMYVKGEEMGLVDSNINHVHAAYEKLDFFVVQDIFFSRTAEFADVVLPASPSLEKEGTFTNTERRIQRLYQVFEPLGESKPDWQIIMEVANKLGADWHYEHPADIMEEAAKLSPIYAGVTYERLEGYNSLQWPVSADGKDSPLLFTERFPFPDGKAILYPVHWTEPEEFGEEYDIHVNNGRLLEHFHEGNLTYKSKGISKKTPEVFLEISPELAAERGIQDGTLVRLTSPFGNVKVKCLITDRVKGKEVYLPMNDSGEAAINLLTGSHADKDTDTPAYKETSAKMEILKRDGSNPLPKINHRNGNPQPQIGVQVQKKWARKDYIFPGDAVKRGIGHNG

SEQ ID NO: 3141 - protein, 162 aa, Geobacter sulfurreducens
MGENTSLEKATFGAGCFWHVEEEFRRVPGVVSTLAGYMGGWKEHPTYEEVCSKTTGHAEVVEVTFDPAAVTYDHLLRVFWDCHDPTQLNRQGPDIGTNYRSVIFYHSPDQERAARASLEHEQRSGRHARPIVTEIVPAATFWWAEEYHQHYLEKRGGGSCRW

SEQ ID NO: 3142 - protein, 311 aa, Streptococcus phocae
KNTRMFQEAYETLSDSQKRAAYDQYGAAGSQGGFGGGAGGFGGFDGAGFGGFEDIFSSFFGGGGGMRNPNAPRQGDDLQYRVNLSFEEAVFGVEKEVSYHREATCSTCSGSGAKPGTSPITCRKCHGSGAITVDTQTPLGMMRRQVTCDVCHGSGQEITDPCQTCHGSGQEKKKHTVSVKIPAGVETGQQIRLQGQGEAGFNGGPYGDLFVILNVLPSKKFERNGSTIYYSLNISFVQAALGDTVDIPTVHGDVEMSIPAGTQTGKIFRLKGKGAPKLRGGGQGDQHVTVTVVTPTKLNDQQKEALKAFAH

SEQ ID NO: 3143 - protein, 348 aa, Streptococcus pneumoniae
KSKKAYRKLSKKYHPDINKEPGAEDKYKEVQEAYETLSDDQKRAAYDQYGAAGANGGFGGAGGFGGFNGAGGFGGFEDIFSSFFGGGGSSRNPNAPRQGDDLQYRVNLTFEEAIFGTEKEVKYHREAGCRTCNGSGAKPGTSPVTCGRCHGAGVINVDTQTPLGMMRRQVTCDVCHGRGKEIKYPCTTCHGTGHEKQAHSVHVKIPAGVETGQQIRLAGQGEAGFNGGPYGDLYVVVSVEASDKFEREGTTIFYNLNLNFVQAALGDTVDIPTVHGDVELVIPEGTQTGKKFRLRSKGAPSLRGGAVGDQYVTVNVVTPTGLNDRQKVALKEFATAGDLKVNPKKKAS

SEQ ID NO: 3144 - protein, 375 aa, Oryza sativa
MAAAAIHQFAECITCHAWSPDHSMIAFCPNNNEVHIYKFFTDKWEKLHVLSKHDQIVSGIDWSRSSNKIVTVSHDRNSYVWTQEGHDWVPTLVILKLNRAALCVQWSPKENKFAVGSGAKSVCICYYEQDNNWWISKVVRKKHESSVTSVAWHPNNILLATTSTDGKCRVLSTFIKGVDTRGSHASTSTDWKFGEQIAQLDLSSMWAFGVRWSPSGKTLAYAGHNSMIYFIDDVETSPAAQNLALRDLPLRDILFLSERTVIGVGFDCNPMIFSADETGLWSFVRYLDERKVTTSTSRASQLSEAFGKLYGQSKQVASSDTVEPSKPRGGVHENCITCIVPLRKGNDSIVKRFSTSGLDGKIVVWDAENHIDIKK

SEQ ID NO: 3145 - protein, 240 aa, Rhodopseudomonas palustris
MIQLATLTKKPIRPADDAPHLLLVDDDRRIRDLLSRFLASEGYRVTTAQSVRDARAKLAGLDFDLLILDVMMPGETGFDLARSIRETSDVPIVMLTARHEAESRIEGLQIGADDYVAKPFEPRELLLRIGNILKRTAPAPAAKAETVAFGPYVFHIERGELRQGDEIVHLTDRERDMLRMLAAAPGETVPRGDLSGAGNANERAVDVQINRLRRKIERDPANPLFLQAVRGIGYRLVAAP

SEQ ID NO: 3146 - protein, 208 aa, Salmonella enterica
MTGKKRSASSSRWLQEHFSDKYVQQAQKKGLRSRAWFKLDEIQQSDKLFKPGMTVVDLGAAPGGWSQYVVTQIGGKGRIIACDLLPMDPIVGVDFLQGDFRDELVMKALLERVGDSKVQVVMSDMAPNMSGTPAVDIPRAMYLVELALDMCRDVLAPGGSFVVKVFQGEGFDEYLREIRSLFTKVKVRKPDSSRARSREVYIVATGRK

SEQ ID NO: 3147 - protein, 136 aa, Glycine max
  misc_feature (121)..(121): Xaa can be any naturally occurring amino acid
ASSLISSPAATTVNRAGAGLVAPFTGLKSMAGFPTRKTNNDITSIASNGGRVRCMQVWPPIGKKKFETLSYLPYLDDAQLAKEVEYRVKKRLMPYLEFEVKHDCVYREHNRSPRCYNRLYXTMIKLAMFSCTEACQ

SEQ ID NO: 3148 - protein, 83 aa, Zea mays
LIHFYDQIPTGGGSPLSEKTDPLGTISAAPWGSALIMPISYTYSHDGLTDASKIAILNANYMAKRLEKHYPVLFRGVNRTIFR

SEQ ID NO: 3149 - protein, 440 aa, Aspergillus nidulans
MADHEQEQEPLSIAIIGGGIIGLMTALGLLHRNIGKVTIYERASAWPDIGAAFAFTGIARECMQRLDPAILSALSKVAQRNPHDKVRYWDGFHPKSKEEAQDPEKSVLFEIEEKNMAYWACLRGVFHAEMARLLPERVVRFGKRLVAYEDGGDQKVVLRFEDGEVEEADIVIACDGVHSTARRVLLGAEHPAANARYSRKAVYRALVPMPAAIDALGTEKAHVQIAHCGPDAHIVSFPVNNAQIYNVFLFTHDSNEWTHGHTMTVPSSKEEILSAVENWGPHIKELASLFPEQLSKYAIFDQADHPLPYYAAGRVALAGDAAHASSPFHGAGACMGVEDALVLAELLEKVQNGSAFKEKKSNIELALKTYSDVRIERSQWLVKSSREMGDLYEWRYEDIGGDGVKCKAEWERRSRVIWDFDVQGMVDQAREAYERAVVKV

SEQ ID NO: 3150 - protein, 112 aa, Brassica napus
SQHHSWTNKKIMDTTRDNRKDMSFRGSAQAPMMSKQEYIRTSSQSSKPRKLVTASYFSLESVVVLVGLTASLLILPLILPPLPPPPFMLLLIPIGDYGSWLMGLGFLWPSFF

SEQ ID NO: 3151 - protein, 282 aa, Geum montanum
GLPPAMAAYGHRVMTVSPRYDQYKDAWDTGVTVELQVGDKIETVRFFHCFKRGVDRVFVDHPLFLERVWGKTASKIYGPVTGEDYKDNQLRFSLLCLAALEAPRVLNLNSNKYFSGPYGEDIIFVANDWHTALLPCYLKDRYQSKGIYMSAKVAFCIHNIAYQGRFAFADFSLLNLPDSFKSSFDFIDGYDKPVKGRKINWMKAGMLESNIVLTVSPYYAKELVSSTDKGVELDNIGRKVGVLGIVNGMDVQEWNPLTDKYTDVKYDATTVMDAKPILKEAL

SEQ ID NO: 3152 - protein, 342 aa, Corynebacterium glutamicum
MMSRLQTEGAGNDHDHYEAVIIGGGQAGLATAYYLMRAGVQTLILDDQPASGGAWLHVWPSLHLFSTSDFSNLPGWPMPKFDGFPTSSHVVDYLTEYERRYEIPVSRSVSVDKVDFVNGAFHLQSGTRSWIAKNVVAATGTWSAPFVPTFPGKFSGTHWHSSNYPGVHPFVGQRIAIVGGANSGAQIAAELSEVSEVTWFTRDKPRWMPDDVDGRELFRRNRLRALAIQRGERDPGPDSELGDIVMLPEVRRARDSGKLFATPMFGSLDEIRADHLIWCTGFRPAIRPVRQLLKHGQPKVPGLYLVGYGDWTGPGSATITGVGLYAKRAAKEIAASVGKVVK

SEQ ID NO: 3153 - protein, 221 aa, Oryza sativa
MARRPARCYRYCKNKPYPKSRFNRGVPDPKIRIFDLGRKKANVDEFPLCVHLVSNEYEQVSSEALEAARICANKYMVKTAGKEAFHLRVRAHPYHVVRINKMLSCAGADRLQTGMRGAFGKPNGLVARVNIGQIILSCRTRDALRPNVIEALRRSQYKFPGRQKIIVSKNWGFTPLRREEYVAKRQSGQVRVDGAYVQFLSTRGPLEYNMRRFPEAFETEA

SEQ ID NO: 3154 - protein, 937 aa, Ralstonia eutropha
MNALTRAERALVESTEPSVTFTLNGREVSAQPGESLLKVAQREGFDVPHLCYKDGLDTAGNCRACMVEIQGERVLAPSCCRYPSQGMTVQTESERALRAQRTVLELLQSDMPETDYTRHNELDQWSARLDVGKPRFAPRERLAADLSHPAIAVNLDACIQCTRCVRACRDEQVNDVIGLALRGDAARIVFDMDDPLGASTCVACGECVQACPTGALMPARDAALAVPDQQVDSVCPYCGVGCQLTYNVKDNRILYVEGRDGPANHERLCVKGRYGFDYVQHPQRLTMPLIRREGVPKRGDFVMDPDHVMDVFREATWEEALALASGKLAQIRDTHGKRALAGFGSAKGSNEEAYLFQKLVRTGFGSNNVDHCTRLCHASSVAALLEGIGSGAVSNPVMDVDRAELVIVIGANPTVNHPVAASWIKNAVKNGTKLVVADPRRSDLARFAWRFLQFTPDADVALLNAMMHVIVSDGLVDQHFIDSRTIGFEELQRNVAAFSPELMAPICGIDAQTIREVARAYATSKASMILWGMGVSQHVHGTDNARCLIALALMTGQIGRPGTGLHPLRGQNNVQGASDAGLIPMMYPDYRRVDDPDAIASFEALWGMPLDRQPGLTVVEIMDAIGRGEVRGMYIMGENPAMSDPDAEHAREALAALDHLVVQDIFLTETAYLADVVLPASAFPEKTGTFTNTDRTVQLGRQALLPPGQARQDLWIIQQMAQGLGLDWHYGNVAEVFDEMRQAMPSIGGVTWERLEQDGAVTYPCHAEGDPGEPVIFTDRFPTPTGRGRFVPADIIPADERPDTDYPMVLITGRQLEHWHTGSMTRRAGVLDAIEPDAVALVHPLDLGLLGGQPGDVITLASRRGEVSLYARADAGTPRGAVFVPFCYYEAAINKLTNAALDPFGKIPEFKYCAIRMTLGGVAPAQSSYGGGKVLGA

SEQ ID NO: 3155 - protein, 701 aa, Pseudomonas putida
MNPVIKTFQFGQSTVTLETGRIARQATGAVLVTVDNDVTVLVTVVGAKQADPGKGFFPLSVHYQEKTYAAGKIPGGFFKREGRPSEKETLTSRLIDRPIRPLFPEGFMNEVQVVCTVVSTSKKTDPDIAAMIGTSAALAISGIPFEGPIGAARVAFHESTGYLLNPTYEQLAASSLDMVVAGTSDAVLMVESEAQELTEDQMLGAVLFAHDEFQAVIQAVKELAAEAGKPTWDWKPAVANTELFNAIRAEFGEAVSQGYTITVKADRYARLGELRDQAVAKFSGEEGQPSASEVKEIFGEIEYRTVRENIVNGKPRIDGRDNKTVRPLNIEVGVLPKTHGSALFTRGETQALVVATLGTARDAQLLDTLEGEKKDPFMLHYNFPPFSVGECGRMGGAGRREIGHGRLARRSVQAMLPAADVFPYTIRVVSEITESNGSSSMASVCGASLALMDAGVPMKAPVAGIAMGLVKEGDKFAVLTDILGDEDHLGDMDFKVAGTAKGVTALQMDIKINGITEEIMEIALGQALEARLNILGQMNQVIGQSRTELSANAPTMIAMKIDTDKIRDVIGKGGATIRAICEETKASIDIEDDGSIKIFGETKEAADAAKQRILGITAEAEIGKIYVGKVERIVDFGAFVNILPGKDGLVHISMLSDARVEKVTDILKEGQEVEVLVLDVDNRGRIKLSIKDVPAAKASGV

SEQ ID NO: 3156 - protein, 474 aa, Arabidopsis thaliana
MATSDQDRRHRVTRNRPPIARPSTSSSRPVVSPPRSKVSKRVLLRVASVACGIQFGWALQLSLLTPYVQELGIPHAWASVIWLCGPLSGLFVQPLVGHSSDRCTSKYGRRRPFIVAGAVAISISVMVIGHAADIGWAFGDREGKIKPRAIVAFVLGFWILDVANNMTQGPCRALLADLTENDNRRTRVANGYFSLFMAVGNVLGYATGSYNGWYKIFTFTKTVACNVECANLKSAFYIDVVFIAITTILSVSAAHEVPLASLASEAHGQTSGTDEAFLSEIFGTFRYFPGNVWIILLVTALTWIGWFPFILFDTDWMGREIYGGEPNIGTSYSAGVSMGALGLMLNSVFLGITSVLMEKLCRKWGAGFVWGISNILMAICFLGMIITSFVASHLGYIGHEQPPASIVFAAVLIFTILGIPLAVIVSVGSGPWDQLFGGGNSPALAVGAATGFIGGIVAILALPRTRIQKPIPLP

SEQ ID NO: 3157 - protein, 125 aa, Brucella melitensis
MTQRLRIALIAHDQKKDDMVAFARAHEQALSRYDIVATGTTGGLIQDACPSLNIHRVKSGPLGGDQQIGAMIAEGTVEVLIFFIDPLSPLPHDVDVKALTRLGSVYDIPMALNRATAEKLVRALD

SEQ ID NO: 3158 - protein, 109 aa, Pseudendoclonium akinetum
MRLAPIKLVVNYYVLFGKSLNQEKENLIEMKGVITQCLSNGMFRVKLENGFKVIAHISGKIRRNFIRILLGDSVIVELSPYDLTRGRIIYRLKPTNSSTETLRFNTNLK

SEQ ID NO: 3159 - protein, 466 aa, Carboxydothermus hydrogenoformans
MNKKIRALLTCAVGLAIWFSPIPTGLDPKAWHLLAIFVATIIGFILQPLPIGAIAFISVTLSALTGILDAKAALAGFANSTIWLIVSAFIFAIGFVKTGLGLRIAYYLIRLLGDSTLKLGYTLVLSDLIISPATPSNTARAGGVLFPIVRSLAEAFGSKPGESPRKVGAYLMQTAYQGNAITSAMFLTSMAGNPLIALLALKTLKIDITWNLWAKAAIVPGIISILVIPYLLYKIYPPEIKKTPEAKEIAAKELVKMGPMKFEEKVLAIVFIGALILWATSQYTKIDATIVAMLGVSAMLVAKVIDWKDVLAEKGAWDTLVWMGVLVALAGNLSELGFIPWFAKNVGNMISGISWFWAFVILLVVYLYAHYGFASLTAHITAMYAAFASVAVAAGAPPYLVALSLAFMSNLCMSLTHYAAGPSPIYFGAGYVDQGTWWKLGFIVSIVNLFIWVGIGAVWWKALGLW

SEQ ID NO: 3160 - protein, 382 aa, Pseudomonas fluorescens
MSAPVVIVGTGLAGYNLAREFRKLDGETPLLLITADDGRSYSKPMLSTGFGKNKDADGLSMAEPGAMAEQLKAEIRTHTRISGIDPGHKRLWIGEEAVSYRDLILAWGAETVRVPIEGDGGDLVFPINDLEDYARFRAAAAGKRRVLLLGAGLIGCEFANDLILGGYEVQLVAPCEQVMPTLLHPAAAAAVQAGLESLGARFHLGPVLTRLQKVADGLEAHLSDGQVVPCDVVVSAIGLRPRIDLAAAAGIQTNRGVVVDRHLQTSHANIYALGDCAEVDGLNLLYVMPLMSCARALAQTLAGNPTVVNYGPMPITVKTPVCPLVVSPPPRGREGVWTVEGQGADIKVLCHDAEGQLLGYALTGAAVMEKLALNKQLPALLA

SEQ ID NO: 3161 - protein, 355 aa, Unknown
  Sulfitobacter sp. EE-36
MSFVRNAWYVAGWSTDFGDELVPLTLLAQNLVAYRTSDGQIAVLEDRCPHRLLPLSKGKRIGDTIQCGYHGMTFGADGACVRVPGQSNLPKSAYVDSYPVLERHGIVFIWMGDADKADPALAFDMPELGQEGWHVHHGDKLHIRANYLNVAENLVDPAHVSFVHPTTLGNAASENVPVHVKTADEVIVAWRWIRDAEPIGFFKAFGGFSGNVDRWHYYYLHMPSTAVIDFGSSDAKLELPEDQRNKGVRIFALHFVTPVTEDYTIDHWMHLRNTALGDDAASDQMDAMFRVAFAEDKAILEAVHQEEQRPQKRKPIRIAIDKAPNVYRKRIRDRIEAEATDDLGDPVAPVFVQHD

SEQ ID NO: 3162 - protein, 178 aa, Unknown
  Erwinia sp. Ejp 556
MATEYAIIAGGCFWCTEAVFKQINGVESVESGYIGGHTENPTYKQVCHGDTGHAEAIRIGFDPEKVSFGDLLDISFATHDPTQLNRQGNDIGTQYRSAIFPTGAQQAEEAKAAISRAQSEHSDPIVTSIEADAVWYPAEDYHQDYWAGEGQENRYCLAVIPPKLQKLRKRFAAYAVSE

SEQ ID NO: 3163 - protein, 334 aa, Xanthobacter autotrophicus
MALPDYSMRQLLEAGVHFGHQSHRWNPKMAPYIFGVRNNIHIIDLSQTVPALHRALQAVSDTVAQGGRVLFVGTKRQAQEQVADAARRSAQYYVNSRWLGGMLTNWKTISNSIARLKKLEEMLSGPEQGSGYTKKERLTLSREKDKLDKALGGIRDMGGLPDLLFVIDTNKEDIAVKEAQRLGIPVAAILDTNCDPDGIAFPVPGNDDAGRAIQLYCELVARAAIDGIGRGHSDLGIDVGAEEAPLVEDLPVETGAWSSFEPLSGPRGVADDLKKLTGVSPEIEQKLNDLGVFHFGQVAGLDAIDAHRIGEEVGLPGRVDGWVAQAKELSAEVE

SEQ ID NO: 3164 - protein, 320 aa, Triticum aestivum
LTKVTCTLRAGVESIGVCYGMSANNLPAASTVVSMFKSNGINSMRLYAPDQAALQAVGGTGVNVVVGAPNDVLSNLAASPAAAASWVRSNIQAYPKVSFRYVCVGNEVAGGATQNLVPAMKNVQGALASAGLGHIKVTTSVSQAILGVYSPPSAGSFTGEADAFMGPVVQFLARTGAPLMANIYPYLAWAYNPSAMDMSYALFTASGTVVQDGSYGYQNLFDTTVDAFYTAMAKHGGSNVKLVVSESGWPSGGGTAATPANARIYNQYLINHVGRGTPRHPGAIETYVFSMFNENQKDSGVEQNWGLFYPNMQHVYPISF

SEQ ID NO: 3165 - protein, 326 aa, Streptococcus pyogenes
KFHPDINKEAGAEQKYKDVQEAYETLSDSQKRAAYDQYGAAGAQGGFGGGAGGFGGFDGGGFGGFEDIFSSFFGGGGSRNPNAPRQGDDLQYRVNLSFEEAVFGVEKEVSYNREATCGTCLGSGAKPGTAPVTCRKCHGSGVMTIDTQTPLGMMRRQVTCDICHGSGKEIKEPCQTCHGTSHEKQAHKVSVKIPAGVETGQQIRLQGQGEAGFNGGPYGDLFVILNVLPSKQFERNGSTIYYSLDISFTQAALGDTVEIPTVHGDVEMAIPAGTQTGKTFRLKGKGAPKLRGGGQGDQHVTVNIVTPTKLNDAQREACKHCRSEGK

SEQ ID NO: 3166 - protein, 698 aa, Treponema denticola
MRKRVTYKIGEHDLILETGYLAKQANGSIYAEYAGSAILATICASGQAQEGLDYVPLTVDYNEKYYAAGKIPGGFIKREGRPKDKEILVSRLIDRPMRPLFNKEFGREIQLVPTCISTDMINPPDILAVIASSAAVHISDIPFDGPVAAARVAYKNGEYIINPTFSQIETADMEIVVAGTKEGITMVEGGANEVSEEVMLTALEKAHEMIKSLCKMQEDLRELAGKEKLPLVPLEAELENKQAIYDEAFPRLSKTLYLSTKMERREESDKVKKELAEKYAEQLEDEIQLKLFNALFEEMEYNILRTNILDKGLRVDGRGTKDIRPITCEIGVLPRPHGSAVFTRGETQSLGVVTIGTVFDEQIYDDIEGDRRENFILHYNFPPFSVGEVGRLGTGRREIGHGNLAHRSLYPMVPEREKFPYTVRVVSEVLESNGSSSMATVCSGTLSMLHAGVPMKKPVAGIAMGLITEGNDRYAILSDILGEEDHLGDMDFKVAGTADGITGFQMDIKIAGVSPEIMKNALAQAKEGRMHILGIMNQCISAPNAELSQYAPRVEMMTIPEDKIGALIGPGGKNVKAISDKYNVTINTENDGTVTIYSKDGTSDLKGAKSIVKGITSDPEVGMVYDGTVKKIMDFGAFVEILPGKEGLCHISKLSRSRVEKVSDVLKEGQEIPVKLLEIDKLGRLNLSYVDALEERSK

SEQ ID NO: 3167 - protein, 298 aa, Streptococcus ratti
  misc_feature (269)..(269): Xaa can be any naturally occurring amino acid
AAYDQYGSAGTDGGFGGFDSSGFGGFEDIFSSFFGGGASRNPNAPRQGDDLQYRVNLQFEEAVFGTEKEVHYNREATCHTCKGSGAKPGTSPITCGKCHGSGVINVDTQTPLGMMRRQVTCDVCHGSGKEIKEPCQTCHGTGHEKQSHKVSVKIPAGVETGQQIRLAGQGEAGFNGGPYGDLFVIINVLKSDKFERDGSTIYYSLNINFVQAALGDTVEVPTVHGNVELAIPAGTQTGKTFRLKGKGAPRLRGNGQGDQHVTVKVVTRXKLNDAQKEALQAFAKASGIDPVHPKKKGF

SEQ ID NO: 3168 - protein, 189 aa, Coprinellus disseminatus
TREQHIRREKATSNICTAQALLANMAAMYAVYHGPEGLKRISNKVHGFTQVFKSSVESLGFKATNTTFFDTLTLDVTGAVANSWAIHASANAAGINLRRIDDKHVGVTFDESVTPAELVNLISVFATAANKSSLTISDLAEPTKSAISPHLKRTSKFLPHPVFNKHHSETEMLRYINHLSSKDLSLTHS

SEQ ID NO: 3169 - protein, 317 aa, Streptococcus sanguinis
HPDINKEAGAEDKYKEVQEAYETLSDEQKRAAYDQYGAAGANGGFGGGAGGFGGFDGSGFGGFEDIFSSFFGGGASRNPNAPRQGDDLQYRVNLRFEEAIFGAEKEIKYNREATCRTCDGSGAKPGTSPVTCGRCHGSGVINVDTQTPLGMMRRQVTCDVCHGRGKEIKSPCETCHGTGHEKQAHSVKVKIPAGVETGQQVRLSGQGEAGFNGGPYGDLYVVVQVEPSDKFERDGSTIYYKLNLNFVQAALGDSVDIPTVHGDVELNIPEGTQTGKRFRLRGKGAPSLRGGSMGDQYVTVNVVTPTGLNDRQKAALK

SEQ ID NO: 3170 - protein, 487 aa, Salmonella enterica
MCDCGEKKSQGVKWLPLILILVIAAGLWQLTPPSGLSAPAWHSAIIFVATIASIVAKVLPIGAVGIIGITVFALAYAAGDKTASGAITTALSELNSSLIWLIVVAFMIARGFIKTGLGRRIALQMIRLLGKRTLGLAYGLAFADLILSPAMPSNTARCGGVIYPIADSLARSFDSHPEDESRSKIGTFLITCIGNVNDVTAALFMTGYTGNLLAVKLAANAGVTLSWGSWFIAALLPCLVSFLIVPLLVYWLTRPEIKHTPDAPDLARKELAQMGSMTRGEWLMLATVGVLLVLWIFGSSLGVDATTASFVGLSILLLSGVLTWEDVKSEKGAWDTLIWFAALLMMANQLKKLGFTSWFGNLIGDSIGSTMHGTSWIIILLLLNAAYFYTHYFFASGNAQIAALYAVFLGVGLHLNIPAAPMALMLAFTSSLYCSLTQYTHARGPILFGAGYVPTGVWWRTGFIISLFNQAVFLTVGLAWWKVLGLY

SEQ ID NO: 3171 - protein, 294 aa, Streptococcus thoraltensis
HPDINKEPGAEEKYKEIKEAYDTLGDEQKRANYDQFGPEGAANGGFGGGAGGFSGFDSAGFGGFEDIFSSFFGGGGASRNPNAPRQGDDLQYRVNLKFEEAIFGTEKEVHYNREVTCHTCDGSGAKPGTSPVTCSKCHGSGVINVDTQTPLGMMRRQMTCDVCHGSGKEIKEPCPTCHGSGREKQRHKMAVTIPAGVETGHQVRVVGQGEAGFNGGPYGDLYVIINVLASDKFERDGSTIYYNLDINFVQAALGDTVEVPTVHGAVDLKIPAGTQAGKVIRIKGKGAPRLNGNG

SEQ ID NO: 3172 - protein, 303 aa, Streptococcus uberis
YDQYGAAGAQGGFGGGGFGGFDGGGFGGFEDIFSSFFGGGGGMRNPNAPRQGDDLQYRVNLTFEEAIFGVEKDVSYHREATCHTCAGSGAKPGTSPVTCGRCHGSGVINVDTQTPLGMMRRQVTCDVCHGSGKEIKEPCQTCHGTGHEKETHKVSVKIPAGVETGQQIRLQGQGEAGFNGGPYGDLFVVLNVLPSQKFERNGSTIYYNLNISFVQAALGDTVDIPTVHGDVEMAIPAGTQTGKVFRLKGKGAPKLRGAGQGDQHVTVNIVTPTKLNEKQKEALRAFAEASGQEISNPKKKRLL

SEQ ID NO: 3173 - protein, 189 aa, Coprinellus disseminatus
TREQHIRREKATSNICTAQALLANMAAMYAVYHGPEGLKRISNKVHGFTQVFKSSVESLGFKATNTTFFDTLTLDVTGAVANSWAIHASANAAGINLRRIDDKHVGVTFDESVTPAELVNLINVFATAANKSSLTLSDLAEPTKSAISPHLKRTSKFLPHPVFNKHHSETEMLRYINHLSSKDLSLTHS

SEQ ID NO: 3174 - protein, 598 aa, Raoultella planticola
MSFITLRTGVAVALSSLMISQACPAVSAAPSVNQNIHVHKESEYPAWWKEAVFYQIYPRSFKDTNDDGIGDIRGIIEKLDYLKSLGIDAIWINPHYDSPNTDNGYDISNYRQIMKEYGTMEDFDNLVAEMKKRNMRLMIDVVINHTSDQHPWFIQSKSDKNNPYRDYYFWRDGKDNQPPNNYPSFFGGSAWQKDAKSGQYYLHYFARQQPDLNWDNPKVREDLYAMLRFWLDKGVSSMRFDTVATYSKIPGFPNLTPEQQKNFAEQYTMGPNIHRYIQEMNRKVLSRYDVATAGEIFGVPLDRSSQFFDPRRHELNMAFMFDLIRLDRDSNERWRHKSWSLSQFRQIISKMDVTVGKYGWNTFFLDNHDNPRAVSHFGDDRPQWREASAKALATITLTQRATPFIYQGSELGMTNYPFRQLNEFDDIEVKGFWQDYVQSGKVTATEFLDNVRLTSRDNSRTPFQWNDTLNAGFTRGKPWFHINPNYVEINAEREETREDSVLNYYKKMIQLRHHIPALVYGAYQDLNPQDNTVYAYTRTLGNERYLVVVNFKEYPVRYTLPANDAIEEVVIDTQQQATAPHSTSLSLSPWQAGVYKLR

SEQ ID NO: 3175 - protein, 445 aa, Robiginitalea biformata
MNELPSHSHWARFKRLTRPLFSGDLSYGLLMVGAVVTALVLANSPWAHEFHAFWEYTLEVRVAGANLELTFHELVNDGLMAIFFFVIGLEIKRELIAGELSNLRKAALPIICALGGLLFPALIFLGLNQGADTAAGWGIPIATDIVFALVLLTIIGNKKVPFALKIFLTALAVVDDLCAVLIIALFYTDQIVFGSLLWAFVSFFVLVIANRIGVRNPFFYGLVGVLGIWTGFFLSGVHATIAGVITAAAIPARAGMDEEQFAHNIENLIKTFRERRATDSDFIKKEKLELVRIIQKAVRKIVPPLQSVEKALQPFVNFVVLPLFALANTGLTLEAENLGRLLEPLSLGIILGLVAGKFAGISLLARLSVALGIARLPERVTWPQIYGAAAFAGIGFTMSIFIGNLAFENADYLQQAKLAILVAFVLAVLLGTLIFRVFVRAERPR

SEQ ID NO: 3176 - protein, 523 aa, Candida albicans
MYQHQDQTQHQYYQQYNSYNPSIEDLIASSDDKRYQNGGIGNSLQRPPVAGLPYISSQVNPNTSSANLSKLTSNINNYGYNNNNNSHIQLHTPPLSSNPSFTSFQNLNYPLSPLSKPTSPEPILSAASVTTSNFLASSFFSWLPPIDVKIVSFCIGWYLCSIISSNSTKLILNDFKFPVTLTQFQFSASFTFCLVFLNIVKVNPESISSKLPPGFIPSMTDTNRISLSEFITPTRLIIQTTLPMGMFQFIGHITSHKATSLIPVSIVHTIKSLSPIITVLIYRFLFGKSYRMRTYVTLIPLCCGIMLTCYKKSHTSNQNNVPGAGSSVINNNLDKINTNNNYSTGLIFAFISMIIFVSQNIFAKKRLTVESTNAIPMNNKSSLRINSNKVDKLTILFYCSIIGFILTCPIYFVTEWMNYNAFGAISLLQLNSYVMSLVLLNGLSHFVQSLLAFQILGMVSPINYSIANILKRIFIILISFIWESKQFSNSQSIGLVITLFGLYCYDRWGTVSNSGSASNPGKY

SEQ ID NO: 3177 - protein, 439 aa, Magnaporthe grisea
MPSATGQNWEKYQKNFADDEIEEKKITPLSDEDIQVLKTYGAAPYGAALKKLEQQIKEKQQSVDEKIGVKESDTGLAPPHLWDVAADRQRMLEEQPLQVARCTKIIQDEKDESKSKYVINVKQIAKFVVQLGERVSPTDIEEGMRVGVDRNKYQILLPLPPKIDASVTMMTVEEKPDVTYGDVGGCKEQVEKLREVVEMPLLSPERFVNLGIDPPKGALLYGPPGTGKTLCARAVANRTDATFIRVIGSELVQKYVGEGARMVRELFEMARTKKACIIFFDEIDAVGGARFDDGAGGDNEVQRTMLELITQLDGFDARGNIKVMFATNRPSTLDPALMRPGRIDRKIEFSLPDLEGRANILRIHAKSMSVERDIRWELISRLCPNATGAELRSVCTEAGMFAIRARRKVATEKDFLSAVEKVIKGNLKFNSTASYMQYN

SEQ ID NO: 3178 - protein, 663 aa, Candida albicans
MSSLTIYAAKILLKRAISGDLEEDTPDLTTPDDAEDSNPVENEIFSSWALFILLFLLMSALWSSYFLQQRRIKAVHETVLSIFCGMIVGLIIRMSPGHYIQDAVKFNPGYFFNILLPPIILNSGYELHQANFFRNLGSILTFAIPGTFISALVVGIILYIWTALGLDNVSLEFVDALAVGATLSATDPVTILSIFNAYKVDPKLYTIIFGESLLNDAISIVMFETCQKFHGQPVRFSSFFQGVGLFLMTFTISTIIGIFIGILVALILKHSHIRRYPQIETCLVLLFAYQSYFFSNGAHMSGIVSLLFCGITLKHYAYFNMSRRTQIATKYIFQLLAQLSENFIFIYLGLSLFTEVELVFKPMLIIVAFIAICVARWSAVFPLSRFLNFFYRTRFERYSAGTLSTSAGNMINMPDEISHSYQMMIFWAGLRGAVGVALAMGFSGEAKWTLLATVLVVVVLTVILFGGTTASMLEILGIKIGCVDESGDFSDDEFDIEAPPRFPQQSQQSNISSVANKNQNIYGNRRFARSSKLSNYKDNLSAVNLLDQEHGGVPNTGNSSTSNFANVNDDDDDDEIVGSDVDDFISGSISNSTSNINNNNDRGGVLGAILSAEEHAKWFTRFDEEVLKPVLLDTLPSTGQSSQNNSTSNLNSSGNGNGKRNQS

SEQ ID NO: 3179 - protein, 332 aa, Mycobacterium avium
MAAQMREPKVVVLGGGSWGTTVASICARRGPTLQWVRSRETADDINENHRNSRYLGNDVVLSDTLRATTDFCEAANTADVVVTGVPSHGFRGVLTELARELRPWVPVVSLVKGLEQGTNMRMSQIVEEVLPGHPAGILAGPNIAREVAEGYAAAAVLAMPDQHLATRLSGLFRTRRFRVYTTDDVVGAEMAGALKNVFAIAVGMGYSLGIALVIARALREMTKLGVAMGGSPDTFPGLAGLGDLIVTCTSQRSRNRHVGEQLGAGKPIDEIIASMNQVAEGVKAASVIMEFGLTMPIAREVDAVINHGSTVEQAYRGLIAEVPGHEVHGSGF

SEQ ID NO: 3180 - protein, 367 aa, Pasteurella multocida
MKIDKTLVVKFGTSTLTQGSAKLNLPHMMDIVRQLAQLHQAGFRLVIVTSGAIAAGRHYLNHPQLPPTIASKQLLAAVGQSQLIQTWEKLFAIYDIHIGQILLTRADIEDRERFLNARDTLRALLDNQIIPVINENDAVATSEIKVGDNDNLSALVAILVQAEQLYLLTDQQGLFDRDPRKHPDAKLIADVDKITDHIRAIAGGSGTSLGTGGMSTKISAADVATRSGIETIIAPGNRPNVIVDLAYGQAIGTKFSVQADRLESRKQWLYAAPSAGIITIDAGAENAMLMQHKSLLPAGIVNVEGRFSRGEVVKIRTQQGKDVALGMPRYNSDALHLIQGKHSQDIEQVLGYEYGAVAVHRDDMIVL

SEQ ID NO: 3181 - protein, 459 aa, Bacillus subtilis
MIGNSSKDNFGQQQKLSRGLKNRHIQLMAIGGAIGTGLFLGSGKSIHFAGPSILFAYLITGVFCFFIIRSLGELLLSNAGYHSFVDFVRDYLGNMAAFITGWTYWFCWISLAMADLTAVGIYTQYWLPDVPQWLPGLLALIILLIMNLATVKLFGELEFWFALIKVIAILALIVTGILLIAKGFSAASGPASLNNLWSHGGMFPNGWHGFILSFQMVVFAFVGIELVGLTAGETENPQKVIPKAINQIPVRILLFYVGALFVIMCIYPWNVLNPNESPFVQVFSAVGIVVAASLINFVVLTSAASAANSALFSTSRMVYSLAKDHHAPGLLKKLTSSNVPSNALFFSSIAILIGVSLNYLMPEQVFTLITSVSTICFIFIWGITVICHLKYRKTRQHEAKANKFKMPFYPLSNYLTLAFLAFILVILALANDTRIALFVTPVWFVLLIILYKVQTQQRT

SEQ ID NO: 3182 - protein, 178 aa, Clostridium perfringens
MLYDFKVKDIEGNEVSLGEYKGKVLLIVNTATGCGFTPQYEGLEMLYKKYHDKGFEILDFPCNQFFEQAPGSNEEIAGFCKLNYGTTFKTFAKVEVNGENACELYKFLKKEAPMAKEDETSLGFYDKLKGLGFTTEGEEIKWNFTKFLIDKNGEVIARFAPTFEPEKLDELIEELLEE

SEQ ID NO: 3183 - protein, 409 aa, Leptospira interrogans
MGGVMNHRRPAALGFIFVTILIDVIGFGIIIPVLPKLIQELTHGTLSQAAWYGGLLMFAYSFVQFVCAPFVGGLSDRYGRRPVLLASLFGFTLDYLFLAFAPSIFWLFVGRVLAGIMGASFTTGYAYIADISPPEKRAQNFGILGAAFGFGFIIGPVIGGILGQYGSRAPFLAAAALTLINWLFGFFILPESLTPENRRKFEWQKANPIGSLINLKRYPMIIGLVVAFFLMNVAAHSVQGTWNYYTMEKFQWNEAMVGYSLGVVGLVYAITQGGLIRIILPALGQNKSIYLGLALSGLGYALFALATQSWMMFVFLIPYCLGGIAMPPLQGIMSSQVPSNEQGELQGALTSLMSVTAILGPILMTGLFSYFTAKGTPVYSPEAPLWMGTILTAASLWITVGSLRKHHSE

SEQ ID NO: 3184 - protein, 327 aa, Pseudomonas putida
MQLGIIGLGRMGGNIARRLMRAGHRTVVHDRNRDAITGLEGEGAQGAHDLGALVQKLKAPRAVWVMLPAGDATEQTIAQLAEMLEPGDAIIDGGNTFYKDDMRRAAELAKRGLHYLDVGTSGGVWGLDRGYCMMIGGEKDVFERLEPLFKALAPGVGDIPRTHGRSGEHQRAEHGYIHAGPPGAGHYVKMVHNGIEYGLMQAYAEGFDLLRSKGGNELPEDQRFDLNVAEIAEVWRRGSVVTSWLLDLTADALVADPQLSQFSGSVSDSGEGRWTIDAAVEQAVPVPVLSSALFARFRSRQQQGTYGDKILSAMRLGFGGHVEKKGE

SEQ ID NO: 3185 - protein, 264 aa, Amaranthus hypochondriacus
MATSTIQQSAFVGQTLLKQQNELVRKVGGNGGRFSMRRTVKSAPQSIWYGPDRPKYLGPFSEQTPSYLTGEFPGDYGWDTAGLSADPETFARNRELEVIHSRWAMLGALGCVFPEILSKNGVKFGEAVWFKAGSQIFQEGGLDYLGNPNLIHAQSILAIWACQVVLMGLIEGYRVGGGPLGEGLDKIYPGGAFDPLGLADDPDAFAELKVKELKNGRLAMFSMFGFFVQAIVTGKGPIENLSDHLADPVANNAWAYATNFVPGK

SEQ ID NO: 3186 - protein, 361 aa, Carboxydothermus hydrogenoformans
MAVGILTGGGDCPGLNAVIRALVKTLQQKLPEEKIIGFLDGFRGAIENRSVPLTTKDVVGLLPKGGTILGTSNRDNPFKFPVSVNGTLEFHDVSDTVIENLHKNNIEVLFVIGGDGSLSIAHELSQKGVKVIGIPKTIDNDLDATDFTFGFDSAVRTATKALDMLHTTAESHHRIMVLEVMGRYAGWIALYSGLAGGADVILIPEIPFNWDAVCRKIQQRKAEGKHFSIVVVAEGAYPEGGERVIARYVKESTDPARLGGIGQVVADHLSRCTGLESRVTVLGHLQRGGGPTPFDRILATRFGVAAVNTWLQGNYNVMVAFLGGRVTTVPLSEGIKKLKLVPVDSELIVTAKAIGISFGDE

SEQ ID NO: 3187 - protein, 354 aa, Oryza sativa
MQTLHSEGMIVLFVMEMLEFHENDPRRTRIANAYFSLFMALGNILGYATGAYSGWYKIFPFTVTPSCSISCANLKSAFLLDIIILVVTTCITVASVQEPQSFGSDEADHPSTEQEAFLWELFGSFRYFTLPVWMVLIVTALTWIGWFPFILFDTDWMGREIYRGSPDDPSITQSYHDGVRMGSFGLMLNSVLLGFTSIVLEKLCRKWGAGLVWGVSNILMALCFVAMLVITYVAKNMDYPPSGVPPTGIVIASLVVFTILGAPLAITYSIPYAMAASRVENLGLGQGLAMGILNLAIVIPQVIVSLGSGPWDQLFGGGNAPAFAVAAAASFIGGLVAILGLPRARIASRRRGHR

SEQ ID NO: 3188 - protein, 112 aa, Idiomarina loihiensis
MKKVEAIIKPFKLDDVREALSEVGIAGMTVSEVKGFGRQKGHTELYRGAEYMVDFLPKVKLEVVVADSEVERCIEAIMETAQTGKIGDGKIFITEIERVIRIRTGEENEDAV

SEQ ID NO: 3189 - protein, 458 aa, Oryza sativa
MPRRPSGGGGGAGPAAAAVRKVPLRKLLRAASVACGVQFGWALQLSLLTPYVQELGIPHAFASLVWLCGPLSGLLVQPLVGHLSDRIAPAASPLGRRRPFIAAGAASIAAAVLTVGFSADLGRIFGDSITPGSTRLGAIIVYLVGFWLLDVGNNATQGPCRAFLADLTENDPRRTRIANAYFSLFMALGNILGYATGAYSGWYKIFPFTVTPSCSISCANLKSAFLLDIIILVVTTCITVASVQEPQSFGSDEADHPSTEQEAFLWELFGSFRYFTLPVWMVLIVTALTWIGWFPFILFDTDWMGREIYRGSPDDPSITQSYHDGVRMGSFGLMLNSVLLGFTSIVLEKLCRKWGAGLVWGVSNILMALCFVAMLVITYVAKNMDYPPSGVPPTGIVIASLVVFTILGAPLAITYSIPYAMAASRVENLGLGQGTVPFESMLSFWVPVLRKSLFHMQV

SEQ ID NO: 3190 - protein, 97 aa, Cucumis sativus
MAEIEGSPGSSMHGVTGREQTFAFSVASPIVPTDTTAKFALPVDSEHKAKVFRIWSLANPHMRTFHLSWVSFFTCFVSTFAAAPLVPIIRDNLNLTK

SEQ ID NO: 3191 - protein, 413 aa, Unknown
  Rhodococcus sp. RHA1
MDTREAVHAAARRARTASRVLALLTTAQKDAALHAAADAVLAASADILAANAADIETARASGTEDSLLDRLRLTPERIEGIASGLRQVAGLPDPVGEVVRGSTLPNGLELRQLRVPLGVVGMVYEARPNVTVDAFGLALKSGNAALLRGSSSAAKSNAALVVALRTSLAAQQLPEDAVQLLPSDDRSSVTHLIQARGLVDVVIPRGGAGLISAVVRDATVPTIETGVGNCHVYVHSAADLEMAERILLNSKTRRPSVCNTAETVLIDAAIAETAVPKLLQALQTHSVTVHGDLPGLVPATESDWSEEYLTLDVALKVVDDLNAAVEHIDRYGTGHTEAIVTSDLAAAREFTARVDAAAVMVNASTAFTDGEQFGFGAEIGISTQKLHARGPMGLPELTSTKWIVWGDGHTRPV

SEQ ID NO: 3192 - protein, 320 aa, Pediococcus pentosaceus
MNEQIKYYFIVNKWAGAHHSAQTWERLHQLLVQNAVNFERVVTKYPQHATQLAQEFADLHPQGWVIVAIGGDGTLLEVLNGVRRSKNTVPIGYVPAGSGNDFARAVGIASDPSTALQQLIQTTTPITLDIGAYQNQANQLTQYFTNNIGIGFDARVVYEANQGQKVRLSKWHLESMAYVSALLKTLMRQKGFPLTIDIDGERHEFANAFVVSLTNIKYFGGGVGIAPRANLHDGKLDVVITEKLSFFKFVKLFIKLLRGGKHLDMPDVFFKTGREIHVQAFENEHGQVNGEDLPLQAFDLKIWMTKQPFWFNHKAAASQE

SEQ ID NO: 3193 - protein, 181 aa, Rumex obtusifolius
MASSIMSSATVARPSAAQATVIAPFTGLKNIATFPTTRKSSDLSFPSNGGKVRCMQVWPPEGKIKFETLSYLPPLSEADLLAQINYLLINGWVPCLEFDVGPGAVYREHHHSPGYYDGRYWTMWKLPMFGCTDATQVVAELEEAKKAYPHAFVRIIGFDNVRQVQCVSFIAYKPPRAEGTY

SEQ ID NO: 3194 - protein, 447 aa, Lactobacillus johnsonii
MDENNKVSGLPELAKSVIWMINFGYLGIQIAFTLETSQMSRIFQTLGADPTKLGWFFILPPLAGLVVQPAIGSFSDRTWAPKLGGRRLPYLLIGMIFAVIMMLFLPNIGSLGLGYGSIEALVFGAIAIAILDVAANMAMQPFKMMIGDMVNDEQKSYAYGIQSMLSNSGAVIAAFFPFLLTVLGVANTAKKGVVPQSVVISFYVGATILVITSLLTVTKVHEYDPKTYARYHGIKEEDNKEGGNWFELLKKAPKVFWQVSLVQLFCWFSFQYLSTYATGAIAENVWKVTDPSSAGYQLAGNWFGVLTAVQSIAAVIWSYVLAKVPNDHHKVGYGISLLLGAIGYGSIFFVHSQNILIVSFILIGISWAAMNTYPLTMVSNALSGKHMGTYLGLFNCSICLPQIIASLLSFILFPLMKYSMPAMMLTAGISGILAAVCVLFIKETYKN

SEQ ID NO: 3195 - protein, 254 aa, Rhodobacter sphaeroides
MLNPLTAPGQVIFVGAGPGSIDHLTMGACRALTQAEVVIHDRLVGPEILDLIPPQALRIEAGKEGFGPSTPQETINALIVDHAASGRRVVRLKSGDSGIFGRLDEEIEALDAAGLGWRIVPGLTTAAAAAAAIGQGLTKRGRNAALRIVTGHDMAGYAEQDWRGLARVGEVAAIYMGKKSARFIQGRLMMHGADPETPVTVIENVSRADERIVAATLATLPEAVAGLSGPAIVLYGLAPRRAAAALPLLKEATA

SEQ ID NO: 3196 - protein, 387 aa, Emericella nidulans
MRLIHAVLGLLAGAAPALVAASPAAPIGNGRDQVSKAVGRHFEIDGKVQYFAGTNCWWLGNLLNDFEVELAVSQIAETGYKVVRTWGFFGVNDPSNPGQPVYYQVLNESLYEGGLGINYGSNGIRRLDTVVSLAERYDIQLVLTFMNNWNDFGGINIYSNAFGSNATTWYTDKKSQRAYREYIKFIVNRYKGSSAIFAWELGNEPRCKGCDPSVIYNWAKSVSAYIKKLDKKHMVALGDEGWLCPPEGDGTYAYDCSEGVDFVKNLEIETLDYGTFHLYPESWGYNYSWGSEWVLQHDAIGKRFNKPVVFEEYGTPLNHTQLERPWQLTTVKETQVAADFIWQFGTVLPVEGTEWGDVNSIYYGTEEYEVLAVQHAWEMARKKVPRH

SEQ ID NO: 3197 - protein, 321 aa, Streptococcus constellatus
PDINKEPGAEEKYKEVQEAYETLSDEQKRAAYDQYGTAGANAGFGGGTGGFGGFDGSSFGGFEDIFSSFFGGGGASRNPNAPRQGDDLQYRVNLKFEEAIFGTDKEIKYHREATCHTCHGSGAKPGTSPVTCSRCHGAGVINVDTQTPLGMMRRQVTCDVCHGRGQEIKEPCQTCHGTGHEKQAHSVHVKIPAGVETGQQVRLSGQGEAGFNGGPYGDLYVVVQVEPSDKFERDGSTIYYKLNLNFVQAALGDSVDIPTVHGDVELNIPEGTQTGKRFRLRGKGAPSLRGGSMGDQYVTVNVVTPTGLNDKQKAALKEFAE

SEQ ID NO: 3198 - protein, 609 aa, Schizosaccharomyces pombe
MIQTASTISSNGGTNQGMESSSANSPEMHGTQNSMSVGMSGSGSSQNRKITQFSNKLYNMVNDSSTDSLIRWSDRGDSFLVIGHEDFAKLVLPRYFKHNNFSSFVRQLNMYGFHKVPHIQQGVLQSDSPNELLEFANPNFQRDQPELLCLVTRKKAGSQPVEESNTSLDMSTISSELQNIRIQQMNLSNELSRIQVDNAALWQENMENRERQRRHQETIDKILRFLASVYLDGKQKPPSKVMPKSRRLLLEAKYPTVSPTNEPSAHSRPSPQGTTANSSSASISSLHNTTPDGEGKYRSVQNGRALNYVSSFNSDSHSPKDYISQSYTNEPGLKKESADSFNNSIDSYISPNQSPNTDVPSLNRDDTTDPKVVNTGDIINMLDDANSIEGSNMNSLSPLLFDYPNSLYPVNNTSSEQHHNSYRGSVSNSQPSGNLSESTNLQPVQPVDYMSNSNPSYGSYNAEDQLTNFHPGYAMDQKRISKLSDGITKQDQNIQALADILGIPLGDGKIDDAGFSANSPTNLNLPVSSDLDSVLNIPPNEDVFPDSNPVFDEFTNISNLTSPIEASNGNTFGSNPVSLPNQQKSVNPSLMTVSSPRQVRKKRKSSIGA

SEQ ID NO: 3199 - protein, 307 aa, Streptococcus constellatus
EIKKAYRKLSKKYHPDINKEPGAEEKYKKVQEAYETLSDEQKRAAYDQYGAAGANGGFGGFDGSSFGGFEDIFSSFFGGGGASRNPNAPRQGDDLQYRVNLKFEEAIFGTDKEIKYNREATCHTCHGSGAKPGTNPVTCSRCHGAGVINVDTQTPLGMMRRQVTCDVCHGRGQEIKEPCQTCHGTGHEKQAHSVHVKIPAGVETGQQVRLSGQGEAGFNGGPYGDLYVVVQVEPSDKFERDGSTIYYKLNLNFVQAALGDSVEIPTVHGDVELTIPEGTQTGKRFRLRGKGAPSLRGGSMGDQYVTV

SEQ ID NO: 3200 - protein, 304 aa, Streptococcus didelphis
EPGAEEKYKEVQEAYETLSDEQKRAAYDQYGAAGANGGFGGGAGGFGGFGGGAAGFGGFEDIFSSFFGGGGSSRNPNAPRQGDDLQYRVNLTFEEAIFGTEKEVKYNREASCRTCNGSGAKPGTSPVTCGRCHGSGVINVDTQTPLGMMRRQVTCDVCHGRGQEIKDPCATCHGTGHEKQAHSVHVKIPAGVETGQQIRLAGQGEAGFNGGPYGDLYVVVSVEASDKFEREGTTIFYTLNLNFVQAALGDTVDIPTVHGDVELVIPEGTQTGKRFRLRGKGAPSLRGGAVGDQFVTVNVVTPTG

SEQ ID NO: 3201 - protein, 307 aa, Glycine max
MDLIKAWRLSPSVSAIPSPFCAAPICVRTFSFQFSTSPYTRPKPLVPIPRGKSRDSDSEPLLESSIVQEVSFDDDDEEEFLDEFEYDEAADGDEYYEEEEEYEEEAGVPYAGDGGAGGGISLAGTWWDKKALAIAKEVTLSFDGELQIYAFRTLVNCTIQVRIENLSKKSGSPSLEDIEAFSATYRAKLDEAELAKSVPDNICLEVSSPGVERIVRIPDDLDRFKERPMYVKYAINDDLNNPAAEGDGVFRLESFDMETKCCTWGLADVKVNRQKAGKGRPLNKKQREWRLSTPFDSLRFVRLHSDI

SEQ ID NO: 3202 - protein, 564 aa, Oryza sativa
MGNQCQNGTLGSDYHNRFPREHAVGYVQGDSYLDLKKFDDTWPEVNNFKPTAASILRRGLDPTSINVLGRKTADLREHYIIGRKLGQGQFGTTYLCTEINTGCEYACKTIPKRKLITKEDVEDVRREIQIMHHLSGHKNVVAIKDVYEDGQAVHIVMELCAGGELFDRIQEKGHYSERKAAELIRIIVSIVAMCHSLGVMHRDLKPENFLLLDKDDDLSIKAIDFGLSVFFKPGQVFTELVGSPYYVAPEVLHKRYGPESDVWSAGVILYVLLSGVPPFWAETQQGIFDAVLKGHIDFQSDPWPKISDSAKDLIRKMLSHCPSERLKAHEVLRHPWICENGVATDQALDPSVISRLKQFSAMNKLKKLALRVIAERLSEEEIAGLREMFKAVDTKNRGVITFGELREGLRRFGAEFKDTEIGDIMEAAHNDNNVTIHYEEFIAATLPLNKIEREEHLLAAFTYFDKDGSGYITVDKLQRACGEHNMEDSLLEEIISEVDQNNDGQIDYAEFVAMMQGSNVGLGWQTMESSLNVHSLCWLFFQRPVLRNESRHVCVTLISMLAFL

SEQ ID NO: 3203 - protein, 317 aa, Streptococcus dysgalactiae
KYHPDINKEAGAEQKYKDVQEAYETLSDSQKRAAYDQYGAAGANGGFGGGAGGFGGFDGGGFGGFEDIFSSFFGGGGMRNPNAPRQGDDLQYRVNLSFEEAVFGVEKEVSYNREATCGTCSGSGAKPGTSPVTCHKCHGSGVMTVDTQTPLGMMRRQVTCDVCHGTGQEIKEPCPTCHGTGHEKKVHKVSVKIPAGVETGQQIRLQGQGEAGFNGGPYGDLFVILNVLPSKKFERNGSTIYYSLDISFTQAALGDTVDIPTVHGDVEMAIPAGTQTGKTFRLKGKGAPKLRGGGQGDQHVTVNIVTPTKLNDAQKEA

SEQ ID NO: 3204 - protein, 541 aa, Psychrobacter arcticus
MSKTAAAIENNANNNDGNNHQPHYLMWFRRDLRVHDNTALAAICERANTDNAKLSAVFFLTPEQWQTHDMSLTQLDHIARTLPILAQKLQALNITLTVQICPSFTDCIAALSALCESNNISCVMANHEYEGNEIARDEQLTKQLAKTDIEFIRWHDQCILPPQTITTNDNSMYQVFTPFYKKWRHTLEVGDIQIHTAPAITNNEQINLISSEFSANTIQAIEALCKETVHDYQQYLQTHECYQYIDTDKQISQARTAYPAGEAEACHRLTQFISDDINHYDVSRDVPSLHATSHLSAYLTIGALSPRLCYLQATKALGELHRNDGDNFDSGDNNDINRWISELAWRDFYRHVLDYKPELIRHQAYKHETDKKINWSYDEDAFAAWREGKTGVPLVDAAMRCLNATGFMHNRLRMVTAMFLTKDLLIDWRWGERYFMQQLIDGDFASNNGGWQWSASTGTDSAPYFRIMNPFSQAKTHDSDGIFLKTWLPELEPIPASILHSEDKMRKALSKNGAFADIDYPIPMVEHKLARQLAIAEFKKE

SEQ ID NO: 3205 - protein, 506 aa, Mycobacterium avium
MTVTPQEAADHGAAEADYFDVLIVGAGISGIDAAYRITERNPQLSYAILERRARIGGTWDLFRYPGVRSDSSIFTLSFPFEPWTRKEGVADGVHIREYLTATAHKYGIDRHIRFNSYVRSADWDSTSDTWTVTVEDGARDGERKLYRARFLFFGSGYYNYDEGYTPDFPGIEEFTGTVVHPQHWPEDLDYTGKKVVVIGSGATAVTLLPSLSDRAAKVTMLQRSPTYLISASKYGKVAAVARKVLPRKPAHLVIRMYSALTEAVFFALSRKAPRLVRWLLRRKAINSLPPGYAVDIHFKPRYNPWDQRMCLIPDADLYNAITAGRADVVTDHIDHFDATGIALRSGAHLDADIIITATGLQLQALGGATISLDGNEIKTNDRFVYKAHMLEDVPNLFWCVGYTNASWTLRADITARATAKLLEHMTTHGYTHAYPHRGNEPMTEKPSWDINAGYVLRSVHALPKSGTKRPWNVRQNYLADAIDYRFDRIEEAMVFGRAADRAALAG

SEQ ID NO: 3206 - protein, 335 aa, Streptococcus infantarius
PDINKEPGAEEKYKEIQEAYETLGDEQKRAAYDQYGPAGANGGFGGGAGGFGGFDGAGFGGFEDIFSSFFGGGGGMRNPNAPRQGDDLQYRVNLTFEEAVFGVEKEVVYNRESTCSTCHGSGAKPGTSPVTCSRCHGSGVINVDTQTPLGMMRRQVTCDVCHGKGKEIKEPCHTCHGTGHEKKTHKVSVKIPAGVETGQQIRLQGQGEAGFNGGPYGDLFVIINVLPSNKFERNGSTIYYTMNISFVQAALGDTVEVPTVHGDVEMTIPAGTQTGKTFRLRGKGAPKLHGGGQGDQHVTVNIVTPTKLNDAQVKALNNLRKQVATKLEIQRKKAS

SEQ ID NO: 3207 - protein, 189 aa, Coprinellus disseminatus
TREQHIRREKATSNICTAQALLANMAAMYAVYHGPEGLKRISNKVHGFTQVFKSSVESLGFKATNTTFFDTLTLDITGAVANSWAVHASANAAGINLRRIDDKYVGVTFDESVTPAELVNLINVFATAANKSPLTLSDLAEPTESAISPHLKRTSKFLPHPVFNKHHSETEILRYINHLSSKDLSLTHS

SEQ ID NO: 3208 - protein, 77 aa, Staurastrum punctulatum
MRKQNLIEMEGIVTESLPNAMFRVCLDNGCQVLAHISGKIRKNYIRILLGDRVKVELSPYDLTKGRITYRLRTRSPS

SEQ ID NO: 3209 - protein, 52 aa, Geobacter sulfurreducens
MERWRCTICQYEYDPEAGDPENGIDPGTPFEELPDDWVCPICGAGKDLFEPA

SEQ ID NO: 3210 - protein, 702 aa, Clostridium perfringens
MNHTHETIIAGRPMKVEFGKLGMLSDAAILMSYGDTVILTNVNASEKPREGIDFFPLSVEYEERLYSVGKIPGGFIKREGKPSEKAILNGRAIDRPLRPLFPKGYRNDVQVVCTVVSVENDNLPEILAINAASMALCLSSIPFTTPVAAVQVGLIGEEFILNPTSKEREESSLQLTVCATKERVMMIEAGGDEIPEDTMINAIKFGFDKCQDIIKFQEEAVSMFGKEKKVPELHKVPEEIEEAVREFAFDMISESMHITDRDERNAAMDEVKAKINEEFEEKYPDNMSDIGEAVYDMQKEVVRHMLLKEGKRPDGRAFDQVRNIGCEVGLLPRTHGTGLFTRGLTQVMTVATLGSISEIQILDGIGEEESKRYMHHYNFPAYSVGEVRPLRGPGRREIGHGALAERALEPLIPSEAEFPYTIRLVSEVLSSNGSTSQASVCGSTLALLDAGVPIKRPAAGIAMGLITSKDLTEEEVLTDIQGLEDFFGDMDFKVAGTEEGITSIQVDTKIKGLSEKVIHDAIYGARKARLMILDKIKECIPAPREEVSKYAPKTSTLQIDPEKIRDVIGAGGKVINKIIADTGVKIDIKEDGLVYVSSAESEGVKEAVKIIEGLTKEVKAGEIYLGKVTKIAQFGAFVEVLPNKEGLVHISKLDNKRVEKVEDVVSVGDEILVKVTEIDSQGRINLSRKDAIKEAEEENKQQ

SEQ ID NO: 3211 - protein, 148 aa, Burkholderia mallei
MFFDSTDSTDSRMIDVTDDAPSPPTAFELVGGEARVRELVDRFYDLMDLEPEFAGIRALHPPTLEGSRDKLFWFLCGWLGGPDHYIERFGHPRLRARHLPFPIASSERDQWLRCIAWAMQDVGLDEPLRERLMHSFHDTADWMRNRPG

SEQ ID NO: 3212 - protein, 455 aa, Francisella tularensis
MSFIPHKLEQIKKMLDTIGASSVDQLFDEIPRHLRADTLKIKDGINEIQLANLMRKRANKNHHNINYIGAGAYSHHIPAAIWDIVARGEFYTAYTPYQAEASQGGLQVIYEFQTMMAGLTGMDASNASMYDGATALAESVLMAIRSNKKAKSQKVLIAEALHPTYLRVLETITKHQGIEFDIVNLDSKNGKTDVTKLEDFANTNYAAVVIQSPNFLGQLADVDGITNWAHKHGALVIAVTNPMSLAILKSPAEWGDNGADIVCGEGQPMGVPLASGGPYFGFMTCKMAHVRQMPGRIVGRTVDLDGNEGFCLTLQAREQHIRRAKATSNICTNQGLMVTAATIYMSLLGAEGLERVASISHENTQTLATELAKINGVSIRFNSAFFNEVVIDLPVNAETFVTEMEKEAIDAGYFLGEYHSDLANSIMVCATEIHTSEDIKEYIEATKKVLARIGG

SEQ ID NO: 3213 - protein, 450 aa, Desulfovibrio desulfuricans
MSNSAFLNWTHARHGRISGTDPASLTPRLGEAANLLGLELAAGRLPFIDMPYADGMTARLQELEPLLRRFEHMVVLGIGGSALGARALQKAFFPAQDRPAHTGPWLWIADNVDADSLEAWLQSLPAEKTVVVVISKSGGTIETIGQYFLIRDWLRTARGDAWTNHVIAVTDERSGFLREEADTHGLASMPVPDHLGGRYSVLSAVGLIPAAFTGMDWQALVRGAKTVGAPLCSSPDAATLGAHPAWHLAAWNHALMQAGYSQLIFFSYMPLWAHFGFWFAQLWAESLGKEGKGSMPLPAVGVTDQHSTQQMFLDGPRDKACLFLTCSSLPQGRTFPGDMPPKWDFLRGRRFGDLLEAEALGTRMALHKTGTPLVEIGMAQPSEEQAGRLMALLEITTLLTGWLLDINPLDQPAVELGKRLANARLGAPGYDTETADLGAFLAAQGSRQEF

SEQ ID NO: 3214 - protein, 481 aa, Francisella tularensis
MVIFEKTRGKNSPSVMPSKKGDVSNIPTDMLRTKKPILPEQAELDVVRHYTQLSRKNFCIDTNFYPLGSCTMKYNPRAAHKYASLAGFLERHPYASAQSVQGTLECLYDLQNLIKELTGMTGVSLAPMAGAQGEFAGVAMIKAYHHKRSDFERDEIIVPDAAHGTNPATAKVCGLKVIEIPTKKDGDIDIEALDKVLGPKTAGIMLTNPSTVGVFERNIAVIAKKVHEAGGLLYYDGANLNAIMGKACPGDMGFDVLHMNLHKTFATPHGGGGPGAGPVAVNDKLKEFLPVPMVGKKDDKFVWLEEKDVSNTIGRLSAFNGNIGVLIRAYIYGAMLGGNGLTEASEIATLNANYMMARLKEEGFTIAYPDRRASHEFIVTLKPEFLNYGVTATDFAKCLIDKGVHAPTMYFPLLVPECLLIEPTETENVDSMEKFIQAMVEIRDIAKKDPQYLKGAPYNLPARRLDDVKATKELDIVWQPK

SEQ ID NO: 3215 - protein, 540 aa, Unknown
  Petunia x hybrida
MAFDFGTLLGNVDRLSTSDHQSVVSINLFVALICACIVIGHLLEENRWMNESITALVIGSCTGIVILLISGGKNSHILVFSEDLFFIYLLPPIIFNAGFQVKKKSFFRNFSTIMLFGALGTLISFIIISLGAIGIFKKMNIGSLEIGDYLAIGAIFSATDSVCTLQVLNQDETPLLYSLVFGEGVVNDATSVVLFNAIQNFDLSHIDTGKAMELVGNFLYLFASSTALGVAAGLLSAYIIKKLYFGRHSTDREVAIMILMAYLSYMLAELFYLSAILTVFFSGIVMSHYTWHNVTESSRVTTKHTFATLSFIAEIFIFLYVGMDALDIEKWKFVSDSPGISVQVSSILLGLVLVGRAAFVFPLSFLSNLTKKTPEAKISFNQQVTIWWAGLMRGAVSMALAYNQFTRGGHTQLRANAIMITSTITVVLFSTVVFGLMTKPLIRILLPSHKHLSRMISSEPTTPKSFIVPLLDSTQDSEADLERHVPRPHSLRMLLSTPSHTVHYYWRKFDNAFMRPVFGGRGFVPFAPGSPTDPVGGNLQ

SEQ ID NO: 3216 - protein, 371 aa, Bacillus anthracis
  misc_feature (20)..(20): Xaa can be any naturally occurring amino acid
  misc_feature (103)..(103): Xaa can be any naturally occurring amino acid
  misc_feature (111)..(111): Xaa can be any naturally occurring amino acid
MSKRDYYEVLGLSKGASKDXIKKAYRRLAKKYHPDVSKEENAIEKFKEVQEAYEVLSDDQKRAQYDQFGHAGANQGFGGFGGGGDFGGGFGFEDIFSSFFGGXGGRRRDPXAPRQGADLQYQVTLEFEEAIFGKELNVEIPVEDPCDTCKGSGAKPGTSKETCKHCSGSGQVSVEQNTPFGRIVNRQACSHCSGTGQMIKEKCTTCHGSGKVRKRKKINVKIPAGIDNGQQIRVSGKGEAGVNGGPAGDLYVVVHVRSHEFFEREGDHIICEMPLTFAQMALGAEVEVPTVHGKVKLKIPAGTQTGTEFRLKGKGAPNVRGYGQGDQYVVVRVVVPTKLTSHQKDLLREFAGQEEQDDSLFGKLKRAFKGE

SEQ ID NO: 3217 - protein, 90 aa, Borrelia burgdorferi
MFNHVKFILLEKIMEVVLNIKEEAIETEGIVKESLPNTMFRVELKNKHIVLAHLSGKMRKHFIKIVPGDKVKVELSPYDLTKGRIVYREK

SEQ ID NO: 3218 - protein, 553 aa, Nierembergia caerulea
MAFDFGTLLGKMNNLTTSDHQSVVSVNLFVALICACIVIGHLLEENRWMNESITALVIGSCTGVIILLISGGKNSHILVFSEDLFFIYLLPPIIFNAGFQVKKKSFFRNFSTIMLFGAVGTLISFIIISAGAIGIFKKMDIGHLEIGDYLAIGAIFAATDSVCTLQVLNQEETPLLYSLVFGEGVVNDATSVVLFNAVQNFDLSHISTGKALQLIGNFLYLFASSTFLGVAVGLLSAFIIKKLYFGRHSTDREVAIMILMAYLSYMLAELFYLSGILTVFFCGIVMSHYTWHNVTESSRVTTKHTFATLSFIAEIFIFLYVGMDALDIEKWKFVSDSPGTSIKVSSILLGLVLVGRGAFVFPLSFLSNLTKKNPEDKISFNQQVTIWWAGLMRGAVSMALAYNQFTRGGHTQLRANAIMITSTITVVLFSTVVFGLMTKPLILLLLPSQKHLIRMISSEPMTPKSFIVPLLDSTQDSEADLGRHVPRPHSLRMLLSTPSHTVHYYWRKFDNAFMRPVFGGRGFVPFVPGSPTEPVEPTEPRPAESRPTEPTDE

SEQ ID NO: 3219 - protein, 101 aa, Brucella melitensis
MPPNHIGSAQIKGRSFYSAAFIKERNRYRMAKEEVLEFPGVVTELLPNAMFRVKLENEHEIIAHTAGRMRKNRIRVLAGDKVLVEMTPYDLTKGRITYRFK

SEQ ID NO: 3220 - protein, 362 aa, Haemophilus influenzae
MQPTLFIDRDGTLIDEPKTDFQIDSLEKLKLEPKVIPALLRLKAKYRFVIVSNQDGLGTDAFPQTDFDKPHNVMMALFESQGITFDEVLICPHKPEENCLCRKPKIKLLDHYIRKNLFDIDRSFVIGDRETDMQLAENLGIRAIQYDPQKMNWDLIAEKLLGETVTNCGKRPPRFAEVIRQTKETDIKVQVWLDEAGVNEIKTGVGFFDHMLDQIATHGGFRMNVQCKGDLWIDEHHTVEDTALALGQALKQAIGDKRGIARFGFVLPMDECKAECALDLSGRPWIKFNACFKRDKVGDFSTELTEHFFQSLAFSMLATLHLNVTGNNDHHKIESLFKAFGRTLRQAIRIEGNEMPSSKGVL

SEQ ID NO: 3221 - protein, 242 aa, Debaryomyces hansenii
MNATVASEYSSEVHTVPIEHRFNPYSDNGGTVLGIAGEDFSVLAGDTRQVVGYSINSRYEPKIFDVGDDIAMTANGFAADGAALIDRFRNQLKWYKFDHGGKKLSIKSAARYIQHLLYGKRFFPYYVSTLIAGLDDEGKGAVYSYDPVGSYEREQCRAGGAAASLIMPFLDNQVNFKNQFVPGTNGTEKKELRYLSLDEVLQLVKDAFSSATERHIYVGDGLEIFIITKDGIRKEYYPLKRD

SEQ ID NO: 3222 - protein, 557 aa, Pediococcus pentosaceus
MAATIKWWQQAVVYQVYPRSFQDTNHDGIGDLKGITAHLDYLKQLGIDVIWLNPIYRSPNDDNGYDISDYQQIAADFGTMADFDELLQAAHDRGLKIIMDLVVNHTSDEHPRFKRSRQDRTNQYRDFYFWRSGNGKKAPNNWEAAFGGSAWQYDEQTQQYYLHTFSTKQPDLNWENPTLRESVYTMMTWWLNKGVDGFRMDVINQISKLPGLPDGPLKPHSQFGDARVTNGPRVHEFLQEMNQEVLSQFDIMTVGETHGVTPADALKYAGADQHELDMVFEFQHLRLDNSQHGLGKWSTRKTPLVALKKVISDWQVGLEGRAWNSLFWNNHDTPRAVSRFGDDRPAYRVRSAKMLATCLHLLQGTPYIYQGEELGMTDAHFTELASYRDIESLSAYRDLVTERQLLSPADMMARLAAASRDNSRTPMQWDTEVNAGFSDAAPWLTVNPNYRQINAAAALADPDSVWYYYQHLIQLRHQYPSVTLGSFELLWADDPQYSYMHGNGKADLASLLQFHSRDTVPTTGSISDPTAKCLISNYGEQQPNKLRPYEAWVYQLA

SEQ ID NO: 3223 - protein, 555 aa, Unknown
  Torenia hybrid cultivar
MGFESVIKLAASETDNLWSSGHGSVVAITLFVTLLCTCIVIGHLLEENRWMNESIIALIIGLATGVIILLISGGKSSHLLVFSEDLFFIYALPPIIFNAGFQVKKKSFFRNFATIMMFGAVGTLISFIIISLGTIAFFPKMNMRLGVGDYLAIGAIFAATDSVCTLQVLSQDETPLLYSLVFGEGVVNDATSVVLFNAVQNFDLPHMSTAKAFELVGNFFYLFATSTVLGVLTGLLSAYIIKKLYFGRHSTDREVAIMILMAYLSYMLAELFDLSGILTVFFCGIVMSHYTWHNVTENSRVTTKHTFATLSFVAEIFIFLYVGMDALDIEKWRFVSGSMTTSAAVSATLLGLVLLSRAAFVFPLSFLSNLAKKSPLEKISLRQQIIIWWAGLMRGAVSMALAYKQFTREGLTVERENAIFITSTITIVLFSTVVFGLMTKPLINLLIPSPKLNRSVSSEPLTPNSITIPLLGESQDSVAELFSIRGQTSQGGEPVARPSSLRMLLTKPTHTVHYYWRKFDNAFMRPVFGGRGFVPYVPGSPTERSVRNWEEETKQ

SEQ ID NO: 3224 - protein, 524 aa, Arabidopsis thaliana
MELEEQERDILFPTDDEECQVDVSCDDEDDDSSSYSSLSQNDSAPWPRSYRQSVDILTGVTPPTISFIHRRSSQTSFTSSVASLYKRRPTSIANSFASSTSKQPLLSEKDDVLFLSSQIGLSNTDLSYGEPNFCSFPQSVLNGINVLCGISLLTMPYAVKEGGWLGLCILLSFAIITCYTGILLKRCLESSSDLRTYPDIGQAAFGFTGRLIISILLYMELYVCCVEYIIMMSDNLSRVFPNITLNIVGVSLDSPQIFAISATLIVLPTVWLKDLSLLSYLSAGGVFVSILLALCLFWVGSVDGVGFHTGGKSLDLANLPVAIGIFGFGFSGHAVLPSIYSSMKEPSKFPLVLLISFGFCVFFYIVVAICGYSMFGEAIQSQFTLNMPQQYTASKIAVWTAVVVPMTKYALALTPIVLGLEELMLPSEKMRSYGVSIFIKTILVLSTLVVALTFPFFAIMGALMGSFLAMLVDFIFPCLCYLSILKGRLSKTQIGICVFIIISGIVSGCCGTYSAIGRLVGKLD

SEQ ID NO: 3225 - protein, 692 aa, Gloeobacter violaceus
MPTDTLAKTLCPYCGVGCGLEVTADARVRGDRAHPSTLGMVCVKGATVLESIGKDRLLYPMVRARLDEPFRQASWEEALALVVGRLRAASPESLCFYGSGQFVTEDYYVAQKLFKGCLGSNHIDANSRLCMSSAVSGYLQSLGSDGPPACYDDLDLTDCAFLVGTNTAECHPVLFNRLLKHRKQDLNSRLVVVDPRATPTAKAADLHLAIRPGSDIDLFNGIAHLILQWDRADQRFIGAHTQGFAAMAEVVRHYPPEAVARRCGITTAALELAARLWVNSARVLSLWSMGINQSIEGTAKVRALINLHLLTAQIGRPGSGPFSLTGQPNAMGGREAGGLSQLLPGYRSVADPDHRRQVEEHWQLPSGSIAARPGRTAWEMIEALEAGAVEVFWIAATNPAVSLPDLERTKAALLRSPFTVYQDCYYPTETARYAHVLLPATQWSEKTGTMTNSERRVTLCPAFHPPPGEARDDWQIFAEVGRRLGFAEQFAFADAAAVFAEFAALTRGRPCEMTGISHARLEREGPLQWPCPAGSAGTARLYTDWRFATPDARARFAACHARGLAEPPDPEYPFVLINGRLYGHWHTLTRTGRIEKLLNLYPEPFIEIHPRDAGKLGLGEGDWVEVRSRRGAIRLPARLTLAVAPGTVFVPMHWGALWAEAAEVNALTHPESDPISGQPEVKSCAVQLSALP

SEQ ID NO: 3226 - protein, 528 aa, Arabidopsis thaliana
MDLEEQERDILIQTDDDDCHVDVSYVNDDDDSNASFSLSQNDSAFWPQSYRHSVDLLTGVTPPMVSFIQGRSTETSFSSSIASLYKRRPTSIANSFVSSTSKQPLLSEKDDVSFLSSQVGLSNTDLSYGEPNFCSFPQSVLNGINVLCGISLLTMPYAVKEGGWLGLCILLSFAIITCYTGILLKRCLESSSDLRTYPDIGQAAFGFTGRLIISILLYMELYVCCVEYIIMMSDNLSRVFPNITLNIVGVSLDSPQIFAISATLIVLPTVWLKDLSLLSYLSAGGVFVSILLALCLFWVGSVDGVGFHTGGKALDLANLPVAIGIFGFGFSGHAVLPSIYSSMKEPSKFPLVLLISFGFCVFFYIAVAICGYSMFGEAIQSQFTLNMPQQYTASKIAVWTAVVVPMTKYALALTPIVLGLEELMPPSEKMRSYGVSIFIKTILVLSTLVVALTFPFFAIMGALMGSFLATLVDFIFPCLCYLSILKGRLSKTQIGICVFIIISGIVSGCCGTYSAIGRLVGELNWMVQ

SEQ ID NO: 3227 - protein, 717 aa, Pseudomonas putida
MSPRTPKKTRSVAPSRIREGMPFPLGATWDGLGVNFALFSANATKVELCLFDSTGEQELERIELPEYTDEIYHGYLPDAHPGLVYGYRVYGPYEPENGHRFNPNKLLIDPYAKQLVGSLKWSEALFGYTIGHPDGDLSFDERDSAPFVPKCKVIDPAFTWGRDQRVQIPWERTIIYEAHARGISMRHPAVPEELRGTFAGLANDELLKHIKDLGVSSIELLPIHAFVNDQHLLDKGLNNYWGYNSIAFFAPHPRYLASGKIAEFKEMVAHLHDAGLEVILDVVYNHTAEGNERGPTLSMRGIDNASYYRLMPDDKRYYINDSGTGNTLDLSHPCVLQLVTDSLRYWAGEMHVDGFRFDLATILGRYHDGYSERHGFLVACRQDPMLSQVKLIAEPWDCGPGGYQVGNFAPGWAEWNDRFRDTARAFWKGDEGQLADFAARLTASGDMFNNRGRRPYSSVNFITAHDGFTLRDLVSYNHKHNEDNDENNQDGTDNNLSWNCGVEGPTDDPAINALRMRQMRNYFATLLLAQGTPMIVAGDEFSRTQHGNNNAYCQDSEIGWVNWDLDEEGQELLAFVKRLTRLRLAYPVLRRSRFLVGDYNEAIGVKDVTWLAPDGSEMSVEQWEDPHGRCLGMLIDGRAQVSGIARPGAEATVLLIVNAHHDIVPFKLPAVPEGDYWSCLVDTDRPELRKGQHLQFDSTFEVKGRSMLLMVLQYDEE

SEQ ID NO: 3228 - protein, 980 aa, Bacillus subtilis
MMDVKSISVRVDGTEIQARAGATILDILNENGIEYPQICHVPEVDPIQTCDTCIVEANGKLVRSCATVAENGMSIDLSGNRVKEAQTEAMDRLLENHLLYCTVCDNNNGNCTLHNTAEMMGIEHQKYPYTPKEDPSCAVDMSHPFYRYDPNQCIACGQCVEVCQNLQVNETLSIDWERERPRVIWDEGVPINESSCVSCGQCVTVCPCNALMEKSMLGQAGFMTGIKEDVMEPMIDLVKNVEPGYGSIFAISEVEAAMRETRTKKTKTVCTFCGVGCSFEVWTKGRDILKIQPVSDAPVNAISTCVKGKFGWDFVNSKERITKPLIRKNGAFVESSWEEALDLVASRLGSIKEQYGKGSVGFISSSKITNEENYVIQKLARQVFETNNVDNCSRYCQSPATDGLFRTVGMGGDAGTIKDIAKAGLVIIVGANPAEGHPVLATRVKRAHKLHGQKLIVADLRKNEMAERSDLFISPKQGTDQVWLMAVTKYMIDQGWHDQAFIDENVNYFEDYKETLKTYTLDYAERITGLSKENIIQIAEMIRDADGTCVLWGMGVTQNTGGSDTSAAISNLLLATGNYRRPGAGAYPLRGHNNVQGACDMGTLPGWLPGYQHITDDKARAKFEEAYGVEIDGKPGLDNIQMLHAIEEGKMKAMYLVGEDMALVDSNANHVHDILSSLDFFVVQDIFLSRTAQYADVVLPATPSLEKDGTFTNTERRVQRLYQALPTLGDAKPDWWIIQEVANRLGANWNYSHPSDIFSEMASLSPLFAKASYEVLEGWNSFLWGSFTGESTPLLYEDGFNFPDKKARFALSDWTEPAAFPEEYDLHINNGRMLEHFHEGNMTNKSKGIQAKVPNVFVEISPELAQERGVCDGSLVRLVSPFGAVKLNALITDRVRKNELYLPMNSTDKESAINFLTGPAADKRTNTPAYKQTKVRMEVLGGCETAPLPKTNPRNKKRHPQNGVEAERKWNRPGYVHLTD

SEQ ID NO: 3229 - protein, 399 aa, Bacillus halodurans
MTRSERKPLLMLMVNMFVVMMGIGLVIPILPYYIEAFGASSVELGLLIAIFSFMQFLLAPFWGRLSDKVGRKPLIAVGMFGFAVAEFIFAFATQFWMLFVSRILAGAFGSAVMPAAMAYVSDRTSEEKRGHGMGLLGASMALGIVVGPGIGGWLAEFSLATPFLFAGFAASFAAIFSLLWLPESLPLEKRKTEVEPVNQFVQMWQAVRSPIGFLLFLVFGLSFGLANFQTIFGIFALHRFHYNPSEVGFIMVLTGIVGAIAQGSLVGRLTERYGEEKVVLGSLSLSGIGFLIMMLAFNYWTVIATTCLFFLGNSILRPAVQSFLSKMAGDQQGMIMGLNNSILSLGNVVGALLAGLLFEWNMFLPYTVGAFVMFASLGATFRWLSKRASQGKHPEKSSP

SEQ ID NO: 3230 - protein, 380 aa, Crocosphaera watsonii
MLQGLILQTFFYSHLIKAMISKLTLSLLTTLIFSSIVPPVLASTDLPLLVSQTPREKQLDDLLRRGRDHVDKRDYQRAIAIYQQAASLDTDNAKIFSGIGYLHSKQGNHSAAVKYYQKALSLDSSNPNFYYALGDSLANVGDNNNAASAYYYAIQLNPKFVKSYIGLGVVLLRQEDYEGAAEAYKRVIALDPNNPEAFAIMGSSLLQQKQLDQALQYLGNAVQRFPRDVDLRLLLATAYLQQGQLELGKEHLKRAERVDPRNIKVQLKIARIYEVQDNLDEALNIYRSVSFFNRKNPEAFAGVGRIQLAQKDYLGATITYQDLIEIIPQNPEPYYYLGMAFKERNRNGEAKKALDYAKKLYQEYDNTEGIKKVDDLLKQL

SEQ ID NO: 3231 - protein, 388 aa, Lactobacillus johnsonii
MAQRDYYDVLGVDKNASESEISKAYRKLAKKYHPDLNHEPGAEEKYKEVNEAYEVLHDKQKRAQYDQFGQAGVNGQGGFGGQGFGGFGGQGGYSSQGFGDFGDIFGDIFGSAFGGGRSRVDPTAPQKGQDLDYTMTIDFMDAIKGKKTDITYTRSEVCPTCDGSGAEKGTHPITCDKCHGSGVMTVTRQTPLGVIQQQTTCDKCGGRGTIIEHPCQTCHGQGTVDKKQTLQVTVPAGIDNGQQIRLSGQGEAGKNGGPYGDLYIVFRVKPSKEFRRNGTTIYTEAPISFAQAALGDKIRVNTVHGPVDLTIPAGTQPNTNFKLRGQGVPKINGTGNGDQEVTVKVVIPKKINDKQKEALVDYVKAGGGNISPQEKNFFERLKDKLNGE

SEQ ID NO: 3232 - protein, 182 aa, Glycine max
  misc_feature (37)..(37): Xaa can be any naturally occurring amino acid
  misc_feature (88)..(88): Xaa can be any naturally occurring amino acid
MENQMAPSMIDCPAVTTVNRAGAVMAASFTGLKSMAXGFRTRETNSDITYIASNGGRVQCMQVWPPVGTKKSETLSYLPDLDDAQLAXEVEYLLRKGWIPCLEFELEHGFVYREHNTSPGYYDGRYWTMWKLPMLGCTDASQVLKERAEAKTVYPNGFIRIIGFFFVGRVHCISWLAYKPPG

SEQ ID NO: 3233 - protein, 287 aa, Arabidopsis thaliana
MASSAFAFPSYIITKGASTDSFKSTSLSSSRSLVTDFHLLFSRPISSGPKYQSAKSAKPESPVAINCLTDAKQVCAVGRRKSMMMGLLMSGLIVSQANLPTAFASTPVFREYIDTFDGYSFKYPQNWIQVRGAGADIFFRDPVVLDENLSVEFSSPSSSNYTSLEDLGSPEEVGKRVLRQYLTEFMSTRLGVKRQANILSTSSRVADDGKLYYQVEVNIKSYANNNELAVMPQDRVARLEWNRRYLAVLGVDNDRLYSIRLQTPEKVFLEEEKDLRRVMDSFRVEKI

SEQ ID NO: 3234 - protein, 563 aa, Thermotoga maritima
MVRPQRNKKRFILILNGVWNLEVTSKDRPIAVPGSWNEQYQDLCYEEGPFTYKTTFYVPKELSQKHIRLYFAAVNTDCEVFLNGEKVGENHIEYLPFEVDVTGKVKSGENELRVVVENRLKVGGFPSKVPDSGTHTVGFFGSFPPANFDFFPYGGIIRPVLIEFTDHARILDIWVDTSESEPEKKLGKVKVKIEVSEEAVGQEMTIKLGEEEKKIRTSNRFVEGEFILENARFWSLEDPYLYPLKVELEKDEYTLDIGIRTISWDEKRLYLNGKPVFLKGFGKHEEFPVLGQGTFYPLMIKDFNLLKWINANSFRTSHYPYSEEWLDLADRLGILVIDEAPHVGITRYHYNPETQKIAEDNIRRMIDRHKNHPSVIMWSVANEPESNHPDAEGFFKALYETANEMDRTRPVVMVSMMDAPDERTRDVALKYFDIVCVNRYYGWYIYQGRIEEGLQALEKDIEELYARHRKPIFVTEFGADAIAGIHYDPPQMFSEEYQAELVEKTIRLLLKKDYIIGTHVWAFADFKTPQNVRRPILNHKGVFTRDRQPKLVAHVLRRLWSEV

SEQ ID NO: 3235 - protein, 436 aa, Glycine max
MPTFTAMALDRLIEPGASKPVDKSAPTSMPVPNSQKLERSTSAPAKKSKVPQPPLKPALYTTPEVTPLPDAPSSFPPSPYIINHKRRGPRLLKSSSEASALSEVNIRCDDDNDKSVDAVVTSSAGDLQVTSTKPELVKEEKVNGVYDGQLDRSNDVDHANGHRETGSGSLTNGLLKEKPPALNLDRVSEVEDFFYPLDSMSFSSNTDGEENAGTELSMKLSSPSTEFYDAWEELSSEGMSQNSTYDIEAELREVRLSLLVEIEKRKQAEESINNMRSQWESIRQGLYQAGIILPAYLNATAEDEQLTSDPVEDLCQQVYIARFISNAIGKGIARAELETEMEAQLEAKNFEIARLLDRLHCYETMNREMSQRNQEAVEMARCERQRSSRRHRWIWGCITTVIALSTAAIAWSYLPTSKGSSSADHDLVPEYDDTAK

SEQ ID NO: 3236 - protein, 1134 aa, Unknown
  Rhodococcus sp. RHA1
MADQAPPTNSEPNETATTGSAVPALPEKIRVHALAKLLGVTSKQVLAEAAALGTELRSAQSSLQRDVAERVHAAFTAAQIAPTEPPAAVEPVAKTPAPEPVAEPPAEPVVEVAPEPVAAADVEEAAAEQTPAPAVPTEEAAAQEPVAEEAAVAERDLGRDLFTTASYQVEAPAAEPAVETPPAASQVPLFLQPDLAAVETPPRRRRSRRDAGTPEPTTEQPPVAETREEVPEPAKATDTGTADTESDESDVDGDQPRRRRRGRRGRGRGRGEQQNEQDTDIDTEGAEAEESARESVREEKAAETPTREPEEKPKKDSEEQPAEAEQAEAESGDEETGEGDSDGSSRRRRRRRRRKSGGEGSGEATSEDDPPNTVVHEREPRNKSRSKDEVQGITGSTRLEAKRQRRRDGRDAGRRRPPILTESEFLARREAVDRVMVVRDRIATGQPHATTQVAVLEDGVLVEHFVTTSASASMVGNVYLGRVQNVLPSMEAAFIDIGRGRNGVLYAGEVNWEAAGLGGNSRKIEQALKPGDQVLVQVSKDPVGHKGARLTTQISLAGRFLVYVPGGTSTGISRKLPDTERKRLKDILRDIVPSDAGVIIRTASEGVSEEELARDVKRLQDQWAGIEAQAAKAESGKSGNPQALYEEPDLLVKVIRDLFNEDFSKLVIEGDKAWSTVESYIRSVAPDLMPRLEQHTSDNGVDVFEAHRIDEQLAKALDRKVWLPSGGTLVIDRTEAMTVVDVNTGKFTGAGGNLEETVTRNNLEAAEEIVRQMRLRDIGGMIVVDFIDMVLESNRDLVLRRLTEALGRDRTRHQVSEVTSLGLVQMTRKKLGTGLVEAFSTTCEHCHGRGIVVHAEPIEVKTSEDNGARGSSRGGDSGGSRKKRGRDKSSGGETSQPPVHEETPTVDATVKRAHPVALAMAHHHHEEEAAHAHSGHEAESAEQPAAAVPEPEQPVAAEAETPAADLPGIEEAVAEAPAAVAAEAVVAPEAEDTVAEEAVVEEAVAEETVAEEPAVEAAPAEAAPVAETSEPVVEPEPEPQPEPVAPPRRRSRRVSRAAAAPVSETPSAGTVFVIPTSETGAEHAPEPEPAMSASAVSAPPASSPDGGDSQASPRRPRRRRAAARPAGPPVDADN

SEQ ID NO: 3237 - protein, 412 aa, Ostreococcus tauri
MRAVAAHYRAPTRTRRAPAIRQPSTSRARRTSTLAVARAAGSSSQNIMPSNGANKPVAIITGASSGLGLYTAKALIEKGYFVVMAVRDPRKGETKANELGFDKKSYAVMYCELGELASVREFCSGFRRSPYVKNFQALVCNAALYLPNATVPSYTKDGFEECVGVNHLAHHLMCLELLDDLAKAPDANMKRLIIVGSVTGNTNTLAGQVPPRAGLGDLSGLRNGFKNSDRNQGAHIDGSRFIGAKAYKDSKLCNMLDIKVFAERYGESTGIKFSTMYPGCIADSNLFRNHTPFFRWLFPILQKNVTKGYVSEEEAGQRLASIVYDPRYTEQGAYWAWKGGGDQLWDNFNNNNEDTRTIAFNNKPSREGRDMAKANAMFDISTELVGYKPNVIDGVSKAFDRVISSATEKISK

SEQ ID NO: 3238 - protein, 338 aa, Rickettsia rickettsii
MNKFKNIAVYGGGSFGTSLASLAAQNCNNVTLFLRDEAIAKEILHNKTNVKYLGDIKLPAHLQATTNLDIIKDFELIIIAVPSYAFDDSIKLLKTHSISKDNTLLIATKGFARNPTTLFSDRLKTLLPHSPTAFFVGPNLAKELAKNLPASASIASLDIDIANKIAYNLSSKIFTTNVSSDIVTLQVAGALKNIFAIKSGIDLARKQGENARATLIVAALKEIAILSKALGGMQKNSDILLEGVVGDLVLTCYSLGSRNTKFGYELGISSDKKQFLQEYKELVEGREALKLVLDLIKKYNLHMPIISEVASCVIPYVIPAKAGMTYESTQQCLRRNDI

SEQ ID NO: 3239 - protein, 638 aa, Geobacter sulfurreducens
MKKYLTLFVLSLSAATALGGEAVAAQERCWEAKRLVKSLSGEDEDARANTEKRILEYCSDGAAGHFVKGLRAEREKRFDQAVTEYRETLRMDPSFPDAQGSLGLALLAKGSADEAVVELTRALAEDSKPRYHQGLGKIFAERSLYSLALYHYAEALRELPDDPSIRVDLAQVYRQAGKKEEAEKELKKALTVAPANENARLALASLYLADGRTEGAVQELKQAQLANPGNRGIHLLLAEAYEKLGDRKAAEYEYTLSGRQRGVLPEEYLRRGDERMAAKEFPKAVEEYRAALKERPGSAEVLHKLSGAQAAAGLDDDAIASYRELLRVKPGNAANHYNLGIIYERKGLIDEAVVEYKQAVRLSAEHGDARRRLADIYTLRGSHPQAIEQYRELLKRGDSNPVLHLKLARGFMSSKNTKDAIASYNEALKLDPDNLEAHRELAAVYRKLNQMDDASKQYREVLRIKKDDAEARNILTAIYVKEKKYDELVPLLQEGVELAPNDAMSHYKLGLIHEFRKDYDSAEVSYRKATELKDDHAKALNALGRIYLKTGKLTEAKEALEAAKKADPGMEETAVLLSNIKDELSPEPKRYVKKKGTKGRKSAVSKKRSGKKSSAKKSTTKKKSTKKSSSSGKKKSGT

SEQ ID NO: 3240 - protein, 398 aa, Bacteroides thetaiotaomicron
MEQKTRIKGNVHYVGVNDRNKHRFEALWPLPYGVSYNSYLIDDEMVALVDTVDICYFEVYLRKIKQVIGERPINYLIINHMEPDHSGSIRLIKQHYPDIIIVGNKQTFGMIEGFYGVTGEQYLVKDGDFLALGKHMLRFYMTPMVHWPETMMTFDETDGILFSGDGFGCFGTVDGGFLDTRINVDKYWGEMVRYYSNIVGKYGSPVQKALQKLGGLPITTICSTHGPVWTENISRVIGIYDRLSRYDADEGVVIVYGSMYGNTEQMAEAIAAELSAQGIRNIVMHNVTKSHPSYILADIFRYKGLIVGSPTYSNQIFPEVESLLSKILVRELKGRYLGYFGSFTWAGAAVKRMAEFAEKSKFELVGDPVEMKQAMQDITYTQCENLARAMADRLKKDR

SEQ ID NO: 3241 - protein, 951 aa, Vibrio vulnificus
MKLIKRSDSVTKEQKQLGISRRVFMRNSSLAAGGAIAGASLFAPGMIRKAEAKSVDASAPIEVKRTICSHCSVGCGIYAEVQNGVWTGQEPAFDHPFNAGGHCAKGAALREHGHGERRLKYPMKLENGKWKKLSWDQAIEEIGNKVLEIREQSGPDSVYWLGSAKHNNEQAYTFRKMASMWGTNNVDHQARICHSTTVAGVANTWGYGAMTNSFNDMHNCKSMLFIGSNPAEAHPVAMQHILIAKEKNSCKIVVADPRRTRTAAKADHYVSLRPGTDVAFIWGVLWHVFNNKWEDKEFIRQRVFGMDEIRAEVAKWNPKEVERVTGVSEEDVYQTAKLLSEHRPGCIVWCMGGTQHTTGNNNTRAYCVLELALGNLGKSGGGANIFRGHDNVQGATDLGVLSHTLPGYYGLAEGSWKHWAKVWGIDFDWLKNRFDQNKYNGKQPMFNMGIPVSRWIDGVLENKDSIEQNDNIRAMFYWGHAVNSQTRGVEMKKAMEKLDMMVIVDPYPTVAAVMNDRTDGVYLLPATTQFETHGSVTASNRSIQWRDQVIEPLFESKPDHEIMYLLTKKLGFADQLFKNVRVVNNQPVIEDITREFNKGMWTIGYTGQSPERLKAHQQNWHTFHKTTLEAEGGPANGETYGLPWPCWGTPEMKHPGTHILYDTSKPVAQGGGTFRTRFGVEFEGKSLLADGSYSKDSDIQDGYPEFSDKLLKQLGWWDDLTAEEKVLAEGKNWKTDLSGGIQRVAIKHGCIPFGNGKARTIVWEFPDRVPLHREPLYTPRRDLIADYPTWDDAASIYRLPTLYKSIQDQDKSQEYPIILTSGRLVEYEGGGEETRSNPWLAELQQEMFVEVNPKDANDLGFKDGDMVWVEGAEKGRIHVKAMVTRRVRPGMAFIPFHFGGKFQGEDLRNKYPEGTDPYVIGESANIATTYGYDPVTQMQETKVTLCNIRKA

SEQ ID NO: 3242 - protein, 574 aa, Glycine max
MTMEEGRVENEDYTQDGTVNIKGKPILRSKSGGWKACSFVVVYEVFERMAYYGISSNLILYLTTKLHQGTVSSANNVTNWVGTIWMTPILGAYIADAFLGRYWTFVIASTVYLSGMSLLTLAVSLPSLKPPQCFEKDVTKCAKASTLQLAVFYGALYTLAVGTGGTKPNISTIGADQFDDFHPKEKLHKLSFFNWWMFSIFFGTLFANSVLVYIQDNVGWTLGYALPTLGLLVSIMIFVAGTPFYQAQSAAGSTFTRMARVIVAACRKSKVPVPSDSKELYELDKEGYAKKGSYRIDHTPTLKFLDKACVKTDSNTSPWMLCTVTQVGETKQMIRMIPILVATFVPSTMMAQINTLFVKQGYYSRQTPWKLQIPQQSLAAFVTVSLLVCIVLYDRFFVKIMQRFTKNPRGITLLQRMGIGLVIHTLIMIIASGTESYRLKVAREHGVVESGGQVPLSIFILLPQFILMGTADAFLEVAKIEFFYDQSPEHMKSIGTSYSTTTLGLGNFISSFLLSTVSNITKKNGHKGWILNNLNESHLDYYYAFFAIFKLPQPHLLRVCSLGTMYIGLKFQIP

SEQ ID NO: 3243 - protein, 1070 aa, Francisella tularensis
MQATNQNIWIQDKFGNFTHLNATHQVYLDFETNSIRFRIQADGFLHGYVIANFNNWQKLEEYKLTWTTDNDDGSLWLTKDVFNISTLNAGTNQYSFILVSLAGEEFKVSINDHDLIPLSFNWQVAKGTLEIKASENYVVSGFNLELIAITKSITGYQNIVDVEWQVSPQNSKITLTNGKLLIDPSVSNLTEVKVSCFAKNNPDLKAERIFTVIKEKRKGSLVHLIKKDQQYKGENFDWDLWNFNKNKPAYSVSLSHRSDFGLYGLCQKKNVIARKRIWDINWHNDWAEQTSCFKISKKHQNYYIVHGDATIYRSLEDVINKTNPRIIHAVMNEASQIIAYLSDIPRIGTSFELWVNSKKVENVGLIVKHRSKQLIFTGLPPINPHDLVEIRANNTFSAAKVLMGEYLNNFYYPNNIGVSFSDELISLRIWSPTAIKVEVLIYNEDLDNNKKQPDVVHELTAERSYGTHHIEICRKNYENKYYIYRLYFEDLDNKGQRCIKTTYAVDPYAYGVGLNGRKGFLVDLNNPKVTPEQWQQSHNPNCLNREDAIIYEAHLRDFTISPESGVSEELRGKYLGAVENNTYYIDSATNQKVSTGIDSLVELGVTHIHLLPIFDFSSVDEEKNNEKDNRNWGYDPQNYNAPDGSYSINPYDPLQRIRGARNMILGFHQKGIGVIMDMVYNHMTETSNLDKIIPKYYFRTDALGNFTNGSGCGNELASEKPMVSKFIQDSVIHWVKNYKIDGIRFDLMELIDINTIKNIVSKVKQINPNVIIYGEPWKGGDSPLINGTHRGTQRNQQFSIFNDYFRDAIRGNNNPGNGFINGDPHNPSNIGNVIEGLRGSIYSLTAMPGESVNYIDAHDNYTLWDQVEKSQSHDIPQGYYRKNLPENIFEHRFVRQNALALGIILTAQGIPFIHGGSEFLRTKQGDHNSYKSGDNINAFHWSDKLRYKAFFDYIAGLIRIRKEHPAFRMRDRETIEKHLNMTTAHHDSKSGVIISHFKNNANGDSWQDIIVIYNATSIDGYDVNALMPIPAGKIWHIVANHEKAGVDTIQTVNSSELPGLKSYSLMIIHS

SEQ ID NO: 3244 - protein, 175 aa, Ipomoea nil
MAKMSDPLVIGRVVGDVVDHFSQSVKMSVVYNSNKHVYNGHEFFPSLLTSKPKVEVHDGDLRSFFTLIMTDPDVPGPSDPYLREHLHWIVTDIPGTTDSSFGREIVSYETPKPNIGIHRFVFLLYKQKRRQSVTVSSSPSRDRFNTRKFADDNDLGSPVAAVFFNCQRETAARRR

SEQ ID NO: 3245 - protein, 425 aa, Oryza sativa
MQYRTQQAMLPAVKLSPGPVAFAGTNLRSRSASVSSVSSLKPSKFVVSSLRPLYLAPLDGPRAAGQKAQRQPLEFRCAASAADDKESKTEVLNAFPYPWLTSTLSLACGSAMMLVSWATRLVEAPKTDLDFWKVLFPVAVAHTIGHVAATVSMSKVAVSFTHIIKSAEPAFSVLVSRFLLGETFPVPVYLSLLPIIGGCALAAVTELNFNMVGFMGAMISNLAFVFRNIFSKRGMKGKSVSGMNYYACLSIMSLVILTPFAIAMEGPQMWAAGWQKALAEVGPNVVWWVAAQSVFYHLYNQVSYMSLDEISPLTFSIGNTMKRISVIVSSIIIFHTPVRPVNALGAAIAILGTFLYSQTAEYFSSFFCYRRQSSEFKKMVMFRAMDEEGIQMKNVSAKPVASTEANFACATYLVDIGGLGFDMRS

SEQ ID NO: 3246 - protein, 996 aa, Lactococcus lactis
MMTMIDVLERKDWENPVVSNWNRLPMHTPMDFLEKQSLNGLWNFDHFSRISDVPKNWLELTESKTEIIVPSNWQIEFKDKSDVPIYTNVTYPIPIQPPYVPEANPVGAYSRYFDITKEWLESGHVHLTFEGVGSAFHFWLNGEYGGYSEDSRLPAEFDISNLAKEGQNCLKVLVFRWSKGTYFEDQDMWRMSGIFRSVNLQWLPDNYLLDFSIKTDLDEDLDFANVKLQAYAKNMDDACLEFKLYDDEQLIGECHGFDAEIGVVNPKLWSDEIPYLYRLELTLMDRSGAVFHKETKKIGIRKIAIEKGQLKINGKALLVRGVNKHEFTPEHGYVVSEEVMIKDIKLMKEHNFNAVRCSHYPNDSRWYELCDEYGLYVMDEANIETHGMTPMNRLTNDPTYLPLMSERVTRMVMRDRNHPSIIIWSLGNESGYGSNHQALYDWCKSFDSSRPVHYEGGDDASRGATDATDIICPMYARVDSPSINAPYSLKTWMGVAGENRPLILCEYAHDMGNSLGGFGKYWQAFREIDRLQGGFIWDWVDQGLLKDGNYAYGGDFGDKPNDRQFSLNGLVFPNRQAKPALREAKYWQQYYQFELEKTPLGQVFAFTVTNEYLFRSTDNEKLCYQLTNGLEVLWENELILNMPAGGSMRIDLSELPIDGTDNLFLNIQVKTIEKYNLLESDFEVAHQQFVLQEKINFTDKIDSNEEITLLEDEELLTVRSAKQKFIFNKSNGNLSRWLDEKGNEKLLHELSEQFTRAPLDNDIGVSEVEHIDPNAWLERWKAVGFYELKTLLKNMIIQATENEVIISVQTDYEAKGKIAFSTIREYHIFRNGELLLKVDFKRNIEFPEPARIGLSLQLAEKAENVTYFGLGPDENYPDRRGASLFGQWNLRITDMTTPYIFPSENGLRMETRELNYGRLKVRAMGQSFAFNLSPYSQNQLAKKGHWHLLEEEAGTWLNIDGFHMGVGGDDSWSPSVAQEYLLTKGNYHYEVSFKLT

SEQ ID NO: 3247 - protein, 112 aa, Unknown
  Synechococcus sp. WH 5701
MKKVEAIIRPFKLEDVKVALVNAGIVGMTVSEVRGFGRQKGQVERYRGSEFTVEFLQKLKLEVVVDDDRVDTVVTAIQDAARTGEIGDGKIFISSVGTVIRIRTGDRDSTAI

SEQ ID NO: 3248 - protein, 151 aa, Ipomoea nil
MSTVRLPSTCMFRSAPVTQPKSAFVKSPSSITSVKRVSKSFGLKADRYRVTASAVYKGKLVCTKMAEYEFDVPADTYILDSAEAAGVELPYSCRAGACSTCARGKTVTGSVDQSDGSFLDDNQMKRDMSVTCCLYPTSDCVIHTHKESDLY

SEQ ID NO: 3249 - protein, 132 aa, Yersinia pestis
MSEALKILNNIRTLRAQARECTLETLEEMLEKLEVVVNERREEESQSQAEIEERARKLQQYREMLIADGIDPNELLQASAAAKAAGKAKRPAKYQYKDENGELKTWTGQGRTPAVIKKAIEEQGKSLDDFLL

SEQ ID NO: 3250 - protein, 209 aa, Unknown
  uncultured proteobacterium RedeBAC7D11
MFGFKSLEIPIKEDCLPGRTQAIYNPENHFVTGAPMSECMSQDSPRILFGMGCFWGAEKMFWDLDCVKVTGVGYAAGHTPNPTYEEVCSGLTAHSEIVFVTYEDASNLEELLQVFWEGHDPTQFMRQGGDVGTQYRSGIYFFDKAQEELALKTKEIYQAKLDANGFGEIVTEILPVSEEFYAEDYHQQYLAKNPNGYCGHGGCGVRFKD

SEQ ID NO: 3251 - protein, 1106 aa, Pseudomonas putida
MAKRSRPAAFIDDPLWYKDAVIYQLHIKSFFDSNNDGIGDFAGLISKLDYIAELGVNTLWLLPFYPSPRRDDGYDIAEYKAVHPDYGSMADARRFIAEAHKRGLRVITELVINHTSDQHPWFQRARHAKRGSKAREFYVWSDDDQKYDGTRIIFLDTEKSNWTWDPVAGQYFWHRFYSHQPDLNFDNPQVLKAVIGVMRFWLDLGVDGLRLDAIPYLIERDGTNNENLAETHDVLKAIRAEIDANYPDRMLLAEANQWPEDTRPYFGEGDGDECHMAFHFPLMPRMYMALAMEDRFPITDILRQTPEIPANCQWAIFLRNHDELTLEMVTDRERDYLWNYYAEDRRARINLGIRRRLAPLLQRDRRRIELLTSLLLSMPGTPTLYYGDELGMGDNIYLGDRDGVRTPMQWSPDRNGGFSRADPQRLVLPPIMDPLYGYQTVNVEAQSHDPHSLLNWTRRMLAVRKQQKAFGRGSLRTLTPSNRRILAYIREYTDADGNTEVILCVANVSRAAQAAELELSQYADKVPVEMLGGSAFPPIGQLPFLLTLPPYAFYWFLLASRDRMPSWHIQPTEGLPELTTLVLRKRMEELLQAPASDTLQSTILPQYLPKRRWFAGKEGPIDAVRLCYGVRFGTATTPVLLSEIEVLSDGTATRYQLPFGLLREEQIHTALPQQLALSRVRRAHQVGLITDAFVLEPFIHAVMQACQDGLRLPCGDAEGELRFECTEQLAGLALDEESEVRYLSAEQSNSSVVIGDRVVLKLIRRVNPGIHPELEMSAYLTAAGFANISPLLAWVSRVDEQHAPHLLMIAQGYLSNQGDAWGWTQNTLERAIRDQMEPTRNDAEAHTDALAELSGFAALLGQRLGEMHLLLAAPTEDPAFQPRPSDAQDSERWCAQISTELTHALDLLAQHRDTLDSDSQSLVDDLQQQRDGLAQHIDTLSKQAQGGLLMRVHGDLHLGQVLVVQGDAYLIDFEGEPARPLEERRAKHSPYKDVSGVLRSFDYAAAMILRSASAVDLSEPARQARQRVARQYLHQSRHAFVEAYGLATAAMPHAWQHAEGERAALELFCLEKAAYEITYEAENRPSWLAVPLHGLHGLISTWGESE

SEQ ID NO: 3252 - protein, 176 aa, Zea mays
MAAASSATSVHDFTVKDSSGKDVDLSVYRGKVLLIVNVASQCGLTNSNYTQQAQLYEKYKNQGLFLIHCSCFEILAFPCNQFGGQEPGTNEEIAQFACTRFKADYPIFDKVDVNGNNAAPIYKFLKSSKGGLFGDSIKWNFSKFLVDKEGRVVDRYAPTTSPLSIEKDIKKLLGSS

SEQ ID NO: 3253 - protein, 307 aa, Bacillus subtilis
MTVITDITELIGNTPLLRLKNFDVPEGVAVYAKLEMMNPGGSIKDRLGDMLIRDALDSGKVKPGGVIIEATAGNTGIGLALSARKYGLKAIFCVPEHFSREKQQIMQALGASIIHTPRQDGMQGAIQKAIQLETEIENSYCVLQFKNRVNPSTYYKTLGPEMWEALDGNIHTFVAGAGSGGTFAGTASFLKEKNPAVKTVIVEPVGSILNGGEPHAHKTEGIGMEFIPDYMDKSHFDEIYTVTDENAFRLVKEAAEKEGLLIGSSSGAALYAALEEAKKASAGTNIVTVFPDSSDRYISKQIYEGGI

SEQ ID NO: 3254 - protein, 377 aa, Listeria monocytogenes
MAKRDYYEVLGISKSASADEIKKAYRKLSKQYHPDINKEAGADEKFKEISEAYEALSDPQKRAQYDQYGHVDPNQGFGGGGAGGGFGGGGFSGFEDIFDTFFGGGGRQQDPNAPRQGSDLQYTMRLKFKEAIFGKDAEIEIPREENCDTCHGSGAKPGTTPEKCSHCGGKGSINVEQNTPFGRVVNKRTCQYCNGTGKEIKEKCPTCHGKGRVTKTKKIKVKVPAGVNDGQQMRVSGEGEAGINGGPNGDLYVVFVVIPDEFFEREADDIYVEVPITFVQATLGDEIDVPTVHGKVRLKIPSGTQTGTTFRLRGKGVPHLRGNGTGDQHVIVKVIVPKKLDDKQKEILREFASTTGDKVDEQTSGFFDKMKRAFKGD

SEQ ID NO: 3255 - protein, 197 aa, Streptomyces avermitilis
MSRVGRVERTTKETSVLVEIDLDGSGKVDVSTGVGFYDHMLDQLGRHGLFDLTVKTEGDLHIDSHHTIEDTALALGAAFKQALGDKVGIYRFGNCTVPLDESLAQVTVDLSGRPYLVHTEPENMAPMIGEYDTTMTRHILESFVAQAQIALHVHVPYGRNAHHIVECQFKALARALRYASERDPRAAGILPSTKGAL

SEQ ID NO: 3256 - protein, 575 aa, Crocosphaera watsonii
MVATPIKTKKRLSIQTGDIAENTTTIRSLDWDRDRFDIEFGLQNGTTYNSYIIRGEKIALIDTSHVKFRQLYIDTITGLIDPKTIDYLVVSHTEPDHSGLVKDILELAPQATIVGSKVAINFLKNFIHQPFEYIAVKTGDSLDLGKGHVLEFVNAPNLHWPDTILTYDQGTETLYTCDVFGMHYCSDVLYDEHLEDIAPDYHFYYECLMGPNARSVLSALKRMDKLGHFSLVANGHGPLLRYNVHELVERYRTWSEEQSKADKSVAVFYISDYGYSDRLSQAIAKGITKAGVAVEMVDLKSADAQDVHEIVSGSAGLVVGMPPLEGTHSNETTSNIGTILAAAKNKQYIGMFESYGDNDEPIDPLLTRFREAGLNKGFNPIRVKDTPTEAIYQLCEEAGVDLGQALTQAKKVKQRKSLDSDLDKAIGRISGGLYILTANKRELNGAMLASWVTQASFDPPGFTVAVAKDRAIESLMQVGDSFVLNILEEGKYQPLMKHFLKRFRPGSDRFEGVNVQTANNGSPILVDALAYLECEVVSRMECSDHWIVYSKVSNGRVSNPDGLTATHHRKVGNYY

SEQ ID NO: 3257 - protein, 419 aa, Colwellia psychrerythraea
MFTRDMNIATFDPELFEAMSNEVVRQEEHIELIASENYCSPRVLEAQGSQLTNKYAEGYPGKRYYGGCEYVDIAEQLAIDRAKELFGATYANVQPHAGSQANAAVFQALVTPGGKVLGMSLAHGGHLTHGSHVSFSGKSYEAFQYGLHPETGDIDYEELERLAVEHKPEMIIGGFSAFSGVVDWARMRTIADKVGAYFFVDMAHVAGLIAAGLYPNPVPHAHVVTTTTHKTLAGPRGGLIISGCDDEAIYKKLNSAVFPGGQGGPLMHIIAAKAVAFKEALSPEFKVYQQNVLANALAMVDVLQDRGYKVVSNGTQNHLLLLDLIDKDITGKDADAALGKAHITVNKNSVPNDPRSPFVTSGLRLGTPAITRRGFGIEETKALTGWICDILDDIENEDVSKRVQDQVKELCARFPVYQK

SEQ ID NO: 3258 - protein, 270 aa, Magnaporthe grisea
MAMNPHDATQAQAQGQAQDGRPQANYDLSKGGHYGASSQLAQQGYAPSEHYTGPWANVHQGLKGPYKNILTTYWQHTIDHLENDTHDYKLHQLPLARIKKVMKADPEVKMISAEAPILFAKGCDIFITELTMRAWIHAEENKRRTLQRSDIASALSMSDMFDFLIDIVPREEAAGHAKRAAGQAGAANAAAGQPQMGGMPAQNHTQHMGAEYGLPGHPMGGEADYRQAQNMYPGQVPTGAPNAYGQPQQPMYEVDPNMYSSYTMQPPQSA

SEQ ID NO: 3259 - protein, 476 aa, Corynebacterium glutamicum
MEQSFNQVGNSSVDCGCHVVCPHPEALTDQAWRMFGLFIATIVAIILKPMPMGAVTIIGMIAAVLTGLVPLTASSDDPGAVYGLIGFSNGTIWLIVMAFLISRGFIKTGLGRRIALFFVSKVGGKMLGVTYGLALADLVLAPAIPSATARGGGIMAPIMKSVALTYDSTPGPTRRRAGAFLALNVGQVNAITCAMFLTAMAGNPLIASLASQMDVNITWTNWAVGAIVPGLVALIVVPWVVYKIYPPELKDTPEVKKMASDELKQLGGFTYGEKVLAGTFVVLLLLWTGGDLVLGISATTTAFVGVIILLVAHVLTWEDIIQEKTAWDTMVWFAVLYMMATALSQYGFIAWISEVIASSLGGMNWVVALVVLVLIYFFSHYFFASATAHISAMYLAFLGAAIAIGAPPLMAALVLAYTSNLFSSLTQYSGGPSPTLFGLNYITVGEWWRTSAIAGAVSITIWLVIGGLWMNVIGLW

SEQ ID NO: 3260 - protein, 292 aa, Unknown
  Populus tremula x Populus alba
RIAAKLEMMEPCSSVKDRIGYSMITDAEEKGLIKAGESVLIEPTSGNTGIGLAFMAAAKGYRLIITMPASMSLERRMVLLAFGAELVLTDPARGMKGAVQKAEEISAKTPNSYILQQFENPANPKVHYDTTGPEIWKGSGGKVDAFVSGIGTGGTITGAGKYLKEQNPDIKLYGVEPVESAVLSGGKPGPHKIQGIGAGFIPGVLNVDLLDETVQISSEEAIETAKLLALKEGLLVGISSGAAAAAAIKIAKRPENAGKLIVAIFPSFGERYLSSVLFESVKKEAENMVFEP

SEQ ID NO: 3261 - protein, 105 aa, Crocosphaera watsonii
MSNTYTVEIHHQGNTQTIEVPEDQKVLVAAREAGIDLPISCEAGVCTSCAGKLLEGEVEQSDGMGLSPELQGEGYALLCVSYPRSNLVVETEKEEEVYSRQFGQP

SEQ ID NO: 3262 - protein, 955 aa, Magnaporthe grisea
MRLKATSCNRFCISLVWGLALLGRHGSAAQPGRDAQAAAAASAIGSCEARTINYITHTLPQQCLRTSWSSASNDAAAAPAGPIVTSTTGEPTAAPETEGQNNDQKTDSETGGADDGQDQELATSSFMPGTTMTGRASNSSKAEKEVETRERQTWILTHCRRRVSRDNGFGSWIDESEATGKQLEQQKQQQDSKGEDLAIYDGLDYTRSKDAGKTCKERFSYASFDAGATVLKTGPRAKNAKAILVENKDSYMLLECAQPNKFVIIELSDDVLVDTVVIANFEFFSSMIRTFRASVSDRYPVKLEKWKVIGTFEARNQRDIQAFLVEHPQIWAKYIRIEFLNHYGSEFYCPISLVRVHGTRMMDSWKEVEGGRDDDDEAIDQGMPTISQQPSEPQPQPAVEEPSPPEPVPADNATSAPPVVTEMGLTPWEPIFREFSSFEMCEMPEPTATDSGLAGQSSVVSGPETQPMHDGRPHDSVDGNRSTAQKPVSSLTSAIFKETAAPRGNVTMPDPAASVYNIENLVPPPLASTESPSGAKDPASTSSTSTQASSSKHVSNSSKHKTLVSKPSSASAKPAMPKPSSTVPSSARNRTGTNTNSAAAASPTVQESFFKTVAKRLQLLESNTSLSMQYIEDQSRFLQDALARMERKQISRVDTFLDTLNRTVLAELRSVRSQYDQIWQSTVIALESQRDQSQREIVALSDRLSVLAEEVVFQKRMAILQSILLLACLVLIIFSRAFGGAASTVTFSGTPRHSRWAFTMPMSPPPSAGPPTGRRYGPGPPSPSPSPSRLGSIPPRSPPEDDDRLAAIDTRHRYADKTLPLTPTSEYDAGGREVTPVIHVVDETGEPSYFDDTASFSSPQRLGSEASDATPDLGYGSDTHVEPADPVVISSEPADEENVSRAEQAKYPPGGEENDGFEADAADKEVEGSGPPLTRTTLPDFGDSRKPLPALPESP

SEQ ID NO: 3263 - protein, 310 aa, Rickettsia rickettsii
MKITTKVLIIGSGPAGLSAAIYTARAALKPILINGMQPGGQLTITTGVENYPGFAETVQGPWLMEQMYMQAKNVGTEIVSDYVEKVDLSKRPFKVFTGAGNEYDAESIIICTGAEAKWLGIASEQKFRGFGVSACATCDGVFFKNQEIVVVGGGNSAVEEALYLTNHANKVTIVHRRDSFRAEKILQDRLFKNSKISVIWDHVVDEIVGSNKPKSVTGVKIQNVHTKEISLLNCSGVFIAIGHAPNTGLFTGQIAMDDDNYIITKSGTTRTSVEGVFAAGDVQDKIYRQAVTAAGTGCMAALEAEKFLNK

SEQ ID NO: 3264 - protein, 318 aa, Haemophilus influenzae
MSDTKHAKLLILGSGPAGYTAAIYAARANLKPVLVTGLQQGGQLTTTDEIENWPGDFEMTTGSGLMQRMLQHAEKFETEIVFDHINRVDLSSRPFKLFGDVQNFTCDALIIATGASARYIGLPSEENYKGRGVSACATCDGFFYRNKPVGVIGGGNTAVEEALYLANIASTVHLIHRRDSFRAEKILIDRLYKKVEEGKIVLHTDRTLDEVLGDNMGVTGLRLANTKTGEKEELKLDGLFVAIGHSPNTDIFQGQLELNNGYIVVKSGLEGNATATSVEGVFAAGDVMDHNYRQAITSAGTGCMAALDAERYLDSQEA

SEQ ID NO: 3265 - protein, 238 aa, Thermosynechococcus elongatus
  misc_feature (4)..(4): Xaa can be any naturally occurring amino acid
  misc_feature (30)..(30): Xaa can be any naturally occurring amino acid
PEFXVTTEPALADLQEQLYNGNEKSQLAAXSTLSTAGTEGYHLLQEFLKDSATFSPPPAPWIRGQAYRLLFHSPEASVQAFLQQHYPQGVIPLRSDRGVDYQELAKLLVAEKFEAADRLTTQKLCELAGPLAQKRRWLYFTEVEQLPIPDLQTIDQLWLAFSLGRFGYSVQRQLWLGCGQNWDRLWEKIGWRQGKRWPRYPNEFIWDLSAPRGHLPLTNQLRGVQVLNALLNHPAWTA

SEQ ID NO: 3266 - protein, 238 aa, Thermosynechococcus elongatus
PEFMVTTEPALADLQEQLYNGNEKSQLAAMSTLSTAGTEGYHLLQEFLKDSATFSPPPAPWIRGQAYRLLFHSPEASVQAFLQQHYPQGVIPLRSDRGVDYQELAKLFVAEKFEAADRLTTQKLCELAGPLAQKRRWLYFTEVEQLPIPDLQTIDQLWLAFSLGRFGYSVQRQLWLGCGQNWDRLWEKIGWRQGKRWPRYPNEFIWDLSAPRGHLPLTNQLRGVQVLNALLNHPAWTA

SEQ ID NO: 3267 - protein, 457 aa, Gracilaria lemaneiformis
MQIFVKTLTGKTITLEVESSDTIENVKTKIQDKEGIPPDQQRLIFAGKQLEDGRTLSDYNIQKESTLHLVLRLRGGMQIFVKTLTGKTITLEVESSDTIENVKTKIQDKEGIPPDQQRLIFAGKQLEDGRTLSDYNIQKESTLHLVLRLRGGMQIFVKTLTGKTITLEVESSDTIENVKTKIQDKEGIPPDQQRLIFAGKQLEDGRTLSDYNIQKESTLHLVLRLRGGMQIFVKTLTGKTITLEVESSDTIENVKTKIQDKEGIPPDQQRLIFAGKQLEDGRTLSDYNIQKESTLHLVLRLRGGMQIFVKTLTGKTITLEVESSDTIENVKTKIQDKEGIPPDQQRLIFAGKQLEDGRTLSDYNIQKESTLHLVLRLRGGMQIFVKTLTGKTITLEVESSDTIENVKTKIQDKEGIPPDQQRLIFAGKQLEDGRTLSDYNIQKESTPHLVLRLRGGQ

SEQ ID NO: 3268 - protein, 189 aa, Coprinellus disseminatus
TREQHIRREKATSNICTAQALLANMAAMYAVYHGPEGLKRISNRVHGFTQVFKSSVESLGFKATNTTFFDTLTLDTTGAVANSWAVHASANAAGINLRRIDDKHVGVTFDESVTPAELVNLINVFATAANKSPLTLSDLAEPTESAISPHLKRTSKFLPHPVFNKHHSETEMLRYINHLSSKDLSLTHS

SEQ ID NO: 3269 - protein, 491 aa, Bacillus anthracis
MKNQDQALIFEVSKEGRIGYSLPKLDVEEVKLEDVFESDYIRVEDAELPEVSELDIMRHYTALSNRNHGVDSGFYPLGSCTMKYNPKINESVARFAGFANIHPLQDEKTVQGAMELMYDLQEHLIEITGMDTVTLQPAAGAHGEWTGLMLIRAYHEANGDFNRTKVIVPDSAHGTNPASATVAGFETITVKSNEHGLVDLEDLKRVVNEETAALMLTNPNTLGLFEENILEMAEIVHNAGGKLYYDGANLNAVLSQARPGDMGFDVVHLNLHKTFTGPHGGGGPGSGPVGVKADLIPYLPKPILEKTENGYHFNYDRPEAIGRVKPFYGNFGINVRAYTYIRSMGPDGLRAVTEYAVLNANYMMRRLAPFYDLPFDRHCKHEFVLSGRRQKKLGVRTLDIAKRLLDFGYHPPTIYFPLNVEECIMIEPTETESKETLDGFIDKMIQIAKEVEENPEVVQEAPHTTVIKRLDETMAARKPVLRYAKPAPVQV

SEQ ID NO: 3270 - protein, 572 aa, Glycine max
ENDPKIDYRGWKAMPFIIGNETFEKLGAIGTLANLLVYLTTVFNLKNITATNIINIFNGSTNFATFIGAFLSDTYFGRYKTIGFCTFTSFLGLLVIQLTAVFKNLHPPHCGKEMKTCKGPTAGQMAFLVSGFGLLLIGAAGVRPCNLAFGADQFNPNTDSGKKGINSFFNWYFFTFTFAQMVSLTLIVYVQSNVSWAIGLGIPAALMLISCVVYFMGSKIYVKVEPSGSPIAGIVQVFVVAVKKRSIKLPAEHPMLSLFNYVPPMSVNSKLPYTFQFRLLDKAAIVTPKDKIKPDGSAADPWNLCSIQQVEEAKCVVRVLPIWFAAIVYHLVIVQMHTLLVFQALQSDRRLGSSNFKIPGASFNVFLMLSMTLWLPIYDRIVVPFSLSNTPEKSGGITLLQSDGIGIFISALCMIVAGVVEEHRRSLALTNPIGVQPRKGAISSMSGLWLIPQLSLAGLSESFTAVGQVEFYYKQFPENMRSIAGSLFYCGMAGSSYLSTLLISIVHNTSEKSATGNWLPEDLNKGRLDFFYYMIAALEIMNLGYFLLCSKWYKYKEIGSSDLELNQVPKHI

SEQ ID NO: 3271 - protein, 215 aa, Oryza sativa
MQTAASSVVGLSAVLPAAVKGRSLQIQAPRRVALRVRAAAAAVAVEAAEVDYSSNISVFPMEACDLIGGEACNVQMYPEAKLSSSAAVAVSRAAAEEVDRDYLSYDELREVQSEIAFYLQLFPLVSYVDATLNWVRHLNKADPSCKEAPLVRPYFVPFVILSWDGSCLAVVQKVHLGIVYTWLYISYLNIYSTICRSFMCLQELNCCLADIYFLR

SEQ ID NO: 3272 - protein, 447 aa, Bacillus anthracis
MLHRYLPMTEEDKKEMLQTIGVQTIDELFSDIPESVRFKGDLKIKEAKSEPELLKELSQMASKNANLKEYASFLGAGVYDHYAPVIVDHVISRSEFYTAYTPYQPEISQGELQAIFEFQTMICELTGMDVANSSMYDGGTALAEAAMLAAGHTRKKKILVSSAVHPESRAVLETYAKGQHLEVVEINHKDGVTDLDVLQSEVDDTVACVIVQYPNFFGQVEKLADIEKIVHQQKSLFIVSSNPLSLGALTPPGKFGADIVIGDAQPFGIPTQFGGPHCGYFATTKAFMRKIPGRLVGQTVDSDGKRGFVLTLQAREQHIRRDKATSNICSNQALNALAASVAMTALGKQGVKEMARQNISKAQYAKRQFEAKGFTVTFAGPFFNEFVVDCKRPVKEVNDALLQKNIIGGYDLGRDYKEHENHMLVAVTELRTKEEIDTLVNEMGAIQ

SEQ ID NO: 3273 - protein, 128 aa, Glycine max
MANFVLQFPNTLRSFAVSASSNSNGAPPGGSGSSSGGGGGPVILELPLDKIRRPLMRTRANDQNKVLELMDSIKEIGLQVPIDVLEVDGVYYGFSGCHRYEAHQRLGLPTIRCKIRRGTKETLRHHLR

SEQ ID NO: 3274 - protein, 408 aa, Treponema denticola
MEAKKLTERVYCIHADIHDRTARFEGIWLLPHGVSINSYVVKGEKTALIDIVKDWDGSVDSYRKQLESIGLSFSSFDYVILNHLEPDHADLINLVKEENPRAEILASSKGVALIKNFFKINEGVRAVKDGEVLDLGGGKKLVFYETPNIHWPETMMTYDPDDKILFSCDAFGSYGCIGEKIFDDQHTEDELKFFENEALRYYANIVASFSSFVNKGIEKLAALELKFICPSHGLLWRGNPSRIVNLYKKFADYNTGTGSGLEKTICIIWGSMYGYTKAGLDAVIEGIDEEGVPYSIYRIPDTDATFILGEAYRSAGLLLAMPTYEYKMFPPMAHILDLFERKHFVNKKVFRIGSWGWVGGAKKEYEEKIEKFKWTNIESHEWQGKLSDEDKRILKERGRELARAVKNG

SEQ ID NO: 3275 - protein, 434 aa, Rhodopirellula baltica [sequence omitted]

SEQ ID NO: 3276 - protein, 918 aa, Arabidopsis thaliana
  misc_feature (13)..(13): Xaa can be any naturally occurring amino acid
MAASVDNRQYARXLEPGLNGVVRSYKPPVPGRSDSPKAHQNQTTNQTVFLKPAKVHDDDEDVSSEDENETHNSNAVYYKEMIRKSNAELEPSVLDPRDEYTADSWIERNPSMVRLTGKHPFNSEAPLNRLMHHGFITPVPLHYVRNHGHVPKAQWAEWTVEVTGFVKRPMKFTMDQLVSEFAYREFAATLVCAGNRRKEQNMVKKSKGFNWGSAGVSTSVWRGVPLCDVLRRCGIFSRKGGALNVCFEGSEDLPGGAGTAGSKYGTSIKKEYAMDPSRDIILAYMQNGEYLTPDHGFPVRIIIPGFIGGRMVKWLKRIIVTTKESDNFYHFKDNRVLPSLVDAELADEEGWWYKPEYIINELNINSVITTPCHEEILPINAFTTQRPYTLKGYAYSGGGKKVTRVEVTVDGGETWNVCALDHQEKPNKYGKFWCWCFWSLEVEVLDLLSAKEIAVRAWDETLNTQPEKMIWNLMGMMNNCWFRVKTNVCKPHKGEIGIVFEHPTLPGNESGGWMAKERHLEKSADAPPSLKKSVSTPFMNTTAKMYSMSEVKKHNSADSCWIIVHGHIYDCTRFLMDHPGGSDSILINAGTDCTEEFEAIHSDKAKKMLEDYRIGELITTGYSSDSSSPNNSVHGSSAVFSLLAPIGEATPVRNLALVNPRAKVPVQLVEKTSISHDVRKFRFALPVEDMVLGLPVGKHIFLCATINDKLCLRAYTPSSTVDVVGYFELVVKIYFGGVHPRFPNGGLMSQYLDSLPIGSTLEIKGPLGHVEYLGKGSFTVHGKPKFADKLAMLAGGTGITPVYQIIQAILKDPEDETEMYVIYANRTEEDILLREELDGWAEQYPDRLKVWYVVESAKEGWAYSTGFISEAIMREHIPDGLDGSALAMACGPPPMIQFAVQPNLEKMQYNIKEDFLIF

SEQ ID NO: 3277 - protein, 72 aa, Streptococcus pneumoniae
MAKDDVIEVEGKVVDTMPNAMFTVELENGHQILATVSGKIRKNYIRILAGDRVTVEMSPYDLTRGRITYRFK

SEQ ID NO: 3278 - protein, 289 aa, Francisella tularensis
MIANINNKKIFHETLYHSYHQSIAISEILYEHKTDYQHLVIFNNPIFGNVMVLDGIVQTTEKDEFIYHEMLVHVPVIAHGNVKNILIIGGGDGGMLREALSHKAVESVTLVEIDQAVIDMCQEYFPGHSKGAFDHPKAKIVIQDGCEFVKNPPRKYDLIICDSTDPIGPGEVLFTSKFYKDCKEAINPGGIMVTQNGVIYFQIDELKKTLERFEPLYKDVSFYTAAVPTYVGGSMAFGWGTDELSYRNHDIQVIAQRFLKSGIKTKYYNPAIHIAAFALPQYVIDTLKK

SEQ ID NO: 3279 - protein, 72 aa, Desulfovibrio desulfuricans
MAKEEAITVTGVVQEALPNAMFRVELENGHEVLAHISGKMRKFHIRVLPGDKVSVELSPYDLTRGRITFRPR

SEQ ID NO: 3280 - protein, 233 aa, Clostridium perfringens
MSVISMKQLLEAGVHFGHQTRRWNPKMAPYIFTERNGIYIIDLQKTVKKAEEAYNFIREVSEAGKDVIFVGTKKQAQEAVKEEAERSNMYFVNHRWLGGMLTNFTTIKTRINRLNKLDEMEQDGTFDVLPKKEVIKLKLEREKLQRNLGGIKELDASNIGAMFVVDPRKEKNAIAEAKILGIPVVAIVDTNCDPEEVDYVIPGNDDAIRAVKLIAGKMADAIIEGRQGEQLAE

SEQ ID NO: 3281 - protein, 491 aa, Bacillus cereus
MLNMNSATNQATSKTETTQGKGELRRGLKSRHLTMISLGGTIGTGLFLASGGVIHSAGPGGALIAYAAIGIMVYFLMTSLAELAAYMPVTGSFSTYATKFVDPSLGFALGWNYWYNWAITIAAELAAVTLIMKFWFPDTPSLIWSGLCLAIIFLLNYLSVKGFGESEYWFALIKVVTIIIFLIVGFMMIFGIMGGETVGFKNFTVADAPFNGGIMAIIGVFMAAGFSFQGTELLGVAAGETSDPERNIPKAIRSIFWRILLFYILAILVIGLLIPYTTESLAASDVTVSPFTLIFEKAGVAFAASVMNAVILTAVLSAGNSGMYASTRMLWDLARQGKAPKFLGKLDSRGVPVNALIVTSIVGSIAFIASLFGDGVVYIWLLNASGMSGFIAWVGIAISHYRFRKAYIAQGKDLNDLPYRAKWFPFGPIFAFTLCIIVILGQNYGAFMGESIDWNGVLVSYIGLPLFLVLWLGYKFTKKTKVIPLDKCELK

SEQ ID NO: 3282 - protein, 286 aa, Francisella tularensis
MANIKVAVVQLSFNDNEAENLAKLESKIIQAAKNGAKIILTPELPSYLYFCKKQNSKYFDLAKTIDESPIVKLYKLLAHKYNIVLPASFFERDGNACYNSIAMIDADGSIMGVYRKAHIPDGIGYQEKYYFSPGSAGFKVWDTKYAKVGVGICWDQWFPEAARVMALKGAEILLYPTAIGSEPHLPDYDSKDHWQRVMQGHAAANMLPVLASNRYATEANDDITATYYGSSFITDHTGDKIAEADRSGDDILYATFDFAELQQQRFYWGLFRDRRPELYDEIVRKY

SEQ ID NO: 3283 - protein, 323 aa, Saccharum officinarum
MAPALSFPIIDMGLLGGEERPAAMELLRDACESWGFFEILNHGISTELMDEVEKLTKDHYKRVREQRFLEFASKTLKDAQDVKAAENLDWESTFFVRHLPESNIAEIPDLDDDYRRAMRQFAGELEALAERLLDLLCENLGLDRGYLARAFRGPRTGAPTFGTKVSSYPPCPRPDLVSGLRAHTDAGGIILLFQDDRVGGLQLLKDGAWVDVPPLRHSIVVNLGDQLEVITNGRYKSVMHRVVAQPDGNRMSIASFYNPGSDAVIFPAPALVKAEEAAAGAYPRFVFEDYMKLYVRHKFEAKEPRFEAFKSVETDSSNCIAIA

SEQ ID NO: 3284 - protein, 89 aa, Zea mays
  misc_feature (24)..(24): Xaa can be any naturally occurring amino acid
YFDLSLFRYDEKLISAIDRHSATXAPPPKFISVRQNVVKFKIKPGSDSGASDSRIKRISSFLFHPFFPLALSIQQTYMQPTVLNIHFRR

SEQ ID NO: 3285 - protein, 169 aa, Streptococcus pyogenes
MERAIFAGGCFWCMVQPFEEQAGILSVRSGYTGGHLPNPSYEQVCAKTTGHTEAVEIIFDPKQIAYKDLVELYWTQTDPTDAFGQFEDRGDNYRPVIYYTTERQKEIAEQSKANLQASGRFDQPIVTTIEPAEPFYLAEDYHQGFYKKNPKRYAQSSAIRHQFLEENWS

SEQ ID NO: 3286 - protein, 377 aa, Meiothermus ruber
MHGRLPLTAQTHRRLVVKVGSAVLSGPQGRQHQLAIAAQVAALRAEGREVVLVSSGAQATGMQKLGLTEKPKSMPGKQALAAVGQPTLMLLWEQAFSWYDLKVAQVLLTAEDLAHRHRYLNARQTLETLLEWGIVPIINENDTVMVEEIKFGDNDQLSALIASLVGADLLILLSDIEALYEADPRTHPEAQPIPYVERVDAGVLRMAGDSPNRVGTGGMKSKLLAAEKAQAAGIPHLLLPGTRPQSIAEALQGAPVGTLFAGGQRRYSGRKLWLYQLPKPQGEVVVDAGAAKALRQGGASLLPAGILEVRGQFGVGEAVRCLDEQGNLIGVGLVNYSAAELARIKRRKTREIEALLGYKNTDEAIHRDYFALASELE

SEQ ID NO: 3287 - protein, 606 aa, Lupinus albus
MITLIDFYHVMTAMVPLYVAMILAYGSVKWWKIFSPDQCSGINRFVALFAVPLLSFHFIASNNPYKMNLRFLAADTLQKIIVLVVLAIWSNVTKRGCLEWTITLFSLSTLPNTLVMGIPLLKGMYGEFSGSLMVQIVVLQCIIWYTLMLFMFEYRGARMLISEQFPDTAGTIVSIHVDSDVMSLDGRQVLETEAEIKEDGKLHVTVRKSNASRSDIFSRRSQGLSSTTPRPSNLTNAEIYSLQSSRNPTPRGSSFNHTDCYSMMAGGRNSNFGTNDVYGLSASRGPTPRDSSFDEEGGAGNNTNNNNNKTRYHYPSGTGHYPAPNPGMFSPTTASKNLPPNANVNAKRPNGQNKPEDGNKDLHMFVWSSSASPVSDVFGAHEYAVHDQKDVKLNVSPGKVEGHRNSTQEEYLEKDDFSFGNRGIDHESVEVGNNKPKTMPPASVMTRLILIMVWRKLIRNPNTYSSLIGLIWSLVSFRWNVEMPAIIAKSISILSDAGLGMAMFSLGLFMALQPKIIACGNSKAAFSMAVRFLTGPAVMAAASITVGLRGTLLHVAIVQAALPQGIVPFVFAKEYNVHPDILSTGVIFGMLIALPITLVYYILLGL

SEQ ID NO: 3288 - protein, 261 aa, Lactobacillus johnsonii
MTVVTMKQLLEAGVHFGHQTRRWDPKMAPYIFTQRNGIYIIDLQKTIKMLDDAYNYVKAVAQDGGVFLFVGTKKQAQDAVKEEATRAGQYYVNQRWLGGTLTNWTTIQSRVKRLKELKQMSEDGTFDVLPKKEVALLTKEMEKLERFLGGIEDMPRIPDVMFVVDPKKEKIAVHEANILGIPVVAMVDTNTDPDPIDVVIPANDDAIRAIRLISGAMADAIIEGKQGQDDSEDVEKEMADKAAAEDDEEESIEVVVEKSED

SEQ ID NO: 3289 - protein, 206 aa, Arabidopsis thaliana
MPRSSRWVNQRATSKIKKFILFLGVAFVFYLYRYPSSPSTVEQSSTSIYNISVKDIEGKDVSLSKFTGKVLLIVNVASKCGLTHGNYKEMNILYAKYKTQGFEILAFPCNQFGSQEPGSNMEIKETVCNIFKAEFPIFDKIEVNGKNTCPLYNFLKEQKGGLFGDAIKWNFAKFLVDRQGNVVDRYAPTTSPLEIEKDIVKLLASA

SEQ ID NO: 3290 - protein, 163 aa, Triticum aestivum
NKFVQKSRLAPVRNSRDIVDPRVRTATARTPTPDCCSGFRQVLGTSKRCMCILVKDRDEPALGIKVNITRAMNLPSVCNIAATFSDCPKIINMSPDSKEAEIFKQYAREHEGKNAATTSPAAAAAATGTTSRKSADATSGAGRRTVVFAVVFSALLASVLVLA

SEQ ID NO: 3291 - protein, 315 aa, Roseovarius nubinhibens
MADTQFGPHGWTPERLGSLAGRCYVITGANAGTGYEAARLFLSKGASVVMLNRSAEKSAAAIATLKAEHGAEADVRFIEMDLADLTSVRRAAEEIRETVPRIDALICNAAIAQVPKQRLTVDGFESQLGTNHYGHFALCGLLFERIEESEGRIVVVASLGYNMGIKTIQFDDLNWDNNYSANAVYSQSKLAQMMFAYELQDRIRAAGKSVEVLVCHPGSSKTSLIKTSGSPVMRAIWWLMTKSPMVQTAQQGAYPEVMCATEEGLEERALYGPTGRMEFVGPVGRGTLHPHAYDKPVMTRLWEVSEAATGVVWPL

SEQ ID NO: 3292 - protein, 205 aa, Xanthomonas oryzae
MNQTLYDIPVTRIEGGPATLADYRGKVLLVVNVASKCGLTPQYEGLEALYRDKRAQGLEVLAFPANDFNGQEPGSEAEIAQFCRLTYDVTFPMFAKIAVTGEQAHPLYQALTSTHPHTTGDGPMREKLAGYGIAPNPRARRVVELRKIPDRPRRQDHRPLRPGYPRRRCTPASGNRHGVGGLNLAILLGVSSACIAGEIALRCLS

SEQ ID NO: 3293 - protein, 394 aa, Arabidopsis thaliana
MKRYIGVGEEEEVQLFYYFIKSERNPQEDPLLLWLSGGPGCSSISGLLYENGPVNVKIEVYNGTLPSLVSTTYSWTKVSSIIYLDQPVGTGFSYSRTKLVNKPSDSGEAKRIHEFLHKWLGKHQEFSSNPFYVGGDSYCGMVIPALVQEISKGNYVCCKPPINLQGYILGNPSTENEVDINYRIPYAHGMALISDELYESMKRICKGKYENVDPRNTKCLKLVGEYQKCTKRINKALIITPECVDTSPDCYMYRYLLTTYWANDENVQRALHVNKGSIGEWVRCYFEIPYNHDIKSSVPYHMNNSIDGYASLIFSGDHDMEVPYLGTQAWIRSLNYSLIDDWRPWMIGDQIAGYTRTYANKMAFATIKGGGHTPEYKPEESYIMFQRWISGQPL

SEQ ID NO: 3294 - protein, 99 aa, Glycine max
  misc_feature (51)..(51): Xaa can be any naturally occurring amino acid
ASSMISSPAVTTVNLAGAGMVAPFTGLKSLAGLPTKKTYYDITSLAYTGGXLHCMHVWPPVGRKKFDTLFYLPDLDYAQLAYVLKYLLANGWIPCYEFE

SEQ ID NO: 3295 - protein, 402 aa, Arabidopsis thaliana
MFPMSSTSRSSAANNRKDPPRKKNKQTPSPVTREPTSIDSLPNDLLLNCFARVSRMYYPALSRVSKRFRSIVTSPEIYNTRSLLNRTEKCLYLCLRFPFDNNTHWFTLYQNPNQTVSDKVFLQIPSPQHPLTLSSNLVAVGSNIYRIGGTVGDDSCPLGFDREPSSKVSILDCRSHTWRDGPRMRLNRRSSTTSVVDGKIYVTGGTEDTDNPSHWIEVFDPKIQSWGTVTNPHIVKVWEEVCYRRAVKSIGHDGKLYLSGDKYVVYDPDEGKWNSVEEHWLIGYAIGSSNCVVDNILFYWDQGVFKWYDSKVSSWKQLKGLEGLPDDFSQREYCKLVDLGGKMAVLWDKWEYSGVCMIFCAEISLEKRDGDEIWGKVEWFDTVLEVGASCSLKSADALSASV

SEQ ID NO: 3296 - protein, 423 aa, Unknown
  Rhodococcus sp. RHA1
MTTTTDVISIDAGPLDDALAQLTGAVEKLGYGPGMHQLLAKPRREMSVSIPLRRDNGDVEVLSGYRVQHNFSRGPAKGGLRFSPHVSLDEVRALAMWMTWKCALLDVPYGGAKGGITIDPTQYSMGELSRVTRRYTSEILPIIGPEKDIPAPDIGTDEQTMAWMMDTFSANVGYTVPSVVTGKPVSLGGSLGRSSATSKGVVHVALAALEYRGLTPSFATAAVQGFGKVGAGSAQFLAEAGVKVVAVGDQYGSIHNGNGLDIPALQAHVAATGTVRGFADSEPIDAAALLELEVDLLVPAAVEGVINSDNASNIRASIVVEGANGPTTAAADKILAARNVLVVPDILANAGGVIVSYFEWVQGNQAYWWTANEVDERLETRMIQGWRCVLETSIRRGLSLREAATVTAVERVADAHLTRGLYP

SEQ ID NO: 3297 - protein, 334 aa, Oryza sativa
MASQGVASMFALALLLGAFASIPQKAEAIGVCYGMSANNLPPASSVVGMYRSNGITSMRLYAPDQAALQSVGGTGISVVVGAPNDVLSNLAASPAAAASWVRNNIQAYPSVSFRYVAVGNEVAGGATSSLVPAMENVRGALVSAGLGHIKVTTSVSQALLAVYSPPSAAEFTGESQAFMAPVLSFLARTGAPLLANIYPYFSYTYSQGSVDVSYALFTAAGTVVQDGAYGYQNLFDTTVDAFYAAMAKHGGSGVSLVVSETGWPSAGGMSASPANARIYNQNLINHVGRGTPRHPGAIETYVFSMFNENQKDAGVEQNWGLFYPNMQHVYPISF

SEQ ID NO: 3298 - protein, 304 aa, Unknown
  Burkholderia sp. 383
MPSKHITVAAVQMASGNWNLEDNMATAERLIRAAAAQGANLVLCPELFAMPYFCLDQNVRHLELAQPFEGNAQIARFAALAGELGIVLPIGFFERAGNAAYNSIAVADADGRVLGVYRKTHIPDGPGYTEKFYFTPGDTGFKVWDTRFGRIGIGICWDQWYPETARSLALMGAEILCFPTIIGSEPFSSAFDSSGHWQRTMQGHAAANMVPVVAANRIGREVGFGNGNPEQQGLTGVFYGSSFIADHTGEKRAEANRTDEAVLVHTFDLDAIRADRQSWGFFRDRRPEMYRTLLTSDGVSSCYR

SEQ ID NO: 3299 - protein, 109 aa, Triticum aestivum
MGKEKMSAAAGGLRQLLTAAVTAGAAEARAAIFGHAVNPLGKRAATKLLRKKLIGEHVAQWYPDDIKRDDPEVMAREEKERLAKLEMLKRRGKGPPKKGQGRRAIKRNK

SEQ ID NO: 3300 - protein, 873 aa, Rhodopseudomonas palustris
MSGLWQSMTTAWMSRTDRSALLDFWLGGRGAGTLIANTDIDEQEMRRIRAAQINSVTRLTPVTMSINVANAALILFTFWDNDARPQLLAWTAMIVFAAGSAVQSWLRNRFEPRLEASAHAIRRMTLHALLLGLIWGAMPVMVFVKADPGDQLIVACVAAGMISGGAFTLSTVPRAGLAYTWSLAAGSALSLALCDGMAYRITAAFLVLYAVFMSRNLISHGEMFFDNLRAKFELERQTEIISLLLKDFQANASDWLWQTDAHGRLVHVPERFVEVAKLPPSLLIGAPLADVIGMLCPEDGRCAMGVAAKMAQREPMNDLVVHVVIGGTPRLWSLTAKPMFDAAGEFAGYRGVGRDVTERWRAEQAEAENRAKSSFLAMMSHEIRTPMNGVLGLANSLLETKLDPEQQQAVTTIRDSGDDLLRILNDILDLSKLEAGRLEFEQADFSPTTLVESVRAIIEPEVRGKGIELKVDIDPRLPPSLNGDAARIRQVLLNLAANAVKFTEQGSIAIVLTCVKRNDSHATVEWQVTDTGIGISPDRVGSLFTDFAQADVSINRRFGGTGLGLAISRRIVEQMGGDIAVTSREGEGSTFRFSLDLPWSNAWIADHRLDRLGSDDLRTRIAMLGRPLRVLIAEDDSTNQMVVMKMLQEFAAEITVVSDGTDAVQAAGEGEFDVVLMDVRMPNMDGLAATRAIRGKGGALAKLPIIALTANAFPDDVKVCRDAGMNDFLAKPLRKPALVAAVLRALRGASTPVTMPSPPMLVDLDTLAELTAEIGQDQVNEMVALFFAETERRIALFRRFAEHMDRHDLEVEAHSLKGGARTLGFHPIAEIARSIEREAGSISPEALDLFTGQLNKALIELRRQCEGSLKLAS

SEQ ID NO: 3301 - protein, 478 aa, Ustilago maydis
MPPKADWEKYKKPDVDSKDEDKIVALDEGDIQLLKTYGQGPYAASLKGIENEIKELQKRVNEKMGVKESDTGLAPPNLWDLPADRQRMGEEEPLQVARCTKIIRAESKKEGEASEGGASGSAGSRSGGGLGGLGGLGGLGGFGGSSHPTADEEDKYVINVKQIAKFVVSLGERVAPTDIEEGMRVGVDRNKYQIQIPLPPKIDPSVTMMQVEEKPDVTYGDVGGCKEQIEKLREVVELPLLSPERFVNLGIDPPKGVLLYGPPGTGKTLCARAVANRTDATFIRVIGSELVQKYVGEGARMVRELFEMARTKKACIIFFDEVDAIGGARFDDGAGGDNEVQRTMLELINQLDGFDARGNIKVLMATNRPDTLDPALLRPGRLDRRVEFGLPDNDGRANILRIHARSMSVEKDIRYHLIARLCPNATGAELRSVATEAGMFAIRARRKMATERDFLDAVDKVIRQGSKFSSTALYAQYN

SEQ ID NO: 3302 - protein, 744 aa, Unknown
  Mesorhizobium sp. BNC1
MGLANIKQIWKWLWDEIAQPGRGFSSRGGTILVAFGFADLLIAGAAFLTKAAPLIPFLLVFAGAAAVAAAIALPSEKKPEEHPHEQTPAEQHIEELADRVSQMQEAEQRFYGLLETLGDLVINRDGEGRILYANRIFGELMECEPQDLFGKTLHQLGVDITPPSAGIFPEEERLSSTDVAIHTRNGLRWFSWTEISRREGESSSVSHWAIARDITARKRAETALVNARERAEQASIAKSRFLATVSHEIRTPMNGIIGMATLLSDTRLSSEQRTYVAAISTSASALLALIEDLLDYSKIEAGRLELEPQRMAARELIESVIELMAVRAFTKKIGLGCHIAPTVPDTILADPGRLRQILLNLLGNAIKFTDEGGVLMTVTTTIHDGAPKLAFRVDDTGPGIEKDSLSRIFQEFEQADTSSTRKHGGAGLGLAITRRLIDAMEGTVTVDSAPGEGATFTVYIPLVGAEGSAAETSLALKGFDVAILTPHAVEGEALAMTVRAHGGKARVFEGEKSALSLLRRRKSGFDAVIIDASLENDNGDLLRRLCRNGLRVHQALTLIAPTDRGRLNKFRTNGYNAFIARPARDRTLLRLLLNPQTAENVAPIGEATARTKATNDGRGLKVLLAEDNEINAMLARATLSKAGHSVAVVSNGRAAVDVLTHPARDFDIVLMDLHMPIMDGLDAIIQIRRYEEDTGLAPIPILVLSADGQEKTRQNALAQGATGFITKPLEPGRLLSALEVHTPA

SEQ ID NO: 3303 - protein, 374 aa, Methylococcus capsulatus
MTDIFDPSDEFGPARIIQVREPSVGLRATVIIDNVALGPAIGGLRIASAGSTADGCRLARTMTLKSAAADLPHGGGVAMLHPAPGSPENACRQHRVRALACALRSEDQFIFAPDMGSGETTMAWIRDENGRAVGLPRELGGIALSRIGAAGWGLYHATEVALRYCGFKLEDARVVIQGFGTVGQNTARYLVENGAVVVGIADSGGTLYHPRGLDIAELVAIKAKGGSVVDSSEGERLAPDAAVDLDCDIWIPAAGSDVITPDNAARLKARLVVEAADASLAPAAERYLHEKGIICVPDFIANAGGLIGAAMECRGANKTQVLSAIKEKIRRNTEKVLQSVETDGTLPREAAVRLAMKPIVKAMSYRRWSGLSAD

SEQ ID NO: 3304 - protein, 148 aa, Triticum aestivum
IRVKDKDASLSFYQDVMGMKLKRTSESPNAGFNLYFLGYGVDAPETTANGVNPVSDSEGLLELTWNYGTEKDAEFKYHNGNDEPQGFGHICIAVDDLDAACARFEEKKVNWKKRLTDGRMKNIAFVLDPDNYWIEVVQNEKLKTRSNW

SEQ ID NO: 3305 - protein, 596 aa, Corynebacterium glutamicum
MPEQDLTTLANDWLQAFEKATASSSPDEAATAVVQLFEDEGYWRDLLAFTWNLTTAEGADEIAEMIRNTWPSSIFRNVELKGEPADEGDGVTRVHFSCESADFKCTGIVRLRNGKAWTLLTSARELLEHPEPKGRNREMGVVHGQNEDTRNWTDRKNDRQAALGVTEQPYTLIIGGGQGGIALGARLKRLGVPALIIDKASRPGDQWRSRYHSLCLHDPVWYDHLPYIPFPDHWPVFTPKDKMGDWLEHYVGIMDLDYWTNTECLRASYNEDTKQWDVTVNRDGAESTLHPTQLVMATGMSGSPNKPTLPGQDKFQGEIRHSSEHPGGDVDRDKNVVVLGANNSAHDICADLYSNGAKPVMIQRSSTHIVRSDSLMREVFGPLYSEDAVEAGIDTDTADLLFASWPYKVLPGVQKQAFDKIREDDKEFYDKLENAGFLLDFGDDDSGLFLKYLRRGSGYYIDVGASELVADGKIPVRSNVSIEDVKENSVVLTDGTELPADVIVLATGYGNMNNWVAQLVDQETADKVGPCWGLGSETTKDPGPWEGELRNMWKPTNVDSLWFHGGNLHQSRHYSRYLSMQLKARYEGMNTPVYSK

SEQ ID NO: 3306 - protein, 608 aa, Mycobacterium avium
MKESFGCDGQPGSYTDVDHADVIALFGHNVAETQTVLWARMLDRLAGSDPPAIVCVDPRLTPVARHATVHLAPLPGTNVALMNGLLHEIIGNGWIDRDYIDAHTVGIDELQCRIGEFTPERVAEICGVAATDLRRAARLIGTARRLLSTVLQGFYQSHQASAAAVQVNNIHLVRGMLGRPGCGVLQMNGQPTAENTRECGADGDLAGFRNWSNDSHVAELAELWNLEPLQIPHYGPPTHAMQMFRFTEEGTLRMLWVTATNPAVSLPELPRIRDILSQQRLFLVVQDIFLTETAALADVVLPAAAWAEKTGTFTNADRTVHLSEKAVEPPGSARSDLEIFLDYARRMDFRDKDGRPFPPWTDPESAFEAWKKCSAGRPCDYTGLSYAKLRGGSGIQWPCNTDHPDGTERLYEDGRFPAAPDYCEAYGKDLITGAPLQPDEYRSLNPSGKAIIKAAQYLPPHERPGPDYPFALITGRTVYHFHTRTKTARAQQLQDAAPEVWVEVSERDARRLDIEAGDLVHVSTPRGRITCAARVGGIRDGVLFVPFHYGYWDRDGGDHQRAGNELTATDWDPASKQPSFKTAAARLDKAPSHRAAPVSEAVAAGSPS

SEQ ID NO: 3307 - protein, 549 aa, Mannheimia succiniciproducens
MSESFAQLFEESLKELETRQGSIVSGTVVAIQKGFVLVDAGLKSESAIPVEEFQNAQGELEVQVGDVVNVALDAVEDGFGETKLSREKAVRHESWIELEKAYEEQATVTGLINGKVKGGFTVELNGVRAFLPGSLVDTRPVRDTLHLEGKELEFKVIKLDQKRNNVVVSRRAVIESENSQDREEILANLAEGAEVKGTVKNLTDYGAFVDLGGVDGLLHITDMAWKRVKHPSEIVNVGDEITVKVLKFDKDRTRVSLGLKQLGQDPWAAIAQNHPVGSKLTGKVTNLTDYGCFVEILDGVEGLVHVSEMDWTNKNIHPSKVVSLGDTVEVMVLEIDEERRRISLGLKQCKANPWLQFAETHNKGDKVEGKIKSITDFGIFIGLEGGIDGLVHLSDISWNVAGEEAVRNYKKGDEVAAVVLQVDSAKERISLGIKQLEEDPFNNFVAVNKKGAVVSATVVEADSKGAKVELNGGVEGYIRAADLTDEVNAGDVVEAKYTGVDRKARIVHLSVRAKDQAEEAAAVASVNNKQEDVAIPNAMAEAFKAAKGE

SEQ ID NO: 3308 - protein, 428 aa, Treponema pallidum
MVEVYARLRAAVARLAVCSAAEKDGALRAVRDALHAQREDILRANAQDLARAREAGLAAPLVARLALSEHLLEDMLRSLTVLSLQRDPIGEIIEGYTLANGLEIRKVRVPLGVVAVIYESRPNVTVDAFALAYKSGNAVLLRAGSAASYSNAALLRAIHVGLKKAHGVVDAVAVPPVLEEKYGDVDHILRARGFIDAVFPRGGAALIRRVVEGAHVPVIETGCGVCHLYVDESANIDVALQIAENAKLQKPAACNSVETLLVHRAVARPFLHRVQEIFATCEETTRKPGGVDFFCDAESFSLLTERGARKNVFHAQAETWDREYLDYQVSVRVVPNLEEALRHIARHSTKHSEVIVTRDRARARRFHQEVDAACVYVNASSRFTDGGQFGMGAEIGVSTQKLHARGPMGLCALTTSKYLIDGEGQVRP

SEQ ID NO: 3309 - protein, 116 aa, Avena fatua
SQVYQKYKDQGLEILAFPCNQFGGQEPGTNEEIVEFACTRFKAEYPIFDKVDVNGKEVSPLYKFLKSSKGGLFGDSIKWNFSKFLVDKEGRVVDRYAPTTSPLSIEKDIKKLLGTS

SEQ ID NO: 3310 - protein, 282 aa, Glycine max
  misc_feature (151)..(151): Xaa can be any naturally occurring amino acid
MILIYYLSEHPAIVGFRWSHAQSWGATWSFLFTSIASYLFLSILLHLSLSLLFRRRQIPLGPFPAVHSLSMSLVSATIFAGILLSSAAEIRDTRWFWPRSKTPLQWLLCFPLGTRPSGRVFFWSYVYYLSHFLHMFRTLLTIVRHRRLSFXHLLSHSISAFASFLWLEFSQSFQVLAILFATLVYAVVYGYRFWTAIGLRGACFPFVLSCQIALLACNIACHVAVFFLHFFLKGGCNGIGAWLFNSILNLALLMLFLNFYVRMHVVHKRRKVRDVVVAPALS

SEQ ID NO: 3311 - protein, 333 aa, Zea mays
MEAEAAAKRAREGGEDATAPVAGAEAVVAGAGEQAGISAVIPGWFSEISPMWPGEAHSLKVEKVLFQGKSDYQNVMVFQSSTYGKVLVLDGVIQVTERDECAYQEMITHLPLCSIKDPKKVLVIGGGDGGVLREVSRHISVEQIDICEIDKMVVDVSKQFFPHLAVGFEDPRVSLHIGDGVAFLKNAPEGTYDAVIVDSSDPIGPAQELFEKPFFHSVARALRPGGVVCTQAESIWLHMHIIEDIFVNCRQVFKGSVNYAWTTVPTYPSGVIGFMLCSTEGPAVDFQHPVFNIEEDEHSTKSKGPLKFYNSEIHTASFCLPSFAKRVIESKAS

SEQ ID NO: 3312 - protein, 116 aa, Thermus thermophilus
MKLIVAIVRPEKLNEVLEALFQAEVRGLTLSRVQGHGGETERVETYRGTTVKMELHEKVRLEIGVSEPFVKPTVEAILKAARTGEVGDGKIFVLPVEKVYRIRTGEEDEAAVTPVQ

SEQ ID NO: 3313 - protein, 493 aa, Aquifex aeolicus
MSVSTALKLCIFFTGFAGIVAEYSLATLATYLLGNAVLQWSVVISIFLLSMGLGSHASRYIPDDKTPLAFVLAELFLSLLVPFSVPIAYHFANNFLHLQTVIYGLSFVIGSLIGLEIPLAVRINNMYEELKVNISSVLEKDYLGSVPAGLLYAYLFLPKLGLPLTAILAGFFNLISAFLLVKVLKPKKFLKFLAIFTFFLLATYAVGHKRITLYEEQKFYGEEIIHFEQTPYQKIVLTRFGKHYSLYLDGHLQFSTLDEKRYHETLVHVPASFLKRYEKALILGGGDGLALRELRKYPFGEIHLVDLDPKMIEFSKKNLVMRKINENSFYDTRLKVFSEDAFNFVKKTKEKYDFVIVDLIDPRTPSSARVYSLEFYMSLKNKLKEDGIFITQAGDTFYKREVFCSILKTIKKAGFYAYPLVVYIPTFGEWGMVIGSKEPLNFENFELKEKTEFLNRERALAFYTLGKSLECPNVEVNTLLKPVLIYYYYKIQN

SEQ ID NO: 3314 - protein, 462 aa, Glycine max
LMLPSDSARQWHVHELELVEVVADQVAVALSHAAILEESMRARDQLIEQNVALDLARREAETAIRARNDFLAVMNHEMRTPMHAVIALSSLLQETDLTAEQRLMVETILKSSNLLATLINDVLDLSRLEDGSLQLEAATFNLHSLFREVLNLIKPVASVKKLSLTSHVASDLPMYAIGDEKRLMQTILNVVGNAVKFSKEGCISITAFVAKPESFRDARIPDFLPVPSDNHFYLRVQVKDSGSGINPQDIPKLFTKFAQNQSLTRNPAGSGLGLAICRRFVNLMEGHIWVESEGIGKGCTVTFIVKLGIPDRSNEFKLPFVPKVPGNHGSTNFAGLKVLVMDDNGVSRTVTKGLLMHLGCDVTTASSSEECLRVVSLEHEVVFMDVCTGLDGYELAVRIHEKFTKHQDRPLIVALTGNTKKVTKENCMRVGMDGLILKPVSVDKMRGVLSELLERRVLFESV

SEQ ID NO: 3315 - protein, 124 aa, Glycine max
LCLAIVCSAIESPQHTVVHSESDFEIRLYRTSVWMSAPALDISFEKATWNGFHRLFQFTEGANLNFSRIPMTIPVLTTAVPGAGPLQSQGYYVSLYLPVKFQGDPPVPLPELNIKPYEFSSHCR

SEQ ID NO: 3316 - protein, 568 aa, Sinorhizobium meliloti
MSATNPTRDDFAALLEESFAKTDLAEGYVAKGIVTAIEKDVAIVDVGLKVEGRVPLKEFGAKAKDGTLKVGDEVEVYVERIENALGERVLSREKARREESWQRLEVKFEAGERVEGIIFNQVKGGFTVDLDGAVAFLPRSQVDIRPIRDVTPADAQPAALRNLKMDKRRGNIVVSRRTVLEESRAEQRSEIVQNLEEGQVVEGVVKNITDYGAFVDLGGIDGLLHVTDMAWRRVKHPSEIQNIGQQVKVQIIRINQETHRISLGMKQLESDPWDGIGAKYPVGKKISGTVTNITDYGAFVELEPGIEGLIHISEMSWTKKNVHPGKILSTSQEVDVVVLEVDPTKRRISLGLKQTLENPWQAFAHSHPAGTEVEGEVKNKTEFGLFIGLDGDVDGMVHLSDLDWNRPGEQVIEEFNKGDVVRAVVLDVDVDKERISLGIKQLGRDAVGEAAASGELRKNAVVSAEVIGVNDGGIEVRLVNHEDVTAFIRRADLSRDRDEQRPERFSVGQTVDARVTNFSKKDRKIQLSIKALEIAEEKEAVAQFGSSDSGRSLGDILGAALKNRQNNE

SEQ ID NO: 3317 - protein, 320 aa, Unknown
  Fragaria x ananassa
MLISGAQSAGVCYGRNGDNLPSDTEVVDLYKSNGIGRMRIYEPNQATLEALRGSNIELMVTILNNNLQALTDAAAATDWVQKNVQPYSADVKFKYIAVGNEVHPDAAEAQYLLPAIQNIQNAVTAANLQGQIKVSTAVDTTLLDPSFPPSDGAFSSAANSFITPIITFLGNNGAPLLVNIYPYFAYIGDPANIKLEYALFTSPGVVVQDGSNGYQNIFDAILDTHYSALEKAGASNMAIVVSEGGWPSEGSDAATNGNAGTYYSNLINHVKTGTPKRPNGAIETYLFAMFDENLKDGAEIENHFGIFSPNKQPKYQLTFG

SEQ ID NO: 3318 - protein, 370 aa, Erysipelothrix rhusiopathiae
MADKRDFYEILGVSKSATDAEIKKAYRQLAKKYHPDINKEDGAEAKFKEVQEAYEVLSDSQKRANYDQFGHAAFDQGAGGFGGGFSGGFDDFGDIFSSFFGGGGGGQRRNPNGPMKGQDRFMSMRIDFMEAVFGANKSVTLNVDEECTSCHGSGAHSKDDIKTCSRCGGTGQTVTQQRTPFGVFQSQATCPDCGGSGKTITKRCGECHGKGFNTKRVEVDIKIPAGIVTGQQLRVSGKGERGANGGPNGDLFIEIVVGTHKHFRREGNDIHINIPLSVIDATLGTEIEVPTVHGDVKLTIPAGTQPNTKFRLREKGVQDLRSGRMGDQYVEVKLEVPTKLSRQQREHLEALKETEVKGDSVFDRFKKAFK

SEQ ID NO: 3319 - protein, 305 aa, Thermus thermophilus
MEKWVIVNPAAGRGKVGRLSGAILKAARAEGARAFLTEGPGHATELAQRAPEGARVVAVGGDGTVHEVLKGLAGTGKVLGVVPIGSGNDFARMLGLLGLPWPKALELALHAPEEAVDLGWVNGEPFGASLGIGFDALVAKKALSAPPFLRGMPRYLYALFAVLKELSLPEARVLVDGEEVHRGRMLLLAAMNGPMYGGGIPIAPMADPGDGRLSVVLAGEFSRTGVVLILPRLLLGRHLSHPRVRAYAGQEVAVEFAHPVPAHADGELLPEASLYRAEVRPLGLRVVGGRAGARAGGLVPEPAGT

SEQ ID NO: 3320 - protein, 282 aa, Unknown
  Acidovorax sp. JS42
MIRKGEAHMSFIEDARWFTVAPAAGESGQPPKPGHVTLVGAGPGDPELLTLRAVKALRGARLVLYDHLVGKEVLRYVADDADLIYVGKQSSHHTLPQESIIDLMVRLARSGRSLVRLKGGDGFIFGRGGEEVQALAEAGIAFDVVPGITAAQGAGACAGIPLTHRDHSATLVFATGHLRGDNEVALDWEALARPRQTVVIYMGMGTLPIICRELVRHGLPDRTPAALVEQASLPGQRCITGTLQDLPALAQQHRVRPPALIIVGDVVALQPQLMQGMLATMV

SEQ ID NO: 3321 - protein, 316 aa, Unknown
  Candidatus Desulfococcus oleovorans Hxd3
MRVAICQTKPALLDVQTNLESVIAHIHKCREQGAQLVVFPELALTGYFVGLQYHKAALRMDSDQIRKLAAATKGTAAVVGFIEESRSMNFYNSALIAVDGEILFAYRKLNLPNYGAFEERKFFANGKHIRVFRLNDFNVSVFICNDMWHPALPYLGVTQKADIFVSIINSSEESMGAEFNNVESWDIINRFYSRVFGIYNICANRVGTEDPDETWDIPEDDKLLKKTSDVFLVPEVKKRYRFWGGSEIINPFGQRIYKARLYETDVIMGELSKDLVRRKKILLPYLRNDDPYFTRRELHRILFEQAGDTSRPQHKL

SEQ ID NO: 3322 - protein, 346 aa, Unknown
  Fragaria x ananassa
MDFSYATLKNTFMAPILLLLVLFMPALQITGAQSAGVCYGRNGDNLPSDTEVVDLYKSNGIGRMRIYEPNQATLEALRGSNIELMVTILNNNLQALTDAAAATDWVQKNVQPYSADVKFKYIAVGNEVHPGAAEAQYLLPAIQNIQNAVTAANLQGQIKVSTAIDTTLLDPSFPPSDGAFSSAANSFITPIITFLGNNGAPLLVNIYPYFAYIGDPANIKLEYALFTSPGVVVQDGSNGYQNIFDAILDTHYSALEKAGASNMAIVVSESGWPSEGSDAATNGNAGTYYSNLISHVKTGTPKRPNGAIETYLFAMFDENLKDGAEIEKHFGIFSPNKQPKYQLTFG

SEQ ID NO: 3323 - protein, 390 aa, Emericella nidulans
MKFSQALLSLASLALAAALPHASTPVYTPSTTPSPTPTPSASGSFATTSGIQFVIDGEAGYFPGSNAYWIGFLKNNSDVDLVFDHMASSGLRILRVWGFNDVNTAPTDGSVYFQLHQDGKSTINTGKDGLQRLDYVVHSAEKHGIKLIINFVNYWDDYGGMNAYMRAYGGGDKADWFENEGIQAAYQAYVEAVVKRYINSTAVFAWELANEPRCTGCEPSVLHNWIEKTSAFIKGLDEKHLVCIGDEGFGLDTGSDGSYPFQYTEGSDFAAALTIDTIDFGTFHLYPDSWGTNNDWGKLWITSHAAACAAAGKPCLFEEYGVTSNHCAIEKQWQNAALNATGIAADLYWQYGDTLSSGPSPDDGNTFYYGSEEFECLVTNHVETIERSAK

SEQ ID NO: 3324 - protein, 98 aa, Secale cereale
PELVKGPWSKEEDDVIIQMVKKYGPTKWSTIAQALPGRIGKQCRERWHNHLNPGINKDAWTQEEEIRLIQAHRIYGNKWAELSKFLPGRTDNAIKNHW

SEQ ID NO: 3325 - protein, 406 aa, Oryza sativa
TFPMGKNGKKTESHRQGRGRRASRFRGGGGGGDEDGDELPSSAYDAPPPHHEDSDGDDTDEAAAEDEHEGGVDGGDQEQREVGSMPSKFHLYQLSVQSPKGDISYLQKFFLMYVGGRVPLHFQEDFCGTALLSAEWLRTDARRTAVGLDLDLESLEWCLENNLSKIGADGYSRMLLFHGNVLQPNVARLVKQKICDAMQDLHVNNDNDSLASNICDQLDPASPKCSANSTMSDLVLPARDIICAFNYSCCCLHRRKDLVLYFRHAFNALSKRGGIFVMDVYGGTSSERKLRLQRRFPSFTYFWEQEEFDIISHQTRISLHFQAGKKQMLRHAFTYHWRLWSIPEIKDCLEEAGFKSIHVWIREMPNTQSSGNAKEYNANRDVKYEELQHFNQADAWNAYVVGVANI

SEQ ID NO: 3326 - protein, 342 aa, Fulvimarina pelagi
MDDISQNRSARTHGRGKIYDSIVDTIGDTPLVRLKKLAAEKGVKANLLAKLEFFNPIASVKDRIGVAMLEKLEADGRIEPGKTTLVEPTSGNTGIALAFAAAAKGYNLILTMPETMSIERRKMLRLLGAQLVLTEGAKGMKGAIARAGELVEEIPNAVIPQQFENPANPEIHRVTTAEEIWNDTGGNVDVLVAGIGTGGTITGAGQILKSRKPDVHVVAVEPEASPVLSGGQPGPHKLQGIGAGFAPQILDQGVYDEVLTVSNEESFELARLVARLEGVPVGISSGSALAAAIKVGQREEMADKNIVVIIPSFAERYLSTPLFEGLTDEDEPKEPRRGAPSI

SEQ ID NO: 3327 - protein, 537 aa, Unknown
  Candidatus Desulfococcus oleovorans Hxd3
MCGIAGCFGRKDEPTVKRMLDTLGHRGPNDRGMHAGASFVVGHTRLSIVDVATGRQPILTGDGTKGIVANGEIYNFRKLRMGIADKYQFRTRSDTEVVLHLYEEKGPACVKDLDGMFAFALFDGDAFMLARDPVGIKPLYYGFKQDALYFSSELGAMSFAGLDEVHEFPAGHYYTPKEGFVQYYKVPPIEDDQLTDIEETCEIIRETFIHAVKKRLLADPEVPVGSFCSGGLDSSLVAAIAADEIPRLHTFVVGMKDAFGDVSDDVKAARIAAAHIGSTHHELIFTEDEYYEALPTVINKLESYDPSLVRCAVPCYFTCKMAAEYVTVVLTGEGADELFTGYHYMKHFPEDKLNLEARRCIGNLHNINLQRADRMGMLFSLELRVPFLDEAMVDLSMKIPHELKIREHNGAKIEKWILRKAFENTHYLPDDILWRYKVQYTQGAGCEDLGERLANRMGDDEYEKIKAENPDAVINSKEAAYYFKIFREYHPQDSILGSIGIWTGFDFAEEREKVKGTVDGDLKHEHEEETDDTSQVA

SEQ ID NO: 3328 - protein, 125 aa, Unknown
  Synechococcus sp. PCC 7002
MAGSEVKADYWINEYITPWDIYSHGITKILAYKQTQFQEMAIVESGAYGKALVLDGKWQSCTGDEFLYHEPLVHPAMIAHGAPKKVLILGAGEGATVREVLRWQSVEKVMMVDIDGEVVEACKEF

SEQ ID NO: 3329 - protein, 470 aa, Unknown
  Rhodococcus sp. RHA1
MRSARNDGEKNPQGTTAGRPGHTLHKGGLRQRHLTMIALGGIIGASLFVGSGSVIHTAGPAAVLSYALGGVLVIFVMRMLGEMATAKPTLGSFMEYAREALGERAGFIVGWLYWYFWVGVVAFEAVVGGKLLGGWFNAPDWVFALVLMFILTATNLLSARSFGETEFWLASIKVATIIVFLSVGALFVLGLWPGSQLSVANIGQHGFIVNGGFSILQGVVVVIFSYFGAEIVTMAAAESEQPAKAVAKATNTVLWRILLFYVGSVALLLMITPWTEIPSNSSPFAAAFDKFGLPAAGQIMNVVVLTAALSVLNSGLYTASRMLFALANRGWAPGWARDCNSRGVPWKAILLSTIVGYVAVAMNYVSPDQVFSFIMNSAGAVALFVYVIIALSQLSLRSRMTDDEKAALGLKMWLHPWLGIITVVGIVVIIFSMSLIESTRTQLWLSLISLGVLLVAYSITQRVRHRRARK

SEQ ID NO: 3330 - protein, 710 aa, Oryza sativa
MSASPSSMSGAGAGEAGVRTVVWFRRDLRVEDNPALAAAARAAGEVVPVYVWAPEEDGPYYPGRVSRWWLSQSLKHLDASLRRLGASRLVTRRSADAVVALIELVRSIGATHLFFNHLYDPLSLVRDHRVKALLTAEGIAVQSFNADLLYEPWEVVDDDGCPFTMFAPFWDRCLCMPDPAAPLLPPKRIAPGELPARRCPSDELVFEDESERGSNALLARAWSPGWQNADKALAAFLNGPLMDYSVNRKKADSASTSLLSPYLHFGELSVRKVFHQVRMKQLMWSNEGNHAGDESCVLFLRSIGLREYSRYLTFNHPCSLEKPLLAHLRFFPWVVDEVYFKVWRQGRTGYPLVDAGMRELWATGWLHDRIRVVVSSFFVKVLQLPWRWGMKYFWDTLLDADLESDALGWQYISGSLPDGRELDRIDNPQLEGYKFDPHGEYVRRWLPELARLPTEWIHHPWDAPESVLQAAGIELGSNYPLPIVELDAAKTRLQDALSEMWELEAASRAAMENGMEEGLGDSSDVPPIAFPPELQMEVDRAPAQPTVHGPTTAGRRREDQMVPSMTSSLVRAETELSADFDNSMDSRPEVPSQVLFQPRMEREETVDGGGGGGMVGRSNGGGHQGQHQQQQHNFQTTIHRARGVAPSTSEASSNWTGREGGVVPVWSPPAASGPSDHYAADEADITSRSYLDRHPQSHTLMNWSQLSQSL

SEQ ID NO: 3331 - protein, 587 aa, Bacillus sp.
MSTALTQTSTNSQQSPIRRAWWKEAVVYQIYPRSFMDSNGDGIGDLRGILSKLDYLKLLGVDVLWLNPIYDSPNDDMGYDIRDYYKIMEEFGTMEDFEELLREVHARGMKLVMDLVANHTSDEHPWFIESRSSRDNPYRDWYIWRDPKDGREPNNWLSYFSGSAWEYDERTGQYYLHLFSRRQPDLNWENPKVREAIFEMMRFWLDKGIDGFRMDVINAIAKAEGLPDAPARPGERYAWGGQYFLNQPKVHEYLREMYDKVLSHYDIMTVGETGGVTTKDALLFAGEDRRELNMVFQFEHMDIDATDGDKWRPRPWRLTELKTIMTRWQNDLYGKAWNSLYWTNHDQPRAVSRFGNDGPYRVESAKMLATVLHMMQGTPYIYQGEEIGMTNCPFDSIDEYRDVEIHNLWRHRVMEGGQDPAEVLRVIQLKGRDNARTPMQWDDSPNAGFTTGTPWIKVNPNYREINVKQALADPNSIFHYYRRLIQLRKQHPIVVYGKYDLILPDHEEIWAYTRTLGDERWLIVANFFGGTPEFELPPEVRCEGAELVIANYPVDDSEAGGPAAAGAPHRFRLRPYECRVYRLLGWH

SEQ ID NO: 3332 - protein, 825 aa, Triticum monococcum
MAFSPRSPWSRSKKPDIYSTVVVHDDEDNARGGGAARAEDDDDDDPSALPPLLQRLPKDFGGASFDDDDDPYSSDLDDASLSATVVIKRGAPASTSSSSRSPFLDLRRSSPRAAEADPFSTFVVHGTARSGGASSPRESVSGTFIRHSGGPPSPRESVSGTFIRHTRGSSSPHESFSGTFIHHTSSASSPRDSASGAGAGFGSSFITPSSGQAEEDRQPSLLMQQQQSRRKASMSSLPDSVTREDPSTKYELLHELGKGSYGAVYKARDLRTQELVAVKIISLTEGEEGYEDIRGEIEMLQQCSHPNVVRYFGSYQGEEYLWIVMEYCGGGSVADLIGITEEPLDEPQIAYICRETLKGLAYLHTIFKVHRDIKGGNILLTEQGEVKLGDFGVAAQLTRTMSKRNTFIGTPHWMAPEVIQESRYDGKVDVWALGVSAIEMAEGMPPRSTVHPMRVIFMISSEPAPMLEDKEKWSLLFHDFIAKCLTKDARLRPPAIEMLKHKFIEKCNTGASKMLAKIKEAKIIRETAVQNQLPDSDDAMDATVRINEDYGETVPTNSQSTHETKNDGSGGDFGTMIVHPEDGDEAAESSIFPRAEFIPGLGSINSFTHDPKRAELISKFWAESTAESDASKERDLYGLPDIQEPKTMPRSTGTVKHHKGVEGTVLRHDITASPGVASTMNKLSSSPSRKAFSVQDKLWSIYAAGNTVPIPFLKAIDISPLALVSDSVAGNGPAGSSTTDALEAVRELFSGDGQAKKGRKGQNEAPLPPGVHDRLTTSPTLMNLAQALAYHKTCYEDMPLQDSQATEEQQTIQNLCDTLRTILRL

SEQ ID NO: 3333 - protein, 540 aa, Unknown
  Mesorhizobium sp. BNC1
MKDYWWKDAIVYAVDVERFCDSDGDGVGDFKGLTSKLDYIAELGVTCIWLLPFYPSTGEDNGYSITDYLRVDSRFGLFQDFLEFIHRAGEHGIRVVVDLVVHHTSNQHPWFQAARHNEKSRYRDFYIWTHNPPPTPPGKGTIFPGEEGTVWTYDEVARAYYHHRFYHFEPGLNHANPDVRDEIGRIIDYWLSFGVAGFRVDAASHILENPLAKSGEDENAPDMLREMFHRATGSKSDIVMLGEVDESPNELERFFDGTRLNMMFNFLLNNYLILGLAKEKAEPIQRGLAMLPVPPENGQWANFLRNFDEADLERLTPEELESVLKIFAPKEEMRIYGRGLRRRLAPMLDGDVRRLKMAMSLLYSMPGAPVLVYGDEIGMGEDLTQEGRNSVRSPMQWDGSRNAGFSSARKERMVQPIIDKGRFAFERINAETQRNDPASLLSFVKQLAILRRERTEIGSGFCAFLECGSDHVLAHHYKSEAAPLVMVHNLAGEAVKIDVKLPAGVTSLGTLFGGEMPSIEDGHLRMSLEPYGVRWLGLPR

SEQ ID NO: 3334 - protein, 309 aa, Arabidopsis thaliana
EFRAEEHSNQFHSIIAMAIWLGAIHFNVALVLCSLIFLPPSLSLMVLGLLSLFIFIPIDHRSKYGRKLARYICKHACNYFPVSLYVEDYEAFQPNRAYVFGYEPHSVLPIGVVALCDLTGFMPIPNIKVLASSAIFYTPFLRHIWTWLGLTAASRKNFTSLLDSGYSCVLVPGGVQETFHMQHDAENVFLSRRRGFVRIAMEQGSPLVPVFCFGQARVYKWWKPDCDLYLKLSRAIRFTPICFWGVFGSPLPCRQPMHVVVGKPIEVTKTLKPTDEEIAKFHGQYVEALRDLFERHKSRVGYDLELKIL

SEQ ID NO: 3335 - protein, 589 aa, Debaryomyces hansenii
MSDITLGKYLFERLKQVEVSTIFGLPGDFNLTLLDKIYEVEGMRWAGNANELNAAYAADGYSRIKGLACLVTTFGVGELSAVNGVAGAYAEHVGLLHVVGVPSISSQANQLLLHHTLGNGDFTVFHRMSKNISHTTAFLSDSETAPAEIDRCIRDAYVYQRPVYLGIPANLVDVTVSSSLLEKPLDLSLKPNNAEAEEEAVELTLKLIEESKNPIILVDACASRHNCKQETKELVEITQFPVFTTPMGKGTIDEGGVGGLLEDDPSSIEKVKKKLDYGNSVSSRFGGVYVGNLSHPEVKEAVENADLILSIGSLLSDFNTGSFSYSYKTKNIVEFHSDYTKIRQATFPGVQMKEALQHLLKKVGQAALKYKPQPVPKVKLINTPASRDSKLTQEWLWTRVSSWFKEGDIIITETGTSAFGIVQSRFPNNTTGISQVLWGSIGFTVGATLGAVMAAEEIDPAKRVILFIGDGSLQLTAQEISTMIKWNTKPYLFVLNNDGYTIERLIHGENATYNDVQPWKNLDLLPLFSAEDYDAIRISTIGEAEDIFRDKEFEENTKIRMVEVMLPRMDASTNLIKQAEYLAKTNAAN

SEQ ID NO: 3336 - protein, 73 aa, Gloeobacter violaceus
MAKQDVIEMEGTVVESLPNAMFRVELDNSFNILAHISGKIRRNYIKILPGDRVKVELTPYDLTKGRITYRLRK

SEQ ID NO: 3337 - protein, 431 aa, Vibrio vulnificus
MNSHYQNHSLENFFSTNLSATDDAVFAGIQAEFTRQNEQIELIASENIVSKAVMQAQGTCLTNKYAEGYPGRRYYGGCEHVDTVEAIAIERAKKLFNCEYANVQPHSGAQANGAVKLALLQPGDTIMGMSLDAGGHLTHGARPALSGKWFNAVQYGVDKETLEINYDDVRALAVEHKPKMIIAGGSAIPRVIDFAKFREIADEVGAILMVDMAHIAGLIATGAHPSPLPHAHVVTTTTHKTLRGPRGGMILTNHEEIIKKINSAVFPGLQGGPLMHVIAAKAVAFGEALGPEFKTYIDSVINNAKVLAEVLQTRGCDIVTGGTDTHLMLVDLRPKGLKGNKAEEALERAGITCNKNGIPFDTEKPMITSGVRLGTPAGTSRGFGAEEFKLIGHWIGDVLDGLVENPEGNAEVEQRVRKEVKALCSRFPLYQ

SEQ ID NO: 3338 - protein, 72 aa, Leptospira interrogans
MAKEEAITVDGTVLEPLPNAMFRVELENGHKVLAHISGKMRMHYIRILPGDKVTVELSPYDLSKGRITYRKK

SEQ ID NO: 3339 - protein, 417 aa, Yersinia pestis
MLKREMNIADYDADLWRAMEQEVVRQEEHIELIASENYTSPRVMQAQGSQLTNKYAEGYPGKRYYGGCEYVDVVEQLAIDRAKALFGADYANVQPHSGSQANVAVYSALLKPGDTVLGMNLAHGGHLTHGSPVNFSGKLYNIVPYGIDESGQIDYEDLARQAEIHKPKMIIGGFSAYSGIVDWAKMREIADSIDAWFFVDMAHVAGLVAAGVYPNPVPHAHIVTTTTHKTLAGPRGGLILAKGGDEDLYKKLNSSVFPGNQGGPLMHVIAGKAVALKEAMEPEFKIYQQQVAKNAKAMVAVFLERGYKVVSGGTDNHLFLLDLVDKDITGKDADAALGRANITVNKNSVPNDPKSPFVTSGVRIGSPAITRRGFKEAESRELAGWMCDVLDNINDEATIERVKQKVLAICARLPVYA

SEQ ID NO: 3340 - protein, 195 aa, Unknown
  Sulfitobacter sp. EE-36
MRQTTINRSTAETEISVEINLDGTGSYANHTGIGFFDHMLDQLARHSLIDMKISANGDLHIDDHHTVEDVGITLGQALSTALGDKRGIRRYGACLLPMDDALVRTALDLSARPFLIWNVDLPTAKIGNFDSELVREFFQALSTHGGITLHIDMLHGLNSHHIAEAVFKSVARALREAVETDPRKSSDIPSTKGAL

SEQ ID NO: 3341 - protein, 254 aa, Oryza sativa
MLSQFSSSFLEGISTHVDPKLPFISLSKGLELNTLRTMSQIIPQALGNPRQPFIVLSGPSFAIELMNKLPTAMVVASKDKKLAAAVQQLLASPNLRISTSNDVTGVEIAGALKNVLAIAAGIVEGMHLGNNCMAALVAQGCSEIRWLATKMGAKPTTLSGLSGSGDIMLTCFVNLSRNRNVGLRLGSGEKLDEIMNSMNQVAEGVSTAGAVIALAQKYHVKMPVLTAVARIIDNELTPKKAVMELMNLPQVEEV

SEQ ID NO: 3342 - protein, 1035 aa, Thermosynechococcus elongatus
MRIFMFRFPLLSFIQLFLPTTAVIAALLTPLYVGQRQALFKDFRVGQEGKLEEIQLTIANDIDDAVTDPKGLGSFHLWHELIDSPSQGELAEEVQELVDQWHRLKEHYDQLYVLDTRGRIRFQWTSTPQSDPPSTVKAINSYWPILRELTPDQVFVSPVEVTATKSSGLPFPVLYIGVPLYHQSAPKGVLVVRYQLNHLFNNLLSRCNIQMGWCLVADDQGYWLLGEDIREQWGFDFPERRQFTVRHQYPLLWQQMQHQLRGGLFGPDGLFVFQSFSLLQENWISAERSAHSSRRQSNVRWWLIGFLPSSALEQYLDHLNRDFLVSFTALCILAAVAVLLITRDRQRKRSLQKLLETSNARFRSVSEMAPVGIFTLDAQGQPTFLNQRLLQLLQVHNLEEAQQQWIERLHPEDRDRVLKAWAACQQKRVPFHERFRIVHNDSSSHWINARIIPLQESSATDSFVGTWEDISQMMQQQELLEVARQAAEEASRAKSEFLATMSHEIRTPMNAIIGLTGLLLDTPLNPQQQEFVNTIRLSGDALLGVINDILDFSKIESGKLELESYPFNLRTCVEEVLDLLASRAAEREVELAAHIDSGVPCAVIGDMGRLRQVLVNLIGNAIKFTQKGNVTLYVKAKPMPMSQYEFMPSYYSYLFAIQDTGIGISAAGMNRLFKPFSQVDASTTRQYGGTGLGLVICQRLVERMGGQIWVESKKTGESLVVGGTPLAVYESIPIAESGSVFYFTARFLLNPNPAPEPTDDTCYLENRRVLIVDDNATNRQILALQIKKWKMQPLVAESGPSALALLQQQGWVDLAILDLQMPEMDGVTLARQIRAAYGELPLILLTSLGNTLTESEKALFSSLISKPVKQSTLYNALNSLFCEKQKTVSPKPAAAPSFEHLKAELPPLRILVAEDNKVNQMVALRILEKLGYRGDIAANGLEVLDAVQRQPYDVILMDMQMPEMDGITATREVTQLFQGLKKPRPRIIAMTANAMESDRQLCLDAGMDDYVSKPIRLEELVRALRQCQPLQTPTT

SEQ ID NO: 3343 - protein, 409 aa, Unknown
  Bradyrhizobium sp. BTAi1
MVFSPDRRSLLGGLAAAAGGWIGTAGAAEGRLQVPVWTRQQGSPVASPAYGVPSRFEDGIKRRPRTPPPIPTAASSGTPLQHLHGIITPAGLHYERHHAGVPDIDPDQHRLVVHGLVERPLAFTMDDLLRFPSVSRIHFMECSGNTSTWGGGNPKWTVQDTHGLISCSEWTGVPLATVLQEVGVKPEGRWILAEGADAAAMTRSVPIEIALDDAILAYAQNGERLRPEQGYPLRLFLPGLEGNLSVKWLRRLKVGDKPFQSREETSKYTDLMPDGTARQFTFTMEAKSVITQPSSGHQLRERGLYEIRGLAWSGRGSISKVEVSTDGGQTWREAELQQPVLSKCLTRFRLPWQWDGGPALLQSRATDSTGYLQPTKEQLIRARGLNSNYHFNAVYGWQLNAEGAVTHVV

SEQ ID NO: 3344 - protein, 350 aa, Medicago sativa
MLDAVNEPENTELRHHDRRKCTHDRFMGSNFQLKDSDRPSSSIDSITNRADQILDDADVGECEIPWEDLVIGERIGLGSYGEVYRADWNGTEVAVKKFLDQDFSGAALSEFKREVRIMRRLCHPNVVLFMGAVTRPPNLSIISEFLPRGSLYRILHRPNCQIDEKQRIKMALDVARGMNCLHASTPTIVHRDLKSPNLLVDNNWNVKVCDFGLSRLKHNTFLSSKSTAGTPEWMAPEVLRNEPSNEKCDVYSFGVILWELATLRLPWSGMNPMQVVGAVGFQNGRLEIPKELDPLVARIIWECWQQDPNLRPSFAQLTVALKPLQRLVIPSHQDQVASPLPQEISVNSTP

SEQ ID NO: 3345 - protein, 189 aa, Lactobacillus johnsonii
MQNSDNIDNIIDRVLFSQDDIEEICQRLGKQLTEDYAGKFPLVIGVLKGAVYFMTDLTRHMNVKMQNDFMDVSSYGDGFESTGKVRLDIDVQADVKGRDVLLVEDIVDTGHTLKFMKDLLIERGAKSVKCCALLNKTERREDDVVVDYYGSKVENEFVVGYGLDYLNAYRNLPYVGVLKPEVIQANLNR

SEQ ID NO: 3346 - protein, 145 aa, Oryza sativa
MARRALAPPDLTTAMYMSCCMAPQRSRSDREFDEFAVSLISRDMTESRETTRSGSPSADGGEEGEVAAARRRREPEASAAYFTAGLTALFACLAALLVFLPLVLPPLPPPPSLLLLVPVGLMAVLLALAFLPADGRRSSIASSCV

SEQ ID NO: 3347 - protein, 220 aa, Silicibacter pomeroyi
MFPIQTLKPIALIAAMALATILQGGKAEAAETQTLTVAGGCFWCVEADFEKVPGVLGAVSGYTGGTLDNPTYKQVTRGGTGHFEAVQILFDPDQVSRERLLHMFFRSVDPTDAGGQFCDRGDSYRTAIFVSNKVESALASQAKANAEAELGQTVVTPILTAGRFYPAEAYHQDYAKGEKLVLTRFGPKRQQEAYKLYRKSCGRDARVKQLWGDAAPFAGS

SEQ ID NO: 3348 - protein, 411 aa, Bacillus cereus
MSIFRLKNERGTEKSIDKHALLFGLISVFLCGIGFSIIMPVVPFLVQPYTSNPEEQALVVTLLTSVYAACVFLTAPVLGALSDKYGRRPLLLICLFGSAIGYLVLGIGGALWVLFAGRIIEGITGGSISTIFAYFADIIPKEQRTKYFGWVSAVVGAGTIIGPTIGGILAKFGDTVPIYFGAIITLINVVYGIKYMPESLEKNNRLKEITFVRLNPFVQLANILSMKNLKWLLVSAFLLWIPNGSLQAIFTQFTMDTFSWKPALIGLMFSILGFQDIVSQSFIMPKLLIKLSDKQIAILGMVSEIIGYSFIAASALFSLYPLLIAGMLMYGFGDSIFGPSFNGMLSKSVSSSEQGRIQGGSQSIQALARMIGPILGGQIYVSLGHAAPAFMGMILIVAAIAVLYKGTHETV

SEQ ID NO: 3349 - protein, 682 aa, Glycine max
  misc_feature (248)..(248): Xaa can be any naturally occurring amino acid
MMLFSFLSFLVILKSEANNDQLQFVYHYCNNEYGNITTETYSDNRNNLLSNMYYDKENDYGFYNSSYGQDPDKVYAIGFCRGDANLDKCRSCLEKSAVLLRERCPVQKEGIGWFDECMLRYTNHSIFGVMVTQPNNIMCNTKNAPKDPRSAAGFDQVVHNLLNELRNRTTTVADPESDSSRSRKFFAEGDAPVQSSNVTIHALIQCTPDISSQNCTRCLEHAMTNILYCDGKRGGRYLGPSCSVRYEXSIPFFEPIVHHAPPPQPATQVTTTTGKEKSNPSRTIIAIVVPVVAVVVLLVAFTYNYLGARRRRQKPFQSEGGEGELDNDIKIDELLQFDFATIKFATNNFSDANKLGQGGFGIVYKGTLSDGQEIAIKRLSINSNQGETEFKNEILLTGKLQHRNLVRLLGFCFSRRERLLIYEFVPNKSLDYFIFDPNNRVNLNWERRYNIIRGIARGLLYLHEDSRLQVVHRDLKTSNILLDEELNPKISDFGMARLFEINQTQASTNTIVGTFGYMAPEYIKYGQFSVKSDVFSFGVMILEIVCGQRNSEIRGSEENAQDLLSFAWKNWRGGTVSNIVDDTLKDYSWNEIRRCIHIGLLCVQEDIADRPTMNTVLLMLNSDSFPLAKPSEPAFLMRDKSSLPTAMLSGGQHSEVTRSGYSGSQSAQESSIMAPITEPYPR

SEQ ID NO: 3350 - protein, 520 aa, Oryza sativa
MDLIKLSSHASLRYKLQPCGASPPAAAAAMETSYREEEARRKASLLHCIFFFLLGALAMAAAIAVLHESSYWEWRCNRLTDIVVDGDDGDGPSSSEVVDGGGEWGMVRTRGAQFVVGGGRPFYVNGFNTYWLMVLAVDPSTRGKVTEVFRQAAAVGLTVCRTWAFNDGGWRALQKSPGVYDEEVFKALDFVVSEARKHKIRLILPLINNWDDYGGKAQYVRWAQAAAAGAGADAFFSDETVRGYFKSHVTAVLTRVNAYTGVAYRDDPTIMAWELMNEPRCASDPTGDTLQAWIAEMAFHVKSVDPAHLLGVGAEGFYGPSSPPARLRVNPNADVALAGADFVRNHRVLGVDFASVHVYPDTWLPAGATKEAQLRFATSWVEAHIADAEGALGGMPVLFAEFGVSTRGARAAFNATSRDAFIEAVYGAMLRSTRRGGGGAGALLWQVFPEGTDYMDDGYAVVLPRAAATAGIVAAHSRRLQSFNSRCAWSCRWGCNKRDNDTAETTTAEADVDVSFHHEL

SEQ ID NO: 3351 - protein, 488 aa, Burkholderia mallei
MNEEILINITPQETRVALVQQGAVQELHVERTLSRGRVGNVYLGKVVRVLPGMQSAFIDIGLERAAFLHVADIWQPRAGDAPAAATHQPIEKIVFEGQTLMVQVIKDPIGTKGARLSTQISIAGRTLVYLPQEPHIGISQKIESEAEREAVRARLTAVIPSDEKGGYIVRTIAEDATSDELAADVAYLRKTWATIVAQGQRVPPTSLLYQDLDLAQRVLRDFANDDTTRIQVDSRETHQRLVEFAAEFTPAVSPKLHHYTGKRPLFDLYNIEAEIQRALSRRVDLKSGGYLMIDQTEAMTTIDVNTGGYVGARNFDDTIFKTNLEAAHTIARQLRLRNLGGIIIIDFIDMENAEHRDAVLAELKKALSRDRTRVTVNTFSQLGLVEMTRKRTRESLAHVLCEPCPTCQGKGQVKTSRTVCYDILREILRESRQFNPREFRVIASQQVIDLFLDEESQHLAMLIDFIGKPVSLQVESNLSQEQYDIVLM

SEQ ID NO: 3352 - protein, 306 aa, Methanococcoides burtonii
MVYDLIIIGGGPGGLSAGIYAVRYGLNTLVLEKGFVSGQISTTGDVENYPGFPSIGGMELMDKFAEHAKAAGVVVEDRDVLEVRSEGDMKIVHTSEGDIEASSVIIATGAEPKHLGIPGEEEFRGKGVSYCATCDGPFFSGRNVIVVGGGESAITDALILSDMAASVCVVHRRDELRASKILQDRAFARSNIEFLWGTTLEEIVGDSVVREAVIRDINAAEVCRVPIDGVFVYVGVKPSTGFVDVDKDKYGFIITNERMECSEKGVFAVGDCRNAILRQVVTAASDGAIAAFEAYNYVSSLERSGK

SEQ ID NO: 3353 - protein, 417 aa, Salmonella enterica
MLKREMNIADYDAELWQAMEQEKVRQEEHIELIASENYTSPRVMQAQGSQLTNKYAEGYPGKRYYGGCEYVDVVEQLAIDRAKELFGADYANVQPHSGSQANFAVYTALLQPGDTVLGMNLAQGGHLTHGSPVNFSGKLYNIVPYGIDESGKIDYDEMAKLAKEHKPKMIIGGFSAYSGVVDWAKMREIADSIGAYLFVDMAHVAGLIAAGVYPNPVPHAHVVTTTTHKTLAGPRGGLILAKGGDEELYKKLNSAVFPSAQGGPLMHVIAGKAVALKEAMEPEFKVYQQQVAKNAKAMVEVFLNRGYKVVSGGTENHLFLLDLVDKNLTGKEADAALGRANITVNKNSVPNDPKSPFVTSGIRIGSPAVTRRGFKEAEVKELAGWMCDVLDNINDEATIERVKAKVLDICARFPVYA

SEQ ID NO: 3354 - protein, 358 aa, Arabidopsis thaliana
  misc_feature (291)..(291): Xaa can be any naturally occurring amino acid
MKQSEINNNTVPGNDTETTGSKLDQLSRAVPLGLDEFKSRASNSRDKSLSGQVTGVIHRMEPGGKEYNYAAASKGAKVLSSNKEAKGASSIICRDKDKYLRNPCSTEGKFVVIELSEETLVNTIKIANFEHYSSNLKDFEILGTLVYPTDTWVHLGNFTALNMKHEQNFTFADPKWVRYLKLNLLSHYGSEFYCTLSLLEVYGVDAVERMLEDLISIQDKNILKLQEGDTEQKEKKTMQAKESFESDEDKSKQKEKEQEASPENAVVKDEVSLEKRKLPDPVEEIKHQPGXRLEQVLERLEWMEKKGVVVFTICVGFGTIAVVAVVFGMGIVRAEKQGGLAWLLLLISSTFVMFILSL

SEQ ID NO: 3355 - protein, 585 aa, Zea mays
MCGILAVLGCADDTQGKRVRVLELSRRLKHRGPDWSGMHQVGDCYLSHQRLAIIDPASGDQPLYNEDKSIVVTVNGEIYNHEQLRAQLSSHTFRTGSDCEVIAHLYEEHGENFIDMLDGVFSFVLLDTRDNSFIAARDAIGVTPLYIGWGIDGSVWISSEMKGLNDDCEHFEIFPPGHLYSSKQGGFKRWYNPPWFSEVIPSVPYDPLALRKAFEKAVIKRLMTDVPFGVLLSGGLDSSLVAAVTVRHLAGTKAAKRWGTKLHSFCVGLEGSPDLKAAKEVANYLGTMHHEFTFTVQDGIDAIEDVIYHTETYDVTTIRASTPMFLMSSKIKSLGVKMVISGEGSDEIFGGYLYFHKAPNKEELHRETCQKIKALHQYDCLRANKATSAWGLEARVPFLDKEFINEAMSIDPEWKMIRPDLGRIEKWVLRKAFDDEEQPFLPKHILYRQKEQFSDGVGYSWIDGLKAHAESNVTDKMMSNAKFIYPHNTPTTKEAYCYRMIFERFFPQNSAILTVPGGPSVACSTAKAVEWDAQWSGNLDPSGRAALGVHLSAYEQEHLPATILTGTSKKPRMIEVAAPGVAIES

SEQ ID NO: 3356 - protein, 433 aa, Haemophilus influenzae
MKSGDLNKYDLVKNTLVLVLAGGRGSRLHELTDKRAKPALYFGGNRRIIDFALSNCINSDLNRIGVVTQYAAHSLLRHLQTGWSFLPQERGEFVDMLPARQQIDDSTWYRGTADAVYQNMAIIKNHYRPKYILILAGDHIYKQDYSVMLMDHVNSGAKCTVGCIEVPRSEAHEFGVMAVNENLKVKAFVEKPKDPPAMVGKPDVSLASMGIYVFDADYLYKMLEQEVNTPQTSHDFGKDVLPKCLEEGALYAHPFSRSCMGRNTEGEIYWRDVGTLDSFWQSNIDLVSENPQLDIYDQSWPIRGNPIQAYPSKFFYKHSNVHPVDNSLIGGGCVITDASISNSVLFDHIKIDAFSKVDHCVVLPQVKIGKNCVLKNCIIDRECEIPDGMQIGVDIEEDKKRFRISSTGKVILVTPKMLKKLEGHEIEEDGHLD

SEQ ID NO: 3357 - protein, 436 aa, Bordetella bronchiseptica
MLTKENNERLCRVGAGTPGSELFRSLWLPAVLSSQLPEGSRAPVRLRLLGEDLIAFRDGSGQVGITHAHCLHRGAPLFFGKVEERGIRCSYHGWLYGRDGQCLEMPSEKNSNLCQKMHLPAYQAQEKAGIVWIYMGAGPAPELPRFPWIDLPEKQRLASVWVQETNWMQGAEGEIDSSHVSTLHKSDQGVASDRVHRTYTYKDPRPELNVEETPIGFMSIARRRADERFYWRVTQWMAPMFSVIPSAAWPIGGRAWVPIDDENTYCWDFNYVLDGELPQAFLEFVERGISFPPEYRYGPFELNSGSIIDTWAPIRNRRNDYLVNREAQKGTSTTGIHGVNDQDRAMQEGMGRIADRTKEKLVSADLAIVMARRKVLDFMASPEALQKFRALVRDGTVFSMAPVDTVADTRELADFLKSLSYPAVPDAEAMQEQVPQ

SEQ ID NO: 3358 - protein, 310 aa, Methylococcus capsulatus
MKIANSVTDLIGNTPLVRIHRLSAGCGAEVVAKLEFFNPAHSVKDRIGAAMIDAAEQAGLIGPDTVIVEPTSGNTGIALAMVCAARGYRCVLTMPETMSKERRMLLRAYGAELVLTPGPDGMGGAIRKAEELAASDPKYFMPQQFKNAANPEIHRRTTAEEIWRDTEGRVDIVVAGVGTGGTITGVGEVLKQRKPSLRCVAVEPDASPVLSGGEKGPHPIQGIGAGFVPPILNTTIYDEVIRVKNDDAFEFARRAAREEGLLVGISSGAALWAARQLACRPENAGKLIVTIIPSFGERYLSTALFAHLED

SEQ ID NO: 3359 - protein, 658 aa, Haemophilus influenzae
MFKIYNNGNPIPMGYSQAVENNVQITNFALFSAAATGVELCLFAEQNQETRLPMVRTENMWHLAVTGVKTGTEYGFRIHGEFANPQKLILDPYAKAVNGKPDLTTEESRSWFLMNDHRDNAHIAPRAVIISEDFDWENDTSPNTPWAETIVYELHAKGFSQLNEKIPAALRGTYTGLAHPVNLAYLKELGVTAVELLPVNFHINEPNLQARGLQNYWGYNPLAMFAVEPKYAATNNPLAEFKAMVKAFHNAGIEVILDVVFNHSAESEQTYPTFSQRGIDDQTYYWRNDQGRYINWTGCGNMLNLSSDVGRKWVVDCLRYWVEQCHIDGFRFDLASVLGRNTPDFNSSAQLFTDIKNEPSLQNIKLIAEPWDIGHYGYQVGNFPSYFAEWNDRFRDDLCRFWLWKSGEIGAFAERFAGSSDLFKKNDRLPHTTLNFITAHDGFTLKDLVSYNQKHNEANGEENHDGRNENYSYNHGIEGSTENLAEPQKSAVENNRTFAQSGLLMSLLLANGTPMLLAGDEFGNTQYGNNNAYCQDNEITWLKWANFNEELFELTKQTIALRKQIGSLNRDQWWSDENVQWLNIAGEPMTVEDWQNQQTKALQVVLDNRWLLLINAKAEGQVFHLPNGKWKPQIGTHNVTLEEQAELSSMGFCMLNDE

SEQ ID NO: 3360 - protein, 326 aa, Saccharomyces cerevisiae
MSTDSTRYPIQIEKASNDPTLLLNHTCLRVKDPARTVKFYTEHFGMKLLSRKDFEEAKFSLYFLSFPKDDIPKNKNGEPDVFSAHGVLELTHNWGTEKNPDYKINNGNEEPHRGFGHICFSVSDINKTCEELESQGVKFKKRLSEGRQKDIAFALGPDGYWIELITYSREGQEYPKGSVGNKFNHTMIRIKNPTRSLEFYQNVLGMKLLRTSEHESAKFTLYFLGYGVPKTDSVFSCESVLELTHNWGTENDPNFHYHNGNSEPQGYGHICISCDDAGALCKEIEVKYGDKIQWSPKFNQGRMKNIAFLKDPDGYSIEVVPHGLIA

SEQ ID NO: 3361 - protein, 847 aa, Unknown
  Nocardioides sp. JS614
MRVERPSPAVVALWVAMTVLVFAHLMVGYGTAFDVTYLAAVWLAPVVAWIGTARRPPGARLVPGLIAAGLTASAVGDLVWDLYAWSGLEPDVSLADIPYFLSYLGIGGAVAIVMFGRRGLPSTDVESALDALTIVVVSMMVFWTVSIREIMADDTMPRLTQAVLAAYPIADAVLLALLLRAISVRHSRQRLGFGLALGAVCWLISDVAYYGLDVTEPVAGSNDIGWMVGAILMSTATLRPVSPPTPETAEPPSHRAPLGRLGIAIVPLLVPPAIMIVNQAIGRSPHVVEVSVGMTALVAIAFVRMGRMLQWEVVARRELAAARDVALEASRSKSTFLATMSHEIRTPMNGVIGLTGLLEATDLDERQRQYAEGVSSAANALMTIINDILDFSKVEAGRLDLETIDFDLVQVVEEVAELIAEPAQSKGLELLAYCSPELPTCLRGDPSRLRQVLLNLASNAVKFTARGEVLVRASLEASLQDGPEAGAEAGVVVRFEVTDTGIGVEEADRERLFEPFSQADSSTTRRYGGTGLGLAISEHLVTAMGGQIGVDSRPGLGSTFWFTLPLGLAEDLSASTPRGTEDIAGLRVLVVDDNQTNRMILHDQLTAWGLHVDLAEDGPHALAALADAHRTHHPFDLAVLDLCMPDMDGLELAHRISSDPTLTGLAMALLTSGGEISQTDARAVGITASMTKPVQLSRLRATLQDIIGTRRPHTPLHIPTTPAGRGRILVVEDGEINQLVAVGILEHLGYTTDVADNGVTALSAMGRTRYDAVLMDVQMPGMDGYQATREIRRLEGDVHHTPIIAMTASATNDDRDRCLAAGMDDYISKPVNPHTLETVLSRWATST

SEQ ID NO: 3362 - protein, 504 aa, Oryza sativa
MAAAAARSGAHPPSFASSLGRCRVLPVVVVRRPGGAARPSPLLAPARCAAAVGTAAPKVEGGGRRSSEQGQLAVAPARLVDELVEEALVWSSQHGLVVGDKNHPRSGKAPGVGLLHAPFALLPMSFSKVYWDQAVELAPLFNELVDRVSLDGDFLQETLARTKEVDSFTGRLLDIHAKMMKLNKKEDVRLGLTRSDYMIDGATDQLLQVELNTISTSSNGLACGVCELHRNLIRQHERELGLDPESVVGNTAIAQHAEALAGAWAEFNNQRFSVVLVVVQPEERDGLPVAVVYFRAGYTPNDYPSEAEWRARLLIECSSAIKCPSIAHHLVGTKKIQQELAKENVLERFLDNKADIEKVRKCFAGLWSLENDSIVMSAIESPELFVLKPQREGGGNNIYGDNLRETLISLKKDGSNELAAYILMQRIFPPASLCYLVRDGTCIRENAVSEFGIFGAYLRNKDRVIINDQCGYLMRTKAASLNEGGVTRDAGREFAVKDRESAWG

SEQ ID NO: 3363 - protein, 182 aa, Triticum aestivum
  misc_feature (78)..(78): Xaa can be any naturally occurring amino acid
MAPTVMASSATSVAPFQGLKSTAGLPVSRRSNGASLGSVSNGGRIRCMQVWPIEGIKKFETLSYLPPLSTEALLKQVXHYLIRSKWVPLPLSPARPESSFREHNAVSRGTYDGPLLAQWWERLPYGWEWPPNAHIGWNQTGGGDGRFHERDVSPLNMRYVSREIYSAHVPIQTLGESNGRVH

SEQ ID NO: 3364 - protein, 161 aa, Musa balbisiana
SSMMVSSAATVSRASPAQSSMVAPFTGLKSTSAFPITRKANADLSHLPSNGGRVQCMKVWPIEGKKKFETLSYLPTLVDEALVKQIEYLLRSRWIPCLEFSHEGFVWRENHRSPGYYDGRYWTMWKLPMFGCTDAVQVVKELEECKKEYPKAFIRIIGFDN

SEQ ID NO: 3365 - protein, 322 aa, Vibrio fischeri
MTKIYEDNSQTIGNTPLVRLNRVSKGNVLAKVEARNPSFSVKCRIGANMIWEAEKAGTLKEGIELVEPTSGNTGIALAFVAAARGYKLTLTMPASMSLERRKLLKALGANLVLTEAPKGMGGAIAKAEEIVASDPSKYLLLQQFNNPANPAIHEKTTGPEIWEATEGNVDVFVAGVGTGGTLTGTSRYLKHTQNKAVLSVAVEPAESPVIAQALAGEEIKPAPHKIQGIGAGFIPGNLDLTLIDRVEAVTSEDAIEMARRLMEEEGILAGISSGAAVVAANRIAELPEFANKQIVVVLPSSGERYLSTALFAGLFTEQENEQ

SEQ ID NO: 3366 - protein, 121 aa, Listeria monocytogenes
MSGLTKIEIITRPNRFHLFQKELAKIGVSGLTVTKALGTGLEKGFIELYRGTKKESNIHERMKIEIVVSTVPVEDVLRVVKETLRTGEPGDGKVFIYPLAEVVKISTGETGIDALQDKPSK

SEQ ID NO: 3367 - protein, 313 aa, Xanthomonas oryzae
MELGMVGLGRMGANMAERLINGGHRVHGYDPGANARTSAQAKGIVTADALAALVSALPTPRVVWLMVPAGKIVDDTLAQLLPLLQTGDIVIDGGNSYYKDSQRRAALLQASGIAFVDCGTSGGVWGLQEGYSLMVGGDEAAVTALHPILATLAPAPDKGWGRVGPSGAGHFTKMVHNGIEYGMMQAYAEGFALMQHKTDFALDLHQVAEIWRDGSVVRSWLLDLTADALTHNPTMAGIAPFVADSGEGRWTVAEAIDLEVSAPVITLSLMERLRSRDKDSFTDKLLAAMRNQFGGHAVMTTTSAVPTIGSKDA

SEQ ID NO: 3368 - protein, 224 aa, Thermosynechococcus elongatus
MGFFGFKNKKLTMPSPSEALPGRAEPMPVPKAHLVNGHPLTPPYPEGMELAMFGMGCFWGAERKFWQVPGVYVTAVGYAGGYTPNPTYEEVCTGMTGHNEVVRVVFDPQIVSYEELLKVFWENHDPTQGMRQGNDVGTQYRSGIYYYSPEQKALAEASRDRYQAALTAAGYGTITTEILPAPEFYFAEPYHQQYLQRNVNGYCGLGGTKVPYELMGATPAFRGD

SEQ ID NO: 3369 - protein, 193 aa, Bradyrhizobium japonicum
MNVVPRDLMTEIPVSPADFRGAMRHLTGGVSVITAGRGKDISGMTVTSVTSLSVEPPTLLVSINRDASSFPLIRRHGAFGVNILNADQLDVAERFAGKGGLKGADRFAGARWVTAVSGVPLLVGALSAFDCEVEEIVERHSHGIVIGRVRDVRSSTRTAALAYWHGQYVAVDQDEDAARLAEVSLPARTRRGV

SEQ ID NO: 3370 - protein, 386 aa, Mycobacterium smegmatis
MTSLQPDGGAGEVRQIEAQAAPTRFARGWHCLGLIRELGDGKPHAINAFGGKLVVFRGEDGKINVLDSYCRHMGGDLSDGEVKGNEIACPFHDWRWGGDGRCKQIPYSRRVPKLARTATWPTLEQDGMLFVWNDPEKNPPPPEVTIPRIEGVGTDRWTDWHWYTTVVHTNCREIIDNVVDMAHFFYIHGGLPTGFKNVFEGHIATQYYKSEARPDLGSGEGAKILGTTSVASYYGPSFMIDDLTYHYEHGDQRTVLLNCHYPIDANSFVLQYGITVEMSDAVPHDVATQMAVALGDFVKMGFEQDVAIWKRKARIDNPLLCEEDGPVYQLRRWYEQFYVDVADVTPDMVDRFEFEIDTTRPREAWLKEVQDNLAAGRLPRLVGVNK

SEQ ID NO: 3371 - protein, 414 aa, Thermus thermophilus
MVKVEVLGMILAGGQGSRLYPLTAKRAKPAVPFGAKYRIIDFVLNNFVNSGIYAIYVLTQYKAQSLTEHIQRYWRFGAFLEDHFILLVPAQMYRYEELGPVWYRGTADAIYQNLHLVHNHAPKAVAVFGGDHIFKMNIRHMVEYHYDTRADITIAAYPVPVAEATRFGVLQVDEEWRITEFQEKPEEPKPIPGRPDTALASMGNYIFRTEALFELLEADARDETSAHDFGKDVIPRALREGYRVYAYDFHRNPIPGQEGPNLYWRDVGTLDAYYEASMDLVKVVPEFDLFNPEWPLRTANLFSPPAKFVHETGERVGRALNSLLAGGVIVSGGTVRESVLFRRVRVNSYSLVERSVLFDDVEVGRYCRIRNAIIDKNVKIPPHTEIGYDLELDRARGFTVTPEGVVVVPKGYRF

SEQ ID NO: 3372 - protein, 407 aa, Triticum monococcum
MAAVAMADGGGKKPYVVAVAIQAINTGTFVVSKAAFDSGMYTYIFVFYRLAAATALLVPIALINCACRRSQSTTSTPAQAMSCRLLFKLFLCAFLGSAGLTLQALTKFVKKSCQEVGGFTSLLSSSLLQGKAEHLHPQVYHASLKQTSATVASAATNSMPVVTFLLALVLRMETIKLRRRSGLGKLAGVALCLAGVLVIAFYVGPSIRPLAHHPVFAHKTQSVGNGAWIRGTFLLILSCTTWSLWITLQVPLLIEYPNKLMATAMQCLFSALQSFVVAVVVEKDFTKWKLGLDIGLLAAFLGTGALMYLQAWCAEMSGPVFVVMWSPLAFIFTIFSSSFFLGEVVHLGSILGGILLVGGLYSVLWGKSNERKNMILPVMPEKSQGQGDGDGATTQEKHGETNLTSQV

SEQ ID NO: 3373 - protein, 342 aa, Exiguobacterium sibiricum
MMKKIAVIGAGSWGTALSLVLADNGHEVILYGRDQKNVDAINQNHENTQFLPGVTLPESLRATTVLSEAVEGVSHILIVTPSSAIRSVSRQLNELLTEPVVLIHASKGIEPKTHLRLSELMEQEIDASKRSAICVLTGPSHAEEVALRKPTTVTVASTDMEEAGRVQELFTNDNFRVYLNADIIGAELGGAFKNIIALAAGMADGLGYGDNAKAALITRGMVEIARLGTLFGANPMTFTGLTGMGDLIVTCTSVHSRNWRAGNAIGRGEKLETVLENMGMVVEGVRATQAAYDLAETKQCELPITTALYHVLFDGHTPAEEVQKLMRRPQKNEIEHLFTMKD

SEQ ID NO: 3374 - protein, 992 aa, Treponema denticola
MSSNLNIIIEQANAAILSRDYAFAEKILLNQLKKQKNTPDEYYQLKNLLGKLYIRSGDMKKGLEIYKELNSLNPNNSDILNNMGVIYRRLNMFNESIVILEKAKAIDSKNETTLYNLGNTYKQNGDYKHAIQCFTDVLDIKPDDALAYNHLGSVYFLCKDYPKALETYKIGLKVDPNHPFLNFNLAELYKEEKHYKEAINSYQTAMKTKPNWYEALAAIADCYVEMEELGKAIETYKMIIGSTGQSEENFTKLAKLYEKIHEDKDAEDFYKKAVSINGNFLPAVLGYANMLKAQKRYFDAYNILINNKEKYPNNKELLLSTAEVCLMLEDYAKAKEILNHLSKEIKGDKDVLKMQGKLYSVLGDTKKAELIFEHLLQLSPSEINMRAELADLYFHNDKYKEAANELIKYLNEKPQEISARLKLGKAYEQMKRYDLAKHEYNKIIKNDANNTEALAAILELNKNEGNTVEAVRLANKIVDIQTDKIENDDIGSLSKSVQLYEDAVKSYGDDGILNKNLDKLRPPQEELDISPEPDLEDLGAVNFEDDDEITLSESFEDMPDLEMPFDDLMELADDEVFDRGEDEDSLDNLVYVDAPIDDSPDIGAEYDPLELGKPGPNRNRKNDIPEEELQLQDTSSKGDVPAKETTPTKDFAPSQSKPYQSPSSESAPLQSPPYQVPPNEPASYQAQPQQQSSIPESDYPQDLSSAAKSGKPDTADMPFSAAKPDTADSFGSEDEGIEMEPELEAVPESRDASSPLSEKPADKKTSQASGSPNLDEMDLSAEDSLSNEDELNNENELIDDLPASSNVPLSEETNLSSDDEDFLDPAGTAPDSLIPSSFDDDLDTSDSVDEIVNKLSDKPYLSLLPHSLKESPRFEEELDIIEGYEIVNLFVYLRDLMDNLPSIELKDFLISNERIQMEYVINKLSGEVGLKRRMILLNVKGALKKTIDPKTSTDKTLKDVLGYLRIIASQLPDKGFASACIGKINSLIEQIE

SEQ ID NO: 3375 - protein, 114 aa, Olisthodiscus luteus
MAKTPSKKAAKAPKKAGSKRNKRVETYSSYIYKVLKQVHPDTGISKRGMSIMNSFINDIFERLAGEASRLARYNKRSTLSSREIQTAVRLMLPGELAKHAVSEGTKAVTKFTSN

SEQ ID NO: 3376 - protein, 377 aa, Exiguobacterium sibiricum
MVEEMKDMPDFEIHRDQVVTGTVVKIEDKQALIDIGYKTEAILPISEVSSLHLDDIQGALKVGDELQVKVKKITDEEVVVSKREVDALQAWEKVEAKYASGEIFEVVVKDIVKGGLVVDIGVRGFIPASLVERHYVEDFSDYIGRTIAVKVVELDQEKNRVILSHKAVVEGELNAKKKETLEHLEVGQVLEGTVQRLTDFGAFVDIGGVDGLVHISEMAHHRVERPSDIVTEGQKVEVKVLGVDRDTEKVKLSIKETQPGPWQQMEGKIEAGDIVKGRVRRIVQFGAFVELAPQVEGLLHISQIANRHIGSPSEVLEEGQEIEAKVLEVHLAEHKISLSTRVLEQEDSSNDDYSQYTDQNEGFSVADLSEKESDTKE

SEQ ID NO: 3377 - protein, 964 aa, Unknown
  Acidovorax sp. JS42
MQMPSPLPLAALENAAEFLPRHIGIDAADEAHMLSVIGEASRRALIDSIVPRSIARQRPMDLPAPATEAAALAELQAIASKNRILKSFIGQGYYGTHTPGVILRNVLENPAWYTAYTPYQAEISQGRMEALLNFQTMVCDLTAMPIANASMLDEATAAAEAMTLAKRSVKSKSDVFIVAGDAHPQTIEVIQTRAAPIGITVVVANSQEEWQAALAGDFFAALIQYPASSGWVQDWQADVDAIHAKQAAAIFVTDLLALTLLKAPGEWDADIVVGSTQRFGMPMGAGGPHAAFMACRDEFKRSLPGRLVGVSVDVHGKPAYRLALQTREQHIRREKATSNICTAQVLPAVIASMYAVYHGPEGLTRIARRVARFTAILSRGLAQLGFTSRHHGSAFDTLSLHTKDATDSIAARAVQMGANLRKAWNDYLCISLDETTTRADIELLWKIFARDGQQLPTIEAMDAAGAPALFPDTLARTSRFLAHPVFNTHHSETGMLRYIRQLSDKDLALDRTMIPLGSCTMKLNATSEMIPITWPEFANVHPFAPADQLEGYRLLDEQLRAWLCQATGYAGVSLQPNAGSQGEYAGLLAIKGYHEARGESHRKVCLIPSSAHGTNPASAQMVGMQVVVTKCDENGNVDMADLQAQCEKHSANLACVMITYPSTHGVFETQVKALCELVHRHGGRVYVDGANMNALVGVAAPGEFGGDVSHLNLHKTFCIPHGGGGPGVGPVCVVEDLVPYLPGHATGGIASKTGAVSAAPLGNAAVLPISWMYIRMMGADGLQAATETAILSANYISARLKDHYPTLYASANGHVAHECILDLRQLKDTSGVMAEDVAKRLIDYGFHAPTLSFPVPNTLMVEPTESETLFELDRFIDAMIAIRREIRQIEAGTWPQDDNPLKNAPHTAECLLVADWQHPYPRDAAAYPVAALRQNKYWSPVGRVDNVYGDRNLFCSCVPVSELG

SEQ ID NO: 3378 - protein, 405 aa, Rhodopseudomonas palustris
MNDTVLIAGAGHAGFQVAVSLRQAKYPGRIALINDEKHLPYQRPPLSKAYLKSGGDPNSLMFRPEKFFQDQAIELISDRMVSIDREGRKLLLASGTAIEYGHLVLATGARNRMLDVPNASLPDVLYLRTLDESEVLRQRMPDKKHVVVIGAGFIGLEFAATARAKGLEVDVVELAPRVMARVVTPEISSYFHDRHSGAGIRMHYGVRATEIAAEGDRVTGVVLSDGNTLPCDLVVVGVGVIPNVEIAAAAGLPTAAGIIVDQQLLTSDPHISAIGDCALFESVRFGETMRVESVQNATDQARCVAARLTGDAKPYDGYPWFWSDQGDDKLQIVGLTAGFDQVVIRGSVAERSFSAFCYKAGKLIGIESVNRAADHVFGRKILPLDKSVTPEQAADLSFDLKKAAA

SEQ ID NO: 3379 - protein, 405 aa, Arabidopsis thaliana
MALQAASLVSSAFSVRKDGKLNASASSSFKESSLFGISLSEQSKADFVSSSLRCKREQSLRNNKAIIRAQAIATSTPSVTKSSLDRKKTLRKGNVVVTGASSGLGLATAKALAETGKWHVIMACRDFLKAERAAQSAGMPKDSYTVMHLDLASLDSVRQFVDNFRRAEMPLDVLVCNAAVYQPTANQPTFTAEGFELSVGINHLGHFLLSRLLIDDLKNSDYPSKRLIIVGSITGNTNTLAGNVPPKANLGDLRGLAGGLNGLNSSAMIDGGDFVGAKAYKDSKVCNMLTMQEFHRRFHEDTGITFASLYPGCIATTGLFREHIPLFRTLFPPFQKYITKGYVSESEAGKRLAQVVADPSLTKSGVYWSWNKTSASFENQLSQEASDVEKARRVWEVSEKLVGLA

SEQ ID NO: 3380 - protein, 103 aa, Brassica napus
  misc_feature (12)..(12): Xaa can be any naturally occurring amino acid
  misc_feature (15)..(15): Xaa can be any naturally occurring amino acid
  misc_feature (22)..(22): Xaa can be any naturally occurring amino acid
  misc_feature (29)..(29): Xaa can be any naturally occurring amino acid
  misc_feature (34)..(34): Xaa can be any naturally occurring amino acid
  misc_feature (39)..(39): Xaa can be any naturally occurring amino acid
  misc_feature (49)..(49): Xaa can be any naturally occurring amino acid
  misc_feature (54)..(54): Xaa can be any naturally occurring amino acid
  misc_feature (58)..(58): Xaa can be any naturally occurring amino acid
  misc_feature (61)..(61): Xaa can be any naturally occurring amino acid
  misc_feature (69)..(69): Xaa can be any naturally occurring amino acid
  misc_feature (74)..(74): Xaa can be any naturally occurring amino acid
MASSMLSSAAVXTSXPAQVTMXAPFTGLXKTSAXFPVTXKANNDITSIXSNGGXVSCXKVXPPVGKKKXETPPXPPLTTRSLNCVEAHYLPLIFAISATPLSR

SEQ ID NO: 3381 - protein, 712 aa, Oryza sativa
MQYRTQQAMLPAVKLSPGPVAFAGTNLRSRSASVSSVSSLKPSKFVVSSFRPLYLAPLDGPRAAGQKAQRQPLEFRCAASAADDKESKTEVVPVRSEAAQKLKISIYFATWWALNVIFNIYNKKVLNAFPYPWLTSTLSLACGSAMMLVSWATRLVEAPKTDLDFWKVLFPVAVAHTIGHVAATVSMSKVAVSFTHIIKSAEPAFSVLVSRFLLGETFPVPVYLSLLPIIGGCALAAVTELNFNMVGFMGAMISNLAFVFRNIFSKRGMKGKSVSGMNYYACLSIMSLVILTPFAIAMEGPQMWAAGWQKALAEVGPNVVWWVAAQSVFYHLYNQVSYMSLDEISPLTFSIGNTMKRISVIVSSIIIFHTPVRPVNALGAAIAILGTFLYSQSILVHSFAIGGKATLPRTREAKRRAIELAMYAMTPRCHLPPPCRAASTTPATSTALSTPPPSRAGPDELRSTWAHRAWTLAGSAAVLSSLSTSATLAAADADANGAAAAFAAPLAAALAAYSLADLATGVYHWLVDNYGDADTPVLGPQIAAFQGHHRHPSTITRREPCNNLHALARAVALALPPAGAALAAAGAPASAHAFAAVFAACVVLSQQFHAWAHGNPRRLPPGVGAMQRAGVLVSRAQHGAHHRAPYDNNYCIVSGMWNATLDRHRVFEAMEMVVFLRTGVRPRSWDEPDAAWTEDYDDTAAVAGGDTSLDTQ

SEQ ID NO: 3382 - protein, 340 aa, Triticum aestivum
  misc_feature (106)..(106): Xaa can be any naturally occurring amino acid
MPPNLECRMYEPRFPEVDAAVMIQVKHIADMGAYVSLLEYNNIEGMILFSELSRRRIRSISSLIKVGRQEPSMVLRVDRDKGYIDLSKRRVSEEEAATCEDRYNKXSKLVHSIMRHAADTLGVDLEPLYQRIGWPLYRRYGHAFEAFKLIVTDPDAVLDVLTYEETVVGPDGVEVTNTVPAVTPEVKDALVKNIRRRMTPQPLKIRADVEMKCFQFDGVLHIKEAMRKAEAAGNADCPVKIKLVAPPLYVLTTQTLDKDQGIAVLTNATKVCAEAIEKHKGKLVVKEAARAVRERDDKLFADTIEKLKLAGEEVDGDDDSEEEDNGMGDVDFTKAGAGAD

SEQ ID NO: 3383 - protein, 569 aa, Debaryomyces hansenii
MMTDNKSDSDSIEIHLAKEMTNIPRTSSTPTPVVGIPGGTKPQTIFIHKLYDMLEDGNISHLIWWTENSESFGLLPGEEFSKVLAQYFKHTNIASFIRQLNMYGFHKVNDAGQSENGGDNNVARWEFRHLANHFRKGDIESLKLIKRRSSKNINHTREAAKTAGGTEDDIHEAVNEDDTKGIHTGDQHDVRAHEQQQHYHQTLQLQQQDQIPQPPSAIQHHHLTQIDGAPSPSVLPPLSKLPQIYKLSSDKSLETRLNEATSNLGTLRHEHHQLQTQFDLVFNEQKKSQFDLIQLVEIMQRHAVKSEDDKKLDYELTNFKQVLLNKFNNLHVLLSQAQGHQTPTIHPQHLSHAHPSMKPQYNSSHLHYSYSQSSADSNTDSSNIETQKLSKNGSKQPVSDGPMAKDVQPPYTYAEKFLEKNNIPTSLHSPHTSEVRRGYQQYPFPNMNSDPRASAPSTPDQFGQSVPPRVSLPSTNTYEQRPQSIPTPNSSLSLSRLALSNSSVSSGSSYSSNISVETPPKLVPLPSVSELDKLIKNGGGGLPLYRMLNSYGPMKRKNSTEEETRKRQA

SEQ ID NO: 3384 - protein, 276 aa, Glycine max
VLLMVFESRLMPLFRQLHCHSKWEGFLLKGGKEARRSNAILHKVITSVMPDTVGDKLIGLVTSRDEIPDLLKLDDVIDLVVPRGSNKLVSQIKESTKIPVLGHADGICHVYVDKSANFDMAKQIVRDAKTDYPAACNAMETLLIHKDLSNNGGLNELVLELQREGVKMFGGPRASGLLNIAETNTFHHEYSSLACTVEIVEDVFAAIDHINQHGSAHTECIVTEDSEVAETFLSQVDSAAVFHNASTRFCDGARFGLGAEVGISTSRIHARGPVGV

SEQ ID NO: 3385 - protein, 984 aa, Burkholderia mallei
MTSSAFDSSRQGCGSGQCACRRAAQMRRADPFDDTDYGTPTRHADTDVTLDIDGRAVTVPAGTSVMRAAIEAGINVPKLCATDSLEPFGSCRLCLVEIEGRRGYPASCTTPVEAGMKVRTQSDRLQALRRNVMELYISDHPLDCLTCAANGDCELQDMAGAVGLREVRYGFDGKNHLSDAKDESNPYFSYDPSKCIVCNRCVRACEETQGTFALTIASRGFESRVAASAGEAFMDSECVSCGACVAACPTATLIEKSVARLGQPEHEIVTTCAYCGVGCALKAEMKGEQVVRMTPHKNGLANEGHACVKGRFAWGYATHKDRITKPMIREKITDAWREVSWDEAIGYAAARFRRIQDEHGRDSIGGITSSRCTNEETYLVQKLVRAAFGNNNVDTCARVCHSPTGYGLKTTLGESAGTQTFASVGSADVIVVIGANPTDGHPVFGSRLKRRVREGAQLIVVDPRRIDLVDGPHVKAVHHLQLRPGTNVALVNALAHVIVTEGLVDEAFVDERCEPQAFDVWRAFAARPENSPEATADITGVPADAVRAAARLYATGGRAAIFYGLGVTEHAQGSTMVMGIANLAMATGNLGIEGAGVNPLRGQNNVQGSCDMGSFPHELPGYRHIGDAAVRARFDEAWSTTLQPEPGLRIPNMFDAALDGSFKGLYCQGEDIVQSDPNTQHVAAALASLDCLVVQDIFLNETAKYAHVFLPGATFLEKDGTFTNAERRISRVRRAMRPLSGYADWEVTLMLSRALGYDMHYAHPSEIMDEIARLTPTFAGVSYALLDELGSVQWPCNDAAPQGTPTMHVDQFVRGKGKFVITQYIASPEKVTPRYPLILTTGRILSQYNVGAQTRRTENVRWHGEDRLEIHPHDANDRGIRTGDWVGVASRAGQTVLRALVTERMQPGVVYTTFHFPESGANVITTDSSDWATNCPEYKVTAVQVAPVAQPSEWQRAYTRFRAEQLALLEQRTAERAPAIATGK

SEQ ID NO: 3386 - protein, 471 aa, Unknown
  Vibrio sp. Ex25
MILVWFRRDLRTLDHTALKAALDSGQPVVACFIATPEQWREHHMAPMQADLIARRLEYLNDELESLNVPFLYKEVPSFSDCTEVISEWAKTLEATSVMANIHYEVNERELDAQVSEALASHDIDFELFHDKCVHPPTTVLNKQGEYFKVFTPFKRAWLTQFQMPAVTKPQEQAPLSSKLLEQLEPIRFSSDFTFSYPRESSEDWFASTNDVLKQLREFARERSDAYKEERDFPAIDGTSQLSPYLAIGALSPRQCIARLYAENQQNDLTEGKATWLSEIIWREFYQHLLVFEPKLVKGKGFIDWEDKIQWSYDEQAFERWKAGATGYPIVDAAMRQLNQTGWMHNRLRMVVASFLTKDLHIDWRWGEAYFMSKLVDGDFAANNGGWQWSASTGCDGQPYFRIFNPISQGEKFDSDGQFVRHWVPEIKSVPNKYIHKPWTWEGFSLLEYHKPMVDHKTEREITLRLFKSAKE

SEQ ID NO: 3387 - protein, 280 aa, Lactuca sativa
GVLLMVFESRPDALVQIASLAIRSGNGLLLKGGKEAKRSNAILHKVITSALPETVGTKLIGLLTSREEIPDLLRLDDVIDLVIPRGSNKLVSQIKNSTKIPVLGHSDGICHVYVDKAANLEMAKKIVLDAKTDYPAACNAMETLLVHKDLTQNGGLQELVKELEQEGVTLFSGPRVNGLVHFTKANTFHYEYNSKACTIEVVNNVDEAIEHIPSYGSSPPECIVTEDPKVAEHFLSRVDSAAVFHNASTRFCDGARFGLGAEGGISTSKIPARGPVGVEG

SEQ ID NO: 3388 - protein, 455 aa, Triticum aestivum
PAGLGTPHGANPCFEPTAGHHLFDGDGMVHAIRIRNGAAESYTCRFTETARLSQERAVGKPVFPKTIGELHGHSGIARLALFYARGACGLVDPSHGTGVANAGLVYFNGRLLAMSEDDLPYQVRVTADGDLETVGRYDFDGQLDCAMIAHPKLDPVSGELFALSYDVIKKPYLKYFYFHADGTKSADVEIELDQPTMIHDFAITENFVVVPDHQMVFKLAEMFRGGSPVMLDKEKTSRFGVLPKYAKESSEMMWVDVPDCFCFHLWNSWEEPETDEVVVIGSCMTPADSIFNDTDDHLESVLTEIRLNTRTGESTRRAILPLESQVNLEVGMVNRNMLGRKTRYAYLAVAEPWPKVSGFAKVDLVTGELTKFEYGEGRFGGEPCFVPMDGEHARPGAEDDGYVLSFVRDEAAGTSELLVVNAADMRLEATVQLPPRVPYGFHGTFIGAADLDAQH

SEQ ID NO: 3389 - protein, 716 aa, Triticum aestivum
MAGADPNRSFMKDVKRIIIKVGTAVITRNDGRLALGRIGALCEQVKDLNAQGYEVIMVTSGAVGVGRQRLRYRKLVNSSFADLQKPQMELDGKACAAVGQSGLMALYDMLFTQLDVSSSQLLVTDSDFDNSNFRERLRETVESLLELRVIPIFNENDAISTRKAPYEDSSGIFWDNDSLAGLLALELKADLLVLLSDVDGLYSGPPSEPSSKLIHTYIKEKHYHEITFGDKSRVGRGGMTAKVQAAVWASTGGVPVVITSGCASQSLVKVLRGEKIGTLFHKNASLWEPSKETSVREMAVAARDCSRRLQNLSSEERKKILLDVADALEANEDLIRSENEADLAAAHEAGYESALVSRLTLKPGKIASLAKSVRTLANMEDPINEILKRTEVADGLVLEKTSCPLGVLLIIFESRPDALVQIASLAIRSGNGLLLKGGKEAMRSNAILHKVITNAIPDNVGEKLIGLITTRDEIADLLKHDDVIDLVIPRGSNKLVAQIKSSTKIPVLGHADGVCHVYIDKSADMDMAKRIVMDAKIDYPAACNAMETLLVHKDLMKTPELNDILVALKTAGVNLYCGPVAHKVLGYPKADSLHLEYSSMACTVEIVDDVQSAIDHIHRYGSAHTDCVVTTDDKVAETFLRQVDSAAVLYNASTRFSDGARFGLGAEVGISTGRIHARGPVGVEGLLTTRWLLRGKGQVVNGDKDVEYTHKSLPLQ

SEQ ID NO: 3390 - protein, 491 aa, Haemophilus influenzae
MDSVELLMNVTPNETRIALVETGMLREVHIERQAKRGIVGNIYKGRVTRVLPGMQSAFVDIGLEKAAFLHAADIVSHTECVDENEQKQFKVKSISELVREGQDIVVQVVKDPLGTKGARLTTDITLPSRYLVFMPENSHVGVSQRIESEEERTRLKALVEPFCDELGGFIIRTATEGASEEELRQDAEFLKRLWRKVLERKSKYPTKSKIYGEPALPQRILRDFIGTNLEKIRIDSKLCFGEVKEFTDEFMPELSDKLVLYSGNQPIFDVYGVENAIQTALDKRVNLKSGGYLIIEQTEAMTTIDINTGAFVGHRNLEETIFNTNIEATKAIAQQLQLRNLGGIIIIDFIDMQTDEHRNRVLQSLCDALSKDRMKTNVNGFTQLGLVEMTRKRTRESLEHVLCDECPTCHGRGRVKTVETVCYEIMREIIRVYHLFSSEQFVVYASPAVSEYLINEESHGLLPEVEMFIGKRVKVKTEQFYNQEQFDVVVM

SEQ ID NO: 3391 - protein, 218 aa, Oryza sativa
MQQPSVGIVVPNACSHPRNDAVPRAGSSRSRRSSLHLAGRHSHRCHARALCAAPDLHSREAIVSAKDNTNQDAKLRARKFFELEMSVSDCDIDPYGVVNNAVYANYVERAREELAAILGVSARTVACTGKALAISEQNLNYLAPLKRGAKFVVKVTLHIKGVRIYAKQFIETLPDRKLVLESTAIIVCLNGEYRPTRVFPELSSKLLDFFSPQESCSD

SEQ ID NO: 3392 - protein, 466 aa, Bifidobacterium longum
MAAAGTPKDDTGLERKMESRHLTMISLGGVIGTGLFVSSGYAIHQAGPLGAILAYAAGSLLVYCVMVSLGELSVAMPYAGSFHMYAKRFIGPGTAFTIAILYWLNWAVALASEFTAAGLLMQRWFPHSPSWVWSAVFIVVVFALNIMSVRLYGEAEFWFASIKVFAIIAFIVIGLLAIFGAIPIAGHDSAPLLGNFVAGGWFPSGIAPIFSTLLTVVFAFSGTEVVGVAAGETKDPSRAIPKAVHTTVLRLAIFFIGSILVMAALIPWHQAGVDTSPFVLVFQSIGMPFAGDIMNFVVLTAVLSAANSGLYVCSRMVWSLAKERLIPERFARTNFRGVPVWAVLFSMAGSLLALLSSVIAASTVYLVLVAVSGLATLVVWFSVCVCHIRFRREWARDGHSADELGYRAPGFPVLPWLAIVMCIGALVLVVLDDTQRSTLYCMIPFVACCYAAYYALERQRKRENNA

SEQ ID NO: 3393 - protein, 206 aa, Leptospira interrogans
MTDKLIGFYDPVRMKAERKTSETEIKLEMNLRGTGQYQFDTEIPFFEHMLSHISKHGLIDLNLWLRGDIEIDCHHSVEDTAILMGTTIHKQLGDKAGIFRYGHFTLTMDEVLTTVAVDLGGRYFFKYTGPELTGKFGIYDAELSLEFLQKLALNAKMNLHVVVHYGDNKHHVHESIFKALGKALRMAIAQDSAAAGAIPSTKGVLE

SEQ ID NO: 3394 - protein, 460 aa, Kineococcus radiotolerans
MRDDGAMRYAETVVDLVGGTPLVKLNRVTEGLACTVLAKVEYLNPGGSVKDRIATRMIEAAEAEGLLKPGGTIVEPTSGNTGVGLALVAQQRGYKCVFVCPDKVGADKRNVLKAYGAEVVVCPTAVPPEDPQSYYSVSDRLVREIEGAWKPNQYSNVHGPRSHYETTGPEIWADTEGRITHFVTGVGTGGTITGTGRYLKEQGPVKVIGADPEGSVYSGGTGRPYLVEGVGEDFWPTAYDPSIPDEIIAVSDADSFEMTRRLAREEGLLVGGSCGMAVVAALRAAKDLGPDDVVVVLLPDGGRGYLGKIFNDDWMASYGFLDSGARGTVGEVLRAKTTGLPALVHTHPTETVHDVIEIMREYGVSQLPVVGAEPPVMAGEIAGAVNERALLDALFTGRAKMSDAVSAHMGPALPLVGAGQSVEDVRSVFSGADAAVVVEDGKPTGVITRHDLLAYLAISH

SEQ ID NO: 3395 - protein, 183 aa, Unknown
  Nocardioides sp. JS614
MHASDVENDLVNVLFTEEQIQQRLAELAKDIEADYEGKDLLIVGILRGAVMVMADLARSFTRHLEMDWMAVSSYGSGTKSSGVVRILKDLDTDISGRHVVIVDEIIDTGLTLSWLTSNLSSRSPASVEICTLLRKPDALTMPVEVKYVGWDIPNEFVVGYGLDYRERYRNLRDIGTLAPHVYS

SEQ ID NO: 3396 - protein, 161 aa, Musa balbisiana
SSMMVSSAATVSRASPAQSSMVAPFTGLKSTSAFPITRKANADLSHLPSNGGRVQCMKVWPIEGKKRFETLSYLPTLVDEALVKQIEYLLRSRWIPCLEFSHEGFVWRENHRSPGYYDGRYWTMWKLPMFGCTDAVQVVKELEECKKEYPKAFIRIIGFDN

SEQ ID NO: 3397 - protein, 391 aa, Sulfolobus shibatae
DLDTLEALSQPERVIQVKIQIRGSDGKLKTFMGWRSQHNSALGPYKGGVRYSPNVTQDEVIALSMIMTWKNSLLLLPYGGGKGGIRVDPKKLTLKELEDLSRKYVQLIHNYLGSDVDIPAPDINTNPQTMAWFLDEYIKITGEVDFAVFTGKPSELGGIGVRLYSTGLGVATIAREAANKFIGGIEGSRVIIQGFGNVGSFTAKFLNEMGAKIIGVSDIGGGVISDDGIDVNKALEVVQSTGSVVNYPEGKKVTNEELLTSDCDILIPAAVENVINKFNAPKVKAKLIVEGANGPLAADADEIIKQRGIVVIPDILANAGGVVGSYVEWANNKSGGIISDEEAKKLIIDRMTNAFNALYEFHKRKFADQDLRTVAMALRVDRVVGMKARAI

SEQ ID NO: 3398 - protein, 390 aa, Xylella fastidiosa
KVGALPIIGAPSLTTSLQRWAETGRITWRQGTFEDSWLQEDIWLVIAATDQPEVNHAAARAAHAQRLFVNVVDDIALSNVQVPAVVERGPLRIAISSGGGAPMVARYLRQQLESLIDDSWGRLTTLFAQRRDTIRARYPNIEARRRFFETQLAGPLQRLLRKQRHAEAEAVLEAALAETPLTESGSVTLVGAGAGDAGLLTLNALRALNEADIILYDRLVSDTVLQMARRDAEQIEVGKSATGHSVRQEDIHTLMLQHAHAGQRVVRLKGGDPFVFGRGGEELEFLRTHGIPYEVIPGITAALACAAYAGIPLTHRDHAQSLCLITAHCQSSLDTLDWAALAQERQTLTFYMGVAGLPTIQQRLCEAGRAETTPFALIENGARAQQRVLT

SEQ ID NO: 3399 - protein, 161 aa, Musa balbisiana
SSMMVSSAATFTRVSPAQSSMVAPFTGLKSASAFPVTRKPNADLSHLPSNGGRVQCMKVWPIEGLKKFETLSYLPTLKDEALLKQIEYLLRSRWIPCLEFSHEGFVWRENHRSPGYYDGRYWTMWKLPMFGCTDAVQVVKELEECKKEYPKAFIRIIGFDN

SEQ ID NO: 3400 - protein, 520 aa, Listeria monocytogenes
MTKFSEFGLDEKIVKSVNRMGFEEATPIQEKTIPLGLEGKDLIGQAQTGTGKTAAFGLPMIHKIDQKSNNVQALIIAPTRELAIQVSEELYKLSYDKHVRVLAVYGGSDISRQIRSLKKNPQIVVGTPGRILDHINRRTLKLDHVETLVLDEADEMLNMGFIDDIETILKEVPAERQTLLFSATMPDPIRRIGERFMHSPELIRIKAKEMTALLIEQFFVKVHEKEKFDVLSRLLDVQAPELAIVFGRTKRRVDELSRALDMRGYVAEGIHGDLTQAKRMSVLRKFKEGKIDVLVATDVAARGLDISGVTHVYNYDIPQDPESYVHRIGRTGRAGKEGMAITFVQPREMGYLRIVEETTKKRMQPLQAPTWDEAFAGQLRVATEKIQEAITEENLADYKTFANELLEKYDATDIAAAMLKMLAKEPDKTPVHITEERPLPSRGGGGYKGKNGKGGKGGGYRGGSGKGGSYRDRNNSGKGRRSGGGSGGGSGSGGGGNRDRRGGGEQRSGGNKGNYSQKSK

SEQ ID NO: 3401 - protein, 415 aa, Carboxydothermus hydrogenoformans
MDEVLNLAKKAKEASKKLAQLSTEQKNRALLKIAQYLEENMEKILTENQKDLAEAKKGGLSPAFIERLTLNEKRILDMAEGVRQVAKLPDPVGEVLGMTRRPNGLVIGQVRVPLGVVGIIYESRPNVTVDAAALCLKAGNAVILRGGKEAFNSNLALVTLMEEALRSEEIPEGAVGMIKTTSRDAANYLMRLNGYLDVLIPRGGAGLIKTVVENSTVPVIETGVGNCHVYVEEDADLEMAERIIINAKCQRPAVCNAMETLLVHEKIAPVFLPQIGKALKENGVEIRGCEVTRRYIPDALPATEEDYYTEFLDLILAVRVVRDLDEAIAHITKYGSGHSEAIVTRDYFKARRFTEEVDAAAVYVNASTRFTDGFEFGFGAEIGISTQKLHARGPMGLKELTTTKYVIYGTGQIRG

SEQ ID NO: 3402 - protein, 161 aa, Musa balbisiana
SSMMVSSAATFTRVSPAQSSMVAPFTGLKSASAFPVTRKPNADLSHLPSNGGRVQCMKVWPIEGLKKFETLSYLPTLKDEALLKQIEYLLRSKWIPCLEFCPKGFVWRENHRSPGYYDGRYWTMWKLPMFGCTDAVQVAKELEECKKEYPDAFIRIIGFDN

SEQ ID NO: 3403 - protein, 140 aa, Oryza sativa
MAAAAAAAKRKPVFVKVDQLKPGTGGHTLVAKVLSSKTVVQKGRAAAGAGPAARPTRIAECLIGDETGCILFTARNEQVDLMKADSTVIIRNAKIDMFKGSMRLAVDKWGRIEVTEPASFNVKEDNNLSLVEYELVNVEG

SEQ ID NO: 3404 - protein, 829 aa, Vibrio fischeri
MKMTRRAFVKANAAASAAAVAGVTLPASATNLIVSSDQTKIKWDKAPCRFCGTGCSVLVGTQNGRVVATQGDPEAPVNKGLNCIKGYFLSKIMYGKDRVQTPMLRMKDGQYNKDGDFAPVSWDVALDTMAEKWKAALKKHGPTGVGMFGSGQWTVMEGYAAVKLMKAGFRSNNIDPNARHCMASAVGAFMRTFGIDEPMGCYDDFENADSFVLWGSNMAEMHPVLWTRISDRRLSHPHVKVNVLSTYYHRSFELADKGYIFEPQSDLAIANFIANYIIQNNAVNWDFVNKHTNFKQATTDIGYGLRDDDPLQMEAANPNSGAMSSISFEEYKKSVAPYTAQKASEMSGVSEEDLITLAKQYADPKTKVMSLWTMGMNQHTRGVWMNSLVYNIHLLTGKIATPGNSPFSLTGQPSACGTAREVGTFSHRLPADMVVANPKHRAISEKIWKLPEGTLNGKPGAHAVVQDRMLKDGKINAYWVMCNNNMQAGPNINTERLPGYRNPENFIVCSDPYPTATAQAADLILPTAMWVEKEGAYGNAERRTQAWYQQVQAKGEAKSDLWQIMEFSKRFKVEEVWGEELVAKAPEYRGKTMYDILFKNGQVDAFPLSEAQELNDDAKAQGFYVQKGLFEEYASFGRGHGHDLAPYDTYHTVRGLRWPVVDGKETLWRFKEGSDPYAKKGSDWDFYGKPDGKALIISAPYEAPPEVPNDEFDMWLCTGRVLEHWHTGTMTRRVPELYKAVPDALCYIHPADAKKRNLRRGDEVLISNKRGEVRVRVETRGRNRPPEGLVFVPFFDARILINKLILDATDPLSKQTDFKKCPVKITKIA

SEQ ID NO: 3405 - protein, 290 aa, Oryza sativa
MAAGRAAAVAACASPAVPRRWAKSDNRRLLHVVYRVGDIDRTIKFYTECLGMKLLRKRDIPEEKYTNAFLGYGAEDNHFVVELTYNYGVDKYDIGAGFGHFGIAVDDVAKTVELIRAKGGKVTREPGPVKGGKTVIAFVEDPDGYKFEILERPGTPEPLCQVMLRVGNLDRAISFYEKACGMELLRKRDNPEYKYTVAMMGYGPEDKNAVLELTYNYGVTEYDKGNAYAQIAIGTDDVYKTAEVVKLFGGQVVREPGPLPGINTKITSILDPDGWKSVFVDNIDFAKELE

SEQ ID NO: 3406 - protein, 658 aa, Mycobacterium smegmatis
MCGLLALVTDPSRADQVEASPGTGSQLVSAVAEAAHLMRHRGPDEPGTWPDPDAENPHPEVVLGFNRLSIIDIAHSHQPLRWGPADAPGRYLLVFNGEIYNYLELREQLRNEFGAQFHTDGDSEAIVAAYHHWGVDALHRLRGMFAFAIWDTEKRELFCARDPFGIKPLFMATGPGGTAVGSEKKCLLSLADRLGLDLGIDQRAVQHYTVLQYVPEPETLHRGVRRLESGSYARIRPGAAPEVTRYFVPKFTAVNFAAGSEQARYDEITAALEDSVAKHMRADVTVGAFLSGGIDSTAIAALAMRHNPRLITFTTGFEREGFSEIDVAVASAEAIGARHVAKVVSQAEFVEALPEIVWYLDEPVADPALVPLFFIAREARKHVKVVLSGEGADELFGGYTIYREPLSLRPFDYLPRPLRKSLGKASKPLPEGMRGKSLLHRGSLTLEERYYGNARSFSDDQLRAVLPQFRQEWTHTDVTAPVYAASQGWDPVARMQHIDLFTWLRGDILVKADKMTMANSLELRVPFLDPEVFAVASRLPVDQKITRATTKYALRRALEPIVPAHVLNRAKLGFPVPIRHWLRSGELMDWAYALIGSSGAGEHVDLAAVRTMLDEHRNGVSDHSRRLWTVLIFMLWHAIFVEHSVTPQIKEPHYPVQL

SEQ ID NO: 3407 - protein, 411 aa, Unknown
  Rhodococcus sp. RHA1
MSSTRTFVVVGGGLAGAKTAEALRDKDFDGSIVLLSEEEHLPYERPPLSKEHFAGKKALGDFTVHHGDWYRDHHVDLRLGTTATALDLTAHTVTLPDGSTLGYDKLALATGSRSRRPPISGSDAEGVHYLRTIDESDSLIDAVAGGGRLVVIGAGWIGLEVGASAREKGVDVTVVEAAEVPLLGSLGPEIGSVFAELHREHGVQLHLGATVEEIVVDDGKATGVRLSDGTVLPADAVLVAVGAAPNIEIAERAGLDVDGGVLVDAGLQTSDPDVVAVGDIAAQWHPQLGTRIRVEHWANALNQPAVAAATMLGHAAEYGNLPYFFTDQFDLGMEYVGYAPHDSYDRVVVRGDFAAREFVAFWLDADNHVLAGMNVNIWDVTDQIKQLVSSSAPVDPDRLADPEVPLTDLSG

SEQ ID NO: 3408 - protein, 343 aa, Saussurea medusa
MALLVSSWSNGVQSVPKDYVMPPERRPGDFVSACNEIPVIDLQENPKIDRSDIVQQILKACQEFGLFQVINHGVSEKMMEDMRVLYHEFFNMPVDDKLRGYFEPWSTTGCSLYTSGVNYAKEDVHYWKDTLRHPCHPLEEHTPSWPEKPARYREEVGRYAVEVRKMGFKILDLIGEGLGLNEGYFNGVNQYQTMAINHYPLCPDPGLAMGIDGHTDPNLITFLQQDQYGLQMCKDGKWMGIDPIPNAFVVNIGYQLEIISNGKLKSAEHRVVTSSTTARTSIVTFFGPNAGLPIVVEPAKELVTSTSPKMFKSYQYNNFIADYLAYIRKPFPPSGTPLDPYRV

SEQ ID NO: 3409 - protein, 558 aa, Legionella pneumophila
MSESFKELFEQSIAGAQFYPGAIITAKVIDIDDDFVTLNAGLKSEGIVAVEEFYDKNGELEVKVGDTVEVALDSVEDGHGETLLSREKAKRQEAWRKLSKCHENNETVTGLISGKVKGGFTVEIGSIRAFLPGSLVDVRPVRDPSYLEGKELEFKVIKMDLKRNNIVVSRRAVVEEESSADRQALLESLHDGQELHGIVKNLTDYGAFIDLGGIDGLLHITDISWKRVKHPSEVLSVGQDVKVKVLSFDSERNRVSLGMKQLGNDPWVDLVERYPIGKRLQGKVTNITDYGCFVEIEEGVEGLVHMSEMDWTNKNVHPSKVVSLGDVVDVMVLEIDEERRRISLGMKQCVGNPWQQFASTHNKGEKVKGKIRSITDFGIFIGLDGDIDGLVHLSDISWTVPGEEAVKQFKKGQELEAVILAIDPERERISLGLKQLEGDSFASFAETYTKGAIVKGTVTAVEPKTVTVALAEDVSGTIRVSELSDERVDDATTIVKVGDEVEAKITNIDRKNRTISLSVKAKDAQDEADAIKKYSRTEAASTTLGDLLKEKMASKEGE

SEQ ID NO: 3410 - protein, 327 aa, Ostreococcus tauri
  misc_feature (12)..(18): Xaa can be any naturally occurring amino acid
  misc_feature (327)..(327): Xaa can be any naturally occurring amino acid
MSFARAVPTSSXXXXXXXCFSSALRFDKGASVPFDLFDVPWVLFRGKSGDVGCVKDECCHRACPLSLGKVVDGRIQCPYHGWEYETSGECVKMPSCRFLKNVYSDSLRVIERDGMIFVWAGESDPEDFIGAGSANAGESWDEDVYEAGEEAGMFTPRDGFVTMAEVTADVKVDSNIVLERLLDITERARRVPVSVKNRQRTPYEKADATKLISKVLRIGYEPMPQSVVFKPSCVIASTIELRPKLGGAGGGKPMLVEQLHVCLPAKPGVTRVLFRMAFDFVPEGAQHAAGDTWNNLAMQVLQEELEDVRSGSLKSETASAAIDTFRX

SEQ ID NO: 3411 - protein, 848 aa, Yersinia pseudotuberculosis
MSKIKIAIIGNGMVGHRFIEDLLDKADKDQFDITVFCEEPRIAYDRVHLSSYFSHHTAEELSLVREGFYEKQGVKVLVGERAITINRAEKVIHSNSGRSLYYDKLVMATGSYPWIPPIKGSEGQDCFVYRTIEDLNAIEACTRRSKRGAVIGGGLLGLEAAGALKSLGVETHVIEFAPVLMAEQLDPMGGDQLRQKIERMGVRVHTGKNTQEIVHSGQNSRKTMLFADGTQLEVDFIVFSTGIRPQDKLANQCGLATARRGGIAINDYCQTSDPDVYAIGECASWQERTFGLVAPGYKMAQVAADHLLGRENAFLGADMSAKLKLLGVDVGGIGDAHGRTEGARSYVYLDESKEIYKRLVVSADNKTLLGAVLVGDTTDYGNLLQLALNNITLPENPDSLILPAHAGNKPAIGVDSLPDSAQICSCFDVTKGDIIRAIGQGCQTVAALKSATKAGTGCGGCIPLVTQVLNAELSKQGIEVNNHLCEHFAYSRQELYHLIRVEGIKTFTELREKYGKGYGCEVCKPTVGSLLASCWNEYVLEPQHTPLQDTNDNFLGNIQKDGTYSIIPRSPGGEITPDGLLVVGQIAKEYNLYTKLTGSQRIGMFGAQKDDLPAIWARLIDAGFETGHAYAKALRMAKTCVGSTWCRFGVGDSVGFGVALEHRYKGIRAPHKIKFGISGCTRECAEAQGKDVGIIATENGWNLYVCGNGGMKPRHADLLAADLDEETLMRYLDRFMMFYIRTADKLQRTSVWLESLEGGIRYLQSVILEDKLGINDQLEAEIARLRDKVACEWKATVENPAAQVRFAHFINSSLRDPNVQVVREREQHRPARPDERIPVRVLELEDNA

SEQ ID NO: 3412 - protein, 244 aa, Oryza sativa
MEGEDDDDEEEEDVDDDDLLDDNEDDDDDYSFEDDFESDDEQDLYVGDGGAGGGISLAGTWWDKEALALAEEVSNSFDGDLKIYAFKTAANLTIRVRIEKMSTRYGSPTIDDIEAFTIAYRAKIDDAESAGRIPQNISLEVSSPGVERVIRIPDDLERFKERAMYVRYTITSDGGEGMTPQEGDGVFRLISYDMDLCECTWGIADVKINRQQAGKGRPLSKKQREWRLQTPFESLKLVRVHSDC

SEQ ID NO: 3413 - protein, 473 aa, Yersinia pseudotuberculosis
MDYFPIFCQLQHKACLLVGGGEIAERKARLLLDAGALVTVNACEFTPQFHHWADQGQLSLISGEFVPELLADKWLVIAATDQLSVNALVYQSANQQRIFCNVVDDPKRTSFIMPSIIDRSPIMIAVSSGGKAPVLARLLREKLEALLPQHLGQLAQLAGNLRQRVKQHFAAMTERRRFWEKLLTHDRLAQSLANNDHVQADQHVEQLFSAPLTDRGEVVLVGAGPGDAGLLTLKGLQQIQQADVVVYDRLVSDEVMNLVRRDAERIFVGKQSGHHCVPQEQINQILLQQAQSGKRVVRLKGGDPFIFGRGGEELEELAGYGIPFSVVPGITAASGCSAYSGIPLTHRDHAQSVRLVTGHAKKEGQLDWANLAAEKQTLVFYMGLSQAGEIQQQLIQHGMPATTQVALVENGTSRHQRVVSGELSQLALLSQQVSSPSLIIVGSVVSLREKLNWFSSRHHDDQPKVTECVAHVG

SEQ ID NO: 3414 - protein, 320 aa, Epichloe typhina
MSPPAAISPPRQVAELATQTSKFAVSGGSKTQTIDEMMGQWDSFKFAPIRESQVSRAMTRRYFRDLDTYAESDIVIVGAGSCGLSAAYVLGKHRPDLKICIIEASVSPGGGAWLGGQLFSAMVMRKPADAFLREIGVPYEDEGNYVVVKHAALFTSTILSKVLSLPNIKMFNATCVEDLITRPSEEGVRISGVVTNWTLVSMHHDDQSCMDPNTINAPLVISTTGHDGPMGAFCVKRLVSMQRIEKLGGMRGLDMNTAEDAIVKNTREIVPGLIVGGMELSEVDGANRMGPTFGAMVLSGLKAAEEALKVFDLRAKQNAI

SEQ ID NO: 3415 - protein, 234 aa, Triticum aestivum
  misc_feature (12)..(12): Xaa can be any naturally occurring amino acid
  misc_feature (25)..(25): Xaa can be any naturally occurring amino acid
LGSPQQHISASXSNSEVNGTGKKEXIVGGARGNGKSTESLTEKNESGEINEDLDDGVSKELEGGHEQCNEAVRNQNSEEASSLVNEESIDAKAADCSEHTKTREEGSSISKNDVLAATACQFKNFVAIVDPPRAGLHPTVIKVLRTHPRIRRLVYISCNPDTLVANAIELCTPSTEHREKNKGHRGWRNMSSAGLARQRTKSMPNSEPFVPKRAMAVDLFPHTSHCEMVMLFER

SEQ ID NO: 3416 - protein, 369 aa, Bacillus cereus
MPKHRKQSKIKIYRITSYKKDKRSELDSNKFELEQQELENKQDKQGKQDKQDNQDNQDNQVQSENVVIVPTDSHNLDIWDEISLKEIQAGEHTSLFAEQSDYQNINLLQVSDIRLYLDKQLQFSSVDEQIYHEALVHPIMSKVIDPKRVLILGGGDGLALREVLKYETVLHVDLVDLDGLMIDMARNVPELVSLNKSAFFDNRVNTHVCDAKEFLSSPSSLYDVIIIDFPDPATELLSTLYTSELFARIATFLTEDGAFVCQSNSPADAPLVYWSIGNTIEHAGLTVKSYHTIVPSFGTDWGFHIAANSADVLNQIEQLYVVPTPRTLPSLLFPLFQFREEHLEQRNLALLNSESNLILHQCYKQEMEF

SEQ ID NO: 3417 - protein, 621 aa, Oryza sativa
HLTSPPPPPPRNYSNPSPSPSSQPAPNRSIASDLGRVSPMASSAPSAPGLAPVAKPPPPPSKVKVATATVPTNGKIKQGARPMRVSAPPVEPRRRMNPLQRLAAAAIDAVEEGLVAGLLERGHALPRTADPAVQIAGNYAPVGERPPVRGLPVSGRLPACLDGVYVRNGANPLHAPRAGHHLFDGDGMLHAVRLAGGRAESYACRFTETARLRQEREMGRPVFPKAIGELHGHSGVARLLLFGSRALCGVLDASRGIGVANAGLVYHDGRLLAMSEDDLPYHVRVTHDGDLETVGRYDFHGQLDADGTMIAHPKLDPVTGELFALSYNVVSKPYLKYFYFTADGRKSRDVDIPVGAPTMIHDFAVTENYAVVPDQQIVFKLQEMVRGGSPVVYDREKASRFGVLPKRAADASELRWVEVPGCFCFHLWNAWEDDATGEIVVIGSCMTPPDAVFNEPSQSPEEESFRSVLSEIRLDPRTGVSRRRDVLRDAAEQVNLEAGMVNRQLLGRKTRYAYLAIAEPWPRVSGFAKVDLESGTAEKFIYGEGRYGGEPCFVPRAGAAAEDDGHVLCFVHDEERGTSELVVVDAGSEAMEEVAAVKLPGRVPYGLHGTFIGANELQRQA

SEQ ID NO: 3418 - protein, 499 aa, Unknown
  Synechococcus sp. WH 5701
MNPPRWLFWHRRDLRLADNLGLAAAARATAAVTGVFVFDPALLDAPDLSPARLWFLSESLRELQGRWREAGSRLLLLRGDPAEVLPQLAQAAGAQVVAWNRDVEPDGRARDRRVAEALRAGGCKLLADWDQLLVPPDALATGAGDPYRVYGPFFRSWRRRIEQAGAEACAPVAAPASLIDLDPAALPAERRRLWDQLNWLETVPTPGDGLPGAPFAGADLCPCRPGEAAAAAQLAAFADGPLLGYEPGRNLPAEPGTSGLSAALRFGTLSPRQAWAAAQQQRPRARSEEELQSITVWEQELAWREFYQQALFHFPELAEGPYRPQWRHFPWENDEGRFAAWCDGLTGVPIVDAAMRQLNDSGWMHNRCRMIVASFLVKDLIVDWRWGERQFMRLLVDGDLAANNGGWQWSASSGMDPKPLRIFNPYTQAARFDPEATYIRRWLPELSRVATADLIRGEIAPLERRGYPGPIVDHKLQQARFKALHAASVAAPQEARLRG

SEQ ID NO: 3419 - protein, 223 aa, Beta vulgaris
MEEVKVYGAWGSPPSHRVEIALKLKGVKYEFIEEDLKNKSEELLKYNPVHKKIPVLVHNGRPIAESLVILEYIDEIWKQCPLLPTDPYDRAQTRFWAKFIAEKITPAVRDAMLIPGEDAEKKTEELIELLHILEKEIKEKKFVGGNRNKYMDIVSLYVIHWIPILQEYSSKHVLTREKFPGIYDWIDQVLLDCGDIMENLPDKNKMFDVLRVIFGPRNNYKPT

SEQ ID NO: 3420 - protein, 849 aa, Brassica napus
MKGVRNIYHHSYTSFLLLFLVMILIHPALSIYINTLSSTESLTISSNRTLVSPGDVFELGFFETNSRWYLGMWYKKLPFRTYVWVANRDNPLSNSIGTLKISGNNLVILGHSNKSVWSTNLTRGIDRSTVVAELLANGNFVMRDSNNNDASQFLWQSFDYPTDTLLPEMKLGNDLKTGLNRFLTSWRSSDDPSSGEFLYELETGRLPEFYLSKGIFPAYRSGPWNGIRFSGIPDDQKLSYLVYNFTENSEEVVYTFRMTNNSIYSKLTVSLSGYFERQTWNASLGMWNVSWSLPLPSQCDTYRRCGPYAYCDVSTSPICNCIQGFNPSNVQQWDQRSWSGGCIRRTRLSCSGDGFTRMENMELPETTMAIVDRSIGVKECKKRCLSDCNCTAFANADVQNGGTGCIIWAGELEDIRNYAADGQDLYVRLAAADLVKRRNANGQIISLTVGVSVLLLLIMFCLWKRKQKRANANATSIANRQRNQNLPMNGMVLSSKREFLEEKKIEELELPLIELETVVKATENFSNCNKLGQGGFGIVYKGRLLDGQEIAVKRLSKTSVQGTDEFMNEVTLIARLQHINLVQIIGCCIEADEKMLVYEYLENLSLDSYLFGKTRRSKLNWKERFDIINGVARGLLYLHQDSRFRIIHRDLKVSNILLDKNMTPKISDFGMARIFARDETEANTVKVVGTYGYMSPEYAMHEIFSEKSDVFSFGVIVLEIVSGKKNSYNLNYKNNLLSYAWSQWEEGRALEIIDPVIVDSLPSTFQPQEVLKCIQIGLLCVQELAEHRPTMSSVVWMLGSEAKEIPQPKQPGHCIGRSPYDLDPSSSSQCDDDESWTVNQYTCSLVDAR

SEQ ID NO: 3421 - protein, 281 aa, Medicago truncatula
MAEIDLEWPKKDNRRLLHVVYRVGDLERTIKFYTEALGMKLLRQRDVPEEKYANAFVGFGDEHSHFAVELTYNYGVTSYDVGDGFGHFAIATQDVYKLVEHIRAKGGNITREAGPVQGGTTVIAFVKDPDGYTFALVQRPIVHDPFCQISLRVGDLERAIKFYEKALGLKVVRKVDNPENKYTIAILGYKEEDDATVLELTYNYGVTEYSKGTAYAQIAIGTDDVYKSADVVNLVTQELGGEITLQPGPIPGLNTKVTSFLDPDGWKTALVDNEDFLKELE

SEQ ID NO: 3422 - protein, 320 aa, Gloeobacter violaceus
MELGTPAPTATDIGFTREDFERLLSQYDYRFNPGDIVKGTVFSLEPRGALIDIGAKTAAYLPLQEMSINRVDDPTEVLGEGDTLDFFILSDENEEGQLTLSIRRIEYMKAWERVRKLQTEDQTVRAKIFAVNRGGALVRIEGLRGFIPGSHLSTREPKEELIGEELPLKFLEVDEERNRLVLSHRRALVERRMNKLEAGQVVIGRVRGIKPYGAFIDIGGVSGLLHISEISHDHIETPHSVFNVGDEVKVMVIDLDAERGRISLSTKQLEETPGAMTQDKQAVFDNAEVMAEKYRARMAAEAAGSEPVEEFDEAVVAAID

SEQ ID NO: 3423 - protein, 288 aa, Medicago truncatula
MSGFCVGMAEIDLEWPKKDNRRLLHVVYRVGDLERTIKFYTEALGMKLLRQRDVPEEKYANAFLGFGDEQSHFVVELTYNYGVTSYDVGDGFGHFAIATQDVYKLVEHIRAKGGNITREAGPVQGGTTVIAFVKDPDGYTFALVQRPIVHDPFCQISLRVGDLERAIKFYEKALGLKVVRKVDNPENKYTIAILGYKEEDDATVLELTYNYGVTEYSKGTAYAQIAVGTDDVYKSADVVNLVTQELGGKITRQPGPIPGLNTKVVSFLDPDGWKTVLVDNEDFLKELE

SEQ ID NO: 3424 - protein, 466 aa, Wigglesworthia glossinidia
MKSVSIIDIIEKKIFKKKLVEINGWVRTKRNSKLGISFVDVYDGSCLQHIQVIAKKDLSNYKSDILRLTSGCSVKIFGVLKKSLKNSKIYELHATCIKVLGWIKDPGKYPISSKPHTLEYLRSFSHLRPRTNIIGSVSRIRNIIFQEVHNFLNKKGFIWVPSPIITSLNTEGSGEMFKVSTFDFKKIPLNKNKLINYRKDFFGKRTFLTVSGQLHIESYACSLSKVYTFGPTFRAENSNTSRHLAEFWMVEIEIAFAKLNDIILLAYNLLSNIFKKVLNKCLNDLIFLEKKLNINIIKKLKNFIEKKLIEVEYCEAIRILKNCEKNFRIQLKWGMDLSSEHERYLSDLYYKSHIVIKNYPKEIKAFYMRLNKDKKTVAAADILLPGIGEIIGGSEREDRLEYLDSMIKEKRLIHKNYEWYRDLRKYGTVPHSGFGLGIERLISYVTGLKNIRDVIPFPRSSKNASF

SEQ ID NO: 3425 - protein, 1277 aa, Cryptococcus neoformans
MPTSKSSIDHRDVYYRKGKSAGYRARSAYKLLHLDEEFDLFTNVHTAVDLCAAPGSWSQVLGQKLKPKSKQGGEGTRVVSCDLQPMAPLPNITTLQTDITLPSTIPLVLDALGGRKADLVVCDGAPDVTGVHDLDAYLHSQLLLAALTLSLTLMAPGATLIFKIFLSPLDPRAEFLASQLRCFFSSPLPEDKEKEDEFGQYAEFEEEGEYAEEAGQDKGDEKKRNVGTKGYDPQGRRGGVWVRKPRSSRQGSAEAFIVCRNFSPSSLPLPPTFSPSALDKLRTTTGTLTLDSLSSLVPQDESKGEEIQGFKGSKEQVKQQWHRWEMIKGYVGGGDLKKKKMLSTDFRSSSSFIPSLYPLLPPSLPAQSPKMTLSSPPKLHLPMPTTPPNLVHHILKTPEIISPHSSTASPKALQPQPTPVDEPPEYFSPKRAHIQALFLSPTKMKEHRQGQGQGQGQGQDGGGTSRQSSLDSLTPNPSPVGDVDSTRPWTSSSPPSSSMSASPPTPVPPTITAPPQEKTSLSIPLLLHSASTSSAVSDGGYGIHGVHGVHSVHSVHSVHSSRPQTPATLGVITPALASPALSSSSKTDLFFSASSAELPTPPRALSPASALDKEPFSSSSAASSGLDVSGNERAQSTTMPSSSFPSTATSGAASWSGSGISTVKLRLPTRKERFRETVIPAEMKDEMDIDRSREGWGAPFGMGLGAGFEEISTSRLRSLSNPIAPPPAHTVPPAPPAPLPAPLPSSFTTQNSSNDGDSRPEFARQSSLTPTVVSPQTPRAGFFPLNNARTKANAVPSVPFHPSPSAGGYTPPPPPWKLRRKESQQLEREHRQAGVDESVKAGDVIEPCFPNTNADNNGEHEKEKRKERVIGGWRLVKKMGEGAFSAVWSAVPAGSTPLSSTPTHAPTATSLLVALKLLTHPLPDHRTRIAFLREASVLRHISHPSIVGYIDDFSTERHDVLVLEAAGGGELFELMSEEENRRRMILPAPAPVAGSEESEMGWDKDGEGFVRRVFSELVKAVGWLHEVGIVHRDIKLENILFTTNPFILPPTSTSSIPLHLLPPPGQPLIKLTDFGLSRFISPASPLLYTRCGSESFAAPEIIMGKPYDGRETDAWALGVVLYGLIIGELPFDREESIKLPDGIATPGGGNSERVRGRKKMHRIAKGEYTWPSPEPALSQDIPGAYVPGTATPSARAVISSLLERSPSKRAKPSDLWEYEWMLGPGGVPRPVEGAGTPQQEGVGKDKGREASGRGRRRVLDGFLVEEERIEDVAMTEH

SEQ ID NO: 3426 - protein, 146 aa, Unknown
  Rhodococcus sp. RHA1
MTKTVRAHTCTMEGAMTDVQQTFYEAVGGAETFRKLTARFYEEVAKDDIVRPLYPEEDLGPAERRMRMFLEQYWGGPHTYSDERGHPRLRLRHQPFKIGPIERDAWLRCMHTAIASIDSGTLDDAHRKALTEYMDMAAASMVNSAF

SEQ ID NO: 3427 - protein, 249 aa, Unknown
  Burkholderia sp. 383
MSRAWLIGAGPGDADLLTLKAVHAIGAADVLLVDDLVNPDVLRHARVDAHIEHVGKRGGHASTPQETIVAAMLVHLRAGRSVARLKGGDPFVFGRGGEELAALGAAGFPVEVVNGVTAGIAAPAAIGIPVTQRGDAQGVIFVTGHGAGADEPDWRALAATRMTIVVYMGIRRLDAIAAALREGGLPGDTPCAAIENATRPEQRHVLATLDTLVERVGTAGIGSPAIVVIGRVAAFADDPAVRAALGSGA

SEQ ID NO: 3428 - protein, 983 aa, Unknown
  Burkholderia sp. 383
MSLDTNNVRQGGCGSGQCACKSAAQARAGNPFDDTDYGTPQRHADTDVTLEIDGQPVTVPAGTSVMRAAIEAGVNVPKLCATDSLEPFGSCRLCLVEIEGRRGYPASCTTPAEAGMKVRTQSDRLQSLRRNVMELYISDHPLDCLTCPANGDCELQDMAGVVGLREVRYGFDGANHLRDKKDESNPYFTYDPSKCIVCNRCVRACEETQGTFALTIAARGFESRVAAGESESFMASECVSCGACVAACPTATLQEKSVVQLGQAEHSVVTTCAYCGVGCSFKAEMKGTQVVRMTPHKNGLANEGHACVKGRFAWGYATHKDRITKPMIREKITDPWREVSWDEALTYAATQFRKLQDKYGRDSIGGITSSRCTNEETYLVQKLVRAAFGNNNVDTCARVCHSPTGYGLKTTLGESAGTQTFASVGQADVIVVMGANPTDGHPVFGSRLKRRVREGAKLIVIDPRRIDVVDGPHVKATHHLQLRPGTNVAIVNALAHVIVTEGLVADAFVAERCETRAFEQWRDFVSRADNSPEATAGVTGVPAESVREAARLYATGGNAAIYYGLGVTEHAQGSTTVMGIANLAMATGNIGREGVGVNPLRGQNNVQGSCDMGSFPHELPGYRHIGDEVVRAQFEAAWSAKLQPEPGLRIPNMFDAALDGSFKGLYCQGEDIVQSDPNTQHVAAALSEMECIVVQDIFLNETAKYAHVLLPGSSFLEKDGTFTNAERRISRVRKVMPPLAGYADWEVTLMLSRALGYEMDYAHPSEIMDEIARLTPTFSGVSYAKLDTLGSIQWPCNEHAPEGTPTMHIDAFVRGKGKFVITQFIASPEKVTQRYPLILTTGRILSQYNVGAQTRRTENVQWHEEDRLEIHPHDAQDRGIRSGDWVGIESRAGQTVLRALVTERMQPGVVYTTFHFPESGANVITTDSSDWATNCPEYKVTAVQVLPVAQPSDWQQAYARFNAEQLDLLERRAAATATVTTGK

SEQ ID NO: 3429 - protein, 352 aa, Glycine max
MGEVDPAFIQDLEHRPKLSIIQAEGIPIIDLSPISNHTVSDPSSIENLVKQIGSACKEWGFFQVTNHGVPLTLRQNIEKASRLFFAQNLEEKRKVSRDESSPTGYYDTEHTKNVRDWKEVFDFLAKDPTFIPVTSDEHDDRVTHWTNVSPEYPPNFRDIMEEYIQEVEKLSFKLLELIALSLGLEAKRFEEFFMKDQTSFIRLNHYPPCPYPHLALGVGRHKDGGALTVLAQDEVGGLEVKRKADQEWIRVKPTPDAYIINVGDLIQVWSNDAYESVEHRVMVNSEKERFSIPFFFNPAHDIEVKPLEELTNEHNPSKYRPYKWGKFLVHRKGSNFKKQNVENIQIYHYKIT

SEQ ID NO: 3430 - protein, 378 aa, Vibrio fischeri
MKSRLKITTVALLFASFFAVITSFFSTAEDMTQPMKGDNEVATLAGGCFWCTESDLEKLDGVVDVVSGYSGGTLENPTYKQVSSGKSGHIEVIQVTFDPKVVSYEQILDHLFRHIDPTDNKGSFVDRGPQYRPAIFYHNEDQKLIAQNFMKDIDAAGIFPKPLATELIEYKTFWPAEAYHQDYYKRNPIRYKYYRHGSGRDKYLDSVFGEDREENPKTLRQYITEYEMAVNVKPYSKPSESQIKKSLTELQYYVTQEEGTERPFDNAYWDNKAEGIYVDIVSGEPLFSSTDKYKSGTGWPSFTKPINKAYIVEEDDFQLFTKRTEIRSKFADSHLGHVFNDGPKPTGLRYCMNSAAMRFVAKADLEKEGYGEYLYLFN

SEQ ID NO: 3431 - protein, 381 aa, Silicibacter pomeroyi
MSKRDYYDVLGVSKGASADEIKKAYRGKAKELHPDRNKDNPDAESLFKEVNEAYEVLKDAEKKAAYDRFGHAAFEGGMGGGQRPGGGFGSGDFSSAFSDVFEDLFGDFMGGQRGGGGRRAARGSDLRYNLRVTLEEAFSGLQKTINVPTAVACSSCEGTGAEGGVEPTTCPTCSGMGKVRAQQGFFTVERTCPTCSGLGQIIKNPCKSCRGQGRVEKDRALSVNIPAGVETGTRIRLAGEGEAGMRGGPPGDLYIFVEVAKHELFERDGVNLYCRVPVSMAKAALGGAIEVPTIDGGRGRVQVPAGSQSGRQMRLRSKGMPALRGGGIGDMFIELAVETPVNLTSKQKDLLREFDELSEDNNPETKSFFSSVKSFWDGMKG

SEQ ID NO: 3432 - protein, 1034 aa, Bacillus megaterium
MLKTGKKFHYTAPANGYPEWNNNPEIFQLNRSKAHALLMPYQTVEEALKNDRKSSVYYQSLNGSWYFHFAENADGRVKNFFAPEFSYEKWDSISVPSHWQLQGYDYPQYTNVTYPWVENEELEPPFAPTKYNPVGQYVRTFTPKSEWKDQPVYISFQGVESAFYVWINGEFVGYSEDSFTPAEFDITSYLQEGENTIAVEVYRWSDASWLEDQDFWRMSGIFRDVYLYSTPQVHIYDFSVRSSLDNNYEDGELSVSADILNYFEHDTQDLTFEVMLYDANAQEVLQAPLQTNLSVSDQRTVSLRTHIKSPAKWSAESPNLYTLVLSLKNAAGSIIETESCKVGFRTFEIKNGLMTINGKRIVLRGVNRHEFDSVKGRAGITREDMIHDILLMKQHNINAVRTSHYPNDSVWYELCNEYGLYVIDETNLETHGTWTYLQEGEQKAVPGSKPEWKENVLDRCRSMYERDKNHPSIIIWSLGNESFGGENFQHMYTFFKEKDSTRLVHYEGIFHHRDYDASDIESTMYVKPADVERYALMNPKKPYILCEYSHAMGNSCGNLYKYWELFDQYPILQGGFIWDWKDQALQATAEDGTSYLAYGGDFGDTPNDGNFCGNGLIFADGTASPKIAEVKKCYQPVKWTAVDPAKGKFAVQNKHLFTNLNAYDFVWTVEKNGELVEKHASLLNVAPDGTDELTLSYPLYEQENETDEFVLTLSLRLSKDTAWASAGYEVAYEQFVLPAKAAMPSVKAAHPALTVDQNEQTLTVTGTNFTAIFDKRKGQFISYNYERTELLASGFRPNFWRAVTDNDLGNKLHERCQTWRQASLEQHVKKVTVQPQVDFVIISVELALDNSLASCYVTYTLYNDGEMKIEQSLAPSETMPEIPEIGMLFTMNAAFDSLTWYGRGPHENYWDRKTGAKLALHKGSVKEQVTPYLRPQECGNKTDVRWATITNDQGRGFLIKGLPTVELNALPYSPFELEAYDHFYKLPASDSVTVRVNYKQMGVGGDDSWQAKTHPNYTLYANRSYTNTFTLKPL

SEQ ID NO: 3433 - protein, 558 aa, Bacillus cereus
MKKQYTVSTYLLDRLHELGIEHIFGVPGDYNLAFLDDVVAHENLKWIGNCNELNAAYAADGYARIKGIAALITTFGVGELSAINGIAGSYAENVPVIKITGTPPTKVMENGAIVHHTLGDGKFDHFSNMYREITVAQTNVTPEHAAEEIDRVLRACWNEKRPVHINLPIDVYNKPINKPTEPIINKPILSNKEALNKMLLHAISKINSAKKPVILADFEVDRFHAKENLHQFVEKTGFPIATLSMGKGIFPEKHPQFIGIYTGDVSSPYLRKRIDESDCIISIGVKLTDTITGGFTQGFTKEQVIEIHPYTVKIIDKKYGPVVMQDVLQHLSDSIEHRNKDTLDVKPFILESSPFTEEFIPKAQMVTQKRFWQQMYHFLQENDVLIVEQGTPFFGSSAIPLPNNTAYVGQPLWGSIGYTLPALLGTQLANLSRRNILIIGDGSFQVTAQELSTILRQNLKPIIFLINNNGYTVERAIHGQNQLYNDIQMWDYNKLSMVFGAEEKSLTFKVENEAELAAVLTNITFNKNQLIFIEVIMSQSDQPELLAKLGKRSGQQNS

SEQ ID NO: 3434 - protein, 120 aa, Glycine max
TDTTVNQDDTGKIAPFTDLKSMAGFPTTKTNNDITSIASNGGRAQCMYVLPPVAKKKFETLSYLPKLDDAQLANEGEYHLRNGWIPCLEFEMEHGFVYREHNRSPGYYYGRYRTMRKQPM

SEQ ID NO: 3435 - protein, 574 aa, Geobacter sulfurreducens
MTIKRFADAEDEADQGGSGEFAELFQESIRHHHVGEVVKGKVVHISNDYVLVDIGYKSEGSIPVEEFLDEAGNLTVQVGDEVKALFERKENQKGYAVLSKRKADRLSAWDSIDAAGGEGGIVEGKITGKVKGGLTVDIGVQAFLPASQVDLRPGGNLDKYIGVTDRFKVLKLNKKRGNIVLSRRVLLEEERAGVRTETLANLAEGQTREGVVKNITDYGAFVDIGGVDGLLHVTDMSWGRLGHPSEMLKPGDKLSVKILKYDQEKGKISLGLKQITPDPWLAVEQKFQVGDRVSGRVVSMTDYGAFVALDEGVEGLVHVSEMSWTKRLRHPSDLLTVGDEVETVVLGIDTGNRRISLGLKQAQANPWTQLEEKYPVGTKLEGQIKSITDFGVFIGVDEGIDGLVHVSDISWTKRIKHPGEVYAKGQTVQAVVLNVDAENERLSLGIKQLTPDPWSVIPATYRPGTRVRGKVTSVTDFGVFLEIEEGIEGLVHVSELSREKVASPKDFASVGDELDAVVLSVDDVEKKIALSVKALQAAAEKAELESYMQDRGEATSNLGALLREGMRKNGDNND

SEQ ID NO: 3436 - protein, 223 aa, Debaryomyces hansenii
MAKTATIKRDTNETKIQIAISLEGGHIALEESIFKNSANETKDDSHATQATSTQVIQVQTGIGFLDHMLHALAKHSGWSLIIECIGDIHIDDHHTAEDVGITLGLAFHKALGQVKGVKRFGCGFAPLDEALSRAVVDLSNRPYAVIELGLKREKIGDLSCEMIPHVMESFAQGAAITIHVDCIRGFNDHHRAESAFKALAVAIKEATSSNGTDDVPSTKGVLF

SEQ ID NO: 3437 - protein, 469 aa, Yersinia pestis
MSKQQIGVVGMAVMGRNLALNIESRGYSVSIFNRSSDKTDEVVAENPGKNLVPSYTVEEFVDSLEKPRRILLMVKAGEATDKTIASLTPHLDKGDILIDGGNTYYKDTIRRNRELSAQGFNFIGTGVSGGEEGALKGPSIMPGGQKEAYELVAPILEKIAARADDGDACVAYIGADGAGHYVKMVHNGIEYGDMQLIAEAYSLLKQSLGLSNEELASTFAEWNKGELNSYLIDITKDIFTKKDEDGNYLVDVILDEAANKGTGKWTSQSSLDLGEPLTLITESVFARYLSSLKDQRVAASKVLTGPKVQPFTGDKAEFIEKIRRALYLGKIVSYAQGFSQLKAASNENNWDLNYGEIAKIFRAGCIIRAQFLQKITDAYAENADIANLLLAPYFKQIADEYQQALRDVVSYAVQNGIPTPTFSAAINYYDSYRSAVLPANLIQAQRDYFGAHTYKRTDKEGVFHTEWMA

SEQ ID NO: 3438 - protein, 524 aa, Bifidobacterium longum
MSQPDTDTAAQSPSSQQEPQIQTDGRRSHSEQMNQPAQTSQSESSHDGKDEHALHTNLKRGMESRHLQMISLGGVIGTGLFLSSGYTIQQAGPIGTILAYSIGALIVYLVMLTLGELSVAMPVTGSFHVYAEKFIGPGTGFVIAIQYWLTWTVALGSEFTAAGLLMQRWFPDSPTWVWSAACIILIFTLNALSVRLFAEAEFWFASIKVFAICAFIVIGLLAIFGVIPIAGYQHAPMFGNLVKDGIFPNGFMPVFATILTVNFAFSGTELIGVTAGETRDPETTVPKAIHTTLWRLVLFFIGSITVMCALIPWRQAGVGESPFVLVFNSIGIPYAGDIMNFVVLTAVLSASNSGLYASTRMVWSMGNEGMIPRWFAKTNRRGVPMLALCAAMAGGLLALLSSVIAASTVYLVLVALSGLSAVVVWIAIAYCQIVFRRRWLESGHSTSELKYRTPGYPYVSWAAFILCTASFVLVIFDVEQRFALVAELVFIVACYGAYFLQQWVRKRKKATEADDLDTLWVARD

SEQ ID NO: 3439 - protein, 1131 aa, Burkholderia mallei
MKPADTLEDVGRAQFVAHMARRPRRARRREAPGVADTPLWYKDAIIYQLHVKSFFDANNDGVGDFAGLIAKLDYIAELGVDTVWLLPFYPSPRRDDGYDIADYRGVHPDYGTLADVRRFIREAHARGLRVITELVINHTSDQHPWFQRARRAKRGSVHRDYYVWSDTDLKYAGTRIIFLDTETSNWTHDPVAGQYYWHRFYSHQPDLNFDNPAVVREVLQIMRFWLDLGIDGLRLDAVPYLVEREGTSNENLPQTHAILKLIRATIDAEYPNRMLLAEANQWPEDVQEYFGDEDECHMAFHFPLMPRIYMSIASEDRFPIIDIMRQTPALAPSNQWAVFLHNHDELTLEMVTDSERDLLWQAYASERRARLNLGIRRRLAPLMERDRRRIELINSILLSMPGTPVIYYGDELGMGDNLHLGDRDGVRTPMQWSSDRNGGFSRADPELLVLPPVMGTLYGYDAINVEAQTRDPHSLLNWTRRILSTRRATRVFGRGAIRFLRPGNRKILAYLRELDGETPVLCVANLSRASQAVELDLSEFAGCVPTEMTSDSPFPPIGQLPYLLTFPPYGFLWFALSEHGREPAWHQQYAEPLPEYLTLVMRRGETQPGAALLDTLAQDALPSWLARRRWFASKERRVDSARFDALTPIPGEPFQYAEARVAVDGREERYVVPLASAWGSETPQPLFAQLALARVRRGHTVGLLTDAFALPSFAHGVLRQLRAGAAVPVAGGGRLEFRPEPDLARLDPGDAPGVRWFAAEQSNSSLVIGEAIVLKIVRKLATGVHPEAEMGRHLRRIGYRNVAPLVGEVVRIGADGAPHTVAILQEYVDNQGDAWTRSCDFLKRAIEELALPAANDADAAAPSAEPEMIDGYATFAGIVGKRLGELHAALAQPSDDAAFAPQRVSPARVDGWIGDALGWFERAASLLAERLDTLEGQTRAAAELLVAQRAAVAEALRALVPRELDGCCIRIHGDFHLGQVLDVQGDALLIDFEGEPARPLGQRRAQSHPLRDVAGFLRSLSYASAAAQFTIEKAPQQAAERKRALFERFGQAAADRFVAQYREALSAASREFVEPRYADRLLALFLIEKASYELCYEAANRPDWLSVPANGLAALVARLIGGAAPQQEDAR

SEQ ID NO: 3440 - protein, 154 aa, Pseudomonas chlororaphis
MIGISFTQASMAARKRIALVAHDHCKSFLLDWAERQKDKLAEHALLATGTTGQLLHQRLGLPVESMISGPLGGDQQLGARIAEQRVDMLVFFWDPFEPQPHDPDIKALLRVAAVWNIPVACNECSADYLLSSPLMEQAHSYRIPDYPAYLSGRR

SEQ ID NO: 3441 - protein, 498 aa, Arabidopsis thaliana
MPTLYKKAGFAAVFLEWLKNNKETVSAEDLRKVKIKKATIESAARRLGGGKEAMKQLLKLILEWVQTNHLQRRRTTTTTTNLSYQQSFQQDPFQNPNPNNNNLIPPSDQTCFSPSTWVPPPPQQQAFVSDPGFGYMPAPNYPPQPEFLPLLESPPSWPPPPQSGPMPHQQFPMPPTSQYNQFGDPTGFNGYNMNPYQYPYVPAGQMRDQRLLRLCSSATKEARKKRMARQRRFLSHHHRHNNNNNNNNNNQQNQTQIGETCAAVAPQLNPVATTATGGTWMYWPNVPAVPPQLPPVMETQLPTMDRAGSASAMPRQQVVPDRRQGWKPEKNLRFLLQKVLKQSDVGNLGRIVLPKKEAETHLPELEARDGISLAMEDIGTSRVWNMRYRFWPNNKSRMYLLENTGDFVKTNGLQEGDFIVIYSDVKCGKYLIRGVKVRQPSGQKPEAPPSSAATKRQNKSQRNINNNSPSANVVVASPTSQTVKYPAVLYKVGIIRKH

SEQ ID NO: 3442 - protein, 355 aa, Yersinia pestis
MSQKFLFIDRDGTIIAEPPTDYQVDRLDKLALEPDVIPALLALQKADYKLVMITNQDGLGTSSFPQETFDPPHNLMMQILTSQGINFEQILICPHLPEDNCTCRKPKTALVESYLADGVMNSTNSYVIGDRETDLQLAENMGISGLRYQRDGLNWTQIAKQLTQRDRHAYVNRVTKETAIDVNVWLDREGGSKIKTGVGFFDHMLDQIATHGGFRMDIQVSGDLYIDDHHTVEDTALALGEAINIALGDKRGIGRFGFVLPMDECLARCALDISGRPHLEYKAEFNYQRVGDLSTEMVEHFFRSLSYAMACTLHLKTKGRNDHHRVESLFKVFGRTLRQAIRVEGNTLPSSKGVL

SEQ ID NO: 3443 - protein, 79 aa, Triticum aestivum
MDLSDNQIQILESVFMECPNLDEAQRAHLGRELHVEPQHIKIWFKNRRAQMRRARNEQVDNHLSDSENDEIDSESDEIH

SEQ ID NO: 3444 - protein, 427 aa, Gluconobacter oxydans
MVTSCCSGSMSEAGHILDGLAEHARRASRSLARANAGTRNHALSEAAKALRVRSDEIVAANQKDLAALSEDRNAAFRDRLTLTPERVEAMARGLEDVAGLPDPVGRVLAEWDRPNGLHFRRVATPLGVIGMIYESRPNVGADAAALCIKSGNAVILRGGGESLHSARAIQAAMEDGLRAAGLDEACVQILPSADRALVGAMLQASGKIDLIIPRGGKSLVERVQREARVPVLAHADGLNHTYIHASADPAMARKILLDAKMRRTGICGATETLLIDAAIAPALLPLLVEDLAAKGCTFRADDRARAIVPTLAAASADDFDTEWLDAVLSVAVVDGVEDALDHIARHGSSHTEAIIAEDPEAAAEFLNGTDSAVVMWNASTQFCDGGEFGFGAEIGIATGRMHARGPVGLEQLTCYRYEVIGTGQVRG

SEQ ID NO: 3445 - protein, 122 aa, Brassica napus
SRELRRKLFGRSRRSYRRGSGSRSRSRSISPRHKREYDWRDPPHREFSHRDRDGEFYRHGSGKRSSERSEKGDRDGSRRRHGSPPPRRGGSPGGGREGSEERRARIEQWNREREEKEEGGGA

SEQ ID NO: 3446 - protein, 177 aa, Arabidopsis thaliana
MENMGTRVIEPLIIGRVVGDVLDFFTPTTKMNVSYNKKQVSNGHELFPSSVSSKPRVEIHGGDLRSFFTLVMIDPDVPGPSDPFLKEHLHWIVTNIPGTTDATFGKEVVSYELPRPSIGIHRFVFVLFRQKQRRVIFPNIPSRDHFNTRKFAVEYDLGLPVAAVFFNAQRETAARKR

SEQ ID NO: 3447 - protein, 215 aa, Unknown
  Synechococcus sp. WH 5701
MSSLPDFDHGSPGGRSGSVHRVTGETDVRVRLGLDGRGRCRVSTGVPFLDHMLHQLASHGLLDLEISAEGDTHIDDHHTNEDVGIAVGQALAQALGSRKGIHRFGHFSAPLDEALVQVVLDCSGRPHLSYGLVIPGQRIGTYDTELVREFFVAVVNNSGLTLHIRQLDGLNSHHIVEACFKAFARALRQAVEIDPRRAGEVPSSKGVLEQAGVLG

SEQ ID NO: 3448 - protein, 509 aa, Unknown
  Synechococcus sp. WH 5701
MTIAPSRPEPGKAAAASSPGYDRADWASAFRNVGTELTSVPLAAASGTIPSELSGSLYRNGPGRLERGGRWVHHPFDGDGMITAVRFEGGAAELSNRFVRTEGWLAEEKAGKVLYRGVFGSQKPGGPLANAFDLRLKNIANTHVVRLGEKLLALWEASSPHSLDPTSLETEGVELLGGVLADGEAFSAHPRFDPGHHGQQRMVTFGVKAGLRSTIRLMEFDASPGAAAGTLVADQKRSFNGFAFLHDFAITQNWAVFLQNAMSFNPLGFVLGWKGAAQCLDSKPGERGQFWLIPRSGDGEPLQVSAPEGFVFHHLNAFEDPSAGTAGQVVVDSIFYDDFPSIGPGVDFRAVDFDSLPIGQLKRCRIDLASGEVSTELLEERCCEFAMVNPRRVGLEARYAWMAVTEQERGNAPLQAIEKLDLSNGERLVWSAAPRGFVSEPVMVPRPRQDAEGDQPAEDDGWILCVVWNGARCASDLVILNAADLSEQAVLPMPLALPHGLHGSWAAAA

SEQ ID NO: 3449 - protein, 72 aa, Spiroplasma citri
MAKTNLLEVQGTILEVLPNTMFKVQLENGATILAHVSGKIRMNYIRILPGDTVVVEMSPYDLERGRIVFRHK

SEQ ID NO: 3450 - protein, 148 aa, Oryza sativa
MAPSVMASSATTVAPFQGLKSTAGMPVARRSGNSSFGNVSNGGRIRCMQVWPIEGIKKFETLSYLPPLTVEDLLKQIEYLLRSKWVPCLERPRRRTLMHSSVSSASTTSGRCSSSASSPTSPRAARSLVATKPSSSYIALFNCSSLIR

SEQ ID NO: 3451 - protein, 509 aa, Phaseolus vulgaris
MEAPSPTKPIDPTKPSITTLSVEGSQGEPSPLRKMFAVASIAAGIQFGWALQLSLLTPYVQLLGVPHAAASFIWLCGPISGLVVQPIVGYYSDRSTSRYGRRRPFILGGAVAVAIAVFLIGYAADIGYSAGDDITKKTRPRAVAVFVIGFWILDVANNMLQGPCRAFLADLAAGDQRKTRIANGFFSFFMAVGNVLGYAAGSFSGLHKIFPFTQTKACDVFCANLKSCFFFSILLLLFLSTVALIYVKDKPVAARAVQEDAQPSCFFQLFGALKELKRPMWMLMLVTAVNWIGWFPYFLFDTDWMGREVYGGTAGEDAYAEGVRVGSLGLMINAVVLGFMSLAVEPLDRMVGGVKRLWGIVNFILAIGFGMTVVITKMAEHQRHLNPAAVGHPSDGVKIGSMVFFAVLGVPLAITFSVPFALASIYSSASGAGQGLSLGVLNLAIVVPQMVVSALSGPWDALFGGGNLPAFMVGAAAAALSAIMAIVLLPTPKPADEAKAASMVAGGFH

SEQ ID NO: 3452 - protein, 105 aa, Fulvimarina pelagi
MATKTVTKDTFQNDVLGASKPVVVDFWAEWCGPCKMIAPSLEEISEENSNVEIAKVNIDENQELAVQFGIRSIPTLMMFKDGQHVDTLMGAQSKSKLASWIDSAK

SEQ ID NO: 3453 - protein, 129 aa, Zea mays
  misc_feature (80)..(80): Xaa can be any naturally occurring amino acid
  misc_feature (121)..(121): Xaa can be any naturally occurring amino acid
MQEEIHELLLSFAEAGANVVRLKGGDPLVFGRGGEEMDFLQQQGIKVEVIPGITSASGIAAELGIPLTHRGVATSVRFLXGHSRNGGTDPLYVAGNAADPDTTLVVYMGLSTLPSLCSKVXMKHGLPPK

SEQ ID NO: 3454 - protein, 283 aa, Arabidopsis thaliana
MAEASDLLEWPKKDNRRFLHVVYRVGDLDRTIEFYTEVFGMKLLRKRDIPEEKYSNAFLGFGPETSNFVVELTYNYGVSSYDIGTGFGHFAISTQDVSKLVENVRAKGGNVTREPGPVKGGGSVIAFVKDPDGYTFELIQRGPTPEPFCQVMLRVGDLDRAIKFYEKALGMRLLRKIERPEYKYTIGMMGYAEEYESIVLELTYNYDVTEYTKGNAYAQIAIGTDDVYKSGEVIKIVNQELGGKITREAGPLPGLGTKIVSFLDPDGWKTVLVDNKDFLKELE

SEQ ID NO: 3455 - protein, 481 aa, Unknown
  Bradyrhizobium sp. BTAi1
MSFSPIVVWFRESLRLSDHPALHAAATSGAPVICCYVYDTESAALRPLGGASRWWLAQSLRALQDELDALGVKLVIRRGPSAKAISELAREASTSAVYWNDVAQTGPRAVAAEVEAALDAIGVKSRVFADDLLIDPAELRGKDGRGPRVFTPFWKRVLALGDPPKPLPVPVRLSSPSGVASLTVDKLALEPTSPDWAGGLRTTWRAGERAAQARLAKFLETTVRGYAADRDRPDIEATSRLSPHLRFGEISPRQIWHAARFAAEQQPAFARGIDKFLSELGWREFSRHLLFNNPDLATRNLQPSFDAFPWSQDAAALRAWQRGQTGYPIVDAGMRELWHTGSMHNRVRMVAASLLVKHLLIDWRLGEQWFWDTLVDADPGSNPASWQWVAGSGADAAPYFRVFNPVLQGEKFDSSGTYVRRWVPELARLPAALIHQPWAAKPLELAEAGVVLGRSYPAPVVDHRHGRERALAAYASLRTSD

SEQ ID NO: 3456 - protein, 373 aa, Nitrosomonas europaea
MTQSILQSARRIVVKVGSSLVTNEGHGLDRCALGGWAGQISRLRQMGKEVVLVSSGAVAEGMQRLGWKMRPAALYELQAAAAVGQMGLAQAYADCFSEYELQTAQILLTHDDLSSRKRYLNARSTILTLLNLGIIPVINENDTVVSDEIRFGDNDNLAALVANLIEAEVLVILTDQEGLFTGDPRKNTDARLIPEVSVSDPDIEVMAGGAGSSIGRGGMQSKVMAARRAARSGAHTVIASGRAKDVLVRLAGGEAIGTILLADMPVKVARKLWLADHLQVRGSVVLDDGASRALLSGGKSLLPIGVVEIKGEFERGEAISCLDASGREIARGLINYDARESRKIMRRPTSQIEAVLGYVDEYELIHRDNLVIL

SEQ ID NO: 3457 - protein, 837 aa, Bradyrhizobium japonicum
MTSPKLDRRQMLKLEAAAIAAAAAGLPVPALAANLATEREVSELKWDKAACRFCGTGCSVMVATKENRVVATHGDIKAEVNRGLNCVKGYFLSKIMYGHDRLTQPMLRKANGKYDKNGDFTPVSWTEAFDIMEVKWKEAMKKRGPNGVAMFGSGQWTIWEGYAASKLFKAGFRTNNIDPNARHCMASAVAGMMRTFGIDEPPGCYDDIEATDAFVLWGSNMAEMHPILWTRLTDRRLSAPHVRVAVLSTFEHRSFDLADIGMVFKPQTDLYLLNAIANHIIKTGRVNKDFVAAHTVFRRGQTDIGYGLRPEHPLQKKATGAAKANDSTDMSYDEYVKFVSEYTLEKAAEMSGVPLNRLEALAELYADPKTKVVSFWTMGFNQHTRGVWCNNLVYNIHLLTGKISSPGNSPFSLTGQPSACGTAREVGTFSHRLPADMVVTNKEHRTKAEHIWQLPEGTIPDKPGAHAVLQSRMLKDGLINAYWVQVNNNLQAGPNANEETYPGFRNPDNFIVVSDAYPSVTALAADLILPTAMWVEKEGAYGNAERRTQFWHQLVPAPGESKSDLWQLMEFSKRFKIEEVWPEELIAKKPEVRGKTLFDVLYKNGQVDKFPVSDIEQGYLNDESKAFGFYVHKGLFEEYASFGRGHGHDLAPFDAYHKERGLRWPVVNGQETRWRFREGSDPYVKQGTDVQFYGYPDGKARIFALPYEPAAESPDGEYPFWLSTGRVLEHWHSGTMTRRVPELYKAFPEAVCFMHPDDAQEAKIRRGDEVKVVSRRGFIRVRVETRGRDRPPRGLVFVPWFDESKLINKVTLDATDPISLQTDFKKCAVRIERVNVS

SEQ ID NO: 3458 - protein, 538 aa, Streptococcus suis
MSEIQKTDWWKKSVIYQIYPRSFQDSNGDGIGDIRGIISRLDYLHELGIDAIWLSPVYQSPMDDNGYDISDYQGIAPEFGTMEDMEELIAEGHKRNIKIIMDLVLNHTSDEHFWFQEALKGPDNPYYDYYVWADEPNELRSTFSGSAWEYVPHLNKYYLHQFSVKQPDLNWKNPALKQEIWDMINFWIEKGVGGFRLDVIDLIGKEPEKLITADGPTLHPLIQELNEKTFGAYDLVTVGETWSANPENAQLYSHPDRKEFSMIFQFEHVGLDQQEGKEKWDLAPLDPARLHKVLSKWQTELVGKGWNSLFWNNHDLPRAISRFGDDRPAFRELSGKMLAIYLHFMSGTPYIYQGEEIGMINTPITDISQADDIETRRMYAERIENGFTKEELITSINAKGRDNARRPMQWTAEEGAGFSTGQAWLALGDTVKDINVEKALADKQSLFYTYQKLIALRKEYPCMSEGKYEVMETGNDLVMAYRKYDEQDDFIILVNFTSEEQAYEFSLEDYSVFMHNYDNKVIFDKSVLRPYEAIVFKK

SEQ ID NO: 3459 - protein, 139 aa, Oryza sativa
MAATALSSQVRLPMSLRVATAPAPARVSVLPANNKLGNRLRMQATYNVKLITPDGEVELQVPDNVFILDQAEEEGIDLPYSCRAGSCSSCAGKVVSGEINQSDQNFLHNNQVAAGWVLTCHANPKSDVVIETHKEDDLT

SEQ ID NO: 3460 - protein, 670 aa, Bacillus subtilis
MDIFLVVLVLLTIIAISNIVNRFIPFIPVPLIQVALGILAASFPQGLHFELNTELFFVLFIAPLLFNDGKRTPRAELWNLRAPILLLALGLVFATVIVGGYTIHWMIPAIPLAAAFGLAAILSPTDVVAVSALSGRVKMPKGILRLLEGEGLMNDASGLVAFKFAIAAAVTGAFSLAQAAVSFVFISLGGLLCGVVISFLIIRFRLFLRRLGMQDVTMHMLIQILTPFVIYLAAEEIGVSGILAVVAGGITHAVEQDRLESTMIKLQIVSSSTWNIILFILNGLVFVILGTQIPDVISVIFNDTAISNMKVIGYILVITFTLMLLRFLWVLFFWNGKWFFNKDQNIYKPGLRSTLLISISGVRGAVTLAGSFSIPYFLEDGTPFPERNLILFLAAGVILCTLVIATVVLPILTEKEEEDEERNKKLLTARRKLIKTALQTIKEDMNETNKTASLAVIAEYNEKMKNLRFQQYTSSNRIKKHERKVRAQGVKAEQEALMKMLERGDIPEETANVLQERFNELEILYANPFKVGLSKTRLKRLMYWIFFGEHKKPEMSILNEAGLIRATRVKTAKAAIEYLEKHKTDEHKEVFLSVITFYKQLIFRLEHSHHELKSSAHFENQKLEVKLKAVQAIRNEIQTLFEEREISRDISHELRQYINDVEAAMLEGGE

SEQ ID NO: 3461 - protein, 49 aa, Ilex perado
  misc_feature (12)..(12): Xaa can be any naturally occurring amino acid
WEFQVGPSVGIXAADHIWCARYLLERITEQAGVVLTLDPKPIEGDWNGA

SEQ ID NO: 3462 - protein, 339 aa, Lactobacillus johnsonii
MAKIAVLGNGSWGSVLGSMLADNGNDVVLYGNIDSVNQEINEHHTNTHYMKNWKLNPNVPATGDLEKALDGAEIILFVLPTKAVRIVAKNARKILDKTGATPLLVTATKGIEPGSKKLISDILTEEVYPNDSEKIVAISGPSHAENVAQKDLTAIACASTSEENAKRVQKIFSNNYVRFYTNDDLVGVEVGGAVKNVIAIAAGILVGKGYGDDAKAALMTRGLAEITRLGVKYFGAKPMTFSGLSGIGDLIVTATSQNSRNWRAGKQIGEGKSLDYVLDHMGQVVEGATTVKAVHELAEEKNIDMPISEAIYRVLYENADVDQEIKTMMGRNPKPEIQL

SEQ ID NO: 3463 - protein, 1005 aa, Actinobacillus pleuropneumoniae
MILPNYFQDPNTLHVNTVEHHAYFIPHQQNETALSGKREQSDYFTLLNGQWDFNYFQSYHDLPDNFLDIAFEHKIPVPANWQNHGFDHHHYTNINYPFPFEPPFVPHQNPCGVYHRTLQLTPKHKRYLLNFEGVDSCLFVYVNKQFVGYSQISHNTSEFDVSDYLQAGTNHLTVVVLKWCDGSYLEDQDKFRMSGIFRDVYLLEREQNYLQDFFIQYELDDELRHANLKVETLFSRQPQAIEYQLLNPNGFTVFNQTDTHLNIEVEDIQLWNAEKPQLYTLILHTAEEVIVQKIGFRKVEIKDGILLFNQQPIKFKGVNRHDSDPKTGYAITYAQAHKDLQLMKQHNINAIRTAHYPNAPWFSELCDQYGFYLIGESDVESHGASMLTVKMPEPSILLNHQNDLQTERIRQDMIDNYCYFARDPLFKKAILDRQQANVERDKNRTSIIIWSLGNEAGYGANFEAAAAWIKQRDKSRLVHYESSIYQHSADNNDLSNLDFYSEMYGSTEDIDRYCATAQRKPFVLCEYSHAMGNSNGDAEDYWQAFHRHPQSCGGFVWEWCDHAPYRANGQFGYGGDFGESPHDGNFCMDGLVSPDRIPHSNLLELKNVNRPARAELIDNQIVIHNYLDFTDLADYLTIDYEFVENGVVTSGGNLSVSCKPHSSVILPIELPKNNGHLWLLNLDYRLNTATELLEAEHSLGFEQLNLFSENKLVLPKFTIEKSTFEVQEDHFRINVHNGQFSYQLDKQKGIFSRIEKAGKAIIQQPLDFNIWRAPTDNDRLIREAWQNAGYDKAYTRAYEIQWQQSEQAVEFSVKSAIVSISRGRILTLDIRYRIFNDGQISVEINAIRPTELPYLPRFGLRFWLAKAENTVEYFGYGEQESYVDKHHLANLGIYHTTAKQNHTDYVKPQENGSHYGCEYLKSENLFVSASQPFSFNLSPYTQEELTEKKHYYELQESDYSVLCIDYKMSGIGSNSCGPNLKDQYRLMESEFKIRFDLIFDKTIRQ

SEQ ID NO: 3464 - protein, 311 aa, Lactobacillus johnsonii
MAEKKNYDVIVIGAGPGGLTAALYAARANLKVVILDRGIYGGQMNNTAGIDNYPGFVDIQGPELGEKMYQTATNAGAEFAYGDVQSIIQDGNKKIVKTDSGEYEAGAVVIATGAVHKHLGVPGEEEYAGKGVSYCAVCDAAFFRDEDVAVIGGGDSAIQEGLYLAQSAKSVTVIHRRDQLRAKAELQKKAFENDKMKFIWNAQTEEIVGDGNKVTGVKYKDKETGEEKEIKVAGVFIYVGIQPQTDAFRDLGITDDQGWILTDDHMRTKVDGVFALGDVRAKELRQIATAVGEGSIAGQEVYNYYQGLSEK

SEQ ID NO: 3465 - protein, 49 aa, Ilex perado
WEFQVGPSVGIEAADHIWCARYLLERITEQAGVVLTLDPKPIEGDWNGA

SEQ ID NO: 3466 - protein, 543 aa, Treponema denticola
MDTMFCFQCQETFKNSGCVRVGVCGKNPLVAGLQDFLIWGTKKLSEVTSYMRENGIKVEKEINHIVSTNLFVTITNANFDEKAINNRINITLKAIHDLHSSLNRPFDPEIEVYIDSDIPKRLGKAITIGVLQTKDPDKRSLKELIIYGLKGLCAYVKHANALGYEDEEVDAFIQKTLSMLIDEKLSVDELISLTLKTGEAGVKGMALLDSANTGSYGNPEITEVSIGVRNNPGILVSGHDLKDIEMLLEQTEGTGVDVYTHSEMLPANYYPKLKKYKHLAGNYGNSWAKQVSEFESFNGPILMTTNCIIPSKASYVSRMYTTNAAGHPGCVHIEADENGHKDFSEIIKKAKSCPPPKEIESGKIIGGFAHAQVFALADKIVESVKNGDIRKFIVMGGCDGRHTTRSYYTGFAEALPKNTVILTAGCAKYRYNKLNLGDINGIPRVLDAGQCNDSYSLALIALKLKEIFNLSDINDLPIIFNIAWYEQKAVIVLLALLFLGVKNIHLGPTIPGFLSPNVKDVLISKFGLSGISSIEDDIKHFFG

SEQ ID NO: 3467 - protein, 303 aa, Salmonella typhimurium
MNTLEQTIGNTPLVKLQRIGPDNGSEIWVKLEGNNPAGSVKDRAALSMIVEAEKRGEIKPGDVLIEATSGNTGIALAMIAALKGYRMKLLMPDNMSQERRAAMRAYGAELILVTKEQGMEGARDLALAMSERGEGKLLDQFNNPDNPYAHYTTTGPEIWRQTSGRITHFVSSMGTTGTITGVSRFLREQEKPVTIVGLQPEEGSSIPGIRRWPAEYMPGIFNASLVDEVLDIHQNDAENTMRELAVREGIFCGVSSGGAVAGALRVARATPGAIVVAIICDRGDRYLSTGVFGEEHFSQGAGI

SEQ ID NO: 3468 - protein, 118 aa, Oryza sativa
AILDSLTYEEKETGADGQEVTKAVPAVTPEVKDALVKNIRRRMTPQPLKIRADVEMKCFQFDGVLHIKQAVKRRKIQEWVTSTLQIPASTRIKVLLFDLDEFCCIPANLKSSYLKRVR

SEQ ID NO: 3469 - protein, 314 aa, Glycine max
MAMASLASSSVLLNLLFIVSALHLGAAAARILSEKEDQQQLQFQYHKGPLLSGNISVNLIWYGSFKPSQRAIISDFITSLSSSPKSTAQPSVATWWKGTEKYYQLIKSAPKPSLTLALGAQILDENYSLGKSLTTDNIVSLASKGAPNDAINVVLTFSDVTVEGFCSSRCGTHGSSVGPRKFAYVWVGNSETQCPGQCAWPFQQPIYGPQNPPLVAPNNDVGLDGMVINVATLLAGTVTNPFGNGYFQGPKEAPLEAASACTGVYGKGAYPGYAGELLVDPTTGASYNANGVSDRKYLLPALFDPTTSACSTLA

SEQ ID NO: 3470 - protein, 315 aa, Glycine max
  misc_feature (149)..(149): Xaa can be any naturally occurring amino acid
MAEHLASIFGTEKDRVNCPFYFKIGACRHGDRCSRLHTKPTISPTLVLSNMYQRPDMNMSIITNPDQPQPQSLDPDKVQDHFDDFYEDLFEELSKYGPIQSLNICDNLADHMVGNVYVQFREEDHAANALMNLTGRFYSGRPIIVDFSXPVTDFREATCRQYEENVCNRGGYCNFMHLKKISRDLRRKLFGRNRRWNGRSGSRSRSPPRNRNHGENSHSGRGSGRRDFDRSHGPHGRRPRSRSPRYRGKRSRSPVGRDRSPPIRESSAERRAKIEQWNREKEQGDTGNMNNSKSSDDYQEQSVAQNGSESGNHQI

SEQ ID NO: 3471 - protein, 1028 aa, Enterobacter cloacae
MSDTPSLTLSALLARRDWENPVVTQWNRLAAHAPLHSWRNEPSARDDAGSARRQTLNGLWRFSYFTAPEQVPQAWVTEDCADAVAMPVPSNWQMQGFDTPIYTNVTYPIPVNPPFVPQENPTGCYSLTFEVDDAWLQSGQTRIIFDGVNSAFHLWCNGQWIGYSQDSRLPAEFDLSAALRPGQNRLAVMVLRWCDGSYLEDQDMWRMSGIFRDVTLLHKPETQIADYHVVTDLNAELDRAVLKVDVTLAGAGFADGEVVFTLWRKGEKCASVSRQPGSAIVDERGSWAERLTVTIPVETPALWSAETPELYRLTMALLNPQGEVLEIEACDVGFRRVEISNGLLKLNGKPLLIRGVNRHEHHSENGQVMDEATMRRDIETMKQHSFNAVRCSHYPNHPLWYQLCDRYGLYVVDEANIETHGMVPMSRLADDPRWLPAMSERVTRMVQRDRNHPSIIIWSLGNESGHGANHDALYRWLKTTDPTRPVQYEGGGANTAATDIVCPMYARVDRDQPFPAVPKWSIKKWIGMPDETRPLILCEYAHAMGNSFGGFAKYWQAFRSHPRLQGGFVWDWVDQALTKRDEDGNTFWAYGGDFGDKPNDRQFCLNGLVFPDRTPHPALYEAHGPQQFFTFTRVSTSPLVIEVQSGYLFRHTDNEVLNWTVARDGDVLVAGEVTLAMVPEGTQRLEIALPELNAGPGEVWLNVEVRQPRATPWSPAAIAAAGSSGRFRLRSLLLRQPRRRAAVLTQTDRILEIAHRQQRWQFDRASGNLTQWWRNGVETLLSPLTDNVSRAPLDNDIGVSEATKIDPNAWVERWKAAGMYDLTPRVLHCEAEQHAGEVVVTTQHVLEYRGKALFLSRKVWRIDEQGVLHGDIQVDMASDIPEPARIGLSVHLAETPENVRWLGLGPHENYPDRKLAAQQGRWTLPLEAMHTPYIFPTENGLRCDTRELVVGMHQLNGHFHFSVSRYSQQQLRETTHHHLLREEPGCWLNLDAFHMGVGGDDSWSPSVSPEFILQTRQLRYTFSWQQNP

SEQ ID NO: 3472 - protein, 1015 aa, Unknown
  Arthrobacter sp. B7
MSSSYITDQGPGSGLRVPARSWLNSDAPSLSLNGDWRFRLLPTAPGTPGAGSVLATGETVEAVASESFDDSSWDTLAVPSHWVLAEDGKYGRPIYTNVQYPFPIDPPFVPDANPTGDYRRTFDVPDSWFESTTAALTLRFDGVESRYKVWVNGVEIGVGSGSRLAQEFDVSEALRPGKNLLVVRVHQWSAASYLEDQDQWWLPGIFRDVKLQARPVGGLTDVWLRTDWSGSGTITPEITADPAAFPVTLRVPELGLEVIWDSPADVAPVSIDAVEPWSAEVPRLYDASVSSAAESISLRLGFRTVKIVGDQFLVNGRKVIFHGVNRHETNADRGRVFDEASAREDLALMKRFNVNAIRTSHYPPHPRFLDLADELGFWVILECDLETHGFHALKWVGNPSDDPAWRDALVDRMERTVERDKNHASIVMWSLGNESGTGANLAAMAAWTHARDLSRPVHYEGDYTGAYTDVYSRMYSSIPETDSIGRNDSHALLLGCNAIESARQRTRPFILCEYVHAMGNGPGAIDQYEDLVDKYPRLHGGFVWEWRDHGIRTRTADGTEFFAYGGDFDEVIHDGNFVMDGMILSDSTPTPGLFEYKQIVSPIRLALTLNAEGNAGLTVANLRHTSDASDVVLRWRVEHNGTRVDAGELTTDGANGPLQAGDSLTLTLPTIVAAAEGETWLSVEAVLREATAWAPAGHPLSETQLDLSPAQPPLRVPRPASPIAGAAPVELGPATFDAGSLVTLAGLPVAGPRLELWRAPTDNDKGQGFGAYGPEDPWINSGRGVPAPSSAVVWQQAGLDRLTRRVEDVAALPQGLRVRSRYAAANSEHDVAVEENWQLSGDELWLRIDIAPSAGWDLVFPRIGVRLDLPSEVDGASWFGAGPRESYPDSLHSAVVGTHGGSLEELNVNYARPQETGHHSDVRWVELSRDGAPWLRIEADPDALGRRPGFSLAKNTAQEVALAPHPHELPESQHSYLYLDAAQHGLGSRACGPDVWPDFALRPEARTLVLRIRAA

SEQ ID NO: 3473 - protein, 370 aa, Oryza sativa
MPGQGADLGIKTYPSLAMVIETLKGIDKYSREGGTPGLGKMTPSLVVISASIVGVVLKENRTGPNRLVFKIGVQIIPQIQKLKWGIAANKDTTLTSKKSLTDAELDTLLKAISLPWIDRRKKHCALPGVVEKARAKEGWTTSNGNMLADSYHSYLHNCSREGKADVSETGNNTPSTTGSNYFGSFPREAKITFEGLVMEALPNGMFRVRLENDTIILGYISGKIRSSSIRILMGDRVKIESTPLNSDWRVVEVIDHHAQYAEPARTRQYAYLHLLQIGLHLERLYMNQQRNEEIRADFNQIFKFFFLFHNHLPNKALFEKNLVWLLHRIYGHTFKVLNKRGERPRSKLLERLKLAADSKGRVFLNATCSF

SEQ ID NO: 3474 - protein, 330 aa, Pyrococcus abyssi
MHPKVDALLSRFPRITLIPWETPIQYLPRISRELGVDVYVKRDDLTGLGIGGNKIRKLEFLLGDALSRGCDTVITIGAVHSNHAFVTALAAKKLGLGAVLILRGEEVLKGNYLLDKLMGIETRIYEADNSWELMKVAEEVAEELKGEGKKPYIIPPGGASPVGTLGYIRGVGELYTQVKKLGLRIDTVVDAVGSGGTYAGLLLGSAIVNAEWSVVGIDVSSATEKAKERVKNLVEKTKELLGINVKVQEPRIYDYGFGAYGKIVKEVAKLIKSVGTMEGLLLDPVYTGKAFYGLMDLAKKGDLGESVLFIHTGGLPGIFHYGEEMLELLV

SEQ ID NO: 3475 - protein, 446 aa, Oryza sativa
MAKRSSPDPASSSPSASSSPSSPSSSSSEDSSSPMSMPCKRRARPRTDKSTGKAKRPKKESKEVVDPSSNGGGGGGGGKRSSIYRGVTRHRWTGRFEAHLWDKNCSTSLQNKKKGRQGAYDSEEAAARAYDLAALKYWGPETVLNFPLEEYEKERSEMEGVSREEYLASLRRRSSGFSRGVSKYRGVARHHHNGRWEARIGRVLGNKYLYLGTFDTQEEAAKAYDLAAIEYRGANAVTNFDISCYLDQPQLLAQLQQEPQLLAQLQQELQVVPALHEEPQDDDRSENAVQELSSSEANTSSDNNEPLAADDSAECMNEPLPIVDGIEESLWSPCLDYELDTMPGAYFSNSMNFSEWFNDEAFEGGMEYLFEGCSSITEGGNSMDNSGVTEYNLFEECNMLEKDISDFLDKDISDFLDKDISISDRERISPQANNISCPQKMISVCN

SEQ ID NO: 3476 - protein, 370 aa, Pseudomonas aeruginosa
MSLPNANLIASSRKAAAQMATRDTSFIFNEWYVAAFAEEVGRELLARTLLGKRVVLYRTLAGQAVALEDRCAHRSFPLSRSRLEGDGIVCGYHGFRYDSQGELIETPSQKACPRGVGIRHYPLLERGPLVWIWLGDPRLADPKRLPQRPWLEDPGWACSKGYFLHPGNYVSMHENLMDLTHLTYLHANTIGTPDYAGAPYELDLKEGHYRLVRHVLPTTLSPVWGRTTGLDGCPTAARITTSEFLSPGLHQVSATFYDTALPAERRPEFHIRTAHILTPETHGSMHYFIVHGRDFAQDDETVGAFMHEQLFAAFVEDVEGLGALEKVLAEADEDSYEISVASDAPAVATRTYLKRRADEEAHQRAAHRVA

SEQ ID NO: 3477 - protein, 171 aa, Triticum aestivum
MQSLQDKASEWSGVAAADAFAIDEVNVFEALGGTPQPFVDLSTNFYTRVYEDEEQWFREIFSGSRKEDAIQNQYEFLVQRMGGPPLFSQRRGHPALIGRHRPFPVTHQAAERWLHHMQQALETTESINPDTKTKMMIFFRHTAYFLVAGNEMTRQTQSVPPCKHATSKPAE

SEQ ID NO: 3478 - protein, 150 aa, Cucurbita moschata
MAMGMLEVHLISGKGLQAHDPLNKPIDPYVEINYKGQERMSKVAKNAGPDPLWDEKFKFLAEYPGSGGDFHVLFKVMDHDAIDGDDYIGDVKIDVKDLLAEGVRKGWSEIRPRMYHVLAHKIHFKGEIEVGVSFKLQGGGGCAGCYPWEN

SEQ ID NO: 3479 - protein, 617 aa, Aspergillus oryzae
MALASKDRIEPGSFNVPVGAFPATCSSTGIDADKIASEVIRLLNTALGLKQPQQISKLFLEDGYWRDHLVLTWDFRTIKGQENITRFLQENPRLLQVEIDRSSAFKAPAIFPIDAFGDVTGVQFFIKVTTDAGSGKGVVRLAEKDGEWKIFTFFTSLLEIKGSEEKINHHRPVGVSHGEHHDRRNWQDRRTADFNYEGKSPTVLIVGAGQAGLTIAARLKMLDIDALIIDEEDRIGDNWRRRYHQLVLHDPVWFDHMPYLQFPANWPIFTPKDKLAEFFECYAKLLELNVWTKTKLQSTSWSDANNVWTIELQRQKEDGTVETRTFNPRHVIQATGHSGKKNLPEFKGVETFQGKRICHSSEFPGADPNSKGKKAVVVGSCNSGHDIAHDYFEKGYDVTMVQRSSTCVISSKSITDIGLKGLYEESAPPVEDADLFLWSIPSDLFKAQQKKVTAVQNQNDKATLDGLEKAGFKVDRGPDDAGLLIKYLQRGGGYYIDVGASQLIVDGKVKVKQGQEIAEVIPQGLRFADGSELEADEIIFATGYQNMRTQARIIFGDEVADRIQSVWGYNEEGEMRTIWQRSGHPGFWFMGGNLALCRYYSRLLALQIKGVELGLNH

SEQ ID NO: 3480 - protein, 111 aa, Mesembryanthemum crystallinum
LIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGF

SEQ ID NO: 3481 - protein, 326 aa, Neotyphodium lolii
MSPPAAISPPRQVAELATQTSKFAVSGGSKTQTIDEMMGQWNSFKFAPIRESQVSRAMTRRYFQDLDTYAESDIVIVGAGSCGLSAAYVLGKHRPDLKICIIEASVSPGGGAWLGGQLFSAMVMRKPADAFLREIGVPYEDEGNYVVVKHAALFTSTIISKVLSLPNIKMFNATCVEDLITRPSEEGVRISGVVTNWTLVSMHHDDQSCMDPNTINAPLVISTTGHDGPMGAFCVKRLVSMQRIEKLGGMRGLDMNTAEDAIVKNTREIVPGLIVGGMELSEIDGANRMGRVQHSVQWSLAVSRLPRKRSRFLTFAQSRMPSKVYV

SEQ ID NO: 3482 - protein, 354 aa, Unknown
  Forsythia x intermedia
MAKVVNPRVEILASNGIQSIPKEYVRPQEELESIRDVFEEEMSDEGPQLPTIDLEGLDSDDKQVREKCHQELIKASKEWGVMHLVKHGISDELIDRVKMAGKAFFNQSVEKEKYANDQASGNVQGYGSKLANNASGQLEWQDYFFHCIFPEEKRDLSICPKTPTDYIPAISEYAKQLRDLTSKMLSVLSLGLGLEQGRLEKEVGGMEELLLQLKINYYPKCPQPELALGVEAHTDISALTFILHNMVPGLQLFYKGKWVTAKCVPNSIIMHIGDTIEILSNGKYKSILHRGLVNKEKVRISWAVFCEPPREKILLKPLPETVSEAEPSRFPPRTFAQHVMNKLFRKSEDSGETK

SEQ ID NO: 3483 - protein, 710 aa, Ustilago maydis
MAMSDATVFDIDYPFPDLDATRARESLRFAALELSNRGLASSSRWTLELLQSVPYTGNLNSGLVLSDQSRSNHSAMVTSTPAPKRRSQARSLVPEHSTPALGVHQRMSVEPGAEDTSAGEGLESFAPGTFSSSPLVNSRLAHVASPRDDPDSSLIPVGSEDGTAPGSAHVHWQSNTNSVDCSPGAFQYRLDGTSSAALSSLEEDSYLLAKNYFDQHQLERCIWVLEGSKGSSDKARFLRLYSRFLMSERKLDEHGMIIPKPNGTLPATSPSLIPILKELVDVSDPFLLFLKGAILRKLNRPIEAMDCLVRSVQSFAYNWAAWQELAMTLEPGEADQMADLLPESFMVSFFREFLDRHSAQEGDATITRIDRLLESFPRSAYLLTCRAQTNVHRLEYIEAEQDFQEAWSIDPYRIDGLADYSNALYLLNRTAELAHLAHKFSSFAKDRPEVCCLVGNYYNQRSDHHRAIEAFRHALRLDSGCVPAWILLGHEYIELKNSHAAAEMYRRALKINPREYRALYGLGQVYELNGAYTYAVNYFQKCAAIRPYDGRMWSSMGICYDHLGRSQDAVSCFKRYLACRLNQGDTVMGLTRIIEVYEKERDFEAAACYHRRLVQVVDRALTGTESNVVARYARSYIIAARWEMGEIGVRSAQEREETADEKEQDGEPETVAKVGNLALANDYLQKVIAAGTEMTDSAEILLKRLAFLRD

SEQ ID NO: 3484 - protein, 481 aa, Clostridium acetobutylicum
MSELSFRDLGLSEEILKSIEKLGYKKPSSIQEKVIPVILNGKDIIAKAKTGSGKTAAFAIPVCEKIELEEREPQVLVLAPTRELAYQIKEDFLNIGRFKRLRCISIFGKEPISNQIRELKQRVHIVVGTPGRVLDHIERGTLNLEKVKYFIIDEADEMLNMGFIEQVESILIKMPKNKNTFLFSATLPEEIVMLSKKYMKNFENIEVQNEGKTKGGIHQVYYEVESREKFDLLKKVIYKEVPGSSIIFCRTKNNVEDVLVKMKNMKFSCMAIHGGMLQENRIAVMNAFKRGEFTFLIATDVAARGIDVENVTHVINYDIPMEKESYIHRIGRTGRMGNKGIAITFVTSKEERFLKEIEEQFSLEIIKEEPPTREEVKKGQEVFKTASKQLNKTKANKSEKLNKDITKIYLSAGKKKKIRPGDIAGTISSIDGVSPEDIGIIDIHDNFSYVEILSGKGDIVLNAIEDKTIKGKKVRAEKAQK

SEQ ID NO: 3485 - protein, 346 aa, Robiginitalea biformata
MKQEIQAFNNILELIGKTPLVRLNRLTAGFPGEYYAKLEAFNPGHSSKDRIAHFIIEEAERSGILKPGSTVIETTSGNTGFSLAMVSIIKGYECILAVSSKSSRDKIDMLRSMGAKVYICPAHVSADDPRSYYQVAKRLHQETQNSIYINQYFNDFNIKAHYATTGPEIWEQTGGQITHLVACSGTGGTISGTARYLKEQNPDIRIIGVDAYGSVLKKYHETGEFDTEEIYPYRIEGLGKNLIPDATDFTVIDEFIKVTDEESAHTARELCHKEGIFAGYTSGAAMQALKQLQEDKTFDANSRVVVIFPDHGSRYMSKIYSDKWMEDQGFFDSKHVGEEQQIQVIK

SEQ ID NO: 3486 - protein, 79 aa, Triticum aestivum
  misc_feature (2)..(2): Xaa can be any naturally occurring amino acid
  misc_feature (5)..(5): Xaa can be any naturally occurring amino acid
  misc_feature (9)..(9): Xaa can be any naturally occurring amino acid
  misc_feature (11)..(11): Xaa can be any naturally occurring amino acid
  misc_feature (14)..(14): Xaa can be any naturally occurring amino acid
  misc_feature (17)..(17): Xaa can be any naturally occurring amino acid
  misc_feature (22)..(22): Xaa can be any naturally occurring amino acid
  misc_feature (26)..(26): Xaa can be any naturally occurring amino acid
  misc_feature (28)..(28): Xaa can be any naturally occurring amino acid
  misc_feature (34)..(34): Xaa can be any naturally occurring amino acid
  misc_feature (42)..(42): Xaa can be any naturally occurring amino acid
  misc_feature (44)..(44): Xaa can be any naturally occurring amino acid
  misc_feature (53)..(55): Xaa can be any naturally occurring amino acid
  misc_feature (58)..(58): Xaa can be any naturally occurring amino acid
  misc_feature (66)..(67): Xaa can be any naturally occurring amino acid
  misc_feature (70)..(70): Xaa can be any naturally occurring amino acid
IXRAXMQTXGXDPXKVXELMDXSIRXIXLQVPIXVLGVDGVXYXFSGCHRYEXXXRLXLPTIRCKXXRGXKETLRDQMR

SEQ ID NO: 3487 - protein, 702 aa, Burkholderia mallei
MPTPTPDRLEPGRSYPLGAHWDGLGVNFAVFSAHARRVQLCLFDPTGRREIARLDLPECTDEIWHGYLPDAHPGTVYAFRADGAYEPQHGHRFNPHKLLLDPYARKLVGQFRWSDALFGYRLHSSRADLSIDRRDSAPAMPKCVVVDEAVDWSTDRRPCVPWRDTVIYEAHVRGVSMRRAELRAPERGTFAALACPAFIDHLLALGVTSVELLPVHAFMHARALVNLGLCNYWGYDTAAFFAPEPSYLATRRLDEMRIAIRQLHAAGIEVLLDVVYNHTCEGNQLGPTICWRGLDNASYYRLAPDDPRRHIDETGCGNTLDLSHPRVLQMVMDSLRYWSNAFNVDGFRFDLCATLGREAAGFDPGAGFFDALRQDPVLATRKLIAEPWDVGPGGYQLGRHPAGFAEWNDRFRDTVRRFWRGDAGMRPELAARLAGSADLFNHHGRRTWSTVNFVAAHDGFTLADLVSYAAKHNDANGEDNRDGRDDNCSANWGAEGPTEDRQVRAVRARVARSLLTTLFAALGTPMLLGGDEFGRTQQGNNNAYCQDNELSWFDWSAAESADGRTMIHFVGRLAALRRAYPVLSEPRYPSGERDGAPGLHEIDWFDERGDALTVPAWHDRERRALTMRRVGNGRAGRPEALLLMLNASSDAIVFHAPPPSLVYRILLDSAAPDAAPRLMPADGVEIAAHAAVIAAASVPEAG

SEQ ID NO: 3488 - protein, 530 aa, Clostridium acetobutylicum
MSMFCYQCQEAAGCKGCTVRGVCGKTEDLAKKQDLLIYTLKVVSLYNVEARKLNLVNKEIDNYIVDSLFATITNANFDENIFTERIEKGIKYKEELKKQISAAGGNVNLNEKTEAVGVLSTENEDIRSLRELLTYGIKGMAAYLKHARNLSYEDSNIQGFMSKALAATLDDTLGADELVALALECGKYGVDAMALLDKANTETYGNPEITKVNIGTRNNPGILISGHDLKDIEELLKQTEGTGVDVYTHSEMLPANYYPAFKKYSHFVGNYGNAWWKQNEEFESFNGPILMTTNCIVPPKASYIDRMYTTGVTGYPGVKHIENGEPKDFSAIIEHAKKCAPPTEIEKGEIIGGFAHNQVIALADKVVEAVKSGAIKRFYVMAGCDGRAKTRNYYTDFAKALPKDAVILTAGCAKYKYNKLDLGDIGGIPRVLDAGQCNDSYSLVVIALKLKEVFGLNDINELPIAYNIAWYEQKAVIVLLALLHLGVKNIHLGPTLPAFLSPNVAKVLVDNFGIGGITNVEDDIKMFENL

SEQ ID NO: 3489 - protein, 420 aa, Bordetella pertussis
MDEIQSIVIVGAGQAGAVAAASLRQLGYRGGLTLVGQEAHPPYERPPLSKAVLQGTATHAEAAVHPAGFYAENDIALLTETAVAALDPAARTVRLADGRTLPYDRCLLATGGHARELPALPRGRAGVHYIRTLDDALDLRAALRPGVRAAVIGGGFLGLEVASTARELGAKVTVIENGSRLLERALPAIVSDWLAERVRASGVDLRLGGAIAAIGDGPPYAITLADGTQVNADLIVVSIGLAPEVTLARQAGLPLDDNGGICVDSQARTADPQVYAAGDCASQPRACLGTAARFESWQNANEQARAAAAAMLGLAPAAEPYPWFWTDQYGCNIQILGLPQPGLRYVCRPQTDPQAAPRVLWIGLRDGVPCHGIAVNAGGDLRQLRVLFERGIPVDPHRLADPAEALKPLVKAWQAAIAVA

SEQ ID NO: 3490 - protein, 580 aa, Burkholderia mallei
MNDSTATHAYALPFGATCVDARHTRFHLWAPACRSAAVERQDGETVAMTPDGGGGFDAIVRCGPGTLYRYLLDGTLRVPDPASRFQPHGVHGPSEVVDPAAYRWRHDDWRGRPWRETVLYEVHVGAFGGYARIARRLPALAALGITAIELMPVNAFPGARNWGYDGVLPFAPDASYGPPDALKSLVDAAHGLGLQVLLDVVYNHFGPDGNLLPRYAPAFFRRDRDTAWGPAIDFSCPQAGAFFLENALYWLDEYRFDGLRIDAAHAIGDDAWLAGLARRVRAYAGDARHVHLVLENERNTASLLAGGRFDAQWNDDFHNSMHVLLTGEQAGYYRAYADAPIRHLARVLGEGFAYQGEPSPLHGGAPRGEPSADLPPSAFVAFLQNHDQIGNRAFGERLRALVNDDALRAASALALLAPQIPLLFMGEECGTTQPFQFFTDHRGALAAAVREGRRREFAAFPAFADPAHRDAIPDPNDPATFARSSLVARWRLGDGSTLAIALNLDARPAALAAPPDGKIVFETPPRARDALADARLAAHACIAWRSGNVNGVARRGRAVDAKHMPAVKHANGVNGQDGAP

SEQ ID NO: 3491 - protein, 242 aa, Neisseria meningitidis
MSQITMRQMIEAGVHFGHQTRFWNPKMAQYIFGARNKIHIVNLEKTLPMFQDAQEAVRRLVANKGTVLFVGTKRQARDIIREEATRAGMPFVDHRWLGGMLTNYKTVKQSIKRLEEKTAALENAAESGFSKKEILEMQRDVEKLERSLGGIKNMKGLPDAIFVIDTGYQKGTLVEAEKLGIPVIAVVDTNNSPDGVKYVIPGNDDSAKAIRLYCRGIADAVLEGKNQALQETVAAAQEAAAE

SEQ ID NO: 3492 - protein, 177 aa, Arabidopsis thaliana
MENMGTRVIEPLIIGRVVGDVLDFFTPTTKMNVSYNKKQVSNGHELFPSSVSSKPRVEIHGGDLRSFFTLVMIDPDVPGPSDPFLKEHLHWIVTNIPGTTDATFGKEVVSYELPRPSIGIHRFVFVLFRQKQRRVIFPNIPSRDHFNTRKFAVEYDLGLPVAAVFFNAQRETAAHKR

SEQ ID NO: 3493 - protein, 140 aa, Sulfolobus tokodaii
MTSKDKISMTTEKDPELGKLLEKKAKELMSQKPKGEVIHLDSKNFDSFLASHKIAVVDFWAEWCAPCLILAPIIEELAEDYPQVGFGKLNSDENPDIAARYGVMSLPTVIFFKDGEPVDEIIGAVPREEIEIRIKNLLGE

SEQ ID NO: 3494 - protein, 536 aa, Glomus mosseae
MASTPPTDYGKEAVLDVSETRDVETGEVKNGGLKQDLKNRHMQMIAIGGAIGAGLFVGSGGALQKGGPAALLIGYLIIGIMLLCTCLALAEMAVLYPVNGAFFTYIVRFVDPSWGFAMGWQYALAWLTVLPFELIAASITIRFWREDINMAVWVSVFLVVLMGIQIFGVRGYGEVEFVLSIIKICACVGFIILGIVINCGGVGDQGYIGVKYWRDPGAFTSFKGFCAVFVVAAFSFGGTEMVGLAAAESANPRKSIPMASKQVFWRIAIFYILNLFIVGLILPANDPRLMGASGANTKASPFVLAIQDAGIKVLPSIMNAVITVAVLSVANSCTFGSTRTIQAMAERNMAPNFFKYIDSKGRPLYCVILQIAFGLLAYIGAAPQGMEIFGWLLALTGLGFLFVWGSICLAHIRMRAGMKAQGINLGLIPYKTPFGVAGSYLGLGLNILALIASFYTALFPASGASPTAEAFFSSYLAFFSVTLLYLGYKACTRKRQMYVRPAEMDLASGAVWLEEVEPKEPFVWADTPKKVLRSFY

SEQ ID NO: 3495 - protein, 177 aa, Arabidopsis thaliana
MENMGTRVIEPLIMGRVVGDVLDFFTPTTKMNVSYNKKQVSNGHELFPSSVSSKPRVEIHGGDLRSFFTLVMIDPDVPGPSDPFLKEHLHWIVTNIPGTTDATFGKEVVSYELPRPSIGIHRFVFVLFRQKQRRVIFPNIPSRDHFNTRKFAVEYDLGLTVAAVFFNAQRETAARKR

SEQ ID NO: 3496 - protein, 1041 aa, Pleurotus djamor
MSSLRWSVGLRIVAGVRHRPVRCPTRRFATLKPLSSLFAPLDTFPERHIGPDDRETSYMLSKLNYNSFDAFIADTVPDQIRVSDTVNNSTIPPLSESELHRRAQALGAKNEKFKSYIGMGYHNAVVPPVVLRNVMENPQWYTPYTPYQPEVAQGRLESLVNFQTMVMSLTSMDIANASLLDEATAAAEGMVMAYVNSNHKKRSFFVDSGVSPQTLAVLRTRAKGFGINIVTGNVERIVSDTALRSDLCGVLVQYPDVDGTIKDYSALADSVHSAGGLVICATDLLALTMIKPPGEWGADVVLGNSARFGVPAGYGGPHAAFFAVTDKLKRKMPGRLIGRSRDASGRPAYRLALQTREQHIRREKATSNICTSQALLANMAAMYAVYHGPEGLKRVAERIHGLTQVLKTAVEGLGFKSVNTEFFDTLTLDVSAATGTADVVHATAMAANINLRQIDDTHVGVTLDESVGPIDLLSIINVFASAVSAPVIDRSRLVLPERVAIASSLRRTSEFLPHPVFNKHHSETEMLRYINHLASKDIGLVHSMIPLGSCTMKLNSTSSMIPLTWPEFSSVHPFAPAEQVEGYLTIIKELEEDLCRITGFHAASLQPNSGAAGEYAGLCVIRAYHESRGEGHRDICLIPLSAHGTNPASAVMAGLKVVPVKALADGSLDLKDLKEKAEKHKDQLAAFMITYPSTFGVFEDGVQEACKIIHDNGGQVYLDGANLNAQIGSTNPAKCGGDVCHMNLHKTFAIPHGGGGPGVGPICVAEHLAPFLPTHPYLSTEANSQAINAVSAAPFGSSSIHLISWAYIKMLGGQGLADSSRIALLNANYMAYRLSGHYSLRYKNNNNRVAHELLIDLAEFDKAAGLKVTDFAKRLQDYGFHPPTCSWPISTCMLIEPTESETLEEIDRFCDAMIQIRQEAQDIIDGKQPKDNNLLKNAPHPAHVIALPEAEWNRPYSRETAAYPAPWLHEKKFWPTVSRIDDGGSRFLIVLSLADRYLAHSSLRRPQSHRECCTSVACSSPSLMMYLLQCDCPSVEELAHA

SEQ ID NO: 3497 - protein, 235 aa, Suaeda maritima
MAEERSVKLYGTWSSPYVLRVKLALKIKGIEYDYFEEDLANKSELLLQYNPVYKRVPVLVHNGLPISESSVILEYIDETWTDPPHLLPKDPYLRAKHRFWAAYLQQVAEMFGTSLVLKSQGKDIEDVVNEYWNKMDVAEELIRETFPYNEIPCFKDTIKPGYLDIILYSLVGTSDASEELFGFKPFIPERYPLLASWTKALSEVPEVKEVTPPKDKLIELLRTIRQMYLPSAPKA

SEQ ID NO: 3498 - protein, 234 aa, Bradyrhizobium japonicum
MRRPALLSLLAATTALTLAFAVPSRAAEDAVVIPAPTMDAAPASGIQTAVIAGGCFWGVQGVFQHTAGVVNAVSGYAGGTKATADYQTVSSGRTGHAESVEIKYDPKKISYGKILQIYFSVAHDPTQLNRQGPDTGTQYRSAIFTTSEEQKKVAEAYIAQLNGAKVFSKPIVTKVGALEAFYPAEAYHQDYLTLHPNQPYIAYNDLPKVENLKKLFADNYIEKPTLVNASKATN

SEQ ID NO: 3499 - protein, 752 aa, Thiomicrospira crunogena
MKRMLINATQSEEVRIALVDGQKLYDLDVETPHHQKKKANIYKGTITRIEPSLEAAFVDYGAERHGFLPFKEIAEEYYPDNKSSGRLSIKDILKEGQEVIVQVQKEERGNKGAALTTQITLAGPYVVMMPNNPKAGGISRRIEGEDRSETRDALQDLNMPEGMGLIIRTAGVGKSTEELQWGVNYLVQLWEAIQKASKEKSAPFLIHQESDIVILAIRDYLRQDIGEIIIDDMETFHKARDFVQHVMPHQVYKVKPYQDTIPLFTRFQVESQIETAYTREVTLPSGGAIVIDITEALTSIDINSSRSTKGGDIEETAYHTNLEAACEIARQLRLRDIGGLVVIDFIDMHSNRHQRDVENKMREAVKSDRARVQIGKISRFGLLEMSRQRLRPSIEESTQMVCPRCNGVGVIRGVQSLALSILRLLEEEAMKENTRRVTVQLPVDVATFLLNEKRHQIINIEDRHNLHVLIVPNEHLDTPDYLMERTRSGDEMSTDSSYKIKEFIDKETQQKQDLPTIAKEEPAIKNMQPSSPPPAPTPKTEEKPGLFVRLWKTLFAAEEPEKEEEPQKAGNKGRNNRNNNNRNRNNNNRNRNNRRRPSSENDDNTDKNEPRKENKRSDNKASDKPSEPRENPRRRRPRNAQSEKPEVKEDKTTKAASNRTEDSSRPSKAATSEEAATPDTTNKPTKKEQSDRPRRRSRYNTRSYNSRRRKPEGAENMSIHSLPEQPKATDTHNKESHSSDNGNATESAENKA

SEQ ID NO: 3500 - protein, 176 aa, Exiguobacterium sibiricum
MSIEVGSKVQGKVTGITNFGAFVELPTGKTGLVHISEVADSYVKDINDVLTVGQEITVKVLSVENDGKIGLSIKKAVDRPEGERPRPPARQFDRGPRPAGQDRGPRSFDNKGPRGGSGGGGNRGGFNKGGRGAPAPRKEQTFDTLMTSFLKDSEDRLATLKRQTDSKRGGRGAKRQ

SEQ ID NO: 3501 - protein, 626 aa, Lactobacillus johnsonii
MKANIRWLDDPETFRVNQIAAHSDHLYFKNYEEWEQKRSSFIQSLDGKWQFKFSNNPQTRPLDFYKTNFDASDFDFIPVPSEIELNNYAQNQYINTLYPWEGKIFRRPAYSLGQKTDRSFSGGEDNTVGSYIKHFDLDNSFQGKHVHVFFEGVERAMFVWLNGHFIGYGEDSFTPSEFDLTPYLKEKNNILAVQVFKHSTASFLEDQDMFRFSGIFRSVKLLAFPETHLMDLALKPTITNDYHDGIFNAKLSFTGTKDGYVRLKIKDINGQTLLDEEHNLTSTITIENKLLKNIHLWDNHHPYLYQLFIEVHDSNKNLIELDSYKFGFREIKITDDKVVLLNGKRLIINGVNRHEWNMNSGRTITKQDMKADIQTFKRNNINAVRTCHYPNQIPWYYLCDQNGIYVMAENNLESHGTWQKMGKVEPSYNVPGSLAEWRNVVIDRARSNYETLKNHTSILFWSLGNESYAGENLIAMNQFYKSHDDTRLTHYEGVVHTPDLKNKISDLESYMYLPPKEAEKYLKNNPSKPFLECEYMHDMGNSDGGMKSYIKLIDEYPQYLGGFIWDFIDQALLTYDPISGKKVLRYGGDFDDRHSDYEFSGDGLMFADRTEKPAMQEVKYYYGLHK

SEQ ID NO: 3502 - protein, 563 aa, Unknown
  Synechococcus sp. RS9916
MQQPWWNGAVIYELIVRSYADGNGDGVGDFQGLTARLPYLRWLGVEAVWLTPIYPSPLQDGGYDITDFQGIHPDLGDLAAFHRFRTAAHKHGIKVILDLVLNHTSTLHPWFQRARWAPKHSPERDVYVWSDDPNRYSEAPVLFRHFEASNWEWDEVAQQYYLHRFLRHQPDLNYENPLVQEAMLEVVDVWIERGVDGFRLDAIPFLFEEEGSRCEGLPATHAFLQRLRQRVEAHGRDVLLLAEAIQPVEEAAPYLDDSELHGAFNFVLTAHLFAAIASGRVAGLRQCLAEAKAAVPGCRWALPLRNHDELWLGDGHLVSDAVVQTIRAGLHQGHGHWLNWGINRRLAPLLNGDPGSNRVLHALIYSLPGMPCLYYGDELGMGDWPGLRDRDPNRTPMAWTPARNGGFSTAPDPLLVLPSITAPGYDYRVVNVEVQKQLQGSLLNWHRRMLTCRRLLPALRHGDFELLECSHPAVIVYVRTSESMTVLVAANLSAAGASLRLDLSRWKGERTREVLWGCEFPPADHDWFVYLPAHGFSWWLIGEVDAELDDQAAQRSRPVTAPD

SEQ ID NO: 3503 - protein, 181 aa, Exiguobacterium sibiricum
MTLMNDMEKVLISEEEIQHKVGELAGELTADYGDRFPLLVCVLKGAMPFMSDLVKKMDMHLEMDFMDVSTYHGGTTSTGEVKIEKDLNTSVEGRDILIVEDIIDSGLTLGYLVDLFKYRKAKSVKIVTLLDKPSGRKNDLHADYSGFVIPHEFVVGYGLDYEEKYRNLPYVGVLKPAVYGG

SEQ ID NO: 3504 - protein, 416 aa, Salmonella enterica
MLEQMGIAAKAASYKLALLSSGEKNRVLEKIADELEAQMESILSANVQDVEQARANGLSEAMLDRLALTPARLKAIADDVRQVCNLADPVGQVIDGGLLDSGLRLERRRVPLGVVGVIYEARPNVTVDVASLCLKTGNAVILRGGKETHRTNAATVRVIQKALKACGLPEAAVQAIDNPDRSLVNEMLRMDKYIDMLIPRGGAGLHKLCREQSTIPVITGGIGVCHIFVDSSADIAPALKIIVNAKTQRPSTCNTVETLLVHQDIAERFLPVLSKQMAESGVTLHGDETVMQVLHGPAKLVPLKPEELDNEFLSLDLNVVVVENMDGAIGHIREHGTQHSDAILTCDMHNAARFVNEVDSAAVYVNASTRFTDGGQFGLGAEVAVSTQKLHARGPMGLEALTTYKWIGFGDGTIRA

SEQ ID NO: 3505 - protein, 544 aa, Oryza sativa
MGLDLGALVLKSGGLLVSDYDSIVAINIFVALLCSCIVIGHLLEGNRWVNESITALVMGLITGGVILLVSGGKNSHILVFSEDLFFIYLLPPIIFNAGFQVKKKQFFRNFMTIILFGAVGTLISFVIISLGAMTLFKKLDVGPLQLGDYLAIGAIFSATDSVCTLQVLNQDETPLLYSLVFGEGVVNDATSVVLFNAIEDIDIANFDSLVLLAFIGNFLYLFFTSTLLGVVAGLLSAYIIKKLCFARHSTDREVAIMILMAYLSYMLSMLLDLSGILTVFFSGIVMSHYTWHNVTESSRITTKHTFATLSFIAEIFLFLYVGMDALDIEKWKLASSSPKKPIALSATILGLVMVGRAAFVFPLSFLSNLSKKETRPKISFKQQVIIWWAGLMRGAVSIALAYHKFTASGHTELRINAIMITSTVIVVLFSTMVFGFFTKPLLNLLIPPRPDIAADLSSQSIIDPLLGSLLGSDFDVGQPSPQNNLQLLLTIQTRSVHRVWRKFDDRFMRPMFGGRGFVPFVPGSPVERSIHGSQLGTVTEAEHS

SEQ ID NO: 3506 - protein, 367 aa, Salmonella enterica
MSDSQTLVVKLGTSVLTGGSRRLNRAHIVELVRQCAQLHAAGHRIVIVTSGAIAAGREHLGYPELPATIASKQLLAAVGQSRLIQLWEQLFSIYGIHIGQMLLTRADMEDRERFLNARDTLRALLDNHIVPVINENDAVATAEIKVGDNDNLSALAAILAGADKLLLLTDQQGLFTADPRSNPQAELIKDVYGVDDALRSVAGDSVSGLGTGGMSTKLQAADVACRAGIDTIIASGSKPGVIGDVMEGISVGTRFHAQASPLENRKRWIFGAPPAGEITVDEGATAAMLERGSSLLPKGIKSVTGNFSRGEVIRICNLQGRDIAHGVSRYNSDALRRIAGHHSQQIDAILGYEYGPVAVHRDDMITR

SEQ ID NO: 3507 - protein, 455 aa, Spiroplasma citri
MTTVLQLYQDQIKDQSEVTILGWVRSNRSSSKLGFLVMNDGTVFDNVQIVYRPEQLANFLAISSLRISSAIKVVGKFCLTPSAKQPFEIQASVIEILDEATEDYPLQKKEHSYEYLREIAHLRAKTNTFNAVFRIRSSSSFAIHEFFNKNNFIYVHTPIITGNDAEGAGESFIVTTRTDDNYNEDFFGKKASLTVSGQLHAEGFAQAFRNVYTFGPTFRAENSNTTRHAAEFWMIEPEIAFIDLEENMALIEKMIKHIINYLFVNNSHELAFLNSNVDDKLLKRLKSVINDEFVRLSYTKSIEILQKAVTKGQKFENTNIFWGMDLQTEHERYLCEIETKKPTFLFNYPKEIKAFYMKINDDNKTVAACDLLVPGIGELVGGSVRENDYDKIVNRCNELKIPTIDLQWYIDLRKYGYYKSAGFGLGFERFVMYVTGMTNIRDVIPFPRTPRNLLF

SEQ ID NO: 3508 - protein, 141 aa, Brassica napus
RARHGTARHDRAPVCPRPHPHRTSALARQMASPARRLLQTNSVQYPTLPAADPPSPLAVDSDVVVILAALLCALICVVGLASVARCARSRAAPAAARRGLRKKALRALPSLAYEDAVAARAGDGAAEVLAECAICLSEFAP

SEQ ID NO: 3509 - protein, 159 aa, Streptococcus suis
MSIYDFTVQKQDGTDQSMAEYQGQVLLIVNTAPGCGLAPQYKELQELYDSYRGQGFVVLDFPCNQFLNPAPGSAEDINQTCSLNYGTTFPRFAKIAVNGSEASPLYRYLKKEKSTLLGGRIEWNFTKFLVDRQGRVVKRYLPTTSPLKLKEDIELYLEK

SEQ ID NO: 3510 - protein, 232 aa, Prunus avium
MDMIYSQLSDLASMENPDTSSFSDASVTARRASLSDEEVILASSCPKRRAGRRVFKETRHPVYRGVRRRNNNKWVCELRAPNNKKARIWLGTYPTAEMAARAHDVAVLAFRGKLACLNFADSAWRLPVPASTDAAEIRRAATEAAEAFRQAEDGGVDEKESKAVVSEEKGCVGMEGSSNLFYLDEDEIFEMPRLLDDMADGIMLCPPQCLDGYMDWNDVETVDDLKLWSFSI

SEQ ID NO: 3511 - protein, 576 aa, Unknown
  Burkholderia sp. 383
MHNQIFMSDLQTSTPNTESFAALFEESLTRQDMRAGEVISAEVVRVDHNFVVVNAGLKSEAYIPIEEFLNDQGEVEVQSGDFVSVAIDALENGYGDTILSRDKAKRLASWLSLEKALDNNELVTGTITGKVKGGMTVMVNGIRAFLPGSLVDTRPVKDTTPYEGKTLEFRVIKLDRKRNNVVLSRRAVIEATQGEERAKLLETLKEGAIVNGVVKNITDYGAFVDLGGIDGLLHITDIAWRRVRHPSEVLSVGQEVTAKILKFDQEKNRVSLGIKQLGDDPWEGISRRYPSGTRLFGKVTNITDYGAFVEVESGIEGLVHVSEMDWTNKNVAPSKVVQLGDEVEVMVLEIDEDRRRISLGMKQCKPNPWDDFSRNFKKGDKITGAIKSITDFGVFIGLPGGIDGLVHLSDLSWSETGEEAVRKYKKGDEVEAIVLGIDVEKERISLGIKQLEGDPFSNYVAMNDKGSIVDGVVKTVDAKGAVVTLTGDIEGYLRASEISQDRVEDARNVLKEGDKVNAMVINIDRKSRGINLSIKAKDSAEQQEAIRGLQSDSSAAATGTTNLGALLKAKLDGQNQ

SEQ ID NO: 3512 - protein, 516 aa, Oryza sativa
MGMEVAAARLGALYTTSDYASVVSINLFVALLCACIVLGHLLEENRWVNESITALIIGLCTGVVILLMTKGKSSHLFVYREDLFFIYLLPPIIFNAGFCLLEFYSWSIYSAAIAIFSRMNIGTLDVGDFLAIGAIFSATDSVCTLQVLNQDETPFLYSLVFGEGVVNDATSIVLFNALQNFDLVHIDAAVVLKFLGNFFYLFLSSTFLGVFAGLLSAYIIKKLYIGRHSTDREVALMMLMAYLSYMLAELLDLSGILTVFFCGIVMSHYTWHNVTESSRVTTKHAFATLSFIAETFLFLYVGMDALDIEKWEFASDRPGKSIGISSILLGLVLIGRAAFVFPLSFLSNLTKKAPNEKITWRQQVVIWWAGLMRGAVSIALAYNKFTRSGHTQLHGNAIMITSTITVVLFSTMVFGMMTKPLIRLLLPASGHPVTSEPSSPKSLHSPLLTSMQGSDLESTTNIVRPSSLRMLLTKPTHTVHYYWRKFDDALMRPMFGGRGFVPFSPGSPTEQSHGGR

SEQ ID NO: 3513 - protein, 112 aa, Vibrio fischeri
MKKIEAIIKPFKLDDVRESLADVGITGMTVSEVKGFGRQKGHTELYRGAEYMVDFLPKVKLEIVVSDDVVDQCIDAIIETAQTGKIGDGKIFVTDVSRVIRIRTGEEDEDAI

SEQ ID NO: 3514 - protein, 617 aa, Zea mays
  misc_feature (596)..(596): Xaa can be any naturally occurring amino acid
MQAPMSPDMCPMPMTHKKKAATTRDFFGHKRMVKAKALGHQQRMFASGSKSKRDDEVASNLKIHDIFREIVLNERNLELYLNSSSGLPSVRCQRQYRYMNADARSRFKMLCRMFEFVCRTLVQTMEQRSLKMRIDNEAAKVMKALPGFTKHGPIVGQVPGVEVGDEFLYRAQLAIAGLHSEYRRGISTTTYRNGMLIAISIVASGGYPDELGCSGELIYTCSGGKSAVKKKDEDQKLKCGNLALKNCIKTKTPVRVIHGFKCRNTDRGSHSGAKLIPKYTYDGLYLVVDFWMDGKPGSRVFKYKLKKIHGQPELPMHIAKRLKSFKSRPGLCMTDISQGKEATPICVINTVDDVQPGPFQYTTRIRYPFGLTEKHNQGCDCTNGCSDSESCACAVKNGGEIPFDLSGAILNEKSVIFECGSSCKCPPSCRNRVSQHDMKIPLEVFRTTKTGWGVRSLWSIPAGSFICEYIGEVQHQKAADKRRNNNYLFDVGLNYDDENVSSVLLSNVSGLNSSSSCSQAMEDVRFTIDASVYGNIGRFINHSCSPNLQAQNVLRDHGDKRMPHIMFFAAETIPPLQELTYDYNNSEIDRVQGVNXNRRMKSKVCQCSSSLCRRRFY

SEQ ID NO: 3515 - protein, 304 aa, Anabaena sp.
MTQAKAKHADVPVNLYRPNAPFIGKVISNEPLVKEGGIGIVQHIKFDLTGGNLKYIEGQSIGIIPPGVDKNGKPEKLRLYSIASTRHGDDVDDKTISLCVRQLEYKHPESGETVYGVCSTYLTHIEPGSEVKITGPVGKEMLLPDDPEANVIMLATGTGIAPMRTYLWRMFKDAERAANPEYQFKGFSWLVFGVPTTPNILYKEELEEIQQKYPDNFRLTYAISREQKNPQGGRMYIQDRVAEHADQLWQLIKNQKTHTYICGLRGMEEGIDAALSAAAAKEGVTWSDYQKDLKKAGRWHVETY

SEQ ID NO: 3516 - protein, 598 aa, Ustilago maydis
MRSVATQSLGVLVALTHLVLGIDAQTTSQQVYEPPAASSGAVSQQSNLTNGVNPQYADLLGNALWFYEAQRSGALPADNRVPWRNSSCENDGSLNNTDLSGGYYDAGDYIKATYPFCWTVTSIAWSALSFGSAYARSSQDAYLDSTLRWGLDWLSKAHSDQNTLWVLVGNPTIDDQYWGGDRNIPDPRPSYSVTRQNPGTDAFASCAAAFAASAYLYSGRSASLPTSAGGAQLGGVPSIHNQTYSEALLRHAEGLWDLAINSSPKQVYSMAQPVAGQSYPSSDYEDDLAFAGLWMALAKADASYANQGLAFYPNGSNAFASINAALNWDRKVAALPVLATQLAQHNASMNLDMSRFQNDAESYFDRLTDGKMQYVSQTRGGLYWWKGDSDAASLNPALNAAFIADLYSGFATTSAKTSAYRSLADSQVDYLLGDNNYNGPYVVGQHPNSPQNPHSAMASGGNDITNVNNSPPQELHVLYGAVVGGPDKQDRFFDIRDDWPQTEIALDYNAPLVAAAVSRIARNVTKDPPYTTSSGSANVAQGRPTDAAYPAKSGGLSQGAKIAIAVIVVVVVLAAIGGLCWWQRQRIRWYFRQKKMGL

SEQ ID NO: 3517 - protein, 743 aa, Thermoanaerobacter ethanolicus
MGRDVLNFNVDWLYIPEDLNDAYKFDFDESNFEVVSLPHANKTFPHHYFKEEDHRFVSWYRKHFKVDERYKGKKVYIHFEGVILLRVYVNGEFVGEHKGGYTPFEFDITEYIKYGNFENLIAVQVDSREHKDIPPEGHLVDYMLFGGIYRNVWLKILNDTHIKDVYFVVDKLQDSVAEISITTTIAGKEISNGKILTEVINKEGVVCSSVVTDIKEMQKEIVQQIKMDNPLTWHPDHPYLYNVSVKLIAENEILDNYTFKTGIKGTVEFRDDGKFYINGEPLKLRGLNRHQTFPYVGGAMPDRVQRKDADILKYELGLNYVRTSHYPQAVSFLDRCDEIGMLVFEEIPGWQHIGDENWKNIAKENLKEMILRDRNHPCIFMWGVRINERLDDHDFYKEMNEIAHKLDRSRPTGGVRYLRDSEKLEDVFTYNDFIYNLEGKIQLPNHKKYMVTEYMGHMYPTKSYDNLNRLITHARLHALIQDKQYGIPNMAGASGWCAFDYNTTSAFGSGDNICYHGVCDIFRLPKFAAHFYRSQADPHLYGPYVFIASYLIPSFEEENGDKLLVFSNCEEVELYINDKFVKRQMPNRVDFPSLPHPPFEFSMKECGISYMEVRVNNSSITAVGLIDGKEVARHTLRPYGKPHKLILTADDVEIMADGSDCTRVVVSVVDENGSILPYANIPVSFEIEGEGKLIGENPLTLEAGRGAVYVKSTRKPGEIILKAKSHYVAEESNVSIKTKSIGY

SEQ ID NO: 3518 - protein, 242 aa, Unknown
  Burkholderia sp. 383
MTVYFIGAGPGDPELITVKGQRLVRTCPVILYAGSLVPAAVLDGHRAEQVVNTAELDLDAIVALLAGAHAKGQDVARVHSGDPSLYGAIGEQIRRLKALGIPYEIVPGVTATAACAATLGVELTLPGVAQTVILTRFAGKTTMPEGEALGSLAAHRATLAIHLGVRHLARIVDEVLPHYGADCPVAVIYRASWPDEARVTGTLADIVGKVQGTQIERTALILIGRVLDAEGFADSTLYASAG

SEQ ID NO: 3519 - protein, 535 aa, Oryza sativa
MAVSLKSSGSFCSTPPQWLHSTRDRILYGYSHSNAKECTCKKTKRPAPLCVKATSTKVELDFNDPSWKQKFQEDWDKRFNLPRITDIYDLKPRPTTFSLKKNRSPAGDENGTPMDKWNGYVNSDDRALLKVIKYSSPNSAGAECIDPDCSWVEQWVHRAGPRKEIYYEPEEVKAAIVTCGGLCPGLNDVIRQIVFTLETYGVKNIVGIPFGYRGFFEKGLKEMPLSRHLVENINLAGGSFLGVSRGGAKTSEIVDSIQARRIDMLFVLGGNGTHAGANAIHEECRKRKLKVSVVAVPKTIDNDILLMDKTFGFDTAVEEAQRAINSAYIEARSAYHGIGLVKLMGRSSGFIAMHASLSSGQVDVCLIPEVPFTLDGEYGVLRHLEHLLKTKGFCVVCVAEAAGQLFYVHYRSLQKSGATDASGNVILSDIGVHMQQKIKMHFKDIGVPADVKYIDPTYMVRACRANASDAILCTVLGQNAVHGAFAGFSGITSCICNTHYVYLPITEVITVPKRVNPNSRMWHRCLTSTGQPDFH

SEQ ID NO: 3520 - protein, 549 aa, Methylococcus capsulatus
MGTVEPGAIGQHLLACLYQAGVGHIFGVPGDYVLGFYDLMAKGPVRHIGTTREDTAAFAADGYARCRGMGALAVTYGVGALNTVNAVAGAYAESSPVVVISGAPGVREQREDPLIHHRFGPFRFQREIFERITCAAVVLDDPVIAFRQVERALAAARQHCKPVYIEIPADRVMAPGYPIPQETPETPSSDDSALAEAVAEAAELLGRAVSPVILAGVELHRRGLQDALVGLVEQARLPVAATLTGKSVFAERHPAYLGVYEGAMSTENARYMVEQSDLLLMLGVTLNDVDTGIYTARLDPQRIVRAAQNEVVIRHHRYPRVLLADFVTALARSVKARGEAFPMPAGPEPWDFPAPDRPMTIARLVERLDRALTSDMIVVCDVGDCLFAATDLRVHERSEFLASAFYTSMGFAVPAALGAQIARPDHRALILVGDGAFQMTGTELSTHARLGLAPIVVVLDNRGYSTERFILDGAFNDIADWRFHRLGEVFGPLQGYDAPDEAAFENALSEALVNRNMPSLINVRLSPGDASIAMKRLAGHLQCRVKGEG

SEQ ID NO: 3521 - protein, 415 aa, Spinacia oleracea
MASFTTTTAAAASRLLPSSSSSISRLSLSSSSSSSSSLKCLRSSPLVSHLFLRQRGGSAYVTKTRFSTKCYASDPAQLKNAREDIKELLQSKFCHPIMVRLGWHDAGTYNKDIKEWPQRGGANGSLSFDVELKHGANAGLVNALKLLQPIKDKYSGVTYADLFQLASATAIEEAGGPTIPMKYGRVDATGPEQCPEEGRLPDAGPPSPAQHLRDVFYRMGLDDKDIVALSGAHTLGRSRPERSGWGKPETKYTKDGPGAPGGQSWTAEWLKFDNSYFKDIKEKRDADLLVLPTDAALFEDPSFKVYAEKYAADQEAFFKDYAEAHAKLSNQGAKFDPAEGITLNGTPAGAAPEKFVAAKYSSNKRSELSDSMKEKIRAEYEGFGGSPNKPLPTNYFLNIMIVIGVLAVLSYLAGN

SEQ ID NO: 3522 - protein, 926 aa, Xanthomonas campestris
MDQQQLQNTLGHRLVVGERQLLRFPAQQRSAAGDRLHAPSVYRRACIASLRSRQACYRHARRRCRQQEGAAMTGINRRELLRGMLASGVRAALPAGAAGALLPGSADAAPAAAKDATPLAPLGDASLAPRERLLFDFGWRFHPGHASDPSRDFEFGTFQRTFAKAGKDTATAAQLAFDDSNWQQVDLPHDWAVTLPFRPEPISASMTEEDPAAAHGYKALGTSFPENSVGWYRRMLQIPASDLGKRICLVFDGVFRDCVVFCNGHIVGRNASGYCGFEVDLSEVLDYGKPNLIVVRVDATLGEGWFYEGAGIYRHLWLQKTDPLHVPQHGVFVRSSVQGDTATAQLSTEVRNDGTASRQCVVQARITAPYGRIVAQAASAAVTVAPGQVQVVEQTVPLGQAALWSIDTPQLYTLTTSVHSAGVAVDALVTPFGVRSIAFDAQRGFLLNGAPLKLHGTNNHQDHAGVGTAIPDALHAWRLRQLKSMGCNAYRSSHNPATPELLALCDRLGMFVIEETRRMSTDPEAMAELETMVRRGRNHPSVILWSLGNEEPQQVTERGARIVTRMQQRVRQLDPTRPTTFAMDKGFGDGVGQVVDVVGFNYRTSQMDGFHAQYPNIPIYGSETGSTVSVRGNYQRDDTRGYTRAYDTDHPWWASTAEAWWSYVAQRPYIAGGFIWTGFDYRGEPTPYNRWPNVGSQFGVLDSCGFPKDNYWYYRAQWTSEPVLHLFPHWNWDGLLQPDDKGRVEVWCHSNLEAVELLVNGVSQGLQQVPAYGHVEWRVAYAPGVIEARGYRGGKLVLTERRETVGKPAAIRLSCDRSALRADAEDVAVVKVEIVDAQGRLVPNADHLVHLVLRGPARLIGVGNGDPSSHEDDKAPQRKAFNGLCMALLRSTRSSGQILLQATAPGLTSAALHLQAATSALRPSVD

SEQ ID NO: 3523 - protein, 382 aa, Corynebacterium glutamicum
MARDYYGILGVDRNATESEIKKAYRKLARKYHPDVNPGEEAAEKFREASVAHEVLTDPDKRRIVDMGGDPMEQGGGAGAGGFGGGFGGSGGLGDIFDAFFGGGAGGSRGPRSRVQPGSDTLWRTSITLEEAYKGAKKDLTLDTAVLCTKCHGSGSASDKKPVTCGTCNGAGEIQEVQRSFLGNVMTSRPCHTCDGTGEIIPDPCTECAGDGRVRARRDIVANIPAGIQSGMRIRMAGQGEVGAGGGPAGDLYIEVMVRPHAIFTRDGDDLHASIKVPMFDAALGTELDVESLTGEEVKITIPAGTQPNDVITLDGEGMPKLRAEGHGNLMAHVDLFVPTDLDDRTRELLEEIRNHRSDNASVHREGGEESGFFDKLRNKFRK

SEQ ID NO: 3524 - protein, 317 aa, Cucumis sativus
MAVFPIINLENINGDGRAKILEQIEDACQNWGFFELVNHGIPHEFLDMVEKMTRDHDKKCMEERFKETVLSKGLEAAQAEVNDMDWESTFFLRHLPESNISQMSDLDEEYKKIMKEFAKKLENLAEELLDLLCENLGLEKGYLKNAFYGSKGPTFGTKVSKYPPCPKPDLIKGLRAHTDAGGIILLFQDDKVGGLQLLKDGDWIDVPPMRHAIVVNLGDQLEVITNGRYKSVMHRVLITQNSGTGRMSIASFYNPGSDAVIYPAPALVEKDEEKKEVYPKFVFEDYMKLYLGVKFQAKEPRFEAMKANANLGPMATA

SEQ ID NO: 3525 - protein, 626 aa, Kineococcus radiotolerans
MEIAIALVALTVGVCVVSALCDRLRWPTPLVLVVVGAAVSLVPVVPEFSLGPELVLNGLLPPLLYATTARASLVDFNRNKTATLLLSVVLVVFTTLVVGWTTSWLLPGVALAACMALGAVVAPPDAVAASAIGQRLGLPRRVATLLEEESLLNDATALIALAAATSALTSELSPLHIGGEFVLAVVGAVLIGGVVAAVLALVRTRIRNPVLDTAVSFVAPYLAFLPAEALHVSGVLSVVVAGLALAHVSPKVQTAASRVAEALNWRTVAFLLENAVFLLIGLQFPLLVRGAADSGFGGGRILLVCAGVLVATVAARFAFVFAVAGILTAVPPWRRKAWPGAVSVLVSWAGMRGVVTLAAAQLIPEDVPGRDVLLLAAFAVVVGTLLVQGLSLPWVVRRVGLPAPDPAQDALQAAALGDAASAAGLRRLDELLTGDEPRHVVGQLRKRSKSRSHAAWERLGRPEADVSTPSAVYTRLRLEMLAAERAVVVEARDRGTAEPEVLQRALADVDFEEALLDRLDDLEPLAADRRLGGASDGGCAHLRTAGTRDDATARWGGPPTECAECVAVGATWVHLRTCLACGHTGCCDSSELRHSRAHFAGTAHPAIVSAEPGEAWRWCWVDEELG

SEQ ID NO: 3526 - protein, 453 aa, Nitrosomonas europaea
MPFIPHTEEDVAEMLTSIGARSIDELFDEIPAELKTGKLTQVPPGLSEMEISRLMYERAQQDGFYLSFIGAGAYEHHIPAAVWQITTRGEFYSSYTPYQAEASQGTLQLLYEYQTMMASLAGMDVSNASLYDGASALAEAALMAVRQHRTSRRILVPQTVHPVYRSVMRTIVRNQAIEVVEVPYDPATGQVAIDKLDQFAQEEFAALIIPQPNFFGVLEQVDALTDWAHDKQSLAVAVVNPTSLAMLKPPGEWGRRGADIAVGEGQPLGIPLSSGGPYFGFMTCKQELVRQMPGRIIGRTTDLEGKEGFALTLQAREQHIRRSKATSNICTNQGLMVTAATIYMSLLGPEGLYRVAAHSHANTVALVEQLEKLPGVKKAFHSPFFHEAALQLSVPADKVLNRLKAQGVLGGVLLENHYPDLKNTLLVCATETKTAEDLDKYTEVLRQALAASA

SEQ ID NO: 3527 - protein, 177 aa, Arabidopsis lyrata
MENMGTRVIEPLIMGRVVGDVLDFFTPTIKMNVSYNKKQVSNGHELFPSSVSSKPRVEIHGGDLRSFFTLVMIDPDVPGPSDPFLKEHLHWIVTNIPGTTDATFGKEVVSYELPRPSIGIHRFVFVLFKQKQRRVIFPNIPSRDHFNTRKFAVEYDLGLPVAAVFFNTQRETAARKR

SEQ ID NO: 3528 - protein, 428 aa, Aquifex aeolicus
MEHLLKTDPEVFDAVVKEYERQFYNLEMIASENFTSLAVMEATGSVLTNKYAEGLPGKRYYGGCEYVDVVENLAIERAKKLFGAEHANVQPHSGSQANMAVYFAVLNPGDTIMGMDLAHGGHLTHGAKVNFSGKLYNVIHYGVNPETELIDYDQLYKLAKEHKPKLIVGGASAYPRVFDWAKMREIADEVGALFMVDMAHYAGLIAGGVYPNPVPYAQFVTSTTHKTLRGPRSGFILTTKEYAKAVDKSVFPGIQGGPLMHVIAAKAVAFKEAMSEEFKEYAKQVVENARVLAEELKKYGFKIVTGGTDSHIVLVDLRNKNIIGKDAEKALEKAGITVNKNAVPFDPLPPTKTSGIRIGTAALTTRGMKEDEMRKIAGWINEVLSNMDDEKTIQRVRQEVRELCETFPLYPELKRRIDELRSGKATDL

SEQ ID NO: 3529 - protein, 232 aa, Carboxydothermus hydrogenoformans
MAVISMKQLLEAGVHFGHQTRRWNPKMAEYIFTDRNGIYIIDLQKTAKKLEEAYSFVRELSAQGGTILFVGTKKQAQDAIKEEAERCGMFYVNQRWLGGTLTNFKTIRKRVERLIEIEKMEQEGALSVLPKKEVAKILKEKEKLSRFLSGIKEMKKLPDALFVVDPRKEKIAVAEARKLDIPVVAIVDTNCDPDEVDYVIPGNDDAIRAVKLITSKIADAVIEGRQGEQYAE

SEQ ID NO: 3530 - protein, 919 aa, Neisseria meningitidis
MKRMLFNATQAEELRVAIVDGQNLLDLDIETLGKEQRKGNIYKGIITRIEPSLEACFVDYGTDRHGFLPFKEVSRSYFQDYEGGRARIQDVLKEGMEVIVQVEKDERGNKGAALTTFISLAGRYLVLMPNNPRGGGVSRRIEGEERQELKAAMAQLDIPNGMSIIARTAGIGRSAEELEWDLNYLKQLWQAIEEAGKAHHDPYLLFMESSLLIRAIRDYFRPDIGEILVDNQEVYDQVAEFMSYVMPGNIGRLKLYEDHTPLFSRFQIEHQIESAFSRSVSLPSGGAIVIDHTEALVSIDVNSARATRGADIEDTAFKTNMEAAEEVARQMRLRDLGGLVVIDFIDMENPKHQRDVENVLRDALKKDRARVQMGKLSRFGLLELSRQRLKPALGESSHVACPRCAGTGVIRGIESTALHVLRIIQEEAMKDNTGEVHAQVPVDVATFLLNEKRAELFAMEERLDVNVVLIPNIHLENPHYEINRIRTDDVEEDGEPSYKRVAEPEENESAKPFGGEKAKAARPEPAVKGVRHTSPAPTAAPEKKTSWWDSFKAWLKRIFGGSETQAAPAAETSEKRSTANRSGSRANNRRQNPRHSKREGSKVEVREVAGKTAGQEARADKAETRNNGNRRRNERGDRAAERANEAEIQDRNVQPAAPVADAAPSETEVQTGKRRRNGSRSERSQTAPETAAVAETTVQTAENTPSEPHTAEDKGSKPKSERNRRERDSRDAKERRERNNQRDRRQNGKKRNIPSAAKIEQYLNIHDTADKVRSAAAHVFGETDANAPITVSIADPVAERDLPTASPAVSNGDAPVYDAAEKIRRATAAILPEGATPKAEAQEMPSETATFTAAAEQARETAQTGGLVLIETDPAALKAWAAQPEVQTGRGLRRSEQPKPSEVATVPAEEMIQVETRQG

SEQ ID NO: 3531 - protein, 483 aa, Nitrosomonas europaea
MLIFEHSRKNRRNYSQAPATRPAKNNIPDHLKRKSTPLLPEVSEMDTVRHYTRLSQKNFSIDTEFYPLGSCTMKYNPRACNSLAMLPQFLSRHPLAPEDTGQGFLACMYELQEILKDITGMAAVSLTSMAGAQGELIGITMIRAYHEAHGDTGRTEIIIPDAAHGTNPATAVMCGYKVIEIPTNRDGDVDMDALKAAVGPKTAGLMLTNPSTLGVFEKKVAEMSRIVHAAGGLLYYDGANLNAVLGKVKPGDMGFDVIHMNLHKTFSTPHGGGGPGAAPVGVAERLLPYLPVPIVAHEQGVYRWLTEEDRPQTIGRLSAHMGNAGVLLRAYIYVRLLGAEGMHRISEYATLNANYLMAELRKLGFEIAYPNRRASHEFIVTMKEIKDRTGVTAMNLAKRLLDKGFHAPTTYFPLLVPECLLIEPAETESKETLDRFVAAMKEILDEIATQPDMVKAAPHDMPLRKIDDVKAARELDLVWDPAG

SEQ ID NO: 3532 - protein, 355 aa, Kluyveromyces lactis
MANTESDITRVLGGIYVGGIQPIANHVPLKVNYQITHILSVIKFEIIPEYLVRKSYTLKNIPIDDNLSTDVLQYFNETNRYIDSCLFPDEIELDRVKVDFKKKPQKGAIYIHCQAGVSRSVTFAVAYLMYRYGFNLKTALHAVKRKRSVAEPNENFMEQLKLYEAMGSNIVDVENKDYKQWKLQNSIKTDPLGANIMAQNEMYKSEEVEAEKVAKLSKEEVEDVSAIRCKKCRFRLAFSTSFIKHDPPSKESMEGHFIRRAAGSRRIIDIQQSQDRCSHYFVEPLEWMKKELQKQELEGKFFCPNCDSKIGGYNWKGSRCSCGKWMIPAIHIQTAKVEQIALTRKDLPNLVSFEE

SEQ ID NO: 3533 - protein, 316 aa, Leptospira interrogans
MAHKIVIIGSGPAGHTAAIYAARANLNPVMYEGFMAGGIAAGGQLTTTTEVENFPGFPEGIDGTKLTQLFREQSIKYGTKIITQTITKVDFSSRPFKLWSDDELIEAQAVIIATGATAKRMNVIGEDIYWQRGISACAVCDGALPIYRNKELVVVGGGDSAVEEASHLTKFASKVYLVHRRDSLRASKIMQKRATTHPKIEIIWNSQVKEAKGDGKSLTSLTLENTTNGQKKELPVGGLFYAIGHKPNTDIFQGILDLDESGYIKTVPGSTKTNIEGIFAAGDVQDKIYRQAVSAAGSGCMAALDAERWLESREEE

SEQ ID NO: 3534 - protein, 317 aa, Exiguobacterium sibiricum
MVMRIANSVLDLVGRTPIVKLNHLTGPEDADVYLKLEYMNPGSSVKDRIALAMIESAESAGHLKAGDTIIEPTSGNTGIGLAMVAAAKGYRSILVMPETMSMERRTLLRAYGAELILTAGPEGMKGAIARATAEAEEHGYFMPQQFNNESNPVVHEKTTGPEIVEAFEGLTLDAFIAGIGTGGTITGAGKVLREAFPGIEIIAVEPTDSPVLSGGKPGPHKLQGIGAGFVPSILDTQIYDSVEQVTTEEAFDHARRAAKSNGVLGGISSGAAIAAALKTAKRLGKGKTVLAIIPSNGERYLSTPLYQVEEETDSSKL

SEQ ID NO: 3535 - protein, 104 aa, Oceanobacillus iheyensis
MAIKHVTDQNFTEETSKGLVLADFWAPWCGPCKMIAPVLEEIDGEMEEKVQIVKLDVDENQETAGKFGVMSIPTLLLFKDGDVVDQVIGFQPKEALEDLINKHA

SEQ ID NO: 3536 - protein, 192 aa, Glycine max
MASSMISSPAVTTVNRAGAGMVAPFTGLKSMAGFPTRKTNNDITSIASNGGRVQCMQVWPPVGKKKFETLSYLPDLDDAQLAKEVEYLLRKGWIPCLEFELEHGFVYREHNRSPGYYDGRYWTMWKLPMFGCTDATQVLKELQEAKTAYPNGFIRIIGFDNVRQVQLISFSWSLKVLEFPQASKCEKFAKHL

SEQ ID NO: 3537 - protein, 240 aa, Prunus avium
MDMFFSQLSDSVDQPQSSLLSDASVTTRGASCSDGDVILASSRPKKRAGRRVFKETRHPVYRGVRRRNNDKWVCEMREPNKKKSRIWLGTYPTAEMAARAHDVAALAFRGKLACINFADSAWRLPVPASMDTMDIRRAAAEAAEGFRPVEFGGVCSGSSDEKERMVVQVEEKNKKGSVNLERSRSLSLSYWDEEEVFHMPRLLHDMAEGLLLSPSQCLGGYMNLDDMGTDADVKLWSFSI

SEQ ID NO: 3538 - protein, 144 aa, Unknown
  Sulfitobacter sp. EE-36
MPIKYLHTMVRVKDLEKSQAFYELLGLKERRRIDNEDGRFSLIFMCPPGQDDGHADVELTYNWDGDDALPDDSRHFGHLAYTVENIYETCKMLQENGITINRPPRDGYMAFIRSPDNVSVELLQEGDRLEPQEPWASMENTGHW

SEQ ID NO: 3539 - protein, 375 aa, Unknown
  Rhodococcus sp. RHA1
MSEHQVAIVGAGTSGVAAAVALADRGINPLLIDRADQVGSSWHSRYDRLRLNTGRQFSHLPNRPYPKGTPTFPTREQVIEHLERHARADGIELRLGCPVERLDLTDGHWRLTTAAGSVDAAEVVVATGFDHEPFVPDWPGRGDWRGALVHSSQYRNPSQYNGKRVLVVGAGCSGMEIAYDLATGGAAKVWLSARTPPNIMLRQGPGGIPGDFIATPLYHAPVPIADAIARFGRERSIGDLREFGLPIPDEGIFARSARLGVAPAIVDKELIAAIRDRSIEVVRGVESLDADSVWLVDGVRIDPEAMVCATGFRQELEKLVGHLGVLDERGWPHATGEKPAAERLRFIGFVPRPSQIGFAAKQARRAARAIARELR

SEQ ID NO: 3540 - protein, 130 aa, Prunus avium
MDVSQLSDSVDQPESSSLSDVSFKTRGPSWSDGEVILASSRPKKRAGRRVFKETRHPVYRGVRRRNNDKWVCEMREPNNKKSRIWLGTYPTAEMAARAHDVAALAFRGKLACLNFADSAWRLPVPASMDR

SEQ ID NO: 3541 - protein, 1764 aa, Cryptococcus neoformans
MSHHPQLSVSTGSAGAGPSTPTLPRRPQGARRRGVMPGLFIANPDNSDEENSPPKAGSQRSSSGVSPISVSSSSGRGGPSSVSIPQPASPSHSIKERGSLPYPSIPAPQSSPLPSISAFPSPQPLIPTPSPAPIAYGHTPEISSGPPQPPPQPQRHLQRAFTTATPENAPRLLPEPRSSSTGTTSFHQQVNNSPSRALPSLPSPITRQSTMPSPVSQSPSTSHGQPYSAPPAYHPHDPTRVASPDDVMSPATGSEHGSIMSAGIGHRNRSASVQGQQVRLQVTTDNEAFHLVDITGINTAEGIREKVFSKLRIRDEDYPTLSMYRTEIGEPADETPILPAALLNICRTLGDSRASLKFLVKQTDVPPSSAASVIPPVSQTDYHPFRAASDPRRAGVPPITTDLPNPVLYRVSSRHSKEGKDWSGPGLSRSTRKSVLQNAGVRLSTSTGGSRSPVTEHSASLGTSSPALPTPPIPPHSTSLQAGEPSIHSSPSSRPSSRHYEFNELSLPPQFDHFKPSNAISVFPRPGTPISDSYQNENAFAGPSRPVMNQEQGSQGLGLTLDDDIDPETRALIEQFQREEQEAQKKEEERRRQLEADEELAKREQQSERELWEMMQQMQKEQRQREQAQIAEDEARARQVEEEQRQEEEQRQALEAARTAWEAEQREQRDQREQREQQESRFHTFEKDRRQRQQFFQNRARMGAPLDDSATWESTWMVGPSAEGSLSSRRPSEGRMPMVQTSAPRTSQTQSPALPPRQSSQPIYQPSQSQYLPDFAYSHRRPSGFPNTSYAETSHAQERLHDPRLQQATGRAPAPGQRGGTSNTPRPESQRLRHPFSYAAHEPSNERLQAPALSTARSVDNLRMTNGPLGMTSRQSQVYGPPRTSITPAPGFAEHRNIQPASATATSYRSPSSDRARDGRYPEPLHSSSRVATPMAPAIIDTGLVPFPSPHPNSAASSNSWRGHTPQFNSLPRSARGPTFDITRPNTVHYDRSPPPPTSPETAIPPRRPSTYYDEFHPPDTARTIVEDGATIRRPSSPFPWGDRARSGNASTPYRTASPVPVDQPRTSETNTFDDTDSQLPYAHNASPQSSWLSVSRAGAHRSDSDTLSVAGTVSSEATVRPGKGMGEDNDTNSGDTAKAGQWDRHLKEMIAKMGPGGGEGTVRPRKEEEEDEATLFITPPVRAPETSSSRTNAIRPSPSKPNLIVNTASLSQQAYDQVNPVLSASTPSDSATESEGTGEGDGEIEGSNIKRGKSFARPRDPNQWNFRPEPEQLYENLDRVFPQIDLDRPIVQGAESTPSTPGIESPSRVEIIGGLPLPAGAAPGRQGGPQAGSGPLGRAPQATGPSSAPTGAFNRSKFNKAENRRSIRVVADHKRRTLQRQVSRHEDLPPEYDVGAEEVNSAMDDQVVDPRSEEQRKKDNRRSSSMWDHKLVEVTRFARAQANREADIPESPASDGKPGTVNWVKGELIGKGSYGRVYIALNVTTGDMMAVKQVELPATEIERHDSRQQGMVKALRDEIELLKGLEHKNIVAYLGYETSPEYLSIFLEYVPGGTIASIYRTPNQARFEPQLVRFFTEQILEGLAYLHSKNIWHRDLKGDNILVDAQGICKISDFGISKQTADAYDSFGQATNMKGSVFWMAPEVIHSYSERSYSGKVDIWSLGCVVLEMWSGKRPWGDMEQFAAMFELFNKRSRPPLPPDINLSSVALDFLNEKCLATDPRNRPMARDLLQHEFIKNRDLTWTFKDSKIGKAVAKRGAKRPQA

SEQ ID NO: 3542 - protein, 683 aa, Streptococcus suis
MALRQFQAFLDDVATIRLVMEKRFDSEHMSFSLESNDATSQLFIHSCLEVDNLVIYYLTSLHALTLDKDYTIYDQDRNKAELGYGHIVRSTLFEQSYTYNGQDLGATYRPEATTFKLWAPISKQVFLVLEGNPHAMTKGAKGVWEITVEGDLEAHSYHYLHKVNGEWISVHDPYALSSTANSGDSYVINPDKLHKIRRAKTQRPISQAIIYEMSVRDFSWQKEAGFKHRSQFLGLTESPTMDGMKLGMDYIRELGVTHIQLLPVYDFGSVDENKPQAVYNWGYDPMQYNLPEGSYSSQPNDPYARIIELQEAIQAYHDADISVIMDVVYNHVYHAEKYAFELIVPGYFYRYDDHGMRTDGTFCGNDVASERSMVRNYIKQSLRQWLELYGFDGFRFDLMGILDSETINQIQTELSAIHPNVYLYGEGWKMATGLEFEKLAHQYNAEHLPEISFFNDDYRDTFKKLLLNPNRLVDKQLHEKVQHLLTGSRLSHFLTPQQSLNYIECHDNATAFDYFHIENPNWTPQQQKRAASFGLQLILISQGMAFIHSGQEFFRTKDEIDNTYNVPDRINRLDWTRAIRYKEHIEFIQELITFRKNNPILSQDNYESIQETCDFYWLTEYVLRYQVTSEEKTIQFIINFADSDFTYEREKDKAVLYNYPPVENRDQQEITIAGQSICILEDK

SEQ ID NO: 3543 - protein, 300 aa, Unknown
  Burkholderia sp. 383
MAYKTIEDTIGNTPLVQLVRLPDDEIRARNNVVLAKLEGNNPAGSVKDRPALSMISKAEARGRIKPGDTLIEATSGNTGIALAMAAAIRGYKMVLIMPEDLSVERRQSMAAYGAEIILTPVKGGMELARDLADQMQREGKGVILDQFANPDNPIAHYEATGPEIWRDTEGRITHFVSAMGTTGTIMGTSHYLKEQNPAIEIVGAQPEDGSRIPGIRKWPEAYMPTIFDRSRVDRVENVSQAAAETMARRLASVEGIFAGISSGGACEVAMRIARQVENATIVFIVCDRGDRYLSTGVFPA

SEQ ID NO: 3544 - protein, 554 aa, Unknown
  Shewanella sp. MR-4
MCSIFSILDIQSDAKELRQVALEMSKLMRHRGPDWSGIYASDKAILAHERLAIVDIEHGAQPLLTEDGSLILAVNGEIYNHKELKAQLGDKYSYQTNSDCEVILALYQEYGTEFLDKLNGIFAFVLYDKAKDAYLIGRDHMGIIPLYTGRDAAGNFYVASEMKALMPVCKTVAEFQPGQYLYSSIGEPVQYYTRDWQSFDAVKDNGASQEELRDALEAAVKRQLMSDVPYGVLLSGGLDSSVISAITQTFAKRRIEDDDQSGAWWPQLHSFAVGLKGAPDLAAAKKVADAIGTIHHEINFTFQEGLDAIKEVIYHLETYDVTTIRAATPMYLMARKIKAMGIKMVLSGEGADELFGGYLYFHKAPNAQAFHEELVRKLDKLHLFDCLRANKAMAAWGLEARVPFLDKEFMDVAMRINPEAKMSKDGRIEKHILRQAFEHKLPKEVAWRQKEQFSDGVGYSWIDGLKAHAAEQVDDLQLANAKFRFPYNTPETKEAYFYRCFFEEHYPLASAAETVPGGKSVACSTPEALAWDESLRGIIDPSGRAVRSVHAASY

SEQ ID NO: 3545 - protein, 396 aa, Wigglesworthia glossinidia
MKKFFICKSKFFKNPTFSGLLLILFCFLAIFISNTNFWKTYNYIINYPLIKINTHDKNFSLTNIVNDILMTFFFLEIGIEIKHEMLVGSLKNKSRAILPGIAAIGGMIFPALIYNFITKEDSSISSGWAITVATDIAFAVGVLKILGHSIPHSLLIFLLSLAIFDDIGAILIIAFFYSNHIDQYMILLSTLVILTILSINYLRVTCIYIYIIFGILLWESIFLSGIHSTISGVILGILMPHSSYLSSSKYEKSMAFLKKSLSFLNKYFILPIFAFFNSGINFSNFENLSSSLLPFGIFFGLVLGKPIGVFLFSYLSVKFKLSKLPVGISFKEIAGISFLCGIGFTMSIFISNLAFQNINEKIIYIAKFSILISSIVSSVIGFLFLYFLYKKIKLKN

SEQ ID NO: 3546 - protein, 374 aa, Wigglesworthia glossinidia
MAKSDYYDILGISKNASDREIKTAYKRLAVKFHPDRNPGNLEAESKFKEIKEAYEVLLDPKKRAAYNQYGHTAFDQGSSNTEFTSNADFSDIFGDVFGDIFGNNRRKRSNRGSDLQYNINLSLEEAVKGISKEITIPKLERCNICSGKGMQPGTSAQNCSTCNGQGQIQMRQGFFSVQQTCPSCRGKCKIIRFPCRNCSGQGRVERSKNISIRIPAGVDNGDKIRLSGEGEAGKLGGSSGDLYVKISVKEHPIFKREEHNLYCEVPINFAMAALGGDIEVPALDGRVKLRIPAETQTGRLFRMRGKGVKSIRSGHQGDLLCRVVVETPVRLSEKQKSLLKELGISFVGRTGMYNSPRSKSFFDGVKKFFDGLTN

SEQ ID NO: 3547 - protein, 439 aa, Prochlorococcus marinus
MENKQINFFKAKDINTVLKPYKKGTVVNIDNFEARERQKELKTGLYGWYAICPSNVLKKNKIHYFSLFDEPLLLFRDNKNNVRCIKNICPHRGASFYGGSISNGELTCPYHGARFSSEGNCQNIDSITCRHIVDNNYDNYAKRIHLSQYKTVEEDNYIFIYFSDKSEMDLNNIKEEPSISNYELISNGFSIEDSVSEEVLVDFKCDWSRIIENHLDILHIFWVHGDTIPDKEVNKNVLVSFNQKININPNYIESIYFYKKNPTKEFIRIKYIPPGRILIYKGDPAVSRYVQVLDHIPLGENKARVIVRHYRKFLKNKLLNNLILFKENQKKIFYKIFNEDYMILKTQTYNHKMGLIKNDEIKLLGEDRMINYFWNWYKKSEEKDTPWKYINNKELNVYDEIIFKYPPEIKKLEVINNINIIRKAFIRYAAPLIFLLLII

SEQ ID NO: 3548 - protein, 49 aa, Ilex canariensis
WEFQVGPSVGIEAGDHIWCARYLLERITEQAGVVLTLDPKPIEGDWNGA

SEQ ID NO: 3549 - protein, 625 aa, Lactobacillus sakei
MQPNIQWLDTPAVFRVGQLPAHSDHRYYATLAEMAQQQSSFEQSLNGTWQFHYSVNAASRPKSFYELAFDAQDFEPITVPQHIELAGYEQLHYINTMYPWEGHYYRRPAFSTSDDKQHLGMFSEADYNPVGSYLHHFDLTPALRNQRVIIRFEGVEQAMYVWLNGQFIGYAEDSFTPSEFDLTPYLKETDNCLAVEVHKRSSAAFIEDQDFFRFFGIFRDVKLLAKPRTHLEDLWVIPEYDVVQQTGQVKLRLQFSGDENRVHLRIRDQHQIILTADLTSGAQVNDLYKMPELVQAWSNQTPNLYTLELEVVDQAGETIEISQQPFGFRKIEIKDKVMLLNGKRLVINGVNRHEWHPETGRTITAEDEAWDIACMQRNHINAVRTSHYPDRLSFYNGCDQAGIYMMAETNLESHGSWQKMGAVEPSWNVPGSYDEWEAATLDRARTNFETFKNHVSILFWSLGNESYAGSVLEKMNAYYKQQDPTRLVHYEGVFRAPEYKATISDVESRMYATPAEIKAYLDNAPQKPFILCEYMHDMGNSLGGMQSYIDLLSQYDMYQGGFIWDFIDQALLVTDPVTGQRELRYGGDFDDRPSDYEFSGDGLVFATRDEKPAMQEVRYYYGEHK

SEQ ID NO: 3550 - protein, 755 aa, Sinorhizobium meliloti
MRSVTSFNDSWVFSEASTRDAERSGRVSRSACRTNAVELPFNYFDERCYQRAFTYQRVLAWRPDFSQGSRSSSTRQWPMRSCISTAKRSSRIRDGYTPFEARLTDRLLEGDNLITVKIDGSENPEIPPFGAGIDYLTYAGIYRDVWLKVTDPVSIANIKIETRDVLSDHKAVSLRCDLSNPQGLSFSGTISALLKNAAGEVLAEVAGETTGQSLAFEMDGLRGLSLWDIDDPVLYVIEVELRTGQGFRLLRRAFRLPHGEFTTEGFRLNGRPLKIRGLNRHQSFPYVGLRMGRTAKGSAHADIMNAHRLHCNLVRTSHYPQSKWFLDHCDRIGLLVFARNPRLAAYRWGGMETGGNPERPPHRSSATGTTRLSYIWGVRINESQDSHDFYAETNRLARELDPTRQTGGVRYITDSEFLEDVYTMNDFILGNEELPGANRPGTALRPQQECTGLPRKVPYLITEFGGHMYPTKIYDQEQRQAEHVRRHLEVLNAAYARNPGISGAIGWCMFDYNTTRISAPATGSAITASWTCSASPKFAAYVYASQCDPSEEIVMKPVTFWARGDDDIGGVLPLIVLTNCDEIELKYGSLTKRVGPDRENFPHLPHPPVVIDHRHFTKDELGVWGMKWESAEFTGFIAGKPVADLRMAADPVPTTLQVEADSKTLRREGRDTVRLILRALDQAGNVLPFLNDAVDIEIHGPARLVGPARIVLQGGSGFLAGVHGRRRHASSRSRRRGSAAAKLDLVALADGAASA

SEQ ID NO: 3551 - protein, 356 aa, Legionella pneumophila
MKIIIKVGTQSILSVDGSPIYSVLNNLVNQIIYLKNLGHQVILVSSGAVGSGRKIAKNSLGKTYGDTVGEKQLLASIGQPELMNLYSSLFKNENILVSQLLLTKQDFHTRQHYLNIARLLTELLKHQNIIPIVNENDSVAIEELMFTDNDELAGLIAAQINADYLILLTNVDGVFTSHPNDPESKLINTIDPNSGWPNVSVVKSKLGRGGMVSKLDTARKMAGLGINTVIANVNVESIVPKILNREAVGTIILASKRKSSIKRWIAFSHRTSLPSIVINDNLITLLRSGNRVMSILPIGIEDFRGECKKGDLIDILNSNNEKIGVGIARYDFLRLKDYLRLQNKPAFIHYDQLHIL

SEQ ID NO: 3552 - protein, 417 aa, Legionella pneumophila
MNTDIANQLRAAKKATTDLNLIQSDTRTIILETLAANLEKHIENIIQENQKDLSLMLEQDPRYDRLLLNKERILSLANDVRKVASLPNPLGVSLLEKSMPNGLSIKKITVPLGVIAVIYESRPNVTIDIFSLCFKSGNVCILKGGKEAHFTNSYLLLLIKNTLKNFNINTDIVCLLPPERALMTQLLNATGLVDLCIPRGSQNLINFVRDNAKIPVIETGAGIVHTYFDKSGDLGKGKKIINNAKTRRVSVCNALDTLIIHADRLKDLPELVETLSQKHVIIYADQDAYHVLDKNYPEQLLIKAKPQDFGHEFLDYKLAIKTVPNIKAAIGHIQQFSSHHSEAIIAEDESAIDQFLIEVDAAAVYANASTAFTDGGEFGLGAEIGISTQKVHARGPMGLEALTSYKWVIRGTGQIRD

SEQ ID NO: 3553 - protein, 180 aa, Unknown
  Mesorhizobium sp. BNC1
MPVVRGKEIEVLYSASTIARRNLELAKEIAARDYTDLLVISVLKGSFIFAADLIRAMHDAGISPEVEFIMISSYGAGTTSGGIKVLRDIDNDVSGRDILLIDDILESGKTLQYTRDLMLSRGAKSVSIAVLLDKHSRRQASLEADFVGFECPDYFVVGYGMDVAHAFRELPFVGIVKGEA

SEQ ID NO: 3554 - protein, 1024 aa, Unknown
  Vibrio sp. Ex25
MLINATQKEELRVALVDGQRLFDLDIESPGHESKKANIYKGRITRIEPSLEAAFVDYGAERHGFLPLKEIAREYFPEGYTYQGRPSIKEVLTEGQEVIVQVEKEERGSKGAALTTFISLAGSYLVLMPNNPRAGGISRRIEGDERTQLKAALSTLELPQGMGLIVRTAGVGKSAEELEWDLNVLLNHWGAIKGAADSNPAPFLIHQESNVIVRAIRDYLRRDIGEILIDSNTIYERAKEHIQLVRPDFLNRVKKYEGEVPLFSHYQIESQIESAFQREVRLPSGGSIVIDPTEALTSIDINSARATKGGDIEETALNTNLEAADEIARQLRLRDLGGLVVIDFIDMTPVRHQREVENRLREAVRLDRARVQIGRISRFGLLEMSRQRLSPSLAEASHHICPRCSGTGVVRDNESLALSVLRLIEEEALKDNTAQVLAVVPVPIASYLLNEKRRSVNHIERIQEVKITVVPNSDMETPHFEVIRVREGEEFDLISYLLPKKLEAMKEAEGKEPAEVDVKPKRIEEPVLKGFAAPSQTAPAPAAKPAPEAKKKEQKVEQEEKPGLFSRLFKALGSFLFGGSEEVKEEPKPQEEKKPNRDNRRNKRDRNDRRRNNNQRDNRENRDNRDNRDNRRRRKPRDEQANEQNEAQQQTNKQQNRNQKRKPKAQQADKAQEQKANAKVAEKGLQLAAEARTETKPEESKPKQQNAKAEKVKERRQRRKLNKSVRVKDQEAVEKKTEETAVKTQEMVETKVEKPTEAAVETQQDNKQAESKQRRNRRSPRHLRASGQRRRRGRDRRPNPFRLRKGGVASPEMAMGKVMPRYIPKPAPKKEEQVKEEAVAAVPTMQGGFACPEMAMGKVIIRREQPVVTEAPVVESKVQETVEAKVESPAVEAPVVEAVIAEKTESAVVETASVEPIVETPATEHAEPVDAIVETAPAEEPVVEAAKEIAAEAPVAKPEPKVEAIKVAAKLNASAPMTKAPGPQELREITVAAAPFKTERYQAKGAGSQVAKNRASAEMTKPNFN

SEQ ID NO: 3555 - protein, 77 aa, Nymphaea alba
MKEQKLIHEGLITESLPNGMFWVRLDNEDLVLGYVSGRIRRSFIRILPGDRVKIEVSRYDSTRGRIIYRLRNKDSND

SEQ ID NO: 3556 - protein, 465 aa, Glycine max
  misc_feature (347)..(347): Xaa can be any naturally occurring amino acid
  misc_feature (367)..(367): Xaa can be any naturally occurring amino acid
  misc_feature (392)..(392): Xaa can be any naturally occurring amino acid
MGNSSSAVTKIQYHGQGCIIQPQNGSRKETGECFQSYLSLSIARFRGRGRKRKVSFMAATSSSFFSQDSTLLNVGAPQTFNHRKGSRLIVRANADYYSVLGVSRNASKSEIKSAISKLFTFDISAYRKLARNYHPDVNKEPGAEQKFKEISNAYEVLSDDEKRSIYDRFGEAGLKGSAMGMGDFSNPFDLFESLFEGMNRGAGSRGSWNGAIDGEDEYYSLVLNFKEAVFGIEKEIEISRLESCGTCNGSGAKPGTTPSRCSTCGGQGRVVSSTRTPLGIFQQSMTCSSCNGTGEISTPCNTCSGDGRVRKSKRISLKVPAGVDSGSRLRVRNEGNAGRKGGSPGGXSLVVIGGLFPDPILKRDDTXNILYTCKVSYIDAILGTTIKVPYLXKGTVDLKIPAGTQPNTTLVMAKKGVPFLNKDNMRGDQLVRVQVEIPKRLSNDERKLIEELADLSKGKTATGRR

SEQ ID NO: 3557 - protein, 312 aa, Mycoplasma genitalium
MSLLAQAESDYPLQKKEHSQEFFRSNAHLRVRAKTYFAVMKIRSVLSHAIFEYFFKNDFILVQSPILTSNDCEGAGETFVIKDSETFFNKTTFLTVSGQFGAEAFAQAFKKVFTFGPTFRAEKSHTNRHLSEFWMIEPEIAFANLKDLMQLIQNLIKFLIKKVMENASDELNVLAKQFSNDIISNLKTIISTKKFPIIEYSKALAILKESSDTKKTNFELNDFSFGIDLKTEHERFLCEQYFQNQPLFVINYPKELKAFYMKTNTDNKTVAAVDLLLPKIGEICGGSERESDLNQLKNRCQSLNIDTKSLNW

SEQ ID NO: 3558 - protein, 287 aa, Triticum aestivum
  misc_feature (214)..(214): Xaa can be any naturally occurring amino acid
HYRTSLYKKAGWYRSGIPGISSTHASGEDWFHEDHIGLDFLAWQIPRDEEGEPLYEEFICHQCSPVCYFLKLYPDTIWASSKQSSASEAVTADSNGMEGGSSGHADTEKNENGAPVDRQSIENTSVEENCTKDIAASDKSILGDNSGVNCKIGVDINTTSADSEKTMPFFMSKGWRETLCKCGTCTNFYAQRGIAHLTDKEDSIEEYEKIAKPXDKREKKLEQQEGAEANFINSLNHVQKIEILSGINDMKNEFQSFMESFDPSKPVTSDDVKSIFENLARKKQRLS

SEQ ID NO: 3559 - protein, 164 aa, Datura ferox
FSSKLPWKETLSFRYSAQKDSSHIVEEYFQRTLGESFNHLGNTYQEYCNSMSTLSLGIMELLGMSLGVEKNHFKEFFEENESIMRLNYYPPCQKPELTLGTGPHCDPTSLTILHQDCVGGLQVFVDNEWRSISPNFNAFVVNIGDTFMALSNGRYKSCLHRAVV

SEQ ID NO: 3560 - protein, 428 aa, Yersinia pseudotuberculosis
MVRFESTDSLMLARQLPNKTVALILAGGRGSRLKDLTATRAKPAVHFGGKFRIIDFALSNCLNSGVRRIGVITQYQSHTLVQHIQRGWSFLNEEMNEFVDLLPAQQRLSTEQWYKGTADAVCQNLDIIRRYDAEYIVILAGDHIYKMDYSRMLLDHVEKGAECTVACIPVPISEGSEFGIMEVTADYQITAFYEKPANPPPIPGDPSNALASMGIYIFNADYLFKLLEEDNNTPGSSHDFGKDIIPQLTARKVVWAHPFDLSCVTSNAELPPYWRDVGTLDAYWRANLDLASVTPELDMYDRAWPIRTHMEPLPPAKFVQDRSGSHGMTMNSLVSGGCIVSGSVVVHSVLFPRVRVNSFCTIDSSLLLPDVHVGRSCRLRRCIIDRACHIPEGMVIGENANEDSARFYRSEGGVVLVTRDMLAKLEAK

SEQ ID NO: 3561 - protein, 442 aa, Chlamydophila caviae
MIENDFQGYSPSYQASHFYRDKVGVIVLCGGEGKRLSPLTYWRCKPTVSFGGRYKLIDVPISHAIASGFSKIFVIGQYLTYTLQQHLVKTYFYHGVLQDRIHLLAPEGREGSQVWYQGTADAIRQNLLYLEDTEIEYFLVLSGDQLYNMDFRKVVDYAIAMQSDMVIVAQPIQEKDASRMGVLQIDKDANLVDFYEKPQEEEILNRFRLSSEDCRKHKLDPQYGNFLGNMGIYLFRRESLFQLLLEEQGDDFGKHLIQAQKQRGSIKTFLYDGYWTDIGTIESYYEANIALTQRPKPQVRGLNCYDDAGMIYSKNHHLPGTIVTDSMISSSLLCEGAVIDSSNVSHSVVGIRGVIGKNSIIDHSIVMGNDRYGNPQQNALGIGDNCEIYKTIIDENCRIGNGVKLTNIQGHKDYNSPDGKLVVRDGIIIIPRGTRIPDNYTF

SEQ ID NO: 3562 - protein, 662 aa, Yersinia pseudotuberculosis
MAVLTHGSPTPSGAYFDGKGINFTLFSAHAEQVTLCLFDEQGQERQIAMPARTGDIWHGYLPGGKPGQRYGYRVSGPFDPSRGHRFNPHKLLIDPRTRALEGKVGDDPRFTGGVSQPDVRDSAAALPKCLVIHEEYDWQGDKPPAIPWGNTVIYEAHVRGLTQLHPDIPPELRGTYAALAHPALIEHLKTLGITTLELLPVQFHIDEPRLQKMGLSNYWGYNVLAPFAVDPDYASGREGISPLRELRDAVKALHNAGIEVILDVVFNHSAELDVFGPTLCQRGIDNASYYWLTPDGEYDNITGCGNALRLSHPYVTQWVIDCLNYWRDSCHVDGFRFDLGTVLGRTPAFDQHAPLFAALAADERLSACKLIAEPWDIGLGGYQLGNFPTGFSEWNDQYRDAMRGFWLRGEVPRGTFAQHFAASSRLFEQRGRLPSASINQITAHDGFTLLDLLCFNQKHNQMNGEENRDGSDNNHSNNFGCEGLVADAAIWQRRKACQRALLTTLLLSQGTPMLLAGDEQGHSQQGNNNAYCQNNILTWLDWGSADRALMTFTADLIRLRQQIPALTQDQWWQSGDSNVQWLDSQGQALSDAAWEQGCQQQLQILLSQRWLVLINATDHECEMHLPEGEWEGIPPFGVSDHAERLTTWRGSAHTICVLIKRD

SEQ ID NO: 3563 - protein, 624 aa, Gossypium hirsutum
MATTGVQNQEKVPMNLKQQLALAVRNIQWSYGIFWSISAKQPGVLEWGDGYYNGDIKTRKTVQSFEPKADDQLGLQRSEQLRELFESLSAGETSPHTKRPSVALSPEDLTATEWYYLVCMSFVFNIDQGLPGRTLSIGQPIWLCNAQYADSKVFSRSLVAKSASIQTVVCFPYAGGVIELGVTDLVSKDPGLIHRVKSLLLDAPETITGNINDVACPGLGPNEIESELSPFLGCEQLERGSPNEISDGFEPNQPAEDPFVNGGASQVQSWQFMDDHHSLNTSDCISQTFSDHEDVVPLCQGENDNDNDFRDVEECDRINRAAFDPISDDMHYRTVVSVLLKSSHQFILGPHFGNSNKESGFISWKMNSSVKYRKAKVEIPQKLLKKMLFEVPRMHDKGLLKSPQGGDGVGDAVWRPEADELCKSHVLSERRRREKINERLMILKSLVPTNSKADKVSILDDTIEYLQDLERRVEELECCRELTESETKTKQKHHRDRAERTSSNKVTNGNKSASSNKRKAYDIEETKQDIDHVASKDGSTENLTVSTNNKDLTIEFKCRWRDGILFEIMDALSVLDLDCHSVQSSTIEGILSVTIKSKYKGSSVAKPGTIKQALLQKVQSLTFV

SEQ ID NO: 3564 - protein, 313 aa, Adenostoma fasciculatum
GGLGDVLGGLPPAMAANGHRVMTVSPRYDQYKDAWDTEVNIELKVGDRTETVRFFHCYKRGVDRVFADHPLFLEKVWGKTASKIYGPMAGEDYKDNQLRFSLLCQAALEAPRVLNLNGSKYFSGPYGEEVVFIANDWHTALLPCYLKAIYKSKGLYKSAKVAFCIHNIAYQGRFAFADFSLLNLPDEFKSSFDFIDGYDKPVKGRKINWMKAGILESDKVLTVSPYYAKELVSAVDKGVELDNFIRKVGILGIVNGMDVQEWNPLTDKYTTVKYDATTVTDAKPLLKEDLQAEVGLPVDRDIPVIGFIGRLEE

SEQ ID NO: 3565 - protein, 117 aa, Triticum aestivum
  misc_feature (53)..(53): Xaa can be any naturally occurring amino acid
  misc_feature (70)..(70): Xaa can be any naturally occurring amino acid
RKELRAKDRPCHPCLGSNLVSRDCKQGAEILSYPTAIGSEPQDMNLDSREHWXANLVSLVASHRIGRELXETEHGKGTIKFYGNFVIAGPTEEIIKLANDENEEVLAAKFDLDEGHS

SEQ ID NO: 3566 - protein, 338 aa, Solanum tuberosum
MAFLSSLVVSLLLVGLLIQITGAQPIGVCYGKIANNLPSDQDVIKLYNANNIKKMRIYYPHTNVFNALKGSNIEIILDVPNQDLEALANPSNANGWVQDNIRNHFPDVKFKYIAVGNEVDPGRESGKYARFVGPAMENIYNALSSAGLQNQIKVSTSTYSGLLTNTYPPRDSIFREEYKSFINPIIGFLARHNLPLLANIYPYFGHIDNTNAVPLSYALFNQQRRNDTGYQNLFDALVDSMYFATEKLGGQNIEIIVSESGWPSEGHPAATLKNARTYYTNLINHVKRGAGTPKKPGKTIETYLFAMFDENEKKGEASEKHFGLFNPDQRPKYQLNFN

SEQ ID NO: 3567 - protein, 620 aa, Gossypium hirsutum
MSTGVQHQERVPMNLKKQLALAVRNIQWSYAIFWSISTRQPGVLEWGEGYYNGDIKTRKTVQSVELNTDQLSLQRSEQLRQLYESLSAGESSPQAKRPSAALSPEDLTDTEWYYLVCMSFVFNIGQGLPGRTLSSGQPVWLCNAHCADSKVFGRSLLAKSASIQTAVCFPFSGGVVELGVTDLVFEDLSLIQRVKTLLLDDPQPIVSKRSIQVDGMNNDLACPALDPLILATKLSPILGCEQLETVSPDDSPDGLEPKQSREDSLLIEGINGGASQVQSWQFMDEEFSNCVHHSLNSSDCISQTIADHRKVVPLCRGENDNGLQDVEECNQTKLTSFDRQNDDRHFHEVLSALFKSSHPLILGPQFRNSNKESSFIRWQKNGLKPQKERDETPQKLLKKILFLVPHMHDRGLIESPETNAVRDAAWRPEADEICGNHVLSERKRREKINERLMMLKSLVPANNKADKVSILDVTIEYLQTLERRVAELESCRKSEARTKIERTSDNNGKKSSLSKRKAYDVVDEADQEIGYVASKDGSTDKVTLSMNNKELLIEFKCPWREGILLEVMDALSILNLDCHSVQSSTTEGILSLTIKSKYKGSSVAKAGPIEQALQRIASKC

SEQ ID NO: 3568 - protein, 389 aa, Mannheimia succiniciproducens
MGERAHPTLVTKIMAKQDYYETLGVQKGADEKEIKRAYKRLAMKYHPDRTNGDKAAEEKFKEVNEAYEILMDKEKRAAYDQYGHAAFEQGGFGGGAGGFGGGFGGFGGFEDIFSEMFGGGASRQRVVRGEDLRYDIEITLEEAVRGTTKDIKINTLAACDHCDGSGAEKGSKVETCPTCHGHGRVRRQQGFFMTETTCPTCQGSGKKIEKPCKHCHGDGRVHKKKNLSVKIPAGVDTGNQLRLSGEGAAGENGAPAGDLYVVIHVKDHHIFERDGSNLYCEVPISFTMAALGGEIEVPTLDGRVKLKIPAETQTGKLFRMRGKGVTSTRAGYAGDLICKIIVETPVKLNEEQKELLRKFEESLEGQSKQRPKSSSFLDGVKKFFDNLGK

SEQ ID NO: 3569 - protein, 313 aa, Aria alnifolia
GGLGDVLGGLPPAMAANGHRVMTVSPRYDQYKDAWDTGVPVEIEVGGRVETVRFFHCYKRGVDRVFVDHPSFLERVWGKTGSKIYGPSAGEDYKDNQFRFSLLCQAALEAPRVLNLNSNKYFSGPYGDEVVFIANDWHTALLPCYLKAIYKPKGIYKNAKIVFCIHNIAYQGRFPISDFSVLNLPENLKGSFDFIDGYNKPVKGRKINWMKAGIIESDRVVTVSPFYAQELVSGEDKGVELDNIIRKTGITGIVNGMDVQEWNPATDKYLDTKYDNTTVLDAKPLVKEALQAEVGLPVDRNIPVIGFIGNRIP

SEQ ID NO: 3570 - protein, 457 aa, Escherichia coli
MMEGQQHGEQLKRGLKNRHIQLIALGGAIGTGLFLGSASVIQSAGPGIILGYAIAGFIAFLIMRQLGEMVVEEPVAGSFSHFAYKYWGSFAGFASGWNYWVLYVLVAMAELTAVGKYIQFWYPEIPTWVSAAVFFVVINAINLTNVTVFGEMEFWFAIIKVIAVVAMIIFGGWLLFSGNGGPQASVSNLWDQGGFLPHGFTGLVMMMAIIMFSFGGLELVGITAAEADNPEQSIPKATNQVIYRILIFYIGSLAVLLSLMPWTRVTADTSPFVLIFHELGDTFVANALNIVVLTAALSVYNSCVYCNSRMLFGLAQQGNAPKALASVDKRGVPVNTILVSALVTALCVLINYLAPESAFGLLMALVVSALVINWAMISLAHMKFRRAKQEQGVVTRFPALLYPLGNWICLLFMAVVLVIMLMTPGMAISVYLIPVWLVVLGIGYLFKEKTAKAVKAH

SEQ ID NO: 3571 - protein, 313 aa, Aria alnifolia
GGLGDVLGGLPPAMAANGHRVMMISPRYDQYKDAWDTGVTVGLKVGDQTETVRFFHCYKRGVDRVFVDHPLFLEKVWGKTASKVYGPVAGVDFKDNQLRFSLLCQAALEAPRVLNLNSSKYFSGPYGEEVVFIANDWHTALLPCYLKAVYKPRGIYSTAKVAFCIHNIAYQGRFAFADFALLNLPDGFKSSFDFIDGDEKPVKGRKINWMKAGILESDKLLTVSPYYAEELVSAVEKGVELDNIIRKIGIFGIVNGMDVQEWNPLTDKHTTIKYDASSVADAKPLLKETLQAEVGLPVDRDIPVIGFIGRLEE

SEQ ID NO: 3572 - protein, 309 aa, Gossypium hirsutum
MGRSPCCEKVGLKKGPWTPEEDQKLLAYIEQHGHGSWRALPLKAGLQRCGKSCRLRWINYLRPDIKRGKFSLQEEQTIIQLHALLGNRWSAIATHLPKRTDNEIKNYWNTHLKKRLTKMGIDPVTHKPKTDALGSTTGNPIDAANLSHMAQWESARLEAEARLVRESKLVPSNPPQSNHFTAVAPSPTPATRPQCLDVLKAWQGVVCGLFTFNMDNNNLQSPTSTLNFMENTTTLPMSSSSSVNGMFNENFGWNSSINPCESGDILKVEYGSDQIPELKERLDHPMELHEMDCSSEGTWFQELFGFNGL

SEQ ID NO: 3573 - protein, 313 aa, Aria alnifolia
GGLGDVLGGLPPAMAANGHRVMTVCPRYDQYKDAWDTSVLVEIEVGGRVETVRFFHCYKRGADRVFVDHPLFLEKVWGKTGSKIYGPRTGVDYMDNQFRFSLLCQAALEAPRVLNLNSNKYFSGPYGDDVVFIANDWHAALLPCYLKTIYKPKGIYKNAKVVFCIHNIAYQGRFAFSDFSLLDLPDNLKGSFDFIDGHDKPVKGRKINWMKAGIIESDRVVTVSPYYAQELVSGEDKGVELDNIIRKTSITGIVNGMDVQEWNPATDKYLDIKYDNTTVLDAKPLLKEALQAEVGLPVDRNIPVFGFIGRLEE

SEQ ID NO: 3574 - protein, 140 aa, Glycine max
  misc_feature (22)..(22): Xaa can be any naturally occurring amino acid
  misc_feature (43)..(43): Xaa can be any naturally occurring amino acid
  misc_feature (56)..(56): Xaa can be any naturally occurring amino acid
  misc_feature (61)..(61): Xaa can be any naturally occurring amino acid
  misc_feature (97)..(97): Xaa can be any naturally occurring amino acid
QQRDVAHTVGPAHHECICTVSXGIGAIEHVLYHSVTYEVTTIXASSPRFLMSRKTXSLGVXWVIFAEGLDQIFGGYMYLYEAPHKALFHQMTIGMVXALAKHDCLRDNRSTSAWGLEARVPMLVKQCVRVAMIFGPEYNM

SEQ ID NO: 3575 - protein, 322 aa, Exiguobacterium sibiricum
MSLKRIAILTSGGDAPGMNAAVRAVTRKAIFHGLEVFGVYNGYQGLINGDLVQLNLGSVGDIIQRGGTFLRSARCPEFRTEEGRAKAVVNLKKFEIDALVVVGGDGSYRGAQKLTGLGFPTIGLPGTIDNDIPGTDYTIGFDTALNTALEAIDKIRDTASSHERTYVIEVMGRDAGDIALYAGLAGGAESILVPERPEDLKEVLNRIQSGVNRGKKHSIVIVAEGAGRAQDVGDEIAKETGLDTRVTVLGHVQRGGAPTAADRVLASRMGAYAIDILLEGKQGRVVGVRGGKMVDLDIDEALDENKHELDLEILELSKQLSI

SEQ ID NO: 3576 - protein, 227 aa, Bacillus halodurans
MTSKSKGGRAMSLVEIFRFRNERIKILHLTWIAFFISFFTWFNMAPLATTMMESMDWLTREHIAALAIINVALTIPARLIIGMLLDRFGPRIVYSSLLVLMAIPAFMFAFGDTWTQLMISRLLLSSIGASFVVGIRMVAEWFPPKDVGFAEGIYGGWGNFGSAVAAMVLPWFAITMFGGPEGWRYAMAFTGVVCLIYGVIYYLFVRDTPEGKTFVRAKRTGAMEVSS

SEQ ID NO: 3577 - protein, 174 aa, Spiroplasma citri
MQTDKLELYLSEYKIQDKIKDYAEKINKLYAGKKLYCIGLLNGALFFMSDLLKQLKIQIVIDTMNISSYIGIQSTNKITIHKDISKDITGQDVLLIEDLIDTGKTLSVVIEQIQAKKPNSLRVVCLADKVAMHSNFNYPYDALFTVPNEFIVGYGFDYNDQFRQLPNVYIWRGE

SEQ ID NO: 3578 - protein, 241 aa, Arabidopsis thaliana
MATKQEALAIDFISQHLLTDFVSMETDHPSLFTNQLHNFHSETGPRTITNQSPKPNSTLNQRKPPLPNLSVSRTVSTKTEKEEEERHYRGVRRRPWGKYAAEIRDPNKKGCRIWLGTYDTAVEAGRAYDQAAFQLRGRKAILNFPLDVRVTSETCSGEGVIGLGKRKRDKGSPPEEEKAARVKVEEEESNTSETTEAEVEPVVPLTPSSWMGFWDVGAGDGIFSIPPLSPTSPNFSVISVT

SEQ ID NO: 3579 - protein, 301 aa, Triticum aestivum
MAGAGRKVAVAAVQFACTDTVADNVAAAERLIREAHKKGANIVLIQELFEGHYFCQAQRMDFFGRAKPYKENPTIMRMQKLAKELDVVIPVSFFEEAGNAHYNSVAIIDADGTDLGLYRKSHIPDGPGYQEKFYFNPGDTGFKAFKTKYATIGVGICWDQWFPETARAMVLQGAEILFYPTAIGSEPQDMNLDSREHWKRVMQGHAGANLVPLVASNRIGKETVETEHGNSTIKFYGNSFIAGPTGEIVKLANDKDEEVLVAEFDLDEIKSTRHGWGIFRDRRPDLYKVLLTLDGKTSSSS

SEQ ID NO: 3580 - protein, 165 aa, Phelipanche nana
KWNPKMALYISAERKHRHIINLTKTARFLYEACNLVFYAVSRGKQFLIVGTNKIRADLVEQAAIKAQCHFVNKKWTGGTLTNWSITEARLQKFRNLIIEEKAGRLECLPKKDAAVVKRQLSRFQKNLGGIKYMRGLPDIVIILDQNEEYKALQECINLGIPTICL

SEQ ID NO: 3581 - protein, 400 aa, Triticum aestivum
  misc_feature (342)..(342): Xaa can be any naturally occurring amino acid
MDRVLLPVRVKEEWPPPPPEEEEELEHGGLAPRPMEGLHETGPPPFLTKTFDLVADPATDGVVSWGRAGNSFVVWDPHLFAAVLLPRFFKHSNFSSFVRQLNTYGFRKIDPDRWEFANEGFIRGQRQLLKMIKRRRPLSYLPSPQHQALGSCLEVGQFGLDEEIEVLKRDKNALLAEVVKLRQEQQSSRADMRAMEERLHHVEQKQLQMMGFLARAIQNPDFFLQLIQQQNKLKDLEDGYPTKRRRPIDVMPFLGPEGTSQSEPLESTFIFEDREFSELENLAMNIQGIRKGMEDDRGGRNQGCGEAELTDDFWEELLSEGMRDEAEILELERRRSRYVDAXAQKLGHLSKSDPKFTRIHNHLIYIPLSLIAILYIVVQIYSHRLDCIAVPTPDYVVVYI

SEQ ID NO: 3582 - protein, 112 aa, Wigglesworthia glossinidia
MNNKEIISVNDEDFEINVLKNKKPVLVDFWAQWCMPCKSMIPILKKISEKYVNKLEVFKINIEKNSIYQEKYLVKSIPSFFLFFKEKIIDKKIGIVSQKQLEIFIDENLNRL

SEQ ID NO: 3583 - protein, 528 aa, Oryza sativa
  misc_feature (393)..(393): Xaa can be any naturally occurring amino acid
METRVFLGHVFSKHHAGGSAGPTATWERPRWGVDGVVILEAVVASEAAAVVVVGVGEEGAGMEDVAVAAALAPAPATAPVFSPAAAGLTLIAAAAADPIAAVVAGAMDGVVTVPPVRTASAVEDDAVAPGRGEEGGEASAVGSPCSVTSDCSSVASADFEGVGLGFFGAAADGGAAMVFEDSAASAATVEAEARVAAGARSVFAVECVPLWGHKSICGRRPEMEDAVVAVSRFFDIPLWMLTGNSVVDGLDPMSFRLPAHFFGVYDGHGGAQVANYCRERLHAALVEELSRIEGSVSGANLGSVEFKKKWEQAFVDCFSRVDEEVGGNASRGEAVAPETVGSTAGVAVICSSHIIVANCGDSRAVLCRGKQPVPLSVDHKPNREDEYARIEAXGGKVIQWNGYRVFGVLAMSRSIGDRYLKPWIIPVPEITIVPRAKDDECLVLASDGLWDVMSNEEVCDVARKRILLWHKKNGTNPASAPRSGDSSDPAAEAAAECLSKLALQKGSKDNISVIVVDLKAHRKFKSKS

SEQ ID NO: 3584 - protein, 1433 aa, Solanum bulbocastanum
MKSLANSIFILILTLFFSHTCIINLLSVAAITSLKPGDELNHSQVLDSEGDPQDKKLWIANPNTPLLNNSGLLTIDTTGTLKITSGGKTVVNITPPLLTRSSIARLQGSGNLVLQDETQNRTLWQSFDHPTNTLFPGMKLGYNLTTKQNWTLTSWLSSYIPASGAFTLSLESIQDAFQLVIRRRGEVYWISGAWRNQSFPLLTALHDSSNRYQYNLNLVSEKDGVFFQFDAPDGSFPSLELNFNGAIVGGGEDSRVYALYNEFCYGYESQDGCVSNQLPECRKDGDKFEQKSGDFIDRSKNSNSYDNASTSLGDCMKRCWEHCSCVGFTTTSNGTGCIIWNGNGEFQVDESGNTVKKYVLVSSKSSNGKQKNWIWIVIVVAIVVPMLISGFICYSIVRRRKLQAEKRREEEYIRELTASDSFNDTNMKEKDGREVQDLKIFSFGFVLAATNNFSSENKLGEGGFGPVYKGKFPDGREVAVKRLSRTSGQGLVEFKNELILIAKVQHTNLVRVLGCCIHEDEKMLIYEYMPNKSLDFFLFDPERKKLLDWQKRYEIIEGIAQGLLYLHKYSRMRVIHRDLKASNVLLDENMNPKIADFGMARIFKQNETEAVTARVVGTYGYMAPEFAMEGAFSIKSDVFSFGILMLEIAWELWKEGCALELKDPALGDLCDTKLLLRVIHVGLLCVQEGATDRPTMSDVISMLGNESMPLPTPKQPAFFTGRNETESHSAGDPVEKKLWIANPNTPILNNSGLLTLDSTGALRITSGGKTVVNIATPLLTGSLIARLQDSGNFVVQDETRNRTLWQSFDHPTSCLLPGMKLGYNLTTRQNWTLTSWLVSSAVPAPGAFTLSLEAIQDAFQLVVSRRGEVYWTSGAWNNQGFPFLPSFRDSATTYQYNLNLVSGTDGMFFQFEATKGSFPSLELFSDGAIAAGDGSIYTRYNKFCYGYGGDDGCVSSQLPECRKDGDKFEQKRGDFIDLSGTTTSYYDNASISLGDCMQKCWEHCSCVGFTTLNSNGTGCLISNGKRDFRVDESGKAWIWIVLSIVITMLICGLICLIKTKIQKLQGEKRKKEEHIREMNAADSFNNTNLKEEDVREVQDLKIFGFGLIMAATNNFSSDNKLGEGGFGPVYKGQFPDGREVAIKRLSRTSGQGLAEFKNELILIAKVQHRNLVRVLGCCIHGDEKMLIYEYMPNKSLDFFLFDPERKKLLDWQKRFEIIEGIAQGLLYLHKYSRMRVIHRDLKASNVLLDENMNPKIADFGLARIFKQNETEAVTRRVVGTYGYMAPEFAMEGAFSIKSDVFSFGVLMLEILSGRRNASLQQFNRPLNLIGYAWELWKEGCGLELKDPDLEDLYDTEQFLRVIHVGLLCVQEGATDRPTMSDVISMLCNGSMSLPIAKQPAFFTGRDEIESYSSSNKTEQCSINDCSITVIEAR

SEQ ID NO: 3585 - protein, 182 aa, Ralstonia solanacearum
MLSAEQARELWANSEEIVSEAAVHASLDRMAAEITEKIGDTFPMVLSVMGGACVFTGMLLPKLAFPLEFDYIHLSRYNNKTVGGEMQWRVAPRESVKDRTVLVLDDILDEGETMAAIRSRIIDMGAAEFYSAVLCEKTLAKDKPLHPDFCGFPVPDRYVFGCGMDAKGYWRNLPAIRALRNS

SEQ ID NO: 3586 - protein, 165 aa, Orobanche ramosa
KWNPKMAPYISAERKHRHIINLTKTARFLYEACNLVFYAASRGKQLLIVGTNKIRADLVEQAAIKAQCHFVNKKWTGGTLTNWSITEARLQKFRNLIIEQKAGRFNCLPKKDAAVVKRQLSRFQKNLGGIKYMRGLPDIVIILDQNEEYKALQECINLGIPTICL

SEQ ID NO: 3587 - protein, 165 aa, Orobanche ramosa
KWNPKMAPYISAERKHRHIINLTKTARFLYEACNLVFDAASRGKQLLIVGTNKIRADLVEQAAIKAQCHFVNKKWTGGTLTNWSITEARLQKFRNLIIEQKAGRFNCLPKKDAAVVKRQLSRFQKNLGGIKYMRGLPDIVIILDQNEEYKALQECINLGIPTICL

SEQ ID NO: 3588 - protein, 270 aa, Oryza sativa
  misc_feature (196)..(196): Xaa can be any naturally occurring amino acid
MAEAVASGAAGRWTLRGKTALVTGGTRGIGHAVVDELAALGAAVHTCSRKEAELGERLREWEGKGFRVTGSVCDVSVREQRERMLREVAGLYGGKLDILVNNVGTNFSKQTTEYSADDYSFIMATNLESAYHLCQLAHPLLKSSGSGSVVFISSVSGVVAVSSGSVYAMTKGAMNQLAKNLACEWAKDNIRTNSVXAPWYMKTSLVEDELARKDFADSVVRRTALKRVGEPEEVSSLVAFLCMPGASYITGQTISVDGGMTINGLYPTQD

SEQ ID NO: 3589 - protein, 181 aa, Zea mays
LVPPPPPETPEKKAASTTELPAPSGWTKKVAPTRGGRFEVIFVSPTGDTPRRSARLSEKVKATESPEGEKTPKRGRSSSKRGKKEEKEDTEAANEAGEDGASEEGKGTDVEMKDAENAEDEKKEVPNADAAEKTEEGEDKKEEAPAVDAAEKTEEGEDKREEEAPAVDAAEKTGEKEVAPA

SEQ ID NO: 3590 - protein, 242 aa, Vibrio fischeri
MATVSMRDMLKAGVHFGHQTRYWNPKMKPFIFGARNKVHIINLEQTVPMFNEALAELAKIGSKKGKVLFVGTKRAASEAVKEAAINSDQFYVNNRWLGGMLTNYKTVRQSIKRLKDFEVQSQDGTFEKLTKKEALMRTRDMEKLEKSLGGIKNMNGLPDALFVIDADHEHIAIKEANNLGIPVFAVVDTNSNPDGVDYIIPGNDDAIRAIQLYLNAAADAVKSGRNQDVAAVAEKDGFVEAE

SEQ ID NO: 3591 - protein, 137 aa, Cucumis sativus
MQFQAALSIASPSCSLLPPTAKSMAFSIPTRSMPRQSKGTLKAKASAVGQDPSTVDYSSMSSVFPAEACDTVGGEACDVEMYPEVKLKPEAKKGNSVTEPVEREYLQYDSPKTVFPAEACDDLGGEFCDPEYQKGVY

SEQ ID NO: 3592 - protein, 374 aa, Ralstonia solanacearum
MALRSLIADARRLVVKVGSSLVTDDGRGLDQAAIARWAAQIAALRAAGKEVVLVSSGAIAEGMQRLGWTRRPKEIHELQAAAAVGQMGLAQVYESEFARHGIRTAQVLLTHGDLADRERYLNARSTLLTLLGLGVVPIINENDTVVTDEIKFGDNDTLGALVTNLIEGDALIILTDQRGLYTADPRKHPDARFVDEAQAGAPELEAMAGGAGSSIGKGGMLTKIVAAKRAAKSGAHTVIASGREADVLARLAGGEAIGTQLRAPTGRMAARKQWMIDHLQLRGRVVLDAGAVDKLTAGGKSLLPIGVTEVQGEFARGEVISCVDTAGREVARGLTNYSAAEARLIARKASSEIEAVLGYVSAAELVHRDNLVLL

SEQ ID NO: 3593 - protein, 316 aa, Arabidopsis thaliana
MWFFGSKGASGFSSRSTAEEVTHGVDGTGLTAIVTGASSGIGVETARVLALRGVHVVMAVRNTGAGAKVKEDIVKQVPGAKVDVMELELSSMESVRKFASEYKSAGLPLNLLINNAGIMACPFMLSKDNIELQFATNHLGHFLLTKLLLDTMKNTSRESKREGRIVNVSSEAHRYSYPEGVRFDKINDESSYSSIRAYGQSKLCNVLHANELAKQLKEDGVNITANSLHPGAIMTNLWGYFNSYLAGAVGAVAKYMVKSVPQGAATTCYVALNPQVAGVTGEYFSDSNIAKPIELVKDTELAKKLWDFSTKLTDSQ

SEQ ID NO: 3594 - protein, 306 aa, Streptomyces globisporus
MRTRRRWSAADVPDRTGTTAVVTGASSGIGLHLAQELARHGAHVVLAVRDPDRGVAAAARIQSRVPSAQLTVRRLDLSRLASVRAGAEELRDRFPRIHLLVNNAGVMWTDRARTPDGHELQFATNHLGHFALTGLLLDSLRAAPGARVVTISSYLHRLGRIDFSDLHGERRYSRYRAYNQSKLANLMFALELHHRLAESGAELASLAAHPGLTATGLGRDFPAPVRRLGSPLAPLFLQPAAAGMLPGLRAATDPGARGGEFYGPLGVTETRGAPGLVRPGGAAVDPRARRRLWEESEHLTGVRLRP

SEQ ID NO: 3595 - protein, 300 aa, Aquifex aeolicus
MKTLFLIGLGRMGSALAYRLKNRGWEIYGYSRTQTTRERAKKDLGIKVLNSYENLKNFPSPKTVWLMVPHTAVDEVLQNLKPFLNKGDTVIDGGNSYYKDSQRRYRELKEVDVNFLDVGVSGGILGKDTGFSFMIGGDEEVFKKHEKLFKDLAYEEKGYAYLGSSGAGHFAKMVHNGIEYGIMEAIAEGFELLKKSPFDYDLREVARVYSQGSVIRSFLIDLLVKAFEDFGDLEDVEGYVEDSGEGRWCVKESVELGAPIPVIAQSFYERFSSREKDLFKNKVLAVLRYEFGRHRVKKKD

SEQ ID NO: 3596 - protein, 472 aa, Staphylococcus aureus
MENTVKYRKFILPIVVGLLIWALTPFKPDAVDPTAWYMFAIFVATIIACITQPMPIGAVSIIGFTIMVLVGIVDMKTAVAGFGNNSIWLIAMAFFISRGFVKTGLGRRIALHFVKLFGKKTLGLAYSIVGVDLILAPATPSNTARAGGIMFPIIKSLSESFGSKPKDGSARKMGAFLVFTEFQGNLITAAMFLTAMAGNPLAQNLASSTSNVHITWMNWFLAALVPGLISLIVVPFIIYKIYPPTVKETPNAKSWAENELATMGKIALAEKFMIGIFVVALTLWIVGSFIHIDATLTAFIALALLLLTGVLTWQDILNETGAWNTLVWFSVLVLMADQLNKLGFIPWLSKSIATSLGGLSWPIVLVILILFYFYSHYLFASSTAHISAMYAALLGVAIAAGAPPLFSALMLGFFGNLLASTTHYSSGPAPILFSSGYVTQKRWWTMNLILGFVYFIIWIGLGSLWMKVIGIF

SEQ ID NO: 3597 - protein, 362 aa, Aspergillus oryzae
MASAARTASRAFLRSTPSVRPAVRSTRFALPTQAFRASARRGYASEAGEAKSSNTFLWAGLAVAGGAGAYFYLQGGDSVSSKNFVPTKEDYQKVYDEIARRLADETDYDDGSYGPVLVRLAWHASGTYDKETGTGGSNGATMRFAPESDHGANAGLKAARDFLEPVKAKFPWITYSDLWTLAGSCAIQELGGPAIPWRPGRQDKDVAACTPDGRLPDASKDHQHVRDIFYRMGFNDQEIVALVGAHALGRAHPDRSGFDGPWNFSPTVFTNEFFRLLIDEKWQPRKWNGPAQFTDKTTGTLMMLPADMAFVKDKAFKKHVERYARDSDAFFKDFADVYVKLLELGVPFESKPEDRIVFKTSQ

SEQ ID NO: 3598 - protein, 323 aa, Aquifex aeolicus
MAVSLMQQPDKVYDVIIIGAGPAGTTAAIYTARAGWKTLVLYRAEADGALGVTQKIENYPGVPGPLSGYELLKIMREQAKSFGAEFVRGKVIATDLNSDPKKVYTIDGREFRGKTIIVASGAMERANKFKGEEEFLGRGVSYCGVCDAAFFKDQPVAVIGDDDYAIEEAEFIARFANKVFFVVPGSKIKAPPEVIEHFEKLPNVEILLRHRPIEIVGDQVVKGIKLKDLEKKEEKLLEVNGVFIFLGGTKPSVDFLMGQVEMTEGDCIVVNEEMMTSVPGVFAAGDVLCNEVKQAVVAAAMGCKAALAVDKFLSGKKKIVPQW

SEQ ID NO: 3599 - protein, 721 aa, Thiomicrospira crunogena
MSNVPLNHAIQFDQFKLVIKNSTVSSFGNIAVATFLTYLIVDALSNTLVFFWLAYMVLVSVFRTGYGRYIRTNVSLDTFKYFQKRYFVFILLTALGWGYASFALFVENDTTLQSFLVMSIAGISSSSVSSLSPVKSYFYSFIIIVITPLFLKFATSYEVYGVAFSLILLLFLIFMIKSAKHYQEAINDSLSLNYQNVGLIKELNQAKQEADASNQLKSEFLANMSHEIRTPMNGIIGMTGLLLDTSLKKEQRDLTLTVKESAESLLAIINDILDFSKIEAGKMELNYESVKLVPFLDGVMEMVASSAQSKGLNLAYFIDPILPAEIETDGVRLRQVLINLLSNGIKFTDHGYVYLTVSALDSDSNRLQFKVTDTGIGISEEGQAKLFNAFSQVDGSSMRVFGGTGLGLTISKQILSLLGGHISVKSALGKGACFCFDIPYRVMDSNNCLAAFEAEIPLIWLMPNDALKPKMVDFFKELNIVVHCDTFDELLEQSDENRRPVWIDMAEVMKTGGKPFELIRALKMKHSFLTLLLTHQQANEWYQQIADLEINTRIKPVKYSHLSDWLFANQEEKILKETPVHSKFDASLSHLKLLLAEDNLVNQKLATALLKKLGITPDIANNGEEALQKLEDNLYDLVLMDCQMPIKDGYQATKELREWARPIKDVVVIALTANAMQGDEQKCYAAGMNDYITKPVSPMVLQEKLQKWAAFIQDNSLSSKG

SEQ ID NO: 3600 - protein, 313 aa, Aronia prunifolia
GGLGDVLGGLPPAMAANGHRVMTVSPRYDQYKDAWDTSVLVEIEVGGRVETVRFFHCYKRGVDRVFVDHPLFLEKVWGKTGSKIYGPRTGVDYMDNQFRYSLLCQAALEAPRVLNLNSNKYFSGPYGDDVVFIANDWHTALLPCYLKTIYKPKGIYKNAKVVFCIHNIAYQGRFPFSDFSLLDCPTTLKGSFDFIDGHDKPVKGRKINWMKAGIIESDRAVTVSPYYAQELVSGEDKGVELDNIIRKTGITGIVNGMDVQEWNPATDKYLDIKYDNTTVLDAKPLLKEALQAEVGLPVDRNVPVFGFIGRLEE

SEQ ID NO: 3601 - protein, 1221 aa, Yersinia pestis
MKRMLINATQQEELRVALVDGQRLYDLDIESPGHEQKKANIYKGKITRIEPSLEAAFVDYGAERHGFLPLKEISREYFPNNYSSHGRPNIKDVLREGQEVIVQVDKEERGNKGAALTTFISLAGSYLVLMPNNPRAGGISRRIEGDDRTELKEALSSLQLPDGMGLIVRTAGVGKSADALQWDLSFRLKHWDAIKKAAEGRPAPFLIHQESNVIVRAFRDYLRPDIGEILIDNPKVLELAKEHIAALGRPDFSSKIKLYSGEIPLFSHYQIESQIESAFQREVRLPSGGSIVIDTTEALTAIDINSARATRGGDIEETAFNTNLEAADEIARQLRLRDLGGLIVIDFIDMTPVRHQREVENRLRDAVRQDRARIQIGRISRFGLLEMSRQRLSPSLGESSHHVCPRCSGTGTVRDNESLSLSILRLIEEEALKENTHEVHAIVPVQIASYLLNEKRESVNAIEKRQGGVRAVIVPNDQMQTPHYSVLRVRKGEEVPSLSYLLPQLHEAEMAQPLEEATIERKRPEQPALATFSLPTEVPPEEAPTVAKAKPAVATPAAVSTDVEQPGFFSRLFSGLKNMFGASAEAEVQPAEVVKTDTSENRRNDRRNPRRQNNGRKERNDRTPREGRDNSSRDNTNRDNTNRDNTSRDNANRDGANRDNSNRDNSGRDNVSREGREDQRRNNRRPAQPTTTSQGQTEVVEADKAQREEQPQRRGDRQRRRQDEKRQAPQEIKADVAEAPVIEEVQPEQEERQQVMQRRQRRQLNQKVRIQSANDELNTLESPVSAPVAQVVVAEVQEEVKLLPQITAQTDDDSANERTTNNENGMPRRSRRSPRHLRVSGQRRRRYRDERYPAQSAMPLAGAFASPEMASGKVWVRYPVTPVVEQVVVEQIAIEQTTTVEQTAIVEQVSVANIVTAQLPVEQVQNTVAEQESSATPSVMTTPTVAVATAAVTLAPQHKPGGSSSSAAAVPGRAPIVAAVPVVAETTAAETVVAKTEAAIDAVAVVEPMAAVESIAAVETATVEPVVTEEPNVTEPAVAEPAIETDPVEETTSVVEIAPTVEPTPMIEDTAVVVAATVVDTTPETASTVQDDIVEETAVEAVNISETVAEETAITEPAAEAIATQQTTIAQETIAEPTVETAIDVVAVVKQPAVAHPEGVVFKHFASAPMTKAPAPDYAPESPTKGHWERPTFDFSGKGSAGGHAAATQATAPATKPQSVE

SEQ ID NO: 3602 - protein, 313 aa, Aronia prunifolia
GGLGDVLGGLPPAMAANGHRVMTISPRYDQYKDAWDTEVTVELKVGDKTETVRFFHCYKRGVDRVFVDHPLFLEKVWGKTASKVYGPVTGVDFKDNQLRFSLLCQAALEAPRVLNLNSSKYFSGPYGEEVVFIASDWHTALLPCYLKAVYKPRGVYSTAKVAFCIHNIAYQGRFAFADFALLNLPDEFKSSFDFIDGSEKPVKGRKINWMKAGILESDKLLTVSPYYAEELVSAVEKGGELGDIIRKTGIFGIVNGMDVQEWNPLTDKYTTIKYDASTVADAKPLLKETLQAQVGLPVDRDIPVIGFIGRLEE

SEQ ID NO: 3603 - protein, 192 aa, Carboxydothermus hydrogenoformans
MRRAEVQRTTLETMINVEFTMDGNGEFSGTSGLGFFDHMLTLFCKFGGFNLNLSCQGDLEVDDHHTVEDIGLVLGEAFSKALGDKKGIARFASGFYPMDEALMLIAVDISGRPYLAFEADFPPVLAGKFNYQMVEEFLRGFVQKAGITLHVREISGKNLHHKAEAIFKGLGRTLKVAVSVQGDELPSTKGVI

SEQ ID NO: 3604 - protein, 389 aa, Glycine max
MVLFVIEQMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGC

SEQ ID NO: 3605 - protein, 313 aa, Cercocarpus betuloides
GGLGDVLGGLPPAMAANGHRVMTISPRYDQYKDAWDTEVIVELKVGDKTEKVRFFHCYKRGVDRVFVDHPLFLEKVWGKTASKIYGPITGEDYQDNQLRFSLLCQAALEAPRVLNLTSNKYFSGPYGEDVVFIANDWHTALLPCYLKANYKPKGIYKSAKVAFCIHNIAYQGRFAFADFAFLNLPDGFKSSFDFIDGYEKPVKGRKLNWMKAGILESDKVLTVSPYYAKELASTVEKGVELDNIIRKTGIQGIVNGMDVQEWNPLTDKYTTVKYDASTVVDAKPLLKEALQAEVGLPVDKTVPVIGFIGRLEE

SEQ ID NO: 3606 - protein, 497 aa, Unknown
  Malus x domestica
MAMRLSLSIFISLFVILGSSISSSVQVLAAGNPNYREALAKSVLFFQGQRSGRLPAGAAQQITWRSNSGLSDGRQAYVDLTGGYYDAGDNVKFNFPMAFTTTMLSWGALEYGKRMGPQLPETRAAIRWATDYLIKCARQTPGRLYVGVGDPNVDHKCWERPEDMDTTRTVYSVSPSNPGSDVAGETAAALAAASLVFRRVDPKYSKLLLNTARNVMQFAIQYRGAYSDSLGSAVCPFYCSYSGYNDELLWGAAWLFRATNELYYYNFIKSLGASDSTDIFSWDNKFAGAYVLLSRRALLNNDKNFEPYKQEAEQFMCRILPNSPSSSTQYTQGGLIYKLPGSNLQYVTSITFLLTTYSKYMAARKLTFDCGNLVVTPMALRNLAKQQVDYILGVNPLKMSYMVGYGPYYPKRIHHRGSSLPSLTSHRQSIGCDGGFQPFFYSLNPNPNILVGAVVGGPNQNDGFPDDRGDYSHSEPATYINGAIVGPLAFFAGSYRS

SEQ ID NO: 3607 - protein, 313 aa, Chaenomeles speciosa
GGLGDVLGGLPRAMAANGHRVMTVCPRYDQYKDAWDTSVLVEIKVGGRIETVRFFHCYKRGVDRVFVDHPSFLEKVWGKTGSKIYGPKTGEDYMDNQFRFSLLCQAALEAPRVLNLNSNEYFSGPYGDDVVFIANDWHTALLPCYLKTIYKPKGIHKNAKVVFCIHNIAYQGRFPFSDFSLLDLPDNLKGSFDFIDGYNIPVKGRKINWMKAGILESDRVVTVSPYYAQELVSGEDKGVELDNVIRSTGITGIVNGMDVQEWNPATDNYLNIKYDNTTVLDAKPLLKEALQAEVGLPVDRNIPVFGFIGRLEE

SEQ ID NO: 3608 - protein, 298 aa, Picea glauca
MAMLSGGLQKEEEMAKIDKACEEWGFFQVVNHGVPHSLMDDITRMGKEFFRLPAEEKEKYAIRDFQGYGQIFVVSEEQKRDWGDLLGLIISPPQSRNLSVWPSVPSEFRQIVEAYNMEIRSLAVKILSLIAENLHLKPDYFEQSFGNTYQKMRMNYYPACPRPDLVLGLSPHADGSGITLLLQDEKVEGLHVRKDDIWVAVQPIPYALVINIGNLLEVITNGRYKSIQHRAVTNKHKSRLSIDVFYSPGFDAEIGPAPELIDESHPCLFRKFIHEDHIKYYMSRKVDGKTSFYEYAGV

SEQ ID NO: 3609 - protein, 755 aa, Oryza sativa
MASVDPSRSFVRDVKRVIIKIIRSGALLGLFCGLLDVTAYVEVANLSTLVGTAVVSRQDGRLALGRVGALCEQVPNQRKVAMQVKELNSLGYEVILVTSGAVGVGRQRLRYRKLVNSSFADLQKPQMELDGKACAAVGQSGLMALYDMLFNQLDVSSSQLLVTDSDFENPKFREQLTETVESLLDLKVIPIFNENDAISTRKAPYEDSSGIFWDNDSLAGLLALELKADLLILLSDVDGLYSGPPSEPSSKIIHTYIKEKHQQEITFGDKSRVGRGGMTAKVKAAVLASNSGTPVVITSGFENRSILKVLHGEKIGTLFHKNANLWESSKDVSAREMAVAARDCSRRLQNLSSEERKKILLDVADALEANEDLIRSENEADVAAAQVAGYEKPLVARLTIKPGKIASLAKSIRTLANMEDPINQILKKTEVADDLVLEKTSCPLGVLLIVFESRPDALVQIASLAIRSGNGLLLKGGKEAIRSNTILHKVITDAIPRNVGEKLIGLVTTRDEIADLLKLDDVIDLVIPRGSNKLVSQIKASTKIPVLGHADGICHVYIDKSADMDMAKHIVMDAKIDYPAACNAMETLLVHKDLMKSPGLDDILVALKTEGVNIYGGPIAHKALGFPKAVSFHHEYSSMACTVEFVDDVQSAIDHIHRYGSAHTDCIVTTDDKVAETFLRRVDSAAVFHNASTRFSDGARFGLGAEVGISTGRIHARGPVGVEGLLTTRWILRGRGQVVNGDKDVVYTHKSLPLQ

SEQ ID NO: 3610 - protein, 367 aa, Zea mays
MEMENGHAKYRVAVIGSGNWGSVASRLIASNTAKLPSFYDEVRMWVFEEILPTGRKLSESINEQNENCKYLPGIKLGTNVIADPDLESAVKDANMLVFVTPHQFVEGICKKLVGKLTPGAEAISLIKGMEVKMEGPCMISKLIADTLGINCCVLMGANIANEIAVEEFSEATIGYRKDKEVANRWAKLFTTPYFLVSVAEDIEGVELCGTLKNIVAIAAGLVDGLDMGNNTKAAIMRIGLREMRAFSKLLFPSVRDNTFFESCGVADLITTCLGGRNRRVAEAFARNGGKRSFDELEAEMLRGQKLQGVSTAREVYEVLTYRGWQELFPLLSTVHEICIGQLPPTSIVEYSEHTPNLSIIGGHTPFY

SEQ ID NO: 3611 - protein, 725 aa, Xanthomonas oryzae
MSPLNAGVPAHPRLSMRRPASAAYANPSRIRQGRPFPRGAVFDGKGTNFALFSAHATRVEVCLFDEQGNETRVDLPEYTNEIWHGYLPDTKPGQRYGYRVHGPYAPTEGHRFNHNKLLLDPYARELEGDLIWADELYGYTVGHPDGDLSFDERDSAPFMPKCVVVEDIYDWGDDTRLLKPWNEMVIYETHVRGYTMGNPQVPEAVRGTFAGLAQPQVLQYIKDLGITAVELLPVHAYLDDQHLLDKGLRNYWGYNTIGFFALKSRYLASGHRDEFRDMVKAMHKQGLEVILDVVYNHTAEGSELGPTLSFKGIDNASYYRLAEDKRYYINDTGTGNTLNLSNSRVIQFVNDSLRYWAGEMHVDGFRFDLATILGREPSGFDQRGGFLDACNQDPLLSEVKLIAEPWDCGPGGYQVGHFPPGWSEWNDKFRDNAREFWKGEDGKLAEFATRFTGSADLFDRRGRRPWASVNFITAHDGFTLRDLVSYNEKHNIDNGEDNRDGSSNDGSCNYGEEGETDNAEILQIRERQMKNLLATLLLSQGAPMMLSGDERGQTQGGNNNTYCQDNAITWLDWENDPTDGRLTDFVKALTKLRKRYPILSRGRFLNGQYNEEAGVRDLTWLNPGGIEMDDAHWTDASARSVGLLLEGKAQTSGVKELANDDTLLIVINAYHEGVSFTLPSSDEPVHWKLVLSTDEALEVDMMPAAASEFLAPPRSVSVFECKSDQ

(The sequence listing continues in the following parts.)

What is claimed is:

1. A method for manufacturing transgenic seeds that can be used to produce a crop of transgenic plants with an enhanced trait resulting from expression of a DNA segment in a plant cell nucleus comprising a stably integrated recombinant DNA construct comprising a promoter that is functional in a plant cell and that is operably linked to a DNA segment encoding a protein comprising an amino acid sequence having at least 90% amino acid sequence identity to SEQ ID NO: 373, or a homolog of SEQ ID NO:373 thereof, wherein said method comprises:

(a) screening a population of plants for said enhanced trait and said recombinant DNA construct, wherein said enhanced trait is increased yield;

(b) selecting from said population one or more plants that exhibit said trait at a level greater than the level that said trait is exhibited in control plants; and (c) collecting seeds from the selected plant.

2. The method of claim 1, wherein said method further comprises:

(a) verifying that said recombinant DNA construct is stably integrated in said selected plants; and (b) analyzing tissue of said selected plant to determine the expression of the protein.

3. The method of claim 2 wherein said seed is corn, soybean, cotton, alfalfa, canola wheat or rice seed.

4. The method of claim 1 wherein the selected plant is a herbicide tolerant corn plant.

5. The method of claim 2 wherein said transgenic plant cell is homozygous for said recombinant DNA construct.

6. The method of claim 2 wherein the transgenic plant cell further comprises DNA expressing a protein that provides tolerance from exposure to an herbicide applied at levels that are lethal to a wild type of said plant cell.

7. The method of claim 4 wherein said herbicide is a glyphosate, dicamba, or glufosinate compound.

8. The method of claim 1 wherein the protein has SEQ ID NO: 373.

9. The method of claim 3 wherein the yield is determined by measuring the number of kernels.

10. The method of claim 1 wherein the homolog has SEQ ID NO:29625.

* * * * *